United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 10

SEQ ID NO: 27700 - DNA, 201 bp, Homo sapiens
acagagtttccgggggcggatgggtaattttcaggctgtgaaccttggtgggggtcgagcttccccttcattgcggcgggctgcgggccaggcttcactgrgcgtccgcagagcccgggcccgagccgcgtgtggaagggctgaggctcgcctgtccccgccccccggggcgggccgggggcggggtcccggcggggcgga

SEQ ID NO: 27701 - DNA, 201 bp, Homo sapiens
caccacagggaagctgggtgaatggagcgagcagcgtcttcgagagtgaggacgtgtgtgtctgtgtgggtgagtgagtgtgtgcgtgtggggttgagggygttggagcggggagaaggccaggggtcactccaggattccaatagatctgtgtgtccctctccccacccgtccctgtccggctctccgccttcccctgcc

SEQ ID NO: 27702 - DNA, 201 bp, Homo sapiens
gtgtgtgctcaggggatgctgggaaccaggcctgggtagttggtgtggggtgctgtctgtcttggccctatgtgaaaccaagagggcgtatattagtgctkgggtgggggctctgcctaacttcagggctggatgaggggagtctcagttccccaggggtccttgggaaagataagggacttgacattttagggtttttag

SEQ ID NO: 27703 - DNA, 201 bp, Homo sapiens
ggcaagactttgtggggatttcctagacagggccaaggcacccccagctcaccccgaggctgcgttagggaagtccttggagtgtctcccctcccccagcratgttcttgtggcttgtgtgtgctcaggggatgctgggaaccaggcctgggtagttggtgtggggtgctgtctgtcttggccctatgtgaaaccaagagg

SEQ ID NO: 27704 - DNA, 201 bp, Homo sapiens
atacctttaatcctccaccagtcatggtgacaaccccaagcagcccacacattttcaagtgcccccaggatgcgtggagggaggggtctgtgcccattctmctgacattagcctgtgagctccgtaagcccgggcctcgtttacgtacctttgtgagccccgggcatctgtacctctttcctttgcccatactggggacca

SEQ ID NO: 27705 - DNA, 201 bp, Homo sapiens
ggccacacagtgagtggcagagccaggaatgtgacttgggtccatttgaatccaaagtccctgtactttccactgccctacctagatgtccctgtacctcstataaaatcagcatggagcctggtgcctggtagtccctacaaatattcacaaattggagcttagctcagctctcaggcaaggcccaggtcaaaagggcag

SEQ ID NO: 27706 - DNA, 201 bp, Homo sapiens
tgttttggggtcagacttggaggaatagcagagattggagtgtcagaaggtgagcatgcctgggggtgttggggagatgcaattcatcagggacagcttaktgtcaggggattagactggggcccatgaaggagaggcagaggctgatgggcctaggggtggtgtgggtaggtgagcttccccagacagtgactctgccct

SEQ ID NO: 27707 - DNA, 201 bp, Homo sapiens
cttcccgctatgtgacctttggcattttacttcaatgtgcctcagtttctacatctgtaaaatgggcacaatagtagtatacttcatagcattgttataakgattaaacaagttatatatgaaaagattaaaacagtgttgctccataataaatgctgtttttactgtgattattattgttgttatccctatcattatcat

SEQ ID NO: 27708 - DNA, 201 bp, Homo sapiens
gaggaatagcagagattggagtgtcagaaggtgagcatgcctgggggtgttggggagatgcaattcatcagggacagcttagtgtcaggggattagactgsggcccatgaaggagaggcagaggctgatgggcctaggggtggtgtgggtaggtgagcttccccagacagtgactctgccctgccctctctccagctaggt

SEQ ID NO: 27709 - DNA, 201 bp, Homo sapiens
ggctcagagcctccatcctgccccaagatgtctacagcttgtgctcctggggtgctagaggcgcacaaggaggaaagttagtggcttcccttccatatccygttcatcagcctagagcatggagcccaggtgaggaggcctgcctgggagggggccctgagccaggaaataaacatttactaactgtacaaagaccttgtc

SEQ ID NO: 27710 - DNA, 201 bp, Homo sapiens
gctgactaggtaagctccctggagcgttttggttaaattgagggaaattgctgcattcccattctcagtccatgcctccacagaggctatgccagctgtakgccagaccctggcacgatctgggtggataatcagactgactggcctcagagccccaactttgttccctggggcagcctggaaatagccaggtcagaaacc

SEQ ID NO: 27711 - DNA, 201 bp, Homo sapiens
ggaaggggaagagctagaacccagggagcagtgagtcagaggaaagggcccactaggcacaggtgcctatggtgcaaggctgggcttgagtctcccaggayaagagggggccgggatctgacaaagattttcaaaggctgcgtttgcctttggggagttagtctctctatgagggaagtgcaagtactgctcccagggagc

SEQ ID NO: 27712 - DNA, 201 bp, Homo sapiens
gggacacactgtggcccctgtgcccagccctgggctctctgtacatgaagcaactccagtcccaaatatgtagctgtttgggaggtcagaaatagggggtmcaggagcaaactccccccaccccctttccaaagcccattccctctttagccagagccggggtgtgcagacggcagtcactagggggcgctcggccaccac

SEQ ID NO: 27713 - DNA, 201 bp, Homo sapiens
actaattggcaccaacgggtagatttggtggtggcattgctggtccagggttggggtgaatgggggtgccgacttggcctggaggattaagggaggggacbctggcttggctgggcaccgattttctctcacccactgggcactggtggcgggcccatgttggcacaggtgcctgctcacccaactggtttccattgctct

SEQ ID NO: 27714 - DNA, 201 bp, Homo sapiens
aagaaagagccatcgagtgcttgctgcccagacacgcctgtgtgcgcccgcgcatgcctccccagagaccacctgcctcctgacacttcctccgggaagcrgccctgtgtggctttgctttggtcgttcccccatccctgcccaccttaccacttcttttactccccccaccgcccccgctctctctctgtctctgttttt

SEQ ID NO: 27715 - DNA, 201 bp, Homo sapiens
cttgggctgatagaagccttggcccctggcctggtgggagctctgggcagctggcctacagacgttccttagtgctggcgggtaggtttgaatcatcacgmaggccctggcctccacccgcccccaccagccccctggcctcagttccctggcaacatctggggttgggggggcagcaggaacaagggcctctgtctgccc

SEQ ID NO: 27716 - DNA, 201 bp, Homo sapiens; identical to SEQ ID NO: 4711

SEQ ID NO: 27717 - DNA, 201 bp, Homo sapiens
cacctcctgcaggaagcccttccagatgcccattctagccagtctggctctttgcttccataccttcacaacacttgtgcctcccccagggcctctttctcatcttgctttctggggcagctgtgtgcacatttgtctgtgtgcagcaactctctaaggcagggatttttactcctatttttgatgaggggagctgtggct

SEQ ID NO: 27718 - DNA, 201 bp, Homo sapiens
acaatgaaggggggaggtgggccatactttctcgccctaatgaaggtagctcaaaaacccctaggccaggttgtaatcctagccttatataaaaggaattstgtgccctcactcccctggatccctgggcaaagccccagagggaaacacaaacaggttgttgtaacacaccttgctgggtaccaccatggaggacagttg

SEQ ID NO: 27719 - DNA, 201 bp, Homo sapiens
ctgtgtgggctgctctctgcttcactgccccttcccccaatctgctaggtgaccctgggcccctttgtgccctctctgggccttcggaggattctttgggkagacagtctgctctgacgccccttcccctgcagcaagcagcctggggagggaggtgaggataagtgaagtcaagttgttcagggggctaagcccatggaa

SEQ ID NO: 27720 - DNA, 201 bp, Homo sapiens
ctacaaatattcacaaattggagcttagctcagctctcaggcaaggcccaggtcaaaagggcagatacagctttgggaccttagttgccaccacatgccayaccttcttcccagcagaaggactccctccaagacagggtaggggtggaggatgtgaacaggggcagaaatgggcatgttttggggtcagacttggaggaa

SEQ ID NO: 27721 - DNA, 201 bp, Homo sapiens
gctctcctcccctcactcctggggcaagcaacagtggtgttccatgtgtgagctggacctaccactagtgttggcttgtttaaattctctgacagagacaractgtcccggggggcggggaaggcagtgtggagctcaccccctgagggagcagcattgtctctgtgggctttggctgggaatgtttctgaagacgcccta

SEQ ID NO: 27722 - DNA, 201 bp, Homo sapiens
tgaaggatgcgggtgaggttccccgcctccacctcccatgggacttggggattcattccaaggggaagctttttgggggaattcctaccccaggtcttttkaccctcagttaccaaccccttgcccaggccagaccttcctgctatcccctcctgggccacaagcctggccctcctctgtcccaattgtgatgaaggggca

SEQ ID NO: 27723 - DNA, 201 bp, Homo sapiens
ttggcattttacttcaatgtgcctcagtttctacatctgtaaaatgggcacaatagtagtatacttcatagcattgttataatgattaaacaagttatatrtgaaaagattaaaacagtgttgctccataataaatgctgtttttactgtgattattattgttgttatccctatcattatcatcaccatcttaacccttcc

SEQ ID NO: 27724 - DNA, 201 bp, Homo sapiens
ctctgggaggcagaggtgggccgatcacttgaggtcaggagttcgagaccagcctgggcaacatggtgaaacaccatctctactaaaaacacaaaaattarccaggtgtggtggcaggcacctgcagtcccagctactccggaggctgaggcaggagaattgctcgaacctgggaggcaggggttgcagtgagccgacatg

SEQ ID NO: 27725 - DNA, 201 bp, Homo sapiens
  misc_feature (1)...(201): n = A,T,C or G, or insertion/deletion polymorphism (see Tables 1-2)
aaattgagggaaattgctgcattcccattctcagtccatgcctccacagaggctatgccagctgtaggccagaccctggcacgatctgggtggataatcanactgactggcctcagagccccaactttgttccctggggcagcctggaaatagccaggtcagaaaccagctaggaatttttccaagctgcttcctatatgc

SEQ ID NO: 27726 - DNA, 201 bp, Homo sapiens
tgagggaaattgctgcattcccattctcagtccatgcctccacagaggctatgccagctgtaggccagaccctggcacgatctgggtggataatcagactgactggcctcagagccccaactttgttccctggggcagcctggaaatagccaggtcagaaaccagctaggaatttttccaagctgcttcctatatgcaaga

SEQ ID NO: 27727 - DNA, 201 bp, Homo sapiens
tccttccaccctttggtgctttctcctaagggggacagacttgccctctctggtcccttctccccctcctttcttccctgtgacagacatcctgaggtgtkttctcttgggcttggcaggcatggagagctctggttctcttgaaggggacaggctacagcctgccccccttcctgtttccccaaatgactgctctgccat

SEQ ID NO: 27728 - DNA, 201 bp, Homo sapiens
ccttccaccctttggtgctttctcctaagggggacagacttgccctctctggtcccttctccccctcctttcttccctgtgacagacatcctgaggtgtgytctcttgggcttggcaggcatggagagctctggttctcttgaaggggacaggctacagcctgccccccttcctgtttccccaaatgactgctctgccatg

SEQ ID NO: 27729 - DNA, 201 bp, Homo sapiens
agggaaattgctgcattcccattctcagtccatgcctccacagaggctatgccagctgtaggccagaccctggcacgatctgggtggataatcagactgaytggcctcagagccccaactttgttccctggggcagcctggaaatagccaggtcagaaaccagctaggaatttttccaagctgcttcctatatgcaagaat

SEQ ID NO: 27730 - DNA, 201 bp, Homo sapiens
ggcaacagtatgggaggcagagaggccggtagaggctgttgtggtcttccaggaggaattgtgctggtggtggggaagcacctttggtgactggcagtgcmggccattgcaaggtctcagcctcaggcagcttttggtctagtaagtgctcctttcccaatcactgaccacgtgccgacccctacattggttaacactgaa

SEQ ID NO: 27731 - DNA, 201 bp, Homo sapiens
acacttcctccgggaagcggccctgtgtggctttgctttggtcgttcccccatccctgcccaccttaccacttcttttactccccccaccgcccccgctckctctctgtctctgtttttttattttccagaaaatcagttcgaggaaagggaaaggggcaaaaacgaaagcgcaagaaatcccggtataagtcctggagcg

SEQ ID NO: 27732 - DNA, 201 bp, Homo sapiens
gggaaattgctgcattcccattctcagtccatgcctccacagaggctatgccagctgtaggccagaccctggcacgatctgggtggataatcagactgactggcctcagagccccaactttgttccctggggcagcctggaaatagccaggtcagaaaccagctaggaatttttccaagctgcttcctatatgcaagaatg

SEQ ID NO: 27733 - DNA, 201 bp, Homo sapiens
tcctgacacttcctccgggaagcggccctgtgtggctttgctttggtcgttcccccatccctgcccaccttaccacttcttttactccccccaccgccccygctctctctctgtctctgtttttttattttccagaaaatcagttcgaggaaagggaaaggggcaaaaacgaaagcgcaagaaatcccggtataagtcctg

SEQ ID NO: 27734 - DNA, 201 bp, Homo sapiens
tcagagccccaactttgttccctggggcagcctggaaatagccaggtcagaaaccagctaggaatttttccaagctgcttcctatatgcaagaatgggatggggcctttgggagcacttagggaagatgtggagagttggaggaaaagggggcttggaggtaagggaggggactgggggaaggataggggagaagctgtga

SEQ ID NO: 27735 - DNA, 201 bp, Homo sapiens
ggcggctggcatcagcaagagcttgcagggaaagagagactgagagagagcacctgtgccctgccctttcccccacaccatcttgtctgcctccagtgctrtgcggacattgaagcccccaccaggcctcaaccccttgcctcttccctcagctcccagcttccagagcgaggggatgcggaaaccttccttccacccttt

SEQ ID NO: 27736 - DNA, 201 bp, Homo sapiens
agcctgagactctcccttctccaaggagctgcccatcctgctcccggccctgaaaggcctttagagagcctgctggcccactctcctccctcccacaagamctgaaaggctgacgggtggatccatacaaaacttggtgattctggatcaatttcgtgtgttaggatcattgtggtggccagtgtgcaaacatggctgtca

SEQ ID NO: 27737 - DNA, 201 bp, Homo sapiens
tgtctccctcctcagactggggctctgagggcaaggggtctggctgttcgtttaggatggggcagttttgcctacacactgaaggagctgtagcatccaasaatactagatacctttaatcctccaccagtcatggtgacaaccccaagcagcccacacattttcaagtgcccccaggatgcgtggagggaggggtctgtg

SEQ ID NO: 27738 - DNA, 201 bp, Homo sapiens
ctcagactgaggctccctcaggccagggctatgtctccctcctcagactggggctctgagggcaaggggtctggctgttcgtttaggatggggcagttttrcctacacactgaaggagctgtagcatccaagaatactagatacctttaatcctccaccagtcatggtgacaaccccaagcagcccacacattttcaagtg

SEQ ID NO: 27739 - DNA, 201 bp, Homo sapiens
tccctgagggtagggctgtgtctctcccctccgacctgggctccctgatagggctgtctccccgctcagactgaggctccctcaggccagggctatgtctscctcctcagactggggctctgagggcaaggggtctggctgttcgtttaggatggggcagttttgcctacacactgaaggagctgtagcatccaagaatac

SEQ ID NO: 27740 - DNA, 201 bp, Homo sapiens
gaagaaagagccatcgagtgcttgctgcccagacacgcctgtgtgcgcccgcgcatgcctccccagagaccacctgcctcctgacacttcctccgggaagyggccctgtgtggctttgctttggtcgttcccccatccctgcccaccttaccacttcttttactccccccaccgcccccgctctctctctgtctctgtttt

SEQ ID NO: 27741 - DNA, 201 bp, Homo sapiens
tgaggagaagaaagagccatcgagtgcttgctgcccagacacgcctgtgtgcgcccgcgcatgcctccccagagaccacctgcctcctgacacttcctccrggaagcggccctgtgtggctttgctttggtcgttcccccatccctgcccaccttaccacttcttttactccccccaccgcccccgctctctctctgtctc

SEQ ID NO: 27742 - DNA, 201 bp, Homo sapiens
aagggctggcagaagcctttccttttgggtgctgtcaggtccgcatgtcttggcgtgttgaccttcacagcttctggcgaggggaggaatgatctgatgcrggtggggagggttagaggaggcctcaggcctaaggtggtgcagggggccccctaggggctgggcagtgccaaggcataaaagccttccctggtccctggt

SEQ ID NO: 27743 - DNA, 201 bp, Homo sapiens
cgtgaggagaagaaagagccatcgagtgcttgctgcccagacacgcctgtgtgcgcccgcgcatgcctccccagagaccacctgcctcctgacacttcctscgggaagcggccctgtgtggctttgctttggtcgttcccccatccctgcccaccttaccacttcttttactccccccaccgcccccgctctctctctgtc

SEQ ID NO: 27744 - DNA, 201 bp, Homo sapiens
ccgttctcagctccacaaacttggtgccaaattcttctcccctgggaagcatccctggacacttcccaaaggaccccagtcactccagcctgttggctgcygctcactttgatgtctgcaggccagatgagggctccagatggcacattgtcagagggacacactgtggcccctgtgcccagccctgggctctctgtacat

SEQ ID NO: 27745 - DNA, 201 bp, Homo sapiens
tgatctgtgccagggttaagcatgctgtactttttggcccccgtccagcttcccgctatgtgacctttggcattttacttcaatgtgcctcagtttctacrtctgtaaaatgggcacaatagtagtatacttcatagcattgttataatgattaaacaagttatatatgaaaagattaaaacagtgttgctccataataaa

SEQ ID NO: 27746 - DNA, 201 bp, Homo sapiens
gctgcagggtgcctgatctgtgccagggttaagcatgctgtactttttggcccccgtccagcttcccgctatgtgacctttggcattttacttcaatgtgyctcagtttctacatctgtaaaatgggcacaatagtagtatacttcatagcattgttataatgattaaacaagttatatatgaaaagattaaaacagtgtt

SEQ ID NO: 27747 - DNA, 201 bp, Homo sapiens
gacgagggcctggagtgtgtgcccactgaggagtccaacatcaccatgcaggtgggcatctttgggaagtggggcaagggggggatagggaggggggtaasactttgggaacaggtggtcccaggtcgtttcctggctagatttgccttgtctggctcctgcccctgagttgcacaggggaggtatggtggggtcttgcct

SEQ ID NO: 27748 - DNA, 201 bp, Homo sapiens
tcttcctgcggcaggtgtcctagccagtgctgcctctttccgccgctctctctgtcttttgctgtagcgctcggatccttccagggcctgggggctgaccrgctgggtgggggtgcagctgcggacatgttagggggtgttgcatggtgattttttttctctctctctgctgatgctctagcttagatgtctttccttttg

SEQ ID NO: 27749 - DNA, 201 bp, Homo sapiens
ttccctgagggtagggctgtgtctctcccctccgacctgggctccctgatagggctgtctccccgctcagactgaggctccctcaggccagggctatgtcwccctcctcagactggggctctgagggcaaggggtctggctgttcgtttaggatggggcagttttgcctacacactgaaggagctgtagcatccaagaata

SEQ ID NO: 27750 - DNA, 201 bp, Homo sapiens
ctgcactctctgcccgtctgtgcccgcctcttcctgcggcaggtgtcctagccagtgctgcctctttccgccgctctctctgtcttttgctgtagcgctcvgatccttccagggcctgggggctgaccggctgggtgggggtgcagctgcggacatgttagggggtgttgcatggtgattttttttctctctctctgctga

SEQ ID NO: 27751 - DNA, 201 bp, Homo sapiens
attttagctccaacatatctagaatatcacttcaggatctaatcaatggaaacattattaatgagtttttttttttttttttttttttttttttttttttkagatggagtcttgctctgtcacccaggctggaatgcagtggtgcaatcttagctcactgcaagctctgcctcctgggttcaagtgattctcctgcctgaa

SEQ ID NO: 27752 - DNA, 201 bp, Homo sapiens
tacgtgccaggtggagcacccaggcctggatcagcccctcattgtgatctggggtatgtgactgatgagagccaggagctgagaaaatctattgggggttragaggagtgcctgaggaggtaattatggcagtgagatgaggatctgctctttgttagggggtgggctgagggtggcaatcaaaggctttaacttgctttt

SEQ ID NO: 27753 - DNA, 201 bp, Homo sapiens
aaataaaggaaaggcatcctagacctctggttaaaatgaagatggcacttggcgagatgtgttccagggtagttcacatgatgtatgttttcagagaattrtcatattgcatatgctgctatattttttattttcatgaattaaaaggcatgttgagatttcagagttttacttatgatctcagactctgcattttttctc

SEQ ID NO: 27754 - DNA, 201 bp, Homo sapiens
tgactacagcctcaatgtcccaggcttaagtgatcttcccaacctcctgagtggctgggaccacaagtgtgtgccaccacacctgactaattttatttttyaattgttttgtgaagacagcatctccctatgtttcccaggctggtcttgaattcctgggctcaagccatcctcctgcctcggcctcccaaagtgctggga

SEQ ID NO: 27755 - DNA, 201 bp, Homo sapiens
gtgaggaccccagtcattggttggaggactcaccctattccactataatctcttcttaaccagtgaactcaccgtattccagataaggtcaggttcacagstactgagggttaggacagagtatcttttggggagatgcaattcatcccataagtgggtggaaaaggatgattaacaagtggtatgtggggatgtattgtt

SEQ ID NO: 27756 - DNA, 201 bp, Homo sapiens
ctggggtggaggtctctagggtgggaggctcctgagagaggcctacctcgggcctttccccactcttggcaattgttcttttgcctggaaaattaagtatrtgttagttttgaacgtttgaactgaacaattctcttttcggctaggctttattgatttgcaatgtgctgtgtaattaagaggcctctctacaaagtactg

SEQ ID NO: 27757 - DNA, 201 bp, Homo sapiens
ttgtttacaagtgtaaatgagtcccagccatgtgttgcactgttcaagccccaagggagagagcagggaaacaagtctttaccctttgatattttgcattytagtgggagagatgacaataagcaaatgagcagaaagatatacaacatcaggaaatcatgggtgttgtgagaagcagagaagtcagggcaagtcactctg

SEQ ID NO: 27758 - DNA, 201 bp, Homo sapiens
atctgactttcccaggagtaatttttgtcatttccagcttaccagcctttgtgagtgttgaatttcagcatttctgtttgcttgcagcagaaggtggagcmaggatagggtggctcaagattagagtttcttccttaacagttcagtcaactttttaatcttggatttatagcttcctacctgctctcttaaaggtgaaat

SEQ ID NO: 27759 - DNA, 201 bp, Homo sapiens; identical to SEQ ID NO: 4761

SEQ ID NO: 27760 - DNA, 201 bp, Homo sapiens
gatacatctcagacaccactacattcagtagtttagatgcctagaataaatagagaaggaaggagatggctcttctcttgtctcattgtgtttcttctgartgagcttgaatcacatgaaggggaacagcagaaaacaaccaactgatcctcagctgtcatgtttcctttaaaagtccctgaaggaaggtcctggaatgtg

SEQ ID NO: 27761 - DNA, 201 bp, Homo sapiens; identical to SEQ ID NO: 4811

SEQ ID NO: 27762 - DNA, 201 bp, Homo sapiens
acttgtaccccatgaatatatataatcttaagaaaatttttttagccaattattattacttactagatattaggctgtgttctgaatcttaatttaattcytccaaagaatcttatgaggtaggtaggagctattgctgctattctgttatgcttatgttgctgttatgaaaccaaggcacagagaggttagttaacttgc

SEQ ID NO: 27763 - DNA, 201 bp, Homo sapiens
caggggaataagtaccaatattcgtataactttcagtgcaagtcacgttagctaactgtagtctattgagttaaatatccttgatttattccttaaaactragtcactatgacggcacttttttgtttttttttttcgagacggagctcgccctgtctcccaggctggagtgcggtggtgcgatctcggctcactgcaatc

SEQ ID NO: 27764 - DNA, 201 bp, Homo sapiens
aggttcacactctctgcactacctcttcatgggtgcctcagagcaggaccttggtctttccttgtttgaagctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 27765 - DNA, 201 bp, Homo sapiens; identical to SEQ ID NO: 4767

SEQ ID NO: 27766 - DNA, 201 bp, Homo sapiens; identical to SEQ ID NO: 4815

SEQ ID NO: 27767 - DNA, 201 bp, Homo sapiens; identical to SEQ ID NO: 4818

SEQ ID NO: 27768 - DNA, 201 bp, Homo sapiens; identical to SEQ ID NO: 4819

SEQ ID NO: 27769 - DNA, 201 bp, Homo sapiens
gggacctaccagggctggataaccttggctgtaccccctggggaagagcagagatatacgtgccaggtggagcacccaggcctggatcagcccctcattgygatctggggtatgtgactgatgagagccaggagctgagaaaatctattgggggttgagaggagtgcctgaggaggtaattatggcagtgagatgaggatc

SEQ ID NO: 27770 - DNA, 201 bp, Homo sapiens
accactccatggcttccacaatgtgattggtcatttcttttttgtttatatgacaagtttttattcttcttctgcctgttaaatgcgcctgacccccagtrttctgattttcactatttttcttaaaaaaaaaagtttaaatgaaaaaagtttcttatgaaaatattaaaacatatacaaaaatagaatagacattgataa

SEQ ID NO: 27771 - DNA, 201 bp, Homo sapiens
gcctgttgctctgtctccaggttcacactctctgcactacctcttcatgggtgcctcagagcaggaccttggtctttccttgtttgaagctttgggctacrtggatgaccagctgttcgtgttctatgatcatgagagtcgccgtgtggagccccgaactccatgggtttccagtagaatttcaagccagatgtggctgca

SEQ ID NO: 27772 - DNA, 201 bp, Homo sapiens
gcaggtgtgtggagcctcaacatcctgctcccctcctactacacatggttaaggcctgttgctctgtctccaggttcacactctctgcactacctcttcaygggtgcctcagagcaggaccttggtctttccttgtttgaagctttgggctacgtggatgaccagctgttcgtgttctatgatcatgagagtcgccgtgtg

SEQ ID NO: 27773 - DNA, 201 bp, Homo sapiens; identical to SEQ ID NO: 4776

SEQ ID NO: 27774 - DNA, 201 bp, Homo sapiens
ctcggtttttggagatgtgagtcttgccaaagctcccagctgaataaagcccttccttctttaactcagtgtctgaggggttttgtctgtagcttgtcctsctacaaaaataagtgttaaacatgagttttatattacctcataggtggaagaagacaggccaaaaaagctgttttaacaacaacaaaatgcacaaatatt

SEQ ID NO: 27775 - DNA, 201 bp, Homo sapiens
gtgaggtacagcatctggcctcatgctgagatttctttcattaccagttcaaacacctttcacttttcaaggcacaaggagaggaattccatgtgttgacrctgggaggaagggtacagacctacttaaaagattcaaaacttctatgacagtaaaagaaatgtatatcaagttccttagggctgccgtaacaaagtacta

SEQ ID NO: 27776 - DNA, 201 bp, Homo sapiens
tgaaatccacaggcagacagcctggtgttgcaccctgggtctggttaaagattgacccccgacctaaccggttatgttatctatagattccagacattgtrtggaaaaacactgtgaaaatccctgttctgttctgattactggtgcatgcagctgccagtcacatacccccacttgctcagtcgatcatgaccctctcac

SEQ ID NO: 27777 - DNA, 201 bp, Homo sapiens; identical to SEQ ID NO: 4800

SEQ ID NO: 27778 - DNA, 201 bp, Homo sapiens
ccagcttaccagcctttgtgagtgttgaatttcagcatttctgtttgcttgcagcagaaggtggagccaggatagggtggctcaagattagagtttcttcyttaacagttcagtcaactttttaatcttggatttatagcttcctacctgctctcttaaaggtgaaatgatctattcaccttcagaccatttgccctcggg

SEQ ID NO: 27779 - DNA, 201 bp, Homo sapiens; identical to SEQ ID NO: 4801

SEQ ID NO: 27780 - DNA, 201 bp, Homo sapiens
ttagagccctcaccgtctggcaccctagtcattggagtcatcagtggaattgctgtttttgtcgtcatcttgttcattggaattttgttcataatattaakgaagaggcagggttcaagtgagtaggaacaagggggaagtctcttagtacctctgccccagggcacagtgggaagaggggcagaggggatctggcatcca

SEQ ID NO: 27781 - DNA, 201 bp, Homo sapiens; identical to SEQ ID NO: 4829

SEQ ID NO: 27782 - DNA, 201 bp, Homo sapiens; identical to SEQ ID NO: 4785

SEQ ID NO: 27783 - DNA, 201 bp, Homo sapiens
gagaggaaggtgaaatggaaagcgaacgagaagccatacagattaggcgagtgagcctaatctctccctaaccataagattgagtatgcctgaattcttcscagagtggaagaatccattttaaatatatatatctacatgtacagatcctttaaatatttgttctgacattcattgtttttgagtcactgtcattgagaa

SEQ ID NO: 27784 - DNA, 201 bp, Homo sapiens
ggaagtgcaagtcaagaaaactttttgtgaaataatttaaactgaaaagaaaaagcagagatttttttctagaaaagtaaggagtggaggtaaaaaaaaamcacagcagagacacaggtatgctacggaaccaaaggtgtgccaatggtactgacagtttaattcagaaaaaaatgaatcagaaaatggatatttttaaat

SEQ ID NO: 27785 - DNA, 201 bp, Homo sapiens
tggtgcgatctcggctcactgcaatctccgcctcccaggttcaagcgattctcctgccccagcctcctgagtagctgggactacaggcacacaccaccacrcccagctaatgtttgtatttttagtagagacagggtttcatcattttggtcaggctggtcttgaactcctgacctcgtgatcagcctgcctcgacctccc

SEQ ID NO: 27786 - DNA, 201 bp, Homo sapiens
tacaggtgtgaggtacagcatctggcctcatgctgagatttctttcattaccagttcaaacacctttcacttttcaaggcacaaggagaggaattccatgygttgacactgggaggaagggtacagacctacttaaaagattcaaaacttctatgacagtaaaagaaatgtatatcaagttccttagggctgccgtaacaa

SEQ ID NO: 27787 - DNA, 201 bp, Homo sapiens
ccaaagtgctgggattacaggcgtgagctaccgcgcccagccaaatttctaacttgttttgttgttgttgagacagggtctcagtctgacaccaaggctgrtgtgcagtactgcgatcacggctcactgcagtctcgacctcctgagctcaagtgatcctcccacctcagcctactgagtagctgggaccaccacgcctgg

SEQ ID NO: 27788 - DNA, 201 bp, Homo sapiens
aagctgttatttaattagccagtgaaaaactattaacaacttgtctattacctgttagtattattgttgcattaaaaatgcatatactttaataaatgtayattgtattgtatactgcatgattttattgaagttcttgttcatcttgtgtatatacttaatcgctttgtcattttggagacatttattttgcttctaatt

SEQ ID NO: 27789 - DNA, 201 bp, Homo sapiens
cagcttcccgagtagctggaattacaggtgcatgccaccacacccagctaattttttttttttgagatgaagtcttgctcttgtctcccatgctggagtgygatggcacgatcttagctcactgcaacctacgcctcccgggttcaagcgattctcctgcctcagcctctaatgtagctgggattacagttgcctgctatc

SEQ ID NO: 27790 - DNA, 201 bp, Homo sapiens; identical to SEQ ID NO: 4760

SEQ ID NO: 27791 - DNA, 201 bp, Homo sapiens
catgccaccacacccagctaattttttttttttgagatgaagtcttgctcttgtctcccatgctggagtgtgatggcacgatcttagctcactgcaacctmcgcctcccgggttcaagcgattctcctgcctcagcctctaatgtagctgggattacagttgcctgctatcacgcccggctaatttttgtatttttagtaa

SEQ ID NO: 27792 - DNA, 201 bp, Homo sapiens
agagccaggagctgagaaaatctattgggggttgagaggagtgcctgaggaggtaattatggcagtgagatgaggatctgctctttgttagggggtgggcygagggtggcaatcaaaggctttaacttgctttttctgttttagagccctcaccgtctggcaccctagtcattggagtcatcagtggaattgctgtttttg

SEQ ID NO: 27793 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaagggtatgtggagagggggcctcaccttcctgaggttgtc

SEQ ID NO: 27794 - DNA, 201 bp, Homo sapiens
ttcaccatgttggccaggctggtctcgaacccctgatctcaggtgatctgccttcctcggccgcccaaagtgctgggattacaagcgtgagccactgagcygggccaatttttgcattttacatagatgaattatatggtatgctaattatatcttaccaaaaattgaaaaaaaggaatagtactatcagccccaatgtgc

SEQ ID NO: 27795 - DNA, 201 bp, Homo sapiens
ctgatgagagccaggagctgagaaaatctattgggggttgagaggagtgcctgaggaggtaattatggcagtgagatgaggatctgctctttgttaggggrtgggctgagggtggcaatcaaaggctttaacttgctttttctgttttagagccctcaccgtctggcaccctagtcattggagtcatcagtggaattgctg

SEQ ID NO: 27796 - DNA, 201 bp, Homo sapiens
cacttctttacagagctcaaggtgcttttatggggtttgtggggaggagttgaggtttgggctgtatctgagtgacaggatgatgttatttgattgaagtktatagctatacaatctaaaattaaactgtgcatggtcttacctataatttgttaagaaaagcctcccagggatgggggggcaaaactgtatgtaaattct

SEQ ID NO: 27797 - DNA, 201 bp, Homo sapiens
agcactttgagttttggtactacgtgtatccacattttacacatgacaagaatgaggcatggcacggcctgcttcctggcaaatttattcaatggtacackgggctttggtggcagagctcatgtctccacttcatagctatgattcttaaacatcacactgcattagaggttgaataataaaatttcatgttgagcagaa

SEQ ID NO: 27798 - DNA, 201 bp, Homo sapiens
aggagcaggcctcaatatgtttaatcattctccagataatcccaatactgtaaagtttgtgaaacacttgtcagataattcaattatgaaggctgtggaasgtgtttcagtaggatctaattggttaatgttatgacttaattaatttgaatcaaaaaacaaaatgaaaaagctttatatttctaagtcaaataagacata

SEQ ID NO: 27799 - DNA, 201 bp, Homo sapiens
gctatagtaatcaagacagtgtagtcctgacataaagataggattatagtctgggtgtggtggctcatgcctgtaatcccagcactttgggaggctgaggkgggcagatcacctgaggtcaggagttccagaccagcctgaccaacatggtgaaaccccgtctctactaaaaatacaaaaattaaccaggcatggtggcag

SEQ ID NO: 27800 - DNA, 201 bp, Homo sapiens
tatacaccagatttagatacaaagtatttttttattatttaaaaaaatcaaattctagcttttactctgaagattctaaaaagaattttggagtctttaaytcatacttcaggggcaggggaataagtaccaatattcgtataactttcagtgcaagtcacgttagctaactgtagtctattgagttaaatatccttgatt

SEQ ID NO: 27801 - DNA, 201 bp, Homo sapiens
gtaatcaagacagtgtagtcctgacataaagataggattatagtctgggtgtggtggctcatgcctgtaatcccagcactttgggaggctgaggtgggcaratcacctgaggtcaggagttccagaccagcctgaccaacatggtgaaaccccgtctctactaaaaatacaaaaattaaccaggcatggtggcaggtacct

SEQ ID NO: 27802 - DNA, 201 bp, Homo sapiens; identical to SEQ ID NO: 4782

SEQ ID NO: 27803 - DNA, 201 bp, Homo sapiens
ctggagagggactgccctgcacagctgcagcagttgctggagctggggagaggtgttttggaccaacaaggtatggtggaaacacacttctgcccctataytctagtggcagagtggaggaggttgcagggcacggaatccctggttggagtttcagaggtggctgaggctgtgtgcctctccaaattctgggaagggact

SEQ ID NO: 27804 - DNA, 201 bp, Homo sapiens
agagcacccaggactgtcatatggaagaaagacaggactgcaactcacccttcacaaaatgaggaccagacacagctgatggtatgagttgatgcaggtgygtggagcctcaacatcctgctcccctcctactacacatggttaaggcctgttgctctgtctccaggttcacactctctgcactacctcttcatgggtgcc

SEQ ID NO: 27805 - DNA, 201 bp, Homo sapiens
gatgggaggtctacacagacggagcaaccatgccaagtaggagagtataaggcatactgggagattagaaataattactgtaccttaaccctgagtttgcktagctatcactcaccaattatgcatttctaccccctgaacatctgtggtgtagggaaaagagaatcagaaagaagccagctcatacagagtccaagggtc

SEQ ID NO: 27806 - DNA, 201 bp, Homo sapiens
tttccagatgagagataatggttcttgaaatccaatagtgcccaggtctaaattgagatgggtgaatgaggaaaataaggaagagagaagaggcaagatgrtgcctaggtttgtgatgcctctttcctgggtctcttgtctccacaggaggagccatggggcactacgtcttagctgaacgtgagtgacacgcagcctgca

SEQ ID NO: 27807 - DNA, 201 bp, Homo sapiens
caaggatctgcatttggacatgttaagtttgagattccagtcaggcttccaagtggtgaggccacataggcagttcagtgtaagaattcaggaccaaggcwgggcacggtggctcacttctgtaatcccagcactttggtggctgaggcaggtagatcatttgaggtcaggagtttgagacaagcttggccaacatggtga

SEQ ID NO: 27808 - DNA, 201 bp, Homo sapiens
cagatgtggctgcagctgagtcagagtctgaaagggtgggatcacatgttcactgttgacttctggactattatggaaaatcacaaccacagcaagggtaygtggagagggggcctcaccttcctgaggttgtcagagcttttcatcttttcatgcatcttgaaggaaacagctggaagtctgaggtcttgtgggagcagg

SEQ ID NO: 27809 - DNA, 201 bp, Homo sapiens
ggctgcgggcgaactaggggcgcggcgggggtggaaaaatcgaaactagctttttctttgcgcttgggagtttgctaactttggaggacctgctcaacccwatccgcaagcccctctccctactttctgcgtccagaccccgtgagggagtgcctaccactgaactgcagataggggtccctcgccccaggacctgccccc

SEQ ID NO: 27810 - DNA, 201 bp, Homo sapiens
ggccacataggcagttcagtgtaagaattcaggaccaaggctgggcacggtggctcacttctgtaatcccagcactttggtggctgaggcaggtagatcayttgaggtcaggagtttgagacaagcttggccaacatggtgaaaccccatgtctactaaaaatacaaaaattagcctggtgtggtggcgcacgcctatagt

SEQ ID NO: 27811 - DNA, 201 bp, Homo sapiens; identical to SEQ ID NO: 4762

SEQ ID NO: 27812 - DNA, 201 bp, Homo sapiens; identical to SEQ ID NO: 4768

SEQ ID NO: 27813 - DNA, 201 bp, Homo sapiens
aaaagagaagagttaaagttgactttgttctttattttaattttattggcctgagcagtggggtaattggcaatgccatttctgagatggtgaaggcagakgaaagagcagtttggggtaaatcaaggatctgcatttggacatgttaagtttgagattccagtcaggcttccaagtggtgaggccacataggcagttcag

SEQ ID NO: 27814 - DNA, 201 bp, Homo sapiens
gtagtgagaataaaagtgagaactcccactaatgagtgagattctcaaagggggtgaataagtgaggcgaccacccctcatattgtcttatgcccaatttytgcctccaaagaaagaaaaagtaaaagctaaaaggcagaaatgaaatccacaggcagacagcctggtgttgcaccctgggtctggttaaagattgacccc

SEQ ID NO: 27815 - DNA, 201 bp, Homo sapiens
gacaaattatttctctcttaatatcttactatactgaaagcagactgctataaggcttcacttactcttctacctcataaggaatatgttacaattaattyattaggtaagcatttgttttatattggttttatttcacctgggctgagatttcaagaaacaccccagtcttcacagtaacacatttcactaacacattta

SEQ ID NO: 27816 - DNA, 201 bp, Homo sapiens
atgatattgactgggagcagtatttcccaggcaaactgagtgggcctggcaagttggattaaaaagcgggttttctcagcactactcatgtgtgtgtgtgkgggggggggggcggcgtgggggtgggaagggggactaccatctgcatgtaggatgtctagcagtatcctgtcctccctactcactaggtgctaggagcac

SEQ ID NO: 27817 - DNA, 201 bp, Homo sapiens
atattgactgggagcagtatttcccaggcaaactgagtgggcctggcaagttggattaaaaagcgggttttctcagcactactcatgtgtgtgtgtgtggsggggggggcggcgtgggggtgggaagggggactaccatctgcatgtaggatgtctagcagtatcctgtcctccctactcactaggtgctaggagcactcc

SEQ ID NO: 27818 - DNA, 201 bp, Homo sapiens
tcggctcactgcaacctctgcctcctgggttcaagcaattttcctgcctcagcctcccaagtggctgagactacaggcgcatgccaccatgcacggctaaktttttttgtatttttagtagagatggagtttcaccatgttggccaggctggtctcgaactcctgacctcaaatgatccgccctttttggcctcccaaagt

SEQ ID NO: 27819 - DNA, 201 bp, Homo sapiens
cggctcactgcaacctctgcctcctgggttcaagcaattttcctgcctcagcctcccaagtggctgagactacaggcgcatgccaccatgcacggctaagkttttttgtatttttagtagagatggagtttcaccatgttggccaggctggtctcgaactcctgacctcaaatgatccgccctttttggcctcccaaagtg

SEQ ID NO: 27820 - DNA, 201 bp, Homo sapiens
gaagtgcaagtcaagaaaactttttgtgaaataatttaaactgaaaagaaaaagcagagatttttttctagaaaagtaaggagtggaggtaaaaaaaaaacacagcagagacacaggtatgctacggaaccaaaggtgtgccaatggtactgacagtttaattcagaaaaaaatgaatcagaaaatggatatttttaaata

SEQ ID NO: 27821 - DNA, 201 bp, Homo sapiens; identical to SEQ ID NO: 4826

SEQ ID NO: 27822 - DNA, 201 bp, Homo sapiens
acatgtgaggagaacaagctgatctgactgctctccaagtgacactgtgttagagtccaatcttaggacacaaaatggtgtctctcctgtagcttgttttyttctgaaaagggtatttccttcctccaacctatagaaggaagtgaaagttccagtcttcctggcaagggtaaacagatcccctctcctcatccttcctct

SEQ ID NO: 27823 - DNA, 201 bp, Homo sapiens
tgaggaaaataaggaagagagaagaggcaagatggtgcctaggtttgtgatgcctctttcctgggtctcttgtctccacaggaggagccatggggcactaygtcttagctgaacgtgagtgacacgcagcctgcagactcactgtgggaaggagacaaaactagagactcaaagagggagtgcatttatgagctcttcatg

SEQ ID NO: 27824 - DNA, 201 bp, Homo sapiens
ctatcactcaccaattatgcatttctaccccctgaacatctgtggtgtagggaaaagagaatcagaaagaagccagctcatacagagtccaagggtctttygggatattgggttatgatcactggggtgtcattgaaggatcctaagaaaggaggaccacgatctcccttatatggtgaatgtgttgttaagaagttagat

SEQ ID NO: 27825 - DNA, 201 bp, Homo sapiens
aaatgaaagaagccagtcacggcaaagcaatatattatatgcctctatgtatactaaatgttccaaatagaaagaaagtagattaaagattgtctagggcygggaggggaggaggaggagaatggaggaatctgggaggcgatgaattaagggtactgaattaggggaacatggtttctttttggggagatagaaatgtaa

SEQ ID NO: 27826 - DNA, 201 bp, Homo sapiens
taaaatcccattgcccaggtggcatcccatactgttactgggaattatgcattgggatggatcctttaaccgaggagattattatagccggagctctgaascagcaatctcagttcttgtgatagtgagcaaagaactacaaactaacaccaaaatgcaagcttaaagcaaagtttattgaagcacaataatacactctga

SEQ ID NO: 27827 - DNA, 201 bp, Homo sapiens; identical to SEQ ID NO: 4833

SEQ ID NO: 27828 - DNA, 201 bp, Homo sapiens
ggtgacttctggagccatccccgtttccccgccccccaaaagaagcggagatttaacggggacgtgcggccagagctggggaaatgggcccgcgagccagsccggcgcttctcctcctgatgcttttgcagaccgcggtcctgcaggggcgcttgctgcgtgagtccgagggctgcgggcgaactaggggcgcggcggggg

SEQ ID NO: 27829 - DNA, 201 bp, Homo sapiens
ccacagcaggatccgcacggggtttccacctcagaacgaatgcgttgggcggtgggggcgcgaaagagtggcgttggggatctgaattcttcaccattccwcccacttttggtgagacctggggtggaggtctctagggtgggaggctcctgagagaggcctacctcgggcctttccccactcttggcaattgttcttttg

SEQ ID NO: 27830 - DNA, 201 bp, Homo sapiens
atttaaccaataatcttttgtatatttatacctgttaaaaattcagaaatgtcaaggccgggcacggtggctcacccctgtaatcccagcactttgggagkccgaggcgggtggtcacaaggtcaggagtttgagaccagcctgaccaacatggtgaaacccgtctctaaaaaaatacaaaaattagctggtcacagtcat

SEQ ID NO: 27831 - DNA, 201 bp, Homo sapiens
agtgtctatggcccttgctttttatttaaccaataatcttttgtatatttatacctgttaaaaattcagaaatgtcaaggccgggcacggtggctcacccytgtaatcccagcactttgggaggccgaggcgggtggtcacaaggtcaggagtttgagaccagcctgaccaacatggtgaaacccgtctctaaaaaaatac

SEQ ID NO: 27832 - DNA, 201 bp, Homo sapiens
aggacacaaaatggtgtctctcctgtagcttgtttttttctgaaaagggtatttccttcctccaacctatagaaggaagtgaaagttccagtcttcctggsaagggtaaacagatcccctctcctcatccttcctctttcctgtcaagtgcctcctttggtgaaggtgacacatcatgtgacctcttcagtgaccactcta

SEQ ID NO: 27833 - DNA, 201 bp, Homo sapiens
cagctattgtgggaaacagtacaaaggttcctcaaaattaaaaatagaactactggccgggcatggtggctcatgcctgtaatcccagcactttgggaggytgagacaggtggatcacatgaggccaggagttcgagaccagactgggcaacatgcagaaaccccatctcaactaaaattacaaaaattagctgggcatgg

SEQ ID NO: 27834 - DNA, 201 bp, Homo sapiens
ttaggaaacaaatacttgtttcctaaaaacatatacttgtcctgagcaaactctgtgtatctcagagtaaacaatcaatagtgtccagttgggtgaatgartttactctccagaactggttttattaatattattgatattttatttctatttatatattattgatattttatttctatttgtatattattgacattctgg

SEQ ID NO: 27835 - DNA, 201 bp, Homo sapiens
gccaaagcaggtggatcccttgagctcaggaattcaagactaacctgggcaacatggggtagaacgccatctctacaaaaaatgtaaaaattagccgggcrtggtggtgcacacctcagctattcaggaggctaaggtgggaggatcgcttgagccctggagatagaggttgcggtgagctgagatcatgccactgcactc

SEQ ID NO: 27836 - DNA, 201 bp, Homo sapiens
tctctgaaatctgtagagaagaatctttccttgtttctctctagcttcttatggtctgctagccatcattggcattccttggcttacagctgcagcacctyaatctgtctccattgtcacagagcattctcccctgtgtatctgtatcctgtgtctcttctaagtacactggtcgtactggactaagggcccagaccattc

SEQ ID NO: 27837 - DNA, 201 bp, Homo sapiens
ttgatgttgatatggcaaggaggcaggcagccagtaattaaagatatggctatttctgagataaccaatttagacttttcttttagcttcagaaaaaatgytaaaagcatggaaagaaatggaagaaaaggccatccactatgctgaggtaaaatcattgacgtcattctgtatacttattaattcttgatgtctccatta

SEQ ID NO: 27838 - DNA, 201 bp, Homo sapiens
gaaacagggtctcactctgttgcccaggttggagtgtagtggcatgatcaaagctcactgcagcctcgacttcccaggctcaagcagtcctcccatcttascctcctgtgtagctgggacaagaggtgcaccaccatgcctggctaacttttacattttttgtagagacggggtctcactatgttgtccaggcttgtatca

SEQ ID NO: 27839 - DNA, 201 bp, Homo sapiens
ggataattgcttgaattcaggaggtggaagttgtagtgagctgagagatcatgccactgcacatcagcctgcgtgacacagcaagactctgtctcaaaagaaaaaaaaaaaaaatagaactgtaagattcaacaatgtcatttcttggtatatatccaaaggattttaaagcaggcttgtgaagagatatttgcactccca

SEQ ID NO: 27840 - DNA, 201 bp, Homo sapiens
tgggagagatgggagtttttatttctgtaaccagttacaggtagaaggcctggaaattaccgccagaccaactcaaaattacaaagtttttccgtagtttrtttatcttctaagctatatgtctatgtgtaagtttgcattcatctaaagacataagtgattaacttcttttaatctgtagctgaggtctgagtcttgaag

SEQ ID NO: 27841 - DNA, 201 bp, Homo sapiens
aggatcgcttgagccctggagatagaggttgcggtgagctgagatcatgccactgcactccagcctgggtgacagagtgagactctacctcaaaaaaaaawtttttttgttgttttttcctttatccacccatctgcacactggtataaatatatatatttttaagaaaaaagtcatctgtattcatttcctaagggttcc

SEQ ID NO: 27842 - DNA, 201 bp, Homo sapiens
tgaagtagcaggatcgcttgaggcccaggaggtcgaggctgcagtgagccaagattacactactgcacttcagcctgggttgacagagcaagactttcttaaaaaaaaaaaaaaaaaaaacccagagcagaaatgaaaaacctgtgaattagcagtgacaaatagtgaacagtaatattaattttttgttgataatttagt

SEQ ID NO: 27843 - DNA, 201 bp, Homo sapiens; identical to SEQ ID NO: 4973

SEQ ID NO: 27844 - DNA, 201 bp, Homo sapiens; identical to SEQ ID NO: 4975

SEQ ID NO: 27845 - DNA, 201 bp, Homo sapiens
aaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttct

SEQ ID NO: 27846 - DNA, 201 bp, Homo sapiens
atactgtcatgttcatgcagggaaaaaggcagaaagaaatatggcatctccttaaaattgcctgtgtaagtaattattaatgaattatttaatgtgacatkgagttgctattattccttgcaaaggggatttttatcagcatgaggtgggccctcttgaagacatgtatattttgcattgggatgacatccatgttccttg

SEQ ID NO: 27847 - DNA, 201 bp, Homo sapiens
taataaatttttgagatctattttataactttgtatttctaagattagacttttttcagtgttttaaatcagttttgcaagaactcagattccaagccctrtattttattaattcctactcttttgctaaaagctgaatgactatccatttctgttattttctcagcttaagatgtgccgtatccaaagccagtggctctt

SEQ ID NO: 27848 - DNA, 201 bp, Homo sapiens
atcatctgcagccatttacctggtaagaaatggatgagaacttgggcatgcttaatgggaatggaaattttttcatttgtctttttttttctttctttaaktgtttaattgcctttgaaatatacaattaaatataattaaatggcaagaaatcttaatttgtgagaatcactttgtcaactgaggtagcttttgatttta

SEQ ID NO: 27849 - DNA, 201 bp, Homo sapiens
tccagtaatcagagttgaaggaagtaaaatttaatactttacttacttttttgcctttattaaaggcatttaagttttttagcggatgttaatgtttacaratgtcaccacaatacaggtaatttccaatttgaagtgtagttgcttgcaaaagtatatctgacagacattttcaatgtattttctagaaggaacacatta

SEQ ID NO: 27850 - DNA, 201 bp, Homo sapiens
ttgtattcatctatctcccaactatacctttttccttcccttttttatttttggcaatatgtgcccatggttttttaatttaaaacgaacagaatatgtartgacgcctaccatagcactccttcccatcacacaagccttcaaggaaactgaagtacttactttggtctccctggaggattccctccgcctcccgcccca

SEQ ID NO: 27851 - DNA, 201 bp, Homo sapiens
acttgagcatcagagtagatttgtacaaaatgtgaggtgaatttttcttttaactcaatgatttctgttacttcaaagtatattttaaactttatttaggrtctgggattcgatatttgcatgaaaacaaaattatacatcgagatctaaaacctgaaaacatagttcttcaggatgttggtggaaaggtaggtgaaacct

SEQ ID NO: 27852 - DNA, 201 bp, Homo sapiens; identical to SEQ ID NO: 4980

SEQ ID NO: 27853 - DNA, 201 bp, Homo sapiens
catgagatttgtcagccttttccagtttcaaatgctttttgcctctttttacttttatgagccttatcatgaaatttacatgccctcagtatggatttggwaattttattcccttgtattttattatgacttattttctcatttgaatattcttttagagtatagtaattaatgtgtggtcactattgcagcccagcaatt

SEQ ID NO: 27854 - DNA, 201 bp, Homo sapiens; identical to SEQ ID NO: 4979

SEQ ID NO: 27855 - DNA, 201 bp, Homo sapiens
tatcatgaaatttacatgccctcagtatggatttggtaattttattcccttgtattttattatgacttattttctcatttgaatattcttttagagtatartaattaatgtgtggtcactattgcagcccagcaatttgcagaacagatttttagatttctttctttttttagctgctcaacaaaccagaaaattgttgtg

SEQ ID NO: 27856 - DNA, 201 bp, Homo sapiens
tgaatattttgattcatgatgtgcctcttctagcaatggaatactgttctggaggagatctccgaaaggtagtgtggatgttttgagatgagagagagtamatcacaaactttagcaatgtttgaatcatgttaaatataataaactagaataagaatcggaaaaactatggtctgcttcctgttttgtaaataaagtttt

SEQ ID NO: 27857 - DNA, 201 bp, Homo sapiens
gtggaattaagagcatagaataactgtactttccttaggaataataggacttatggtaaaggtagtattgggcaacttctttaagagtgttttcctctgaratgtcctatcaccactatctacatctaaaaaacatgctcgattcttgccctataaactgatgtcacagccccaccatccccatttttgctagtggtatca

SEQ ID NO: 27858 - DNA, 201 bp, Homo sapiens
gagagtaaatcacaaactttagcaatgtttgaatcatgttaaatataataaactagaataagaatcggaaaaactatggtctgcttcctgttttgtaaatmaagttttattggaacacagccacattcatttctttacacattgtctatggctgctttcttatggctgcagaagtgagtagttttaacagagactatgtga

SEQ ID NO: 27859 - DNA, 201 bp, Homo sapiens
tttcctagtcaaccaaattttttagtcatcacatatcactgttcgtcatctattataataggcagtctctctcttgtttccctggttttagaagattttartaataaacatttattgggtacctgttacttggagggtattaagctagatggcaagatctgaaacaacataggcagtatagtaaaagtgcttatctgggag

SEQ ID NO: 27860 - DNA, 201 bp, Homo sapiens
ggtgggtggatcacctgaggtcaggagttcaaaaccagcttggccaacatggtgaaaccccatctctactaaaaatagaaaagttagctgggcatgttggyatgtgcctgtaatcccagctacttgggaggatgaggcaggagaatcgcttgaacctgggaagaggaggttgcagtgagccaagatcacaccactgcactc

SEQ ID NO: 27861 - DNA, 201 bp, Homo sapiens
gtgttatttaatcttgtaatcttatgtctaggcttcctgctaagtgagagtttaattataaattcttaaatcccctaggttttcttcctgtccccttttasatggcttagggaaagaattgtgtctactgaagtgaaatgtattcttcccctaatcagactgatttccatatgttgttccatatttattttacccattctt

SEQ ID NO: 27862 - DNA, 201 bp, Homo sapiens
ctcgtagatatgagtatactgtgtagacacatgtatgtatagcacttagcatgtctgaggaaatgcagtatgactggagtgtagagtttcaggagagagaraacctaaatataggagagagagaaaacgtaaatataggtttttttgtttgtttttaataaaaacatgttaatgggcaataggtttgttatttttaaatga

SEQ ID NO: 27863 - DNA, 201 bp, Homo sapiens
aagatgttatttgcatttttcaccatgttgacattttcattgatggtgcaacataaaatggctttcaccttagtatgaatcaaggcactagcgccaaactrtgctagtagccgttatattttttaccaccatgcagtcacagtttttaaaaaatgacagtttcacttacaaatgtccttgataaagcagtaaaaatattat

SEQ ID NO: 27864 - DNA, 201 bp, Homo sapiens
tttaaatgaattaagacacgagtatttttaaatttctgtttaattcctgaaaaaccctttggggttctcaagaattttctagtgtaaaggggtcctgagaycaaaaagtttgagaactgcttatctagactattctcagaagcttggctgctcaggaaagaagagaggtgggtgagtagctaaaagttgatgtagagtcaa

SEQ ID NO: 27865 - DNA, 201 bp, Homo sapiens
aagttgatgtagagtcaagggaggtcacttctcagaaggaagacttaaacatgaggtgccacatgatgatgttttggttaacaacaaattgtgtatactayggtagtcccataagattatactactgtatttttactatgtattttctatgtttacatgcacaaatacttaccattgtgttacagttgcctacagtattca

SEQ ID NO: 27866 - DNA, 201 bp, Homo sapiens
tagttatatgagaaagctcttggcttggtccatggtatttaggaaggaatgctgtttggagaagaacctttttggagccttgcatttgattgttggtgagraggagacaacagagatgtgtggggaataaagttgggctatgggggaagtatttggagtgatagataacaaaggacacaacgttttttaaacctcctttga

SEQ ID NO: 27867 - DNA, 201 bp, Homo sapiens
aacaggcttaggctttttaaaaaacaggccaggtggctcatgcctgtgattgcagcactttgggaggctgaggcaggcagatgacctgagatcaggagttwgagaccagcctagccaacacggtgaaaccccgtctctactaaaaatgcaaaaaattagctgggcgtggttgcatgcgcctgtaatgccagctactcggga

SEQ ID NO: 27868 - DNA, 201 bp, Homo sapiens
aatgctgtttggagaagaacctttttggagccttgcatttgattgttggtgaggaggagacaacagagatgtgtggggaataaagttgggctatgggggawgtatttggagtgatagataacaaaggacacaacgttttttaaacctcctttgatgctcatcatttcctttttggtaaaatgggggtaacaaaagtagtct

SEQ ID NO: 27869 - DNA, 201 bp, Homo sapiens
tacagtagaaaaaataatcaacaaaacgaaaaagcaacccaacccatggattgggaaaagatatttgcataccatacatccaataagaaattaatatcctraatttataagaaactcatgcaactcaataccaaaaatgtaaataacccaatttaaaaatgtgcaaaggacctgaattagacacttctcaaaagaagaaat

SEQ ID NO: 27870 - DNA, 201 bp, Homo sapiens
tgagacaaagtctcgctctgtcacccaagcaggattgcagtggcataactgtggctcactgtagcctcaacctcctgggctctagagttcctcccacctcrgcctcatgagtagctgggaccacaggcgcatgctaccatgcctggcaaacttttttgattttttatagagacaggagggtctccctgtgttgcccaggct

SEQ ID NO: 27871 - DNA, 201 bp, Homo sapiens
cagcccggtcaacatggcaaaaccccatctctactaaaaatacaaaaattagccaggtgtggtggcgggtgcctgtaatcccagctacttgggaggccgarggaggagaattgcttgaacccgggaggcggaggttgcggtaagctgagatcataccactgcactccagcctgggcgactccgtctctaaataaataaata

SEQ ID NO: 27872 - DNA, 201 bp, Homo sapiens
agagtagcaaatattattattattgcatttaggcttaattattgtccaaagaaaataccagcatgatgcataagcaactttcaactcctttagccattttstgaaatataacaattaatgatttttttttaaaatcgaggtcacattttaaactgtagaacccattgtgaccaacagccatcccatttgagggtatctggc

SEQ ID NO: 27873 - DNA, 201 bp, Homo sapiens
taataatcttttcctgttgcttatttatttatttattttgagacagggtctcactctgtcacctaggctggagtgcagtggcatgtttttggctcactgcmacctgcgcctcccaggttcaagcgattctcttgcctcagcctcccgagtagttgggactaaaggtgtgcaccaccatgcccagctaatttttgtattttt

SEQ ID NO: 27874 - DNA, 201 bp, Homo sapiens
aggcttaattattgtccaaagaaaataccagcatgatgcataagcaactttcaactcctttagccattttctgaaatataacaattaatgatttttttttwaaatcgaggtcacattttaaactgtagaacccattgtgaccaacagccatcccatttgagggtatctggctgctgccagttggctttaagatgtcatact

SEQ ID NO: 27875 - DNA, 201 bp, Homo sapiens
tacaggcatgagccaccatgtccagccagaatacattgtataagaaaattgatttcaattataatgtacctgtggtacttaactaccaaggattgggaacygtttgaccataatttttccatctgttggataagagctgaatcagaatgtcattctaagctaatagtggctatcatccatgacctaaaacggactcttgtt

SEQ ID NO: 27876 - DNA, 201 bp, Homo sapiens
cttcctacctcttttgactgggaattacgagattacagccccacctacggaaattgagcacattagcactggccatgctgtacatacagcaaatgagaggkcttcatactgttacaacaatctgtaccacaattctctgtgcggtctgcccagctctaaatgacatgtcctcagaggcatcatcatctccaagtccatgga

SEQ ID NO: 27877 - DNA, 201 bp, Homo sapiens
acatctcgcatttgtttcatacttgtcataggaatcatagcatagtttctgctctgaagggcatctgtgagcctcttgttatagggcacggggaaagagtmcacattatggagtttatagtttacagactttaattcagtttgcagcaccactatttacctatctgtgaacctgagcaaatgtctctctatctcaaggaca

SEQ ID NO: 27878 - DNA, 201 bp, Homo sapiens
ggttactataaactactgatttgttaaaacttgaggaaattaccataaaatgtctactgaatcaatttttcctgcatttagtcttaatgtcaattctgtayatttcctctttcattaagaaaaatagcagtggccaggcatggtggctcacgcctgtaatcctagcactttgggaggccaaggcaggtggattgcttgagc

SEQ ID NO: 27879 - DNA, 201 bp, Homo sapiens
atcagactgatttccatatgttgttccatatttattttacccattctttccttagttcatgccatcacttctttatctgccatctcactctccattccttytctcctgtctaaatcttgccaggcttttaaaggctcatcccagattcttcctcttctgatctatagctcttaaagtctatattgtaaattttggcccttt

SEQ ID NO: 27880 - DNA, 201 bp, Homo sapiens
tatatatgagagagagttctgaaaagacctgttataaaatcagtttcaggcacttttcccttgtatgctgttgtgtgtttgaaggtcagttttaaagcatkggtgtaatagtctcatggtttatctttttaaaaagcattgcctcaagagagctgtggataaatatatttaattagtaaagctaaaaagttttgttgtctt

SEQ ID NO: 27881 - DNA, 201 bp, Homo sapiens
gctgcggccgggcgcgggcgggccctgggagatgcgggagcggctgggcaccggcggcttcgggaacgtctgtctgtaccagcatcgggtgaggcggggcrtgagagggagcggcggtgggttggagcggcggtgggtttgagcgtctgtggaacacagggctgacagtgtgggatagatggttggtgggaccttgggcag

SEQ ID NO: 27882 - DNA, 201 bp, Homo sapiens
gtggatcacctgaggtgaggagtttgagaccagcctggccaacatggtgaaaccccgtctttactaaagctacaaaaattagctgggcgtggtgccaggcrcttgtaatcccagctactcaggaggctgaggcaggagaattgcttgagcctgggaggtggaggttgcagtgagccaagatcgctccattgcactccagcc

SEQ ID NO: 27883 - DNA, 201 bp, Homo sapiens
gaggagtttgagaccagcctggccaacatggtgaaaccccgtctttactaaagctacaaaaattagctgggcgtggtgccaggcacttgtaatcccagctrctcaggaggctgaggcaggagaattgcttgagcctgggaggtggaggttgcagtgagccaagatcgctccattgcactccagcctgggtgacagtgaaac

SEQ ID NO: 27884 - DNA, 201 bp, Homo sapiens
tttatatcttttatcttaacccaatttttaatttaaatggagatgtttattaattaaaattagtttcagagtttcagggatttttgaggaattttttgttyggaggctgatatgttacagaagaaaggttatatccactgactgatgtcttttatagatcactcctacagtgacagcacagagatggtgaaaatcattgtg

SEQ ID NO: 27885 - DNA, 201 bp, Homo sapiens
ttactcaatacaatgctctgtgaaatacttgttggcaatatgaacttgctttaaaatgggttcattattcaaataaaatattgtttcaagttgtagattaytgaagtcattaaattaccttcacttatcagagcgtgttttctcttttatagggaacagcgtgccattgatctatataagcagttaaaacacagaccttca

SEQ ID NO: 27886 - DNA, 201 bp, Homo sapiens
gaggctgaggcaggaagatcgcttgagttcaagagtttcaggctgcagtgagccgtaatcctgccattgcactccagcctgtgacagagtgagactttgtytcggggaaaaaaaaaaaaaaaaaggataatggtggccagccatatgacatgtacctgtagtccgagttactagggaggctgaggcagaaggattgcatga

SEQ ID NO: 27887 - DNA, 201 bp, Homo sapiens
gaggctgaggcagaaggattgcatgagcccaggagttcaaggctgcagtgcattatgattggacttgtgaatagccactgtactccagcttggcaacatarcaagatcctgctctcttaagaaaaaaaaaaaaaaagaaaagaaaaggaaagaataattgtttacttcaaatatttatgaaaaaaactctgaaattttttt

SEQ ID NO: 27888 - DNA, 201 bp, Homo sapiens
tacactgcaaaaggacaaataaaccgaacagctaccgtttgagagtgagcgagtgggttctctgcacaagaacaaaccaaccagtcccttgtccgaaaggscgtctccttttctctgcttcgctgctcactccagactgcgggctgtcctcttccgaagcagttaaccagcagtgtacagaaagcgacttgcctccaaagg

SEQ ID NO: 27889 - DNA, 201 bp, Homo sapiens
caagcccgggttctggtggctgcagtggtggggttggtggctgtcctgctctacgcctccatccacaagattgaggagggccatctggctgtgtactacakgtgagcggcatgtgcagtcagttagggctctagagcagattaaaagggtactccagagtggagtctgggaagttgttccctctgcaacgttcgggggcgc

SEQ ID NO: 27890 - DNA, 201 bp, Homo sapiens
tatgaccttgcaaatgtgtttatattttcaagaccggtagctaagttctatgaatttacaaggtgcaaaataggactttgttttctttgctccccaaatgyctcctttttataatttccagggcttgctttcatagttttcacattccaggatttggttaacaagcccttatgctatttatttgtatagtcttgtcaccct

SEQ ID NO: 27891 - DNA, 201 bp, Homo sapiens
tgtctttctgacagtaaaaccagagaaaggacatttcaaggaatgactcaaagaattagtaatgaacctcaaacagttcatctttccttgttattatgacyttgcaaatgtgtttatattttcaagaccggtagctaagttctatgaatttacaaggtgcaaaataggactttgttttctttgctccccaaatgcctcctt

SEQ ID NO: 27892 - DNA, 201 bp, Homo sapiens
aaatgaggctctagagcagtgcccggtagacttttcacaacgatggaaatgctcaaatatctgcactgtccaatacagttgtgactagccacttgtggccmctgagtgctgaaatgtggctaatgtgactgaggaactaaatttttgattttatttaattaattagaatttaaatttaaatagccatacctggctaatggt

SEQ ID NO: 27893 - DNA, 201 bp, Homo sapiens
gaaatgtggctaatgtgactgaggaactaaatttttgattttatttaattaattagaatttaaatttaaatagccatacctggctaatggttaccccactrgatagcaggctgtagagagcttaggtagcttgtcctagtcacacagtggtaggttcaaacccaggcctgttggacctcaaaacttgaggtcttaacctca

SEQ ID NO: 27894 - DNA, 201 bp, Homo sapiens
acctgaggtgaggagtttgagaccagcctggccaacatggtgaaaccccgtctttactaaagctacaaaaattagctgggcgtggtgccaggcacttgtartcccagctactcaggaggctgaggcaggagaattgcttgagcctgggaggtggaggttgcagtgagccaagatcgctccattgcactccagcctgggtga

SEQ ID NO: 27895 - DNA, 201 bp, Homo sapiens
caaaaccatagagggagtaacataacttaagcaaagattgaagatgggaagttgctggcaagaagatacagtttgaaggggagtggaaaatgtgtagaacrgagtatctgatgctggtgtctgtgatttgcagctgttttttctcccctagttaaaaatgggctttgagtgagccttgaacctgtcttggactaattcaga

SEQ ID NO: 27896 - DNA, 201 bp, Homo sapiens
aggtgaggagtttgagaccagcctggccaacatggtgaaaccccgtctttactaaagctacaaaaattagctgggcgtggtgccaggcacttgtaatcccrgctactcaggaggctgaggcaggagaattgcttgagcctgggaggtggaggttgcagtgagccaagatcgctccattgcactccagcctgggtgacagtg

SEQ ID NO: 27897 - DNA, 201 bp, Homo sapiens
gtgtgtgagtgtgtctgtatgtagttattctttagtcctaagagccaagatagttgttttgttgacattgggcttgtgctgctgttacgtgggcctgagtyccctagaaggagaggcagaggaattttaaatcagagtgggtatgactaggctcctgactctgcaaactcatgtctagttgaggtgacaaaactacagttt

SEQ ID NO: 27898 - DNA, 201 bp, Homo sapiens
gttgtgtagttacgatgatccatataaacttgagcatcagagtagatttgtacaaaatgtgaggtgaatttttcttttaactcaatgatttctgttacttyaaagtatattttaaactttatttagggtctgggattcgatatttgcatgaaaacaaaattatacatcgagatctaaaacctgaaaacatagttcttcagg

SEQ ID NO: 27899 - DNA, 201 bp, Homo sapiens
aggtgaagtgtagataggagtagagacaatatgaagtttagaaaagactaattgctggacgcggtggctcatgtctataatcccagcactctgggatgccraggtgggaggactacttgagaccaggagttcgggaccagcctgggcaacgtagcaagaccatgtctctacaaaaaataaaaaattagccaagcgaggtgg

SEQ ID NO: 27900 - DNA, 201 bp, Homo sapiens
tcatgaaagtggcaaagttgaacctgagaggcatatttagagggcaaagattgaggtgagggcattctagccagaagtgctagggaactttaattgagcayatactctgtgccaagaactgtaccaagaactttacacatacatgactcatttaatcttcataactctgtaaggtaggtactgtcatcccgatttaccagt

SEQ ID NO: 27901 - DNA, 201 bp, Homo sapiens
gcagtgctcaacattctggttgcagcatcacatttatcaataatttgattccatgctgattcctttacttggagtattgagatcccccaggtacagtgaargtatgaccctcttaaatggaagaccaggagttgtttcccctatgctatggcaatccgccacccggaagcacttgctgcaccaacagcattcccaaagctt

SEQ ID NO: 27902 - DNA, 201 bp, Homo sapiens
ctgggcagttctaaactcatcagtacctgggttggttacagggctttggggatcatcagggtataggccataggtgaaattaagatagggtaaatacagtsctgagctgaagatgattacctgagaaatatcagtatttaaggagtgcttgaaaatagtgatctaacatttacatagagaaggagcaaagagaatgctaca

SEQ ID NO: 27903 - DNA, 201 bp, Homo sapiens
gtgcctgattctcatttccatggtggtaaaggcctgcatgggacatagatataactggtcacctgctcataacaaaaggaagattgaagggagtgagaacygtgggtaggctagcatgcagtctatcctagtttccttcttctctatgcaccaggtatcatcttatctctagcttcttttttcctctcaccctccaattca

SEQ ID NO: 27904 - DNA, 201 bp, Homo sapiens
tttttgttttattatggtaaagtatacataacacaacatttatcactttatttttaagtgtacagttaggtggcattaagtacattgacgttgttgtacarccataaccctatctccagaatattccgacttttttgttgttgttgtacatctataaacttcccatagaatattctttgtgaaaaggtagaatttcacaga

SEQ ID NO: 27905 - DNA, 201 bp, Homo sapiens
cctagtttccttcttctctatgcaccaggtatcatcttatctctagcttcttttttcctctcaccctccaattcacactaccctatccaagctatgtcttscttccccacctataatatattttttctgtcctggcccctgggctcttctctctgtattcatacacagcctttattacaactctggtttgtgtcagagatt

SEQ ID NO: 27906 - DNA, 201 bp, Homo sapiens
aaactctgacacatgccacagcatggatgaatcttgtggacattatgctaaatgaaataagccagtcacaaaaagacaaatactgtgtcattccacttatrtgtggtacctagagtagtcaaactcacagtgaaagaaagtagaatggtgtttgccagagggtgaagggaccagcaaatagagaataatttttaataggtg

SEQ ID NO: 27907 - DNA, 201 bp, Homo sapiens
tttgattttcacttaaaaaaggaagcaacaaaacagttactgaaatatttcccttttgaaaaaatagcttagcaagtctgattgtatgcatattttccaaytgtttattatgaacatctttagatatgtagaagagttgaaagaagtgtactgaacctaccactaaaaataatgatgaaacagtagcatttaattattatt

SEQ ID NO: 27908 - DNA, 201 bp, Homo sapiens
cacttaaaaatggttaaggtggtaaattttatgctatgtgtgttttaccacaatcaaaaaactatttcatttcagttaacaaaagtcagctagggccgggygtggtggctcacacctataatcccagcactttgggaggccaaggcggatggattacctgaggtcaggagtttgagaccagcccggtcaacatggcaaaac

SEQ ID NO: 27909 - DNA, 201 bp, Homo sapiens
agatatgtagaagagttgaaagaagtgtactgaacctaccactaaaaataatgatgaaacagtagcatttaattattatttttttttgcctcctctttcaygcccctaaatgtaactatattctgagtctcttcttggttctctctttttccattacatttcctttcttttattaggcagcctcttcaactgtatagcttt

SEQ ID NO: 27910 - DNA, 201 bp, Homo sapiens
cttttccagtttcaaatgctttttgcctctttttacttttatgagccttatcatgaaatttacatgccctcagtatggatttggtaattttattcccttgyattttattatgacttattttctcatttgaatattcttttagagtatagtaattaatgtgtggtcactattgcagcccagcaatttgcagaacagattttt

SEQ ID NO: 27911 - DNA, 201 bp, Homo sapiens
acttcccaggctcaagcagtcctcccatcttagcctcctgtgtagctgggacaagaggtgcaccaccatgcctggctaacttttacattttttgtagagamggggtctcactatgttgtccaggcttgtatcaaactcctgggcttaagcaatcctcccacctcagcctcccatagagctgggattataggcatgagccac

SEQ ID NO: 27912 - DNA, 201 bp, Homo sapiens
catagtgaaaccccatctctactaaaaatacaaaaattagctgggcacaatgccgcatgcctgtagtcccagctactcgggaggctgaggcaggagaatcrcttgaacccaggagatagaggttgcagtgagccgagattgcaccactgcactccagcttggacaacagagtgagactttgtcacacacacacaaaaagaa

SEQ ID NO: 27913 - DNA, 201 bp, Homo sapiens
tgagtcctgactatccctttgtaataatcttaggcaacttacttgacttttttgatgttcatatttcctcacctgtaaaacaggaatgtctcatagaactkctgtggaaatttgattagacaatgtatataaagtgcttgggaaataaatgttcagcaaatgttgcgtattattagctcaaatgttgcttattattagcta

SEQ ID NO: 27914 - DNA, 201 bp, Homo sapiens
ttgtggctaagagtcctttttttgtctaatagatgttccaatagctgacaaaaaaatcatgtgaaatgaccttactcaatttctctccccccctaccattkacatagtaattttgtttacagtggaattacatctccttgagggatgggtcctcaagtcaactcttttttgtttgtttgttttgagacggagtctagctct

SEQ ID NO: 27915 - DNA, 201 bp, Homo sapiens
cctggccaacatggtgaaaccccgtctttactaaagctacaaaaattagctgggcgtggtgccaggcacttgtaatcccagctactcaggaggctgaggcrggagaattgcttgagcctgggaggtggaggttgcagtgagccaagatcgctccattgcactccagcctgggtgacagtgaaactccatctcaaaaataaa

SEQ ID NO: 27916 - DNA, 201 bp, Homo sapiens
ctttgatctcagcatcacaacaactgaaagctaaattggagttttttcacaaaagcattcagcttgacttggagagatacagcgagcagatgacgtatggratatgtaagtgtctgtgtaatgtatttgaaaggagcatctggtttcttgaagccatctgttattttgccttcttaactcagccagttgttttacttacct

SEQ ID NO: 27917 - DNA, 201 bp, Homo sapiens
ttgaaaagtggatttgacgggaatgtggggtttggagagatcttatgttttccaagactagaaaaacattgtggttccgttcagccctcccggaaaatacrtaggggacttaaagagcggaccgagtacctgtttgtttccccatcccttagccggcagggctctggcagcgccctgggagaacttagggaagggccttct

SEQ ID NO: 27918 - DNA, 201 bp, Homo sapiens
gttttattatggtaaagtatacataacacaacatttatcactttatttttaagtgtacagttaggtggcattaagtacattgacgttgttgtacagccatmaccctatctccagaatattccgacttttttgttgttgttgtacatctataaacttcccatagaatattctttgtgaaaaggtagaatttcacagagttga

SEQ ID NO: 27919 - DNA, 201 bp, Homo sapiens
gacaagagcaagaccctgtctgaaaaaaaaggaaagcatcttgatgccactaaactgtacacttaaaaatggttaaggtggtaaattttatgctatgtgtrttttaccacaatcaaaaaactatttcatttcagttaacaaaagtcagctagggccgggcgtggtggctcacacctataatcccagcactttgggaggcca

SEQ ID NO: 27920 - DNA, 201 bp, Homo sapiens
gctagctttccccagaaagatcttttcctcagaaagagtgagtgatctgagagagagagagagagagagagagtgaacgagcgagcaagatgaaaaccgaygtatcttttatgatctttacttggaagtgagactccatccttttccaccacattctgtttgttacagtgagtcactaagtacagcctacattcaagggga

SEQ ID NO: 27921 - DNA, 201 bp, Homo sapiens
cattcctgaagttagatctaagtatttactcacatttaatctactataaggaggtatgatgcttcttcaagtttggaagtcacccttgcctttactttccrgtttaatggattgagcttattttgaatatagtaaaataaaaattaatagcccacctgtattcaatttttaccatgtaccaagcactgtgttaccttcttt

SEQ ID NO: 27922 - DNA, 201 bp, Homo sapiens
agaaaatggacaacctgcaaaattacctttctaacagtataaagggaaattggaacataatgatttgattttcaccctattttgtatgttttctagtttartagtagaacccatggaaaactggctacagttgatgttgaattgggaccctcagcagagaggaggacctgttgaccttactttgaagcagccaagatgttt

SEQ ID NO: 27923 - DNA, 201 bp, Homo sapiens
agggtttcgctatgttgtccaggctggtctcgcactcctgacctcaggtgatctgcccgcctccacctcccaaagtgggattacaggcgtgagccattgcrtccagccctgatgcttatttgaaaaagaaaattatattcttagagctgattttttaaaaagtttatttagcaagctgtctcagtttgcttctctgtggtc

SEQ ID NO: 27924 - DNA, 201 bp, Homo sapiens
tccttgagggatgggtcctcaagtcaactcttttttgtttgtttgttttgagacggagtctagctctgttgcccaggctggagtgcagtggtgcgatctcrgcttactgtaacctctgcctcccaggttcaagcgattctcctgcctcagcctcccgagtagctgggattacaggtgcccgccatcacacctggctaattt

SEQ ID NO: 27925 - DNA, 201 bp, Homo sapiens
ttgcccaggctggagtgcagtggtgcgatctcagcttactgtaacctctgcctcccaggttcaagcgattctcctgcctcagcctcccgagtagctgggaytacaggtgcccgccatcacacctggctaatttttgtatttttaacagagacggggtttcactgtgttggccaggctggtctcaaactcctgacctcgtga

SEQ ID NO: 27926 - DNA, 201 bp, Homo sapiens
tcactgtgttggccaggctggtctcaaactcctgacctcgtgatctgcccgcctcggcctcccaaagtgctgggattacaagcgtgagccaccgcacccakccaagtcaactcttcagggtgaaaaatctctgcttaatcagaatgactccagaaaaattcctaaaataaccagtacctaaccttttggaggaacctcaaa

SEQ ID NO: 27927 - DNA, 201 bp, Homo sapiens
aacctcaaaaaccaaaaatttgtttccccatagattttggttttgcctcttttccaaggtcatgagggctaaagtccaattgaaatgagtgatttaggtgrgagaaagaggcttataagagtttcagggattttcccaattgcttgttgcatttctatttggtgttaattctaatgagttaaatgaacatatagtataatt

SEQ ID NO: 27928 - DNA, 201 bp, Homo sapiens
aaatttgtttccccatagattttggttttgcctcttttccaaggtcatgagggctaaagtccaattgaaatgagtgatttaggtgggagaaagaggcttakaagagtttcagggattttcccaattgcttgttgcatttctatttggtgttaattctaatgagttaaatgaacatatagtataattttgtagtatttgttt

SEQ ID NO: 27929 - DNA, 201 bp, Homo sapiens
gggtagcttggccatagctatctgcatttatgtgtccttttgtatgcattactttggagataagtcattaaatctgatgctgattgtggttcatttcctcmgctgggttttgggaatatggtgtacagtcttggggcatgtgaaagtgtctgacactgatttaatctctccagcaagttgttgggctgtaagcagaagatt

SEQ ID NO: 27930 - DNA, 201 bp, Homo sapiens
gaatacataatatgttaacacttattattttattcttatgaagcacatccaaaacacatacatgcacatcctgggtccactttaagaaaaaaaagaaagtrtatatatttttaaaacttattttccttcccccaatttaaatgagtcatctggagaagaaccagaaattgtgaattgactcttaaaatgttcatttcattg

SEQ ID NO: 27931 - DNA, 201 bp, Homo sapiens
ttgtgtgtgccgtctctttagttagtgaaaatagttgttggcctcttggaggtgttggaaccttggtgatgcctcttctcttaggaacctttcacgtatgyttggcaccaaatatctctgctttttttttttttaatccaaagacttcaggacattcctgaagttagatctaagtatttactcacatttaatctactataa

SEQ ID NO: 27932 - DNA, 201 bp, Homo sapiens
acttctcagaaggaagacttaaacatgaggtgccacatgatgatgttttggttaacaacaaattgtgtatactatggtagtcccataagattatactactrtatttttactatgtattttctatgtttacatgcacaaatacttaccattgtgttacagttgcctacagtattcagtacagtcacttgctgaacaggtatg

SEQ ID NO: 27933 - DNA, 201 bp, Homo sapiens
cttcaagtttggaagtcacccttgcctttactttccagtttaatggattgagcttattttgaatatagtaaaataaaaattaatagcccacctgtattcartttttaccatgtaccaagcactgtgttaccttctttactttcgttatttcattggatcctaataacaattctgtgaagcagggactgttagtcatccaat

SEQ ID NO: 27934 - DNA, 201 bp, Homo sapiens
tagtttggctagagaacgaattttgaataaatagtaaatataaatagccacttgggactagtggctaccattttggacagcacaggtctggtggaaacaasaactgccatttaactgtttgacatatgtcctaagaaggctcttaggataatgaagtaaatgggttatttgcagaatggatttggactcatccgtcagagt

SEQ ID NO: 27935 - DNA, 201 bp, Homo sapiens
agtatattttagttaaggaagtttgcctcagtttctccagagttgtaaaggagcaggagagtagttgtctgtttcaagttgcattatccagtagaactttytgtgatgatgtagaaaccttctatatttctgttggccacatgaggttattgactacttgacatgtagctagtttggctagagaacgaattttgaataaat

SEQ ID NO: 27936 - DNA, 201 bp, Homo sapiens
aggaagctcaccgagcaggggcggcccactggcctccgggggcggaggagttggcaaggggtcagcgggctcagccagaagggaagaatgaggggacaggkgtactggactccccggctcagcctgcgagagagcgccaagtttccggagggagagggtagaaactggagggggtggacctgtcactcacgggactgaggg

SEQ ID NO: 27937 - DNA, 201 bp, Homo sapiens
tagtcaatgaagaaagggtccaaggacaggttactaatggtgtgtaaaggtgggaatagttttgtactgaaatactctggttgtgcatataagtagtaacrgaaatgtaagtcttaggaatatgataagaaattgtgtgaatcaacagagatgcttgcctgtaatcttttgatgtttttttcttttccttcagacacagag

SEQ ID NO: 27938 - DNA, 201 bp, Homo sapiens
aaaggatgcatgctggcagcttttgtgacttcttttcttggtccctgggtggggatggatgaattaatcactttttgttttattatggtaaagtatacatmacacaacatttatcactttatttttaagtgtacagttaggtggcattaagtacattgacgttgttgtacagccataaccctatctccagaatattccgac

SEQ ID NO: 27939 - DNA, 201 bp, Homo sapiens
gaaacaagaactgccatttaactgtttgacatatgtcctaagaaggctcttaggataatgaagtaaatgggttatttgcagaatggatttggactcatccrtcagagttgtcagtaactaacatatgtggagttttgagtagtttttgatggaaaaaagtttgtcccctgtcatttcatgaatttgaaagtaatttatgaa

SEQ ID NO: 27940 - DNA, 201 bp, Homo sapiens
gtttgttatttttaaatgaattaagacacgagtatttttaaatttctgtttaattcctgaaaaaccctttggggttctcaagaattttctagtgtaaaggkgtcctgagaccaaaaagtttgagaactgcttatctagactattctcagaagcttggctgctcaggaaagaagagaggtgggtgagtagctaaaagttgat

SEQ ID NO: 27941 - DNA, 201 bp, Homo sapiens
gagtcatactaccagcatttctgttttcttttataaaacaaatcctttttaggaaacaaatacttgtttcctaaaaacatatacttgtcctgagcaaactmtgtgtatctcagagtaaacaatcaatagtgtccagttgggtgaatgaatttactctccagaactggttttattaatattattgatattttatttctattt

SEQ ID NO: 27942 - DNA, 201 bp, Homo sapiens
ctcatgcctgtaatcccagcactttgggaggtggaggcaggcagatcacttgaggtctggagttcgagaccagcctggccaacatggtgaaaccccatctstactaagaatacaaaaattagccagggatggtggtgcatgcctgtagtcccagctacacgggaggctgaggcagaagagttgcttgaacctgggaggtgg

SEQ ID NO: 27943 - DNA, 201 bp, Homo sapiens
gggcatgtatcaggttcttagtaaattatttattgatatgaatgagagctatagatagttctattatgcagtgtacccagaaacaactctcatcaatagtstttacatttgtattgattgtttgtagtatacaggtttctaaaattgaaatgagaaattataatcatgtaatgttggagtacatggcgagatagctcactt

SEQ ID NO: 27944 - DNA, 201 bp, Homo sapiens
ctgtaatcccagcactttgggaggtggaggcaggcagatcacttgaggtctggagttcgagaccagcctggccaacatggtgaaaccccatctctactaakaatacaaaaattagccagggatggtggtgcatgcctgtagtcccagctacacgggaggctgaggcagaagagttgcttgaacctgggaggtggaggctgc

SEQ ID NO: 27945 - DNA, 201 bp, Homo sapiens
aaaaaaggaagcaacaaaacagttactgaaatatttcccttttgaaaaaatagcttagcaagtctgattgtatgcatattttccaactgtttattatgaayatctttagatatgtagaagagttgaaagaagtgtactgaacctaccactaaaaataatgatgaaacagtagcatttaattattatttttttttgcctcct

SEQ ID NO: 27946 - DNA, 201 bp, Homo sapiens
ctttgggaggtggaggcaggcagatcacttgaggtctggagttcgagaccagcctggccaacatggtgaaaccccatctctactaagaatacaaaaattarccagggatggtggtgcatgcctgtagtcccagctacacgggaggctgaggcagaagagttgcttgaacctgggaggtggaggctgcattgaaccaagatc

SEQ ID NO: 27947 - DNA, 201 bp, Homo sapiens
caaatttatcttttgaatatcttaacaattttgagcttgccaggttctcaatttagaaaggcttgcatagttttctttcacttattgaataaagtccagascctttcattggtactcaaaacctatcttggtttcatatcaacttacactcctggacttatctcttactaatgccctgagaggccatcattttaggtacat

SEQ ID NO: 27948 - DNA, 201 bp, Homo sapiens
ggaggcaggcagatcacttgaggtctggagttcgagaccagcctggccaacatggtgaaaccccatctctactaagaatacaaaaattagccagggatggkggtgcatgcctgtagtcccagctacacgggaggctgaggcagaagagttgcttgaacctgggaggtggaggctgcattgaaccaagatcgcaccactgca

SEQ ID NO: 27949 - DNA, 201 bp, Homo sapiens
tgtgtaaaagtagatgtccattataggattttctattgctataagtggcagctgtcatagtgtgaaatctgcctaaattgggaaggcatggaaagtctcargtagtataattgtattgcaaatccgtatcagttttgaagatttccctactccccttttaaacataaagatttatattaaagaaaagtctcttaataagag

SEQ ID NO: 27950 - DNA, 201 bp, Homo sapiens
caccgcgcccagcctaattttttaaattgacaaataattatacaaattaatggggtaaatagtgatgtttcaatacatgcactgtgtagtgatcagattarggtaattagcatatccatcagctaaaacataatttctctgtgttgggaatattcagtatccctttcttttttctttttttttctttttcttctttctttt

SEQ ID NO: 27951 - DNA, 201 bp, Homo sapiens
ctttaggtgagagtgataaaacggttcttacttgatttggggcccttaagcaggttgctgctctgggattaggttgtcttataaaaaggtaactcaccacscataacaatgctttttcctgtttaaagagagacctagttcttctatcagatgatttcttaaggcagcatgaagtagccagacacaaaaagagttaagatc

SEQ ID NO: 27952 - DNA, 201 bp, Homo sapiens
cagcctaattttttaaattgacaaataattatacaaattaatggggtaaatagtgatgtttcaatacatgcactgtgtagtgatcagattagggtaattarcatatccatcagctaaaacataatttctctgtgttgggaatattcagtatccctttcttttttctttttttttctttttcttctttcttttttttttttt

SEQ ID NO: 27953 - DNA, 201 bp, Homo sapiens
tacaaattaatggggtaaatagtgatgtttcaatacatgcactgtgtagtgatcagattagggtaattagcatatccatcagctaaaacataatttctctrtgttgggaatattcagtatccctttcttttttctttttttttctttttcttctttctttttttttttttttgagacaaagtctcactctgtcgcctggag

SEQ ID NO: 27954 - DNA, 201 bp, Homo sapiens
cagtttagtatttctgtagcaccacttatttgggcatctgtgttaggatttgtaagtggaaataatagtgggccttcaaactaaaaagtgtacagtagaaraaataatcaacaaaacgaaaaagcaacccaacccatggattgggaaaagatatttgcataccatacatccaataagaaattaatatcctaaatttataag

SEQ ID NO: 27955 - DNA, 201 bp, Homo sapiens
cttacaaaagagacctgaatgagatccctcatcccttctgcatgtgaggacagagcaagaagatggtcatctaggaaccagaaagcaggccctcaaatctrccttgttcttggacttcccagcctccagaactataagaaataaatttctgttgtttttatggcacttagtctatggtattttgttatagtagtccaaatg

SEQ ID NO: 27956 - DNA, 201 bp, Homo sapiens
aaaaacattgtggttccgttcagccctcccggaaaatacgtaggggacttaaagagcggaccgagtacctgtttgtttccccatcccttagccggcagggmtctggcagcgccctgggagaacttagggaagggccttctcgcagcggttaccggaagtgacgcattcattctcgcgagaacaaagacgcgcgagcatcgg

SEQ ID NO: 27957 - DNA, 201 bp, Homo sapiens
ctggctcgccgcttccggaaagactttgagccctatgactttactctggatgactaaaacaaagggaagaactttttatgaactccacaggaagtagtaargcttttttttttttttaattaaaagaattttttttgagacaaagtctcgctctgtcacccaagcaggattgcagtggcataactgtggctcactgtagcc

SEQ ID NO: 27958 - DNA, 201 bp, Homo sapiens
ggctggagtgcaatggcacaatcttggctcactgcaacccccacctcccgggtacaagcgattctcctgtctcagtctcccgagtagctgggattataggygcacaccaccacgcccagctaatttttgcatttttagtagagacagggtttcaccgtgttggccaggctgctcttgaactcctgacctcaagggatctgc

SEQ ID NO: 27959 - DNA, 201 bp, Homo sapiens
agatggagctctacataagaaattacagattagtccagatttccttccagtttaaaagcattgtctttctgacagtaaaaccagagaaaggacatttcaargaatgactcaaagaattagtaatgaacctcaaacagttcatctttccttgttattatgaccttgcaaatgtgtttatattttcaagaccggtagctaagt

SEQ ID NO: 27960 - DNA, 201 bp, Homo sapiens
agggctgacagtgtgggatagatggttggtgggaccttgggcagtatttgggggccagtgggcttgtgtgtgtgtattagagagaaagatactatgcctgygtgtccaaagttgtatttgaggtactgggcatagatagagctgttgcggggaacttgggtatgactgtcaggctgtgaccaggtgtttagtgagtgtgac

SEQ ID NO: 27961 - DNA, 201 bp, Homo sapiens
atggaataagaggataaaaaggttgaagatgttaacaaatagtgatttaagtgatagaagttgtagctagagtaaaatattaaaatctaagatttcaaatrgagcaagtccaattctttttctttaatcaatatttctgggccaggcgtcgtggcacatgcctgtaatcccagccactttggaggctgaggcaggagaatt

SEQ ID NO: 27962 - DNA, 201 bp, Homo sapiens
attttttccccttatcctgtacatttgtccacggtcctaagttattacactccttaatgtcagtacttaccctgaggatgtgggtggggatacccatggtrtcctggggtgggaaatccaagttctttatctttttgtgtccctattcaaggtagtggggaccagggggcagtcaaaatcatagagccaagatacaagtaa

SEQ ID NO: 27963 - DNA, 201 bp, Homo sapiens
gttggccttttttggtttttaataaaagcatttatttcataggagtgttaagaattttccaagtataactaagttacaaactatttccctactcattatayctctggtccaaggtattgactcttaaatgccctaaaacttgaaattttttctgaattaaagttctggattaaaaacttcagatattttctcgaattatag

SEQ ID NO: 27964 - DNA, 201 bp, Homo sapiens
aggaatctattttttatctccacaagtttgccttttctgaacattccatataaatggaattatgtaatatatagtcttgtgtctgactttttttacttgcyttgtatttttgaagcccgtgcatgttgtagcatgtatcagtacttcattcgttttgattaccgattagttttttcactgtatatatctttttgcatttgt

SEQ ID NO: 27965 - DNA, 201 bp, Homo sapiens
tgttctttgggttttggtgattgttcactttagcccatacaaaagtttgggtcttttttcctcaacaaaagtttggactctgttatctgtaagagatatgstaatacacattgattttgttcatttgcatttcaaagtaggaaatctggtgcataagtatttagaaaacctaggattttcaaagatccttgaacaggattt

SEQ ID NO: 27966 - DNA, 201 bp, Homo sapiens
tatgattagtagaaatggacttttggtgttgtgttctgtatctcatacttgaagtttctatatggagttatatgagaactctgaaaaatggatttatatartttggaaggtgaaaaggtagatattaaatctccatgagatcattcaagagaagatttactttcttgaggatagggctctcacaggagaatgaaacttcac

SEQ ID NO: 27967 - DNA, 201 bp, Homo sapiens
aggatagatggcagggatctgaagaaaggtgaagtgtagataggagtagagacaatatgaagtttagaaaagactaattgctggacgcggtggctcatgtstataatcccagcactctgggatgccaaggtgggaggactacttgagaccaggagttcgggaccagcctgggcaacgtagcaagaccatgtctctacaaaa

SEQ ID NO: 27968 - DNA, 201 bp, Homo sapiens
ggattgcagtggcataactgtggctcactgtagcctcaacctcctgggctctagagttcctcccacctcagcctcatgagtagctgggaccacaggcgcawgctaccatgcctggcaaacttttttgattttttatagagacaggagggtctccctgtgttgcccaggctggtctgtaatgcctaggctcaagggatcctc

SEQ ID NO: 27969 - DNA, 201 bp, Homo sapiens
gtcctggccagtgaagccatccttaatgttcctgataagtctgactggaggcagtgtcagatcagcaaggaagacgaggagaccctggctcgccgcttccrgaaagactttgagccctatgactttactctggatgactaaaacaaagggaagaactttttatgaactccacaggaagtagtaaagctttttttttttttt

SEQ ID NO: 27970 - DNA, 201 bp, Homo sapiens
aaaacatcaagttgtataactcaaatatataacatttttatatgtcaaattaaattgtcacaaaataaaatatgtaaaagataaagcaataaatcaggagrgggggctatgatagatgaaacaagataggctctatgtaaatgatggttgaaactaggtgaggcattcacagggttgggagggggcttattgtactgttgt

SEQ ID NO: 27971 - DNA, 201 bp, Homo sapiens
gtgccattgcactccagcctgggcaacggagcgagaccccatcttaattaaaaagaaaaaaatacaggagagactgggctgctttgaaaagtggatttgasgggaatgtggggtttggagagatcttatgttttccaagactagaaaaacattgtggttccgttcagccctcccggaaaatacgtaggggacttaaagagc

SEQ ID NO: 27972 - DNA, 201 bp, Homo sapiens
tcaagttgtataactcaaatatataacatttttatatgtcaaattaaattgtcacaaaataaaatatgtaaaagataaagcaataaatcaggagagggggytatgatagatgaaacaagataggctctatgtaaatgatggttgaaactaggtgaggcattcacagggttgggagggggcttattgtactgttgtctatag

SEQ ID NO: 27973 - DNA, 201 bp, Homo sapiens
aggagaatggcgtgaacccgggaggcggagcttgcagtgagccgagatcccgccactgcactccagcctgggcgacagagcgagactccgtctcaaaaaawaaaaaaaaaaataaataaataaataaataaataaataaataaataacttgttcttttaaattgggatttttcttaattttgaaaatttcttaactttgaa

SEQ ID NO: 27974 - DNA, 201 bp, Homo sapiens
tgaacccgggaggcggagcttgcagtgagccgagatcccgccactgcactccagcctgggcgacagagcgagactccgtctcaaaaaaaaaaaaaaaaaawaaataaataaataaataaataaataaataaataacttgttcttttaaattgggatttttcttaattttgaaaatttcttaactttgaaattttattgttg

SEQ ID NO: 27975 - DNA, 201 bp, Homo sapiens
cccgggaggcggagcttgcagtgagccgagatcccgccactgcactccagcctgggcgacagagcgagactccgtctcaaaaaaaaaaaaaaaaaataaawaaataaataaataaataaataaataaataacttgttcttttaaattgggatttttcttaattttgaaaatttcttaactttgaaattttattgttggaac

SEQ ID NO: 27976 - DNA, 201 bp, Homo sapiens; identical to SEQ ID NO: 4982

SEQ ID NO: 27977 - DNA, 201 bp, Homo sapiens
gcactccagcctgggcgacagagcgagactccgtctcaaaaaaaaaaaaaaaaaataaataaataaataaataaataaataaataaataacttgttctttyaaattgggatttttcttaattttgaaaatttcttaactttgaaattttattgttggaactaacatctattgtagaaaaggaaattgttcagttttcagaa

SEQ ID NO: 27978 - DNA, 201 bp, Homo sapiens
aacatctattgtagaaaaggaaattgttcagttttcagaatgtcattttataattataaaaggagatctcactttggagaatgagtgagccttgtttaatktagaaataatgccttttgcccatattcaccttttagtatctggcagcgaatcttttatgtaacaaataatcaataactttacctttttttcttatttata

SEQ ID NO: 27979 - DNA, 201 bp, Homo sapiens
gatcctcggaaaccagcctctcaatgtgttctagatggagttgtaagaaaattaattataatatccctagagtatgtgaaatctagagggattgcgtgccytgcaatttttatgcatacttggaattccttgggaggccgcacattttgttttggttttgtccttctcccaactcttatcattgctttgcaaggtgaacag

SEQ ID NO: 27980 - DNA, 201 bp, Homo sapiens
ggattataggtgcccaccaccatgcctagctaattttttgtatctttagtagagacggggttttgccactcctgaccgacctcaggcgatctgcctacctyggcctcctgaagtgttgggattacaggcgtgagccactgcacccggccactctttcagcttttaatatttaacttcaccactcagtcgtgctgaaacagt

SEQ ID NO: 27981 - DNA, 201 bp, Homo sapiens
tgtatgtaggagcacgaatgtgtgagaagagggctgaaggggactgcctttgggaatgtgtgcgtccgtgtgtgtgtgtgtgtgtgtgtgtgtgtgtgtgygcgcgcgcgcgcgcgcttggaggccatatgatatcagtggggactggagtagacaaggaaggcttcatgatgggtccagagttaagcctttggaagcatg

SEQ ID NO: 27982 - DNA, 201 bp, Homo sapiens
gagcccaggaggtcaaggctacagtgagctgagatcataccactgtactccagcctgggtgacaagagcaagaccctgtctgaaaaaaaaggaaagcatcttgatgccactaaactgtacacttaaaaatggttaaggtggtaaattttatgctatgtgtgttttaccacaatcaaaaaactatttcatttcagttaacaa

SEQ ID NO: 27983 - DNA, 201 bp, Homo sapiens
tcgccatgtgggcctcttcatggggaagcttgaatgttttcatgacatggaagctagctttccccagaaagatcttttcctcagaaagagtgagtgatctragagagagagagagagagagagagtgaacgagcgagcaagatgaaaaccgacgtatcttttatgatctttacttggaagtgagactccatccttttccac

SEQ ID NO: 27984 - DNA, 201 bp, Homo sapiens
tttccatttcagacctcaccacactgaactgtagttttgtgtttagtttttttgtcccttctgctaaacagtggttccatcagagaaggaacagcacctgctttttttttctttttcttttttttcatttttcatacttaacccagctcctagacttcacctgtcttgttcaagtctgtttttccatcatagtatctagca

SEQ ID NO: 27985 - DNA, 201 bp, Homo sapiens
ttagtgaaaatagttgttggcctcttggaggtgttggaaccttggtgatgcctcttctcttaggaacctttcacgtatgcttggcaccaaatatctctgctttttttttttttaatccaaagacttcaggacattcctgaagttagatctaagtatttactcacatttaatctactataaggaggtatgatgcttcttcaa

SEQ ID NO: 27986 - DNA, 201 bp, Homo sapiens
cttaacctttacctcatacaagaccagcttgtcactgctccttatgcctcaaacccgttatctacctttgtgctttgacagatgctatccttctgcctggdtatccatttctgtgtatcttctcacctacactggcatatctttaagagcttttctttaaatggtctctgccacaaaatttgtcatttaaaggctatattc

SEQ ID NO: 27987 - DNA, 201 bp, Homo sapiens
tctgctggaaagagtactggatggggaatcagaggcttgaattctagattgagtaatttactgaccgttacctcaggcaaatctgcgtttcccatttcctycttctgcaaaatggggttgaaacctaactttcctactcagtgagtatattgtgacagtgtatttaagaggatgtttgtgaaaatgctttgaaaactataa

SEQ ID NO: 27988 - DNA, 201 bp, Homo sapiens
atcagaggcttgaattctagattgagtaatttactgaccgttacctcaggcaaatctgcgtttcccatttcctccttctgcaaaatggggttgaaacctarctttcctactcagtgagtatattgtgacagtgtatttaagaggatgtttgtgaaaatgctttgaaaactataaactattatgtacttgcaagatattatc

SEQ ID NO: 27989 - DNA, 201 bp, Homo sapiens
tctgtgccctaatgtgcattatacttaaatgcatgttaaaaaaagatatacttttacactttaaaatttgtagacacatagcaacacatgcaaattaatayacatgtgaaattgtatttcatatactattttcacatttaaaaaataacattatctcctcttatactgcttttattttactgaaatgtattcagtttagtc

SEQ ID NO: 27990 - DNA, 201 bp, Homo sapiens
tgcagggaggtcctggccagtgaagccatccttaatgttcctgataagtctgactggaggcagtgtcagatcagcaaggaagacgaggagaccctggctcrccgcttccggaaagactttgagccctatgactttactctggatgactaaaacaaagggaagaactttttatgaactccacaggaagtagtaaagcttttt

SEQ ID NO: 27991 - DNA, 201 bp, Homo sapiens
acatgtatgtatagcacttagcatgtctgaggaaatgcagtatgactggagtgtagagtttcaggagagagaaaacctaaatataggagagagagaaaacstaaatataggtttttttgtttgtttttaataaaaacatgttaatgggcaataggtttgttatttttaaatgaattaagacacgagtatttttaaatttct

SEQ ID NO: 27992 - DNA, 201 bp, Homo sapiens
aaaaaaaaattctgactcccagttttctggctaatgaatcagataccacagatacacagtgatagcatttgtttaggttatattttttaaaactttgaggyagccctgtcaacataccatgaagctcagaaataaactgctacccaggtagcttctttgagtgtcaccttgagtgacaaactgtaacaagattgtgtctgt

SEQ ID NO: 27993 - DNA, 201 bp, Homo sapiens
tacagatcattcttccagttatcacagcaatcttatatttaggtattattttgcaaatgaggaagttgaagcttatagaatcacatagctggtggttggtraagtgtggatttgaaataaatactttctgactctaatatctgtgcttaattccattttgattctcaaacttggttatgtggcagaatcaccaggaaagct

SEQ ID NO: 27994 - DNA, 201 bp, Homo sapiens
cttctcacatgactgctgtgaggattaaatgggaaaattataagcagagagtagcaaatattattattattgcatttaggcttaattattgtccaaagaawataccagcatgatgcataagcaactttcaactcctttagccattttctgaaatataacaattaatgatttttttttaaaatcgaggtcacattttaaact

SEQ ID NO: 27995 - DNA, 201 bp, Homo sapiens
tttggtggtgcacccctgtagtcctagctacttgggagattgaggtgggagaatcacttgagcccagggaggttgaggctgcaatgagccatgatcacgcsgctgcactccagcatgggtgacagagcaagaccctgtctcaaaaaaaaaaatttctttttgtatttgaagcccagtactctgaaactactgtgagaacag

SEQ ID NO: 27996 - DNA, 201 bp, Homo sapiens
gcaaaatacagcttccaattatacagctgcgtaaagtgtgggctgaagcagtgcactatgtgtctggactaaaagaagactatagcaggctctttcagggrcaaagggcagcaatgtaagtggattctgttgtttataagcacaatgcaatgtgcatcatatactcaagaattaatcttgccggttttcactaatcaatat

SEQ ID NO: 27997 - DNA, 201 bp, Homo sapiens
cggataaacatgaaattccaagcaacctagttcaagggcctccttcctttaggtaatgaaagtttgatgaattgtcctactgtttctaaatatgtggttartcatccaagaaaaattgttcccttggccagaggctgcatttgtgtctagggcttgggttagtatgggttaaagatagccaagactattgttctcaagcac

SEQ ID NO: 27998 - DNA, 201 bp, Homo sapiens
ctccacaagtttgccttttctgaacattccatataaatggaattatgtaatatatagtcttgtgtctgactttttttacttgccttgtatttttgaagccygtgcatgttgtagcatgtatcagtacttcattcgttttgattaccgattagttttttcactgtatatatctttttgcatttgttctttgggttttggtga

SEQ ID NO: 27999 - DNA, 201 bp, Homo sapiens
ttataggtaatctttatatcttttatcttaacccaatttttaatttaaatggagatgtttattaattaaaattagtttcagagtttcagggatttttgagraattttttgtttggaggctgatatgttacagaagaaaggttatatccactgactgatgtcttttatagatcactcctacagtgacagcacagagatggtg

SEQ ID NO: 28000 - DNA, 201 bp, Homo sapiens
ccatacaaaagtttgggtcttttttcctcaacaaaagtttggactctgttatctgtaagagatatggtaatacacattgattttgttcatttgcatttcaragtaggaaatctggtgcataagtatttagaaaacctaggattttcaaagatccttgaacaggattttaactgtttgtttctttttcagagaggctgtgat

SEQ ID NO: 28001 - DNA, 201 bp, Homo sapiens
tactctggatgactaaaacaaagggaagaactttttatgaactccacaggaagtagtaaagcttttttttttttttaattaaaagaattttttttgagacraagtctcgctctgtcacccaagcaggattgcagtggcataactgtggctcactgtagcctcaacctcctgggctctagagttcctcccacctcagcctca

SEQ ID NO: 28002 - DNA, 201 bp, Homo sapiens
actctggatgactaaaacaaagggaagaactttttatgaactccacaggaagtagtaaagcttttttttttttttaattaaaagaattttttttgagacaragtctcgctctgtcacccaagcaggattgcagtggcataactgtggctcactgtagcctcaacctcctgggctctagagttcctcccacctcagcctcat

SEQ ID NO: 28003 - DNA, 201 bp, Homo sapiens
gaacaagttaagtgtttgatcactgtatatctgtccaaataaagtaaagcacaaaattgtaaaatcaagaacaaaattgagcagaggggctaaaatgtatrtaatcttacttttttaaaagtctttttattagttttcttttgaatttttcttttaaattgaggcagtttacatagagtgaaattcacagatcatatagtt

SEQ ID NO: 28004 - DNA, 201 bp, Homo sapiens; identical to SEQ ID NO: 5049

SEQ ID NO: 28005 - DNA, 201 bp, Homo sapiens
tatgacagtgacacactaatgcttttattattgaaaaaacaattccaacatagcagtgtatttagaacactaaatgaaaatatgcccgggagcagtgactyatgcctgtaatcccagcactttgggaggctgaggtgtaagaatcacattaatccagtaagtcgaggctgcagtaagccatgatcataccacttcagcctg

SEQ ID NO: 28006 - DNA, 201 bp, Homo sapiens
ctacggcttggggcccagagagatggtagtcacacaccttgcagaattcctgaatctgaaagctgccccttttttttctgagacaaggtctcgcttcatcrcccaggctggagtgcagtggctgggaacacggctcactgcggcctcaacctccagagctcaattgatccgctgccctcagcctcccaaagtgctgggatt

SEQ ID NO: 28007 - DNA, 201 bp, Homo sapiens
atttagaacactaaatgaaaatatgcccgggagcagtgactcatgcctgtaatcccagcactttgggaggctgaggtgtaagaatcacattaatccagtargtcgaggctgcagtaagccatgatcataccacttcagcctgggcgagagtgagacctctggctcaaaaaaaaaaaaaaaaaaaaaaaaaaaagaaaaaaa

SEQ ID NO: 28008 - DNA, 201 bp, Homo sapiens
aggcgacacatgaggagcatgtgaaagaatatgaaaaagccaggtgcagtggctcacgcctgtaatcccagcacactgggaggctgaggcaggcagatcaygagggcaggagttcgagaccagcctggccaatatggtgaaactccgtctctactaaaaaaaaatacaaaaattagctgggcgtggtggcgggcacccata

SEQ ID NO: 28009 - DNA, 201 bp, Homo sapiens
tttttttttttttccggatggagtttccctcttggtgcccaggttggagtgcaatggtgtgatctcagctcactgcaacctccacctcctgggttcaagcrattctactgcctcagcctcccaagtaactgggattataggcatgtgccaccacacccggctaattttgtatttttagtagagatggggtttcaccatgtt

SEQ ID NO: 28010 - DNA, 201 bp, Homo sapiens
caccactgcactccagcatagacaacagagcaagactccatctcaaacaacaacaacaaaaatcattttgaacaaatgcatttaaatatatttgtctttcmaccctttttggggtgttagggtgatggacatataattatttttcttattgatattcacactgtctcgtatttgaccagatagaaccctagtataatattt

SEQ ID NO: 28011 - DNA, 201 bp, Homo sapiens
tacaaagaatacacaaattagtgagtcatggtggcacatgactgtagtcccagctactggggaggctgaagtgatcgtgccactgcactccagcaggggcracagagagagaccttgtctcaaaacataaatacataaaactttggtgacctagaactttattgattctataatggtgaactgggcttctacctcatccga

SEQ ID NO: 28012 - DNA, 201 bp, Homo sapiens
agaggggctcgtggggccagagaggcagaaacacagccaactatggttgggctgggtcgaggtgaaggagaagtggctgaataatgtgggaggaagagccmgatgctgaagccccacgaccctgccgtgagatgtgcggctgcctgcaccagtcttaccttcactccatcgtcataccctggcttgcttagaaagctttta

SEQ ID NO: 28013 - DNA, 201 bp, Homo sapiens
tggatcacctgaggtcaggagttcaagaccagcctggacaacatggtgaaaccccgtctctaccaaaaatgcaaaaaaaaattagccgagtgtggtggtgygttgtctataatcccagccactcgggaggctgaggcaggagaatcgcttgaacccaggaggcggaggttgcagtgagcagagattgtgccactgttctct

SEQ ID NO: 28014 - DNA, 201 bp, Homo sapiens
aagccccacgaccctgccgtgagatgtgcggctgcctgcaccagtcttaccttcactccatcgtcataccctggcttgcttagaaagcttttacagaactsagcagagattcagatctacctggaagtatggattaagtgcttgttgtgtgcacggcactgggagagatgtcccaaacaaagaggatggaagtcatattcc

SEQ ID NO: 28015 - DNA, 201 bp, Homo sapiens
catgttggtcaggttggtcttgaacgcctgacctcaaatgatccacccaccttggccttccacagtgctgggattaccagtgtgaaccaccacgcttggcygccatgcttaatttctaaaccaggatgattgggaagatgatgaggggggagttttgcatgtcggcaggagggcatctgccgtcatgaaatctcttaatag

SEQ ID NO: 28016 - DNA, 201 bp, Homo sapiens
attttttgtatttttggtagaaacagggtctcactgtgttgcctaggttggtcttgaactcctgagtgtgagcaatctgccctccttggtctcccaaagtrctgggatcataggtgtgaaccactgcgcccaacaatcctgtaccttcaaagaatattcctctgcagcacccccagacattacataccattgtccctgagt

SEQ ID NO: 28017 - DNA, 201 bp, Homo sapiens
gaggttgcagtgagccaagatcacacactgccctccagcctgggtgacagagcgagactctggctcaaacatacgtgcgtgtgtgtgtgtgtgtgtgtgtrtatgtgtgcgtgtgtatacccatgtacaccatgagaaagtctgagaatcactgctttccagattggacatgggctgtggtagcccgggcactgctagctg

SEQ ID NO: 28018 - DNA, 201 bp, Homo sapiens
tgtggttgtccaggcaggagaagatagtggagacaatggtggtgaagagaagtgggggggttgggagatatttgggagctagaagcaatcaaactgctgayggacaggaagtgagggagacgaggtgatgaggaggaagccccaggttccagccaggcgatgctagtgtcaccaagaaccagagagatcatgaggcagcca

SEQ ID NO: 28019 - DNA, 201 bp, Homo sapiens
tggcctggccaggtgggtcatccaggtaggaggtttggggctttgctgcgccatggtttctggccccagggatccactgccctctttgacctttgcagtcyggcaagctggatgcgttcctggtgctggagcagctgcggtgcaatggggtgctggaaggcattcgcatctgccggcagggcttccccaaccggatcgtct

SEQ ID NO: 28020 - DNA, 201 bp, Homo sapiens
ttgatgtcagaccttggcactcacatcctatgttaatctcatatagtctggcatgtcaagaagcagacctggggacatggatagaaggtgtttgatgtctstgcaacataactgtctggtcccagaaaagtttttggccacattgtaagagaggaaaccaagggacctgggggttcattctgctgggtctctccctggaag

SEQ ID NO: 28021 - DNA, 201 bp, Homo sapiens
gccttcagcttcgcagctgtgtgttgtctcagtatccatttcttttctgcccaatgcgcccctctgcccaccccaatttttaaacccttgcacatttccaygagattcttgcaaaatctggaggcttggatatctttgtgcaaagctttcattgaaaccaagatcaggatgacaaatagacctcatctcttgacccactgt

SEQ ID NO: 28022 - DNA, 201 bp, Homo sapiens
ttcaggatttggtggctgtctcctgccctgggtagggcagcattattaggtatttggccactgccctcagatcacatcaggggctcagcttctcaggcagktctgtggagcccacccagaatggtgctcccagcgcaccaccagccacctggaactgagagccatgctcgtgcaatgggaacttctttgtggtcaactgca

SEQ ID NO: 28023 - DNA, 201 bp, Homo sapiens; identical to SEQ ID NO: 5048

SEQ ID NO: 28024 - DNA, 201 bp, Homo sapiens
gcaccaacaccaagaccttcagcttccgtggttttcctaaagcaacatcttgactaccccctgggctgacggcagcggcgatgaagacatgtgtgaaggcrgcttcccaaattccaggcgcttccccaaccttcagacagagcaaaccaaattaagctgacataacagctgtgacaaactggctagcaccggggcccagag

SEQ ID NO: 28025 - DNA, 201 bp, Homo sapiens
gtaatcccagtgctttcagaggccgaggcagttcgatcagttgaggtcaggagttcaagaccagcctggccaacatggcaaaatcttgtttctactaaaamtacaaaattagctgggcatggtaacaggtgcctgcctgtaatcccagctactcgggaggctgaggcatgagaatcgcttgaatccaggaggcagaggctg

SEQ ID NO: 28026 - DNA, 201 bp, Homo sapiens
attaatccagtaagtcgaggctgcagtaagccatgatcataccacttcagcctgggcgagagtgagacctctggctcaaaaaaaaaaaaaaaaaaaaaaaraaaagaaaaaaaaaaaaaaaggccagttgcactggctcaagcctataatcccagcactctgagaggtcgagatgggaggattgcttgaggtcaggaattt

SEQ ID NO: 28027 - DNA, 201 bp, Homo sapiens
gatcgtcttccaggagttccgccaacggtaagtcccaaggtctggcccaggtagggcagggggtgagcgggactgggtggaggaatggatgctggaggtayccggggtgacttctgctctgtgtttcaagctacgagatcctggcggcgaatgccatccccaaaggcttcatggacgggaagcaggcctgcattctcatgg

SEQ ID NO: 28028 - DNA, 201 bp, Homo sapiens
tataaataaaaacagtgccaaaccaaacgcacacacacacacctcccagatatgagccctgaccaaaacacgagtttcaaatcttaaaatctttagcaatrtattttgctaggcatagggaaaagctctttccctgtgcacaaagaacttaccagatatggcatctaggaactgataaaaacccttctagaaaataagatg

SEQ ID NO: 28029 - DNA, 201 bp, Homo sapiens
ccttcggcagccccaagcatctagctagaatttggtaatactgttttccttgtatttatatttataattgccatctatttatggcaagtgaagatgatttktcactgaagatagagaaagttttctattaaaacaaatgtaaggaaagagaaggaagtaaatttaaagaaaatgattaagcaaataatggagcagatggta

SEQ ID NO: 28030 - DNA, 201 bp, Homo sapiens
catggtgaaaccctgtctctactaaaaatacaaaaattagctgggcgcagtgacacatgcctgtattcccagctactcgggaggctgaggtgggagaattycttgaacccggggagatggaggttgcagtgagccaaagtcacaccactgcactccaacctgggcgacagagtgaggctcttgtctcaaaaaaaaaaaaaa

SEQ ID NO: 28031 - DNA, 201 bp, Homo sapiens
aagcccagatgggtggattgctcgaggtcatgagttcgagaccagcctgggcaatatggcgaaaccctgtctctacaaaaaatacaaaaattactttggtrtggtagcacatacctgtagtcccacttcttgggaggctgaggtgggaggatcgcttgagaccaggaagtggaggttgcagtgagccgagatcacgccact

SEQ ID NO: 28032 - DNA, 201 bp, Homo sapiens
gatggtgcttgaccccccagcttcccctgctattgggtttctccaacgaggagacatggtcttcgcttctcagagtctgtggggccagggacaggggccaytcatggtccccctctcaccctaccctggacgctgtccttgtagctctccgactcgaagaagaagctgcaggactttgccagcaccgtggaagctctggaa

SEQ ID NO: 28033 - DNA, 201 bp, Homo sapiens
ctgtttccaaaaataaataaaagaaaaaacatctgtgctttttttgtttttttgttgttttttgttttgttttgtttttgagacagagtctagctctgtcrcccaggctggagtgcagtggcgcaatctcggctcactacacgctccgcccttcccagttcacatcattctcctgcctcagcctcccgactagctgggact

SEQ ID NO: 28034 - DNA, 201 bp, Homo sapiens
ccaaaggcacgctggtgctgcttggccgtctctccccgccatctctgttcttgctgctccgcccagaggctgggccacctgttcggtttggggactgatcrtacacgaggttccggcaggaagcgagtttggactccagtgcctggacagaaatacacttttatctctcaagttataggcaaggactattctgtcttacca

SEQ ID NO: 28035 - DNA, 201 bp, Homo sapiens
cttcttctttttttttttttttttttgagatggagtctggctctgtcacccaggctggagtgcagtggcactatcttggctcactgcaacctctgcctccygggtttgagcaattctgcctgagcctcccaagtggctgggattacaggtgcacaccatcacacctggctaatttttgtattttcagtagagacggggttt

SEQ ID NO: 28036 - DNA, 201 bp, Homo sapiens
taatcttagagatgcaggttctgggctcagcaatgtccagcagtctacctaaactgctgaagaccgtttgtggcatacctggcggggagcatggctttgaygcctggtcctaagggtcccttggtcttctgaatgctgtcttttggctgagttcgtctgcctcgagttagttagttcgttcctcccttccttccttccttc

SEQ ID NO: 28037 - DNA, 201 bp, Homo sapiens
ctgaagtagtggatcaacacagcccatctgtctgtccatctcaaaatctttccttaagatagtggaggttgtctgggccggtcccaggaggttctctctgyctgggttctaatcacagggtacctggttcttctatccttcaccctcttttaaaaaatcactttttagtactttgggaggctgaggcgggcggatcacctg

SEQ ID NO: 28038 - DNA, 201 bp, Homo sapiens
agtcctggattcaaacgatcctctcacctcagcctcctgagtagctgtggaccacaggtgtgcaccaccacacctggctaattaaaaaaaaaaaaaaaaayttctgtagagactgggatctcactatattgcccaggctggtctcaaactcctggcctcaagccatctcctgccttgacttttcacggcgctgggattacg

SEQ ID NO: 28039 - DNA, 201 bp, Homo sapiens
aaccctttagagtagatactgttattctaactggctttattttacacatatggagtctgaataacttgcttaagatagctcagctaaccagtaaggaaaasaagattctacaaatctaggtctttctaactccagagtttcacagattaccctcatgggaggatttgatgagctaatgtgtatgaagggtttagcacagtg

SEQ ID NO: 28040 - DNA, 201 bp, Homo sapiens
catccatccatcatccgtctatcctctatccatgaattattcatccatcaatccatcctctattcatccatctatcctctactcatccgtccatcattcayccattcatctacccacccatccatccatccgtccattcatccatgaacccatcctctatccatttattcattcatccatccatccaccttccacctacca

SEQ ID NO: 28041 - DNA, 201 bp, Homo sapiens
ccaatccaagtgctgtacattgacacattgtattttatttaacacagcatcccctgagttaaaaatgtttgccccttttagggaaggaagctgaggtgcartgttgcaaaatgtatctttactttcttaagtaggggaagtctcttgtctgtggcactgtttgtatggaaaaattattgatctggggctgtttgtatggtg

SEQ ID NO: 28042 - DNA, 201 bp, Homo sapiens
tccaggaaaaaacaaaagttgggatggaaggagaagtaatcacattggactaaggagcccagctgtgcaagtttggagtatttatctaaccagaataactmcctgtgatggacttggctctgtggggaaagggaagaggattagatgggaactgaattctcatattccatggtaggatgtacacatttgatgtttgacaat

SEQ ID NO: 28043 - DNA, 201 bp, Homo sapiens
acaggtgcacaccatcacacctggctaatttttgtattttcagtagagacggggtttcaccatgttggccaggctggtcttgaactcctggcctcaagtgwtttgcccacctcggcctcccacagtgttgggtttacaggtgtgagccaccttgtccagccctacttcctgcctcctgagcactgggtagtatttcacagt

SEQ ID NO: 28044 - DNA, 201 bp, Homo sapiens
aaaaaaattagctgggcatggtggcgggtgcctgtagtcccagctattcaggaggctgaggcaggagaatggtgtgaacctggggggcggggcttgcagtkagcagagatcgcaccactgcactccagcctgggtgacagagcgagactctgtctcaaaaaaaaaaaaaaaagaaaagaaaagaaactgaaaattggccac

SEQ ID NO: 28045 - DNA, 201 bp, Homo sapiens
agtcacttgatgtcattaagcttcattgtcctcattagtaaaacaggagatgcaataatagttgccgtctctactagaggtattatgagggttaaattagrccagtgatgctcaaactcaagcaggcatcatgaccccctggaaggctttgtttatttatttagggacagagtcttgctttgtcacccaggctggagggcg

SEQ ID NO: 28046 - DNA, 201 bp, Homo sapiens
gtgtcaggattctagataacatcccagtttctcctcttcccatcagctacctctcctctgggctgtcagctcatcttcaatgcttcgttatctggttgaargcctgaggttgcttttattttcctgtcacatagagtgtagtgcagtggcacacatagtgtgggatttttgtgttgactgtgccatttagaggtccctgtc

SEQ ID NO: 28047 - DNA, 201 bp, Homo sapiens
tcatggggataggccatttttccactgttcttatagatatttcagaaggagttagagtggctttttaaagagccaaatggtaagagtgagcaacttagcarctcataacttttttttttttttttgagatgggggcttactctgtctttgaggctggagtgcagtggttctatcgtagctcagtacagcttccaagtcctg

SEQ ID NO: 28048 - DNA, 201 bp, Homo sapiens
ccatctcctgccttgacttttcacggcgctgggattacgggtgtgagccactgtgcctggccgtaactattaaatatgtcctccaatccaagtgctgtacrttgacacattgtattttatttaacacagcatcccctgagttaaaaatgtttgccccttttagggaaggaagctgaggtgcagtgttgcaaaatgtatctt

SEQ ID NO: 28049 - DNA, 201 bp, Homo sapiens
tagcagctgtagaatcaaatgataaaaatgaccttcttggccaggcatggtagcccacacctgtcgtcgcagcactttgggaggatgaagggtgaggatcrcttgaagctcagagtttgagaccaaactcggcaacatggcaaaacctgtctctagaaaaaatacaaaaaattagccgagcacggtgacacgcacctgtac

SEQ ID NO: 28050 - DNA, 201 bp, Homo sapiens
aatttgcaacagaaaatagtaatcagctggtagtttcagaaatcacccttttgctgagtcttaaatttttttttattccagggaaacgtgaagattgtggrgcgctatttttttttttaaagcaaaccacacagcatatctggccacctaaaacacaaagtgtttgaaactaaccgtaagatttcctttctgctcgcccaa

SEQ ID NO: 28051 - DNA, 201 bp, Homo sapiens
caacattcgtttctcttgattttattgatcttttaaaaaaataaaaggacatcttctgtggatacaggttaggatgtttctagggtaagaaacccaccatygcagcgtaattctctgcggaatttcagtagcacttggaaagttctgttttcaacctgaaatttttgctgttcttccagaaaataacttagtaacaaaatg

SEQ ID NO: 28052 - DNA, 201 bp, Homo sapiens
cacctgcttgtcccccgacctgtggggttgtccctcttcctctcctctgctgatccctcacctcgaaacctgcttgccactagaccgccccagggtatcarcttagttctcttttgagcagagtcttgctctgttgcccaggctggagtgcagtagcactatctcagctcactgcaacctctgcctcccagttcaagctat

SEQ ID NO: 28053 - DNA, 201 bp, Homo sapiens
gggcagcagcacgtgacgcagtccatcatgcctctggcctaattcacttgcttccctggacttccccgacaccatccacacctgcttgtcccccgacctgkggggttgtccctcttcctctcctctgctgatccctcacctcgaaacctgcttgccactagaccgccccagggtatcaacttagttctcttttgagcagag

SEQ ID NO: 28054 - DNA, 201 bp, Homo sapiens
ctgggtgacagagtgagactcggtctcaaaaaaaaaaaaaaaaaaaaaactgtatgtgaagagttgctggttcccctcgcccccacccatcactctcccaraagcctcccatgggtgacactaatggccagaggtcccctgacagggcagcagcacgtgacgcagtccatcatgcctctggcctaattcacttgcttccct

SEQ ID NO: 28055 - DNA, 201 bp, Homo sapiens
atttaacttacacaatatgtgctttgcttttttcctaatttgcaacagaaaatagtaatcagctggtagtttcagaaatcacccttttgctgagtcttaawtttttttttattccagggaaacgtgaagattgtggggcgctatttttttttttaaagcaaaccacacagcatatctggccacctaaaacacaaagtgttt

SEQ ID NO: 28056 - DNA, 201 bp, Homo sapiens
accttgctacccttactacaaaactggatgtgaatgccgaaaccctgtctctaccaaaaaatataaaaattagccaggtgtggtggtgcatgcctatagtyccagctactcaggaggctgaggcacaagaatggcttaaaaccgggagagagaggttgcagtccagcctgggtgacagagtgagactcggtctcaaaaaaa

SEQ ID NO: 28057 - DNA, 201 bp, Homo sapiens
aaaagacattggtgatactattgagggcagtctcagtcccatggtatggaaggttgtcagcatacaataaagtgcggaagtgaggaaccagtaacaacaamagcagaatgactcctcctgaggtttggaaaaagatgtgcaagatccaatgtgatcaggcccctgcatagttttctacacatttcttaccctaccacctct

SEQ ID NO: 28058 - DNA, 201 bp, Homo sapiens
cattctctctcagctggggaccttacttcctacttaactcaaaagcagaaatgatcatgaaacgtgcacaagctcccactgcctcatcatcctacctccgkgcacctctgtacacttctattttttttccatttctatgctgaaccctctggcaccaaccgaggccaacacctccattggacccgaccctcttgttcactc

SEQ ID NO: 28059 - DNA, 201 bp, Homo sapiens
cttttcactttttctttgaacttatgatcgctcctccccattctctctcagctggggaccttacttcctacttaactcaaaagcagaaatgatcatgaaaygtgcacaagctcccactgcctcatcatcctacctccgtgcacctctgtacacttctattttttttccatttctatgctgaaccctctggcaccaaccgag

SEQ ID NO: 28060 - DNA, 201 bp, Homo sapiens
tagggtgaacaggcatcattctccaggcgactccaggacagagaaagcaagggacaagtcactcgctcagcctgggtggcactgacacttgtggaagcacytcttttttttggagacagggtctctctgtggcccaggctggagtgcagtggcgcaatcttggctcactgcaacctctgcctcccaagttcaagggattct

SEQ ID NO: 28061 - DNA, 201 bp, Homo sapiens
tatgcagagacactagggagtaaaagccagagaatacagagaggacgtttttacctttagggcctgcgtctctggctttggccatcagggtcaaagagtargagtgaggaaggaagggatgggacagcatccctgggacgttcaagtaccatcctggtctcccttctccagccttagagagtggaccagccagagcacctc

SEQ ID NO: 28062 - DNA, 201 bp, Homo sapiens
ctctagttgcgttcctggaggagaggcgatgatctccctgttcaattaaatattaaaaaaaccttctggccaggcacggtggctcatgcctgtaatcccarcactttgggagacagaggtgggtggatcacctgaggtcaggggtttgagaccagtctggccaacatggtgaaaagtctctactaaaaatacaaaaattag

SEQ ID NO: 28063 - DNA, 201 bp, Homo sapiens
gcagctcacgcctgtaatcccagcacttagggaggccaagatgggtggatcacttgaggtcaggagttcgagagcagcctggctaacatggtgaaacctcrtctctactaaaaatacaaaaattagtcgggcatggtggcgggcgcctgtaatcccagctacttgggcagctgaggcaggagaatagtttgaacctgggag

SEQ ID NO: 28064 - DNA, 201 bp, Homo sapiens
ctcctgagtagctgggaccaccagtgtacaccatcaggcctggctaatttttgcattcttgtagaggccaagtcggggcagggggtttcaccatgttgccygggctggtgtcagactcctgagctcaagtaatctcccaccttggcctcccaaagcactgggattacaggtatgagcacccggccaaaagagaaggcagtt

SEQ ID NO: 28065 - DNA, 201 bp, Homo sapiens
tatgaggctgctggggctggagcagagagaagggggagaatgtaggaggtaggagtggaggcccaagagggagagcgttggttttcctgtctcctacaccycttcactggccagttctgctttcatgtttttatttattatatattttttgagacagagtttcactctttcacccaagctagagcgcagtggcacaataat

SEQ ID NO: 28066 - DNA, 201 bp, Homo sapiens
tggaagtaagctgggttctctgtctgcagacgtactctggcctcttctgcgtggtggtcaacccctataaacacctgcccatctactcggagaagatcgtygacatgtacaagggcaagaagaggcacgagatgccgcctcacatctacgccatcgcagacacggcctaccggagcatgcttcaaggtgagtgaactcagg

SEQ ID NO: 28067 - DNA, 201 bp, Homo sapiens
ggtgagtgaactcagggctgcacggggccagctccagggagcccctcctgtcctgcttgtctgcagttcttgccaggaatgtggagtttggcaggcactgygagggaccaggagttactgtggctgaaaaagggaaaaagcaaaaggaacatctgtgtttgcagcctgggagggtgagggagagccaagagcttgggcaaa

SEQ ID NO: 28068 - DNA, 201 bp, Homo sapiens
tctgtgtttgcagcctgggagggtgagggagagccaagagcttgggcaaatacgggcatgggcccgctccagctccagctccggggctcgctgcccaaggkccccgtcgggccagctgtctgcaaaggatggaaagagggtggggaacagccctggggctgagccattgtggtctgtgttgacacctacctgtccctcaac

SEQ ID NO: 28069 - DNA, 201 bp, Homo sapiens
tgtaatccctgctactctggaagctgaggcaggagaatcgcttgaacccagggtggggtggaggttgcagtgagccaagattgcgccactacaccccagcytgagtgatggagtgaaaaccctgtctcaaaaataaataaaatgaggattgtacagtgaggctaaatgccagatgcctgcaggttccctacccctccctga

SEQ ID NO: 28070 - DNA, 201 bp, Homo sapiens
ctaatttttccatttttagtagagatgcagtttcgccatgttggccaggctggtctcgaactcctcacctcaagtgatccacctgccttggcctcccaaakctacttatttctgaaacagggtctcactttgttgcccaggctggagtgcagtggtgtgatcatagctcactgcagcctccaattcctgggctcaagcaag

SEQ ID NO: 28071 - DNA, 201 bp, Homo sapiens
acagtgagtgagactccatctcaaaaaaaaacaaaaaacaaaaaaatcacccttagtcacaccagttaacattcttgagaaattccttcctgtctgtgtgkgtatcagtcagtccccaagctccaattcccaagtatgtgtgtgtatcacttttgtgttaaattttaaaaataaaattgatcagattggttttcaattgaa

SEQ ID NO: 28072 - DNA, 201 bp, Homo sapiens
tgacacagtgagtgagactccatctcaaaaaaaaacaaaaaacaaaaaaatcacccttagtcacaccagttaacattcttgagaaattccttcctgtctgkgtgtgtatcagtcagtccccaagctccaattcccaagtatgtgtgtgtatcacttttgtgttaaattttaaaaataaaattgatcagattggttttcaat

SEQ ID NO: 28073 - DNA, 201 bp, Homo sapiens
aattcctgacttcaggtgatccacccatctcggtctcccaaagtgtcaaaattcacttaaaccccaagaaacaaaccaaaaaaaaaaaaaaaaaaaaaaarggtggcagtttttttctcttctgagacaacgtcgtgctgtcacccaggatggagtgcagtgttggaatctcagctcactcagcctcaacctcccaggctg

SEQ ID NO: 28074 - DNA, 201 bp, Homo sapiens
ggtggcgcatgcctgtaaatcccagctactcaggaggctgaggcagtagagtcacttgaatctgggaggcagaggttgcagtgagctgagatcgcaccatygcactccagcctgggtgacacagtgagtgagactccatctcaaaaaaaaacaaaaaacaaaaaaatcacccttagtcacaccagttaacattcttgagaa

SEQ ID NO: 28075 - DNA, 201 bp, Homo sapiens
gcatacctggcggggagcatggctttgacgcctggtcctaagggtcccttggtcttctgaatgctgtcttttggctgagttcgtctgcctcgagttagttmgttcgttcctcccttccttccttccttccttccttcctccctccctccctccctctctctttcttcctttctttctctgtctttctgtcttcttttttct

SEQ ID NO: 28076 - DNA, 201 bp, Homo sapiens
gaaggctcatttccgggcatctctctggggcctccccttcctgaagagcaccttggtttttgcagtgcggctaaagaaggaagagaagagccgacaggagmtggagaagctgaaacggaagctggagggtgatgccagcgacttccacgagcagatcgctgacctccaggcgcagatcgcagagctcaagatgcagctggc

SEQ ID NO: 28077 - DNA, 201 bp, Homo sapiens
ctatcctaagaaaatcgtcttagccaggtgtggtggctcatgcctgtaatcccagcactttgggtggccaaggcaggaggatcacctgggttcacgagttygaaaccagcctggccaacatggcgaaaccctatctctactgaaaatacaaaaattagccaggtgtggtggtgggcacctgtaatcccagctactcaggag

SEQ ID NO: 28078 - DNA, 201 bp, Homo sapiens
ccatatctctgaaaacaacacttgatcattgtgctgctatcttaattttgttttcaattttaggtatcatctattgactttcctccatgaaagatgaaatktagctcattcaccctctggatttgcccctatttcctcgttccaacacacatgcctcatatcagagtcccagtataattttatcttagttttgacaaactc

SEQ ID NO: 28079 - DNA, 201 bp, Homo sapiens
ccagggatgccctaagcattgtacaatgcacaggatggtccctcaacccccagcacagaatccctacaagatgccagtagtgctgaggttatgggagacayggggagaggtaaacatacagctgatgatggtgatggaatgtggtcagttaggagaacaccaaagagccagggctcctcccacagcctcaggactcagaga

SEQ ID NO: 28080 - DNA, 201 bp, Homo sapiens
tcttggcccttctaggcagggcctgccattacctccaaagaccagcaggtggagccttgcaaaggcaatcttggagctgtaatctcaggttgtaaagtgayggctcctggagtcaggtatctgtctttttttttttttgagacggagtctcgctctgtcgcccaggccggactgcggactgcagtggcgcaatctcggctc

SEQ ID NO: 28081 - DNA, 201 bp, Homo sapiens
aaccccatctctactaaaaatacaaaaactaactgggcgtggtggtggtaatcccagctactcgggaggctgaggcaggagaactgcttgaacctgggagrcgcaggttgcagtgagctgagattgtgccattggactccagcctgggcaaaagagcaagactctgtcttgaaaaaataaaactaaaaataaaaaataaaa

SEQ ID NO: 28082 - DNA, 201 bp, Homo sapiens
accagtgatgctcaaactcaagcaggcatcatgaccccctggaaggctttgtttatttatttagggacagagtcttgctttgtcacccaggctggagggcrgtggtgcaatcttggctcactgcagcctccaccttctgggttccagtgattttcctgcctcagcctcccaagtagctagcattacaggcacacaccacca

SEQ ID NO: 28083 - DNA, 201 bp, Homo sapiens
actttgggaggctgagatgggaaaatcacttgaggccaggagttggaggccagcctagccgagagagacccccgtctctataaaaaaaaggtgtttttttkttgttgttgttagtaagccaggcaggatagtgcacacctgtactcccaacctcttggaaggctaaggcaggaggatcatgtgagccaggagttccaggct

SEQ ID NO: 28084 - DNA, 201 bp, Homo sapiens
gacacccaggtgagtgtcctgccacatcatccaggggacctggggggtggccttcctcggggcaggtccctgggacctctttgcatcccttttgcaggagytgcttcaagaagaaacccggcagaagctcaacgtgtctacgaagctgcgccagctggaggaggagcggaacagcctgcaagaccagctggacgaggagat

SEQ ID NO: 28085 - DNA, 201 bp, Homo sapiens
ccattggggctcaaataagttcttagaaccacagagtctagggccagggtcccaactcataggtgacggagttcccttcaagccacagattctgttttttktgtgtgtgtgtgtgtttttttttttttttatcagagtcccatacctcacgggtattttctcaatcagtgaacacctcaagtactagcccatgtgttttga

SEQ ID NO: 28086 - DNA, 201 bp, Homo sapiens
tggcgtgatcttggctcacagcaacctccacctcccaggttcaagtgattctcctgcctcagcctcccgagtagctgggataacaggcatgtaccaccatrcctggctaattttgtatttttagtagagacagggttttgtcatgttggtcaggctggtctcgaactcctgacctcaggtgacccggggagcctcggcctc

SEQ ID NO: 28087 - DNA, 201 bp, Homo sapiens
ggatccatttagtgggatcaggtcccagtcaataccattggggctcaaataagttcttagaaccacagagtctagggccagggtcccaactcataggtgayggagttcccttcaagccacagattctgttttttttgtgtgtgtgtgtgtttttttttttttttatcagagtcccatacctcacgggtattttctcaatca

SEQ ID NO: 28088 - DNA, 201 bp, Homo sapiens
catcaacatgccttggctgttattgtataggcccttgccctgtggctctcaagagtcctggataatgtacaaaggacatagcttagtctggcttgcagaaytgtagtattctattgactcctcagtacctccactgcatcatgggcacaaacaatgctctctaccagggcctggcaacagagtccgatctggcccacagct

SEQ ID NO: 28089 - DNA, 201 bp, Homo sapiens
tcctcttttttcttcctttttttcttccctaccctctttcccttccctttccttctctgccattgctttttttttttttttttttttttttatgacatggkctgactctgttgcccaggctggagtgcagtggcacaatcttgcctcactgcaacctccacctccctgcctcaagtgatcctcccgcctcagcctcccaag

SEQ ID NO: 28090 - DNA, 201 bp, Homo sapiens
catccagctgtcattccattcattcattcattcattcatctgtccatgcatccacccatccatctctttatccctcatttattcaatactagaatattcasagtcccatgtcaggttttgtttgtttgtttgttttttgtttttgagccagagccttgctctgttgcccaggggggggtgcagtggtgccatcgcagctca

SEQ ID NO: 28091 - DNA, 201 bp, Homo sapiens
gaaggcggaggttgcagtgagctgagatcgcgccactgcactccagcctgggcgacagagcgagactctgtctccaaaaataaataaataaataaacaaayaaataaataaataaatctatctatctcagggactttacatactttaccttatttagtcctgggtaccaacaaggtaccgaagagctgaccctttttaaag

SEQ ID NO: 28092 - DNA, 201 bp, Homo sapiens
caagagatggggaaaaaaaaatcctaaaatcactctatttactctgccttgcacatgcaaagcagcatgtaatgctattttcatgttaagggaccagctcrtggtcacaccactgcacttcagcccgggcgacaggaagactgcatctcaaaataaaagaagagcatttaggttgactctagcattttgctattgcaaaca

SEQ ID NO: 28093 - DNA, 201 bp, Homo sapiens
tgaacccgggaggcagaggttgcagtgagccgagatggtgccgttgcactccagcctgggcaataagagcgaaactccatctcaaaaaaaaaaaaaaaaaraaaagaaacattaaaaaatttattagctgggtgcgtgggctcacacctgtaatcccagcactttgggaggccaaggtgggtggatcacctgaggtcagga

SEQ ID NO: 28094 - DNA, 201 bp, Homo sapiens
gaagttcttgaggcaggaatccaggtgtgcctgagagatgccacgaccccgcccccaaggtagagggactcaggtataagtgccccaactttctgacagtkagccagactccacaggtaggaccagaatcttggcccttctaggcagggcctgccattacctccaaagaccagcaggtggagccttgcaaaggcaatcttg

SEQ ID NO: 28095 - DNA, 201 bp, Homo sapiens
cccagggatctgagttgggagttgagaggagcccaattctggaagttcttgaggcaggaatccaggtgtgcctgagagatgccacgaccccgcccccaagrtagagggactcaggtataagtgccccaactttctgacagttagccagactccacaggtaggaccagaatcttggcccttctaggcagggcctgccattac

SEQ ID NO: 28096 - DNA, 201 bp, Homo sapiens
ctcgaaaactcacaccccctctgaaagggcaccaacaggtgggaacccagggatctgagttgggagttgagaggagcccaattctggaagttcttgaggcmggaatccaggtgtgcctgagagatgccacgaccccgcccccaaggtagagggactcaggtataagtgccccaactttctgacagttagccagactccaca

SEQ ID NO: 28097 - DNA, 201 bp, Homo sapiens; identical to SEQ ID NO: 5055

SEQ ID NO: 28098 - DNA, 201 bp, Homo sapiens
taaatgtaaccccccaaattaggccacattcacaggttccaggtggacatattttagaaagaccaacattcaacctaatataggtggcttccactctttaycacctactaggccaggcccttgctcagcatcttacaagacctaaacttcacgaagcaggtactactgttaccatctccgttttgcagatagggaaactga

SEQ ID NO: 28099 - DNA, 201 bp, Homo sapiens
tgacctcatgatccgcccgcctcagcctcccaaagtgctgagattacaggtgtgagccaccatgcccagccgagttgttccttttgactaaagaattggtyactgagttgtgttcatccttatggcttcttatccaacccttgcgtggggagcaaaagtctgctctcttctttgatgtcctaaaataagacctgtcttccg

SEQ ID NO: 28100 - DNA, 201 bp, Homo sapiens
gtctcgccatgttggccaggctggtcttaaactcctgacctcagatgatccacccatcttggcctcccaaagtgctgggattgcaggcatgagccaccgtrcctggcctggggttttttgttttgttttggtttgatttttggaggggtgggtagagacaaggcttcaccatgttatccagtattctctggtcttgaactc

SEQ ID NO: 28101 - DNA, 201 bp, Homo sapiens
agcacatgtgacatgacacccaacagtgtgcgcccttatcactgcatcttgacgagatggcagaggctgtgtgtgtagcttggatttttcttcctttcatrccaaaagccactcttacgtggttagggcactcagcagtgctgtcctcccttgtccagtgaagacactgcactgaatgaatatgacagttccactatctgg

SEQ ID NO: 28102 - DNA, 201 bp, Homo sapiens
tgggtctcgccatgttggccaggctggtcttaaactcctgacctcagatgatccacccatcttggcctcccaaagtgctgggattgcaggcatgagccacygtgcctggcctggggttttttgttttgttttggtttgatttttggaggggtgggtagagacaaggcttcaccatgttatccagtattctctggtcttgaa

SEQ ID NO: 28103 - DNA, 201 bp, Homo sapiens
agtggcatgattacaactcactgcagccttgacctcctgggctctagccatcttcccgtcttagcctcctgagtagctggaaccgtaggcatgcaccaccrtgccaggctaatttttaatttttttacagagacaggggcttcttatgttgcccaggttggtcttgaactcctggcctcaagggatcctcctgtctcagct

SEQ ID NO: 28104 - DNA, 201 bp, Homo sapiens
ctgttccccttcgagggcatttggctccccgcccgcccctgtctgacccctggtggggccctccaggagtgaagtgcacagctggaaggttaagagagaasgaaaggggcgggtgtttttgcaacacactcccccctccccggccgttttgcattctcctcggccttttagcaacacatagggtgtagtctcagggttgac

SEQ ID NO: 28105 - DNA, 201 bp, Homo sapiens
cgcagcatccctccagcaccgcggatccaggaggtgcgaagggtcagacacacctgggcacaagtcccagccccaaacttcctagatgccacagagtgggmcaagtcccttaaccttctggggcatgggctctttacctgcagaatgggactcatcatagctcatggggtgcacgaggctgtcatgaggattaaataagat

SEQ ID NO: 28106 - DNA, 201 bp, Homo sapiens
acagtgttgggtttacaggtgtgagccaccttgtccagccctacttcctgcctcctgagcactgggtagtatttcacagtgtggaaatagcatggcttatrtatccagctgtatgttggtggacatttgggttgtctgacttttggtattttaggcgatgacacacatccctttctgaagggcctttgggtggtctctgtt

SEQ ID NO: 28107 - DNA, 201 bp, Homo sapiens
tgggaggcagaggtgcatcacttgagtccaggagttcaagaccagcctgggcaacatagcgagacccctgtttccgccaaaaaaaaaaaagcctggcctgrtgaagcacacctatagtcccatctacttgggaggctgagccaggatgatcgcttaagcccaggagtttaaggcggctgtgcactatgatcacgcctagga

SEQ ID NO: 28108 - DNA, 201 bp, Homo sapiens
cctgaccaacatggagaaaccccgtctctactaaaaatacaaaattagctgggcatggtggtgcatgcctgtaatcctagctactcgggaggctgaggcargagaatcgattgaacccaggaggtggagcttgtggtgagccgagatcatgccattgcactacagcctgggcaagaagagcgaaactccatctcaaaaaaa

SEQ ID NO: 28109 - DNA, 201 bp, Homo sapiens
aggcaagtggatcacctgaggttgggagttcgagagctgcctgaccaacatggagaaaccccgtctctactaaaaatacaaaattagctgggcatggtggygcatgcctgtaatcctagctactcgggaggctgaggcaagagaatcgattgaacccaggaggtggagcttgtggtgagccgagatcatgccattgcacta

SEQ ID NO: 28110 - DNA, 201 bp, Homo sapiens
ctgggcaacaagagtgaaactccatctcaaaaaaaaaaaaaaaacaaaacaaaaagcaccacccactagaggcacaaagagttcaaagatcacgtctgccscacaggcccttccagagatgagcatgggcctggggtctggagtccctcattgcagggttccttcttccagccaagcatgccatgcctgtgttggacgcct

SEQ ID NO: 28111 - DNA, 201 bp, Homo sapiens
ctgcctcagcctcttgagtagcttagactacaggtgtgcactaccatgtccaatgaattttttatttttatttttttgtagagacagagtctcgctatgtygcccaggctggccttgaactcctggtctcaagcaattctccctcctcagcctctcaaagggctgggattacaagtatgaaccaccatgcctggccagaaa

SEQ ID NO: 28112 - DNA, 201 bp, Homo sapiens
gagaatctaatgctgctgctgatcttatgggaagcggagctcagacagtgatgcaagcgatgggcagcagctgcaaatagcggataaagcttcacttgctyacctgctgctcacctcctgctgtgtggcccagttcctaacatggaccggtactggtctatggcctatgggttggggaacccttggcctatgatatgtaat

SEQ ID NO: 28113 - DNA, 201 bp, Homo sapiens
taaagggtcagtagtaaacgttttagactttaaggaccagatggcctctgttgcaactactcaactctgttgcctagtgagaaagcagccatgagaaataracaaggacatcagagcagctgtgtttcaataaaactttatttacaaaaacaacaggggaccagatttgccaacctgtgatataagccttatatattgatt

SEQ ID NO: 28114 - DNA, 201 bp, Homo sapiens
ttcagctgttaacaaatgggtgaagtgggccaagtacagggagaggcagatgacactaaggtctccgtgtcacggatatggggattgggggaaactcaacratgtgtgttctaaacaaccactactcaggttttttattttttaacttttgctctgtcacccaggatggagtgcaatggtacaatcatagctcactgcagc

SEQ ID NO: 28115 - DNA, 201 bp, Homo sapiens
gctggtgcaggggttaaatgaaataatatgcataataatatgcacagcccttggtacggtactgggcccaaagtgagcatctcataggtggtggctattgygttaactcaatgttttctacgtttctactttaatctgcccaaaccagccaggattcccatcctgcagctaggagggctgtcaggcttcggtcaagtccag

SEQ ID NO: 28116 - DNA, 201 bp, Homo sapiens
tgcactctagcccaggccaacgcttaaaaaaaaaaaaaaaatcaccagcctggggcaacatggcgaaaccaaaatacaaaaattagcccggcatagtggtrcacggctgtagttccagctacttgggaggccaaggcgggcagatcacttgaggtcaggagtttgagaacagcctggccaacacggtgaaacccccgtctc

SEQ ID NO: 28117 - DNA, 201 bp, Homo sapiens
ggcgccgctgttccccttcgagggcatttggctccccgcccgcccctgtctgacccctggtggggccctccaggagtgaagtgcacagctggaaggttaakagagaaggaaaggggcgggtgtttttgcaacacactcccccctccccggccgttttgcattctcctcggccttttagcaacacatagggtgtagtctcag

SEQ ID NO: 28118 - DNA, 201 bp, Homo sapiens
aggcacagagtggctcacacctgtaaacccagcaccttgggaggctgagttgggaagatcacctgaggtcaggagtttgagaccagcctggctaacatggkgaaaccctgtctctactaaaaatacaaaaattagctgggcgcagtgacacatgcctgtattcccagctactcgggaggctgaggtgggagaattccttga

SEQ ID NO: 28119 - DNA, 201 bp, Homo sapiens
gcatatcaatgctcgggccaggccacaccaacagaagacacagtaagagacagacacttaggtctatccacggcgacagctacaaatacaaggaaaagggwcaagttcaggcactgatgatgttggcatgggattttccagaatggcaactgactctcagtgaagcgctgaaccaaagaacaatcttctctagagtcacac

SEQ ID NO: 28120 - DNA, 201 bp, Homo sapiens
ctctactaaaaacacaaaaattagccaggcatggtggtgggcgcctgtaatcctagctactcaggaggctgaggcatgagaatcggttgaacccgggaggyggaggctgcagtgagccaagatcctgccactgcactccagcctgggcaatgaagcaagactttgtctcaaaaaaaaaaaaaaaaaaagtaaaaaggaaat

SEQ ID NO: 28121 - DNA, 201 bp, Homo sapiens
tttctttgatttactcaacgatactattttagaattgttcagagacggaacttgacgctgaactgaaagtcattaggtggcagggtgtgaaataagatagrgaattttgtttgaaggaaattgatgttttccctttgagatagctaccgttgatggaacacttcagtgccacatgctgttgcaacatttaacttaatttat

SEQ ID NO: 28122 - DNA, 201 bp, Homo sapiens
atgaagaagaaataacataagacaattcataatgaaagtgtgcatttcaggccaggcgaggtggctcatgcccgtagtcccagtactttgggagactgagrcgggcagatcacttgagctcaagagtttgagaccagcctgggcaacatggggaaaccccatctctacaaaaataaataaataaagtgcatttcagcatat

SEQ ID NO: 28123 - DNA, 201 bp, Homo sapiens
aagaaaaatatacatataaagaaaatgtggtcaagctcgttggctcagccctgtaatcctaaagaggccgaggcgggaggatcacttgaggctaggagttygagaccagcctggccaacatggcaatatcccgtctctactaaaaacacaaaaattagccaggcatggtggtgggcgcctgtaatcctagctactcaggag

SEQ ID NO: 28124 - DNA, 201 bp, Homo sapiens
ctgagagattaaatggtgaactgtccgtccggggtttggcaaaaagaatgcaggctattaataaactgctttgcatagttttttgtttctttgatttactyaacgatactattttagaattgttcagagacggaacttgacgctgaactgaaagtcattaggtggcagggtgtgaaataagatagagaattttgtttgaag

SEQ ID NO: 28125 - DNA, 201 bp, Homo sapiens
ggaggggaggacaaggagaaaaactcccagaatccagggcctggaggcctcggggcccaactgcagccgccatgttttagggctaggccaagagcagctcrtttgctttcccagcttaacttaccacattggccctttcctgccatgattaatcacgtgaccgcgtttgtgcaaaggcatcccggcagagggggccggtgg

SEQ ID NO: 28126 - DNA, 201 bp, Homo sapiens
acgtccagctaattttgtagttttagtagacacagggtttcaccatgttggtttggccaggctggtctcgaactcctgacctcaagtgatccacctgcctyggcctcccaaagtgctgggattacaggcgtgagccactgcgcctggcccccctcggaattttatttggccctaaccactctgtgacgtttctggacagga

SEQ ID NO: 28127 - DNA, 201 bp, Homo sapiens
atgtaagaaaactaaggttttcttgttcactctatttttttagagatgaggtcttgctctgtcacccaggctggagtgcagtggtgtgatcatggctcacygtggcctcaaactcctgggctcaagccatcctcccacctcagcctcctgagtagctgggactacaggcatgcaccaccaagcctggttaatttttcttat

SEQ ID NO: 28128 - DNA, 201 bp, Homo sapiens
ttccagcacagggtctggtagggattttgccacttgagaaaaggtaccatccaaagccatgcttgtcaagaagtaaaagaaaatatttagaaacccaaggygggagtgtttagttgcagtatgaagaactgagagattaaatggtgaactgtccgtccggggtttggcaaaaagaatgcaggctattaataaactgctttg

SEQ ID NO: 28129 - DNA, 201 bp, Homo sapiens
gtgaacaaattcttttttcaacttaaaaaaaaaactctcttatattttagagtattaagtgagctcagaaaataaaagagataaggcaaagaaaggaaacmcaaaaaacaaaagtaaactgaaaaatagaagaagacgataaacaagtgaagttttggtcaaggcactgtccttatctttcactaggagtggtggaacata

SEQ ID NO: 28130 - DNA, 201 bp, Homo sapiens
agaatcacgggaaaccaggaggtggcggttgcagtgagccgagatcacaccactgcactctagcctaggcgacagggcaagactccgtcttaaagaacagrcaaacaaacaaacgacattatgcagaggactaaatgacttaacagcatttgtaaaaacgtttagaacagaaatttgaacttagtaagtacaatatatgta

SEQ ID NO: 28131 - DNA, 201 bp, Homo sapiens
cccgtctctactaaagatacaaaaaattagccggatgtggtggcacgcacctgtaatcccagctactcaggaggctgaggcaggagaatcacgggaaaccrggaggtggcggttgcagtgagccgagatcacaccactgcactctagcctaggcgacagggcaagactccgtcttaaagaacagacaaacaaacaaacgac

SEQ ID NO: 28132 - DNA, 201 bp, Homo sapiens
tgctagacatttcaaaaattgtttgcaaacattatcttctttaagctgtgtgactgtaagagatggctaaacaggacaaccactctgtttcttggaagcaraaacaccgtatgccttggccatctctaaatgtgcatgtgagcagcagaggcaaactagatccaagttcaagggatctttgcattcaagtccaaggcttcc

SEQ ID NO: 28133 - DNA, 201 bp, Homo sapiens
cagtgtgagtcactgcacccggccaagaataaaaatcttcaccaccagcctggcttatgtgaaaatggagcccattgagaataaccgggttcccctggttsccctctgcaggctgactttgctgtagaggctttggccaaggcaacatatgagcgccttttccgctggatactcacccgcgtgaacaaagccctggacaag

SEQ ID NO: 28134 - DNA, 201 bp, Homo sapiens
gatccttccgctgcagcctctcaaagtgctaggattacaggcatgcccagccactttggggcttttttaagccaacagcaaaaaaagactataagagagaratttccccttggctgtcttgtttcatggattcgtggaaactcccattaaacagccggtcacagaaaaagatatgccaaggaaaattacttgacagcactc

SEQ ID NO: 28135 - DNA, 201 bp, Homo sapiens
gtcttcctcctgtcccttttctcaatacttcaggctcaggcctgtttgttggttttttttgtttgttttgttttgtttttggagtctcgctctgttgcccmggctggagtgtagtggcatgatctcacctcactgcaacctccacctcctgggttgaagtgattctcctgcctcagcctccggagtaccttggattacagg

SEQ ID NO: 28136 - DNA, 201 bp, Homo sapiens
agttcaagaccagcctggacaacatggtgaaaccccgtctctaccaaaaatgcaaaaaaaaattagccgagtgtggtggtgcgttgtctataatcccagcyactcgggaggctgaggcaggagaatcgcttgaacccaggaggcggaggttgcagtgagcagagattgtgccactgttctctagtctgggcgacgaacaag

SEQ ID NO: 28137 - DNA, 201 bp, Homo sapiens
ggcatggtggcgtcgcctgtagtcccagttaggaggctgagatgggaacaccatttgagcctgggaggttgaagctgcagtgagccgtgattgcatcactrcactccaacctgggcaacagagtgagacccagctatctcaaaaagcaaaaaaaaaggaatctcaatgacttctgttgtttgtgcccacaacaatgggaga

SEQ ID NO: 28138 - DNA, 201 bp, Homo sapiens
agagagtcaccagcccggctcacagagtgagacctggcctctacaaaaaataaaaactagcagggcatggtggctcttgcctgtagtcctagctactcgcraggctgaggtgggaggaccattcgagcctgagaggtcgaagctgcagtgggctgtgaaggcaccactgcactccggcctgggcaactccctgctgcctca

SEQ ID NO: 28139 - DNA, 201 bp, Homo sapiens
gagatctgccggtagccttcagagtgctgcacttcaaacttctcctgaaggacaacacagacactgagtgaatgacttaagacttctgagaaggctagacrcagtagcacacatccacctggagtcacagctactcgggaggctaaactgggaggactgcctgagcccaggagttagaggctgcagtgagctatgactgta

SEQ ID NO: 28140 - DNA, 201 bp, Homo sapiens
gaaagattattacaataaatacacaatgcaatacaataaatgaccaatgcaaatagtttctccatagagttatgcagtgtacaacatgcaccacggtccayggccatcctgcaggtaggaggtcaagtggaaaggtctccaactcagctctagaaaagtgcagagttagagaaggtatcatagaagagttgactcccaaga

SEQ ID NO: 28141 - DNA, 201 bp, Homo sapiens
accacctaagaaaaccaaataaatcaagaacataaaagaattcatcatctctggctgggtatggtggctcaagcccgtaatcccagcactttcggagaccraggcaggcagatcacctcaggtcaggagtatgagaccagattggccaacatggtgaaatcccatctctactaaaaatacaaaaattagccgggtgtggta

SEQ ID NO: 28142 - DNA, 201 bp, Homo sapiens
tcaacctcgtaagggccatggtgggggcagagttgtgatttggatctctctctgccttatcgtcttagattatcctagactttccccaaacagcatttctyaagattgccagtgagaagtaccattttgggggtgcttattaacgatatcaatgcctggacccaactccatttcccaactctagaatccccagaaaaactg

SEQ ID NO: 28143 - DNA, 201 bp, Homo sapiens
gaacctgggaggtagaggttgcagtgagccgccatcacacactgcactccagcctgggcaatagagcaagagtcagtctcaaaaaaaaaaaaaaaaaaagwaaagaaaaaaaatgcagagcgtttataaagaattaggaagaatttccagatggcaacattagagtatgaagcacagggtggtccctgtgagacggtacag

SEQ ID NO: 28144 - DNA, 201 bp, Homo sapiens
aaaagtcctatagggtattctataggggctggggtgcacttaggggtccctgttgtcaacctcgtaagggccatggtgggggcagagttgtgatttggatytctctctgccttatcgtcttagattatcctagactttccccaaacagcatttcttaagattgccagtgagaagtaccattttgggggtgcttattaacga

SEQ ID NO: 28145 - DNA, 201 bp, Homo sapiens
atactgtttgccctgcctggcccacccttccctccatccttcccacagggctctcttgtaactttcaaggctcagcaactccctggcttccccatccacascctcccctctcctcccttcccctcgatcttctcagtcacatcacccagatgtagcaatgatatctccaccacgaactatcttgattatttgtttacttgg

SEQ ID NO: 28146 - DNA, 201 bp, Homo sapiens
aacaaatgatgggctaaccgtgtgtgtgcaggtgaagccactgctgcaggtgacacggcaggaggaggagatgcaggccaaggaggatgaactgcagaagrccaaggagcggcagcagaaggcagagaatgagcttaaggagctggaacagaagcactcgcaggtacctgtatggatgcatggctggggttgctggggaac

SEQ ID NO: 28147 - DNA, 201 bp, Homo sapiens
atttttttgttgagacagagtctcactctgttgcccaggctggagtgcagtggtgcgatcttggctcactgcaacccccgcctcctgggttcaagcaattytcctgcctcagcttcccgagtattatgccatcatgcccagctaatttttgtattgttaatagagatgggttttctccatgttggccagcctggtctcaaa

SEQ ID NO: 28148 - DNA, 201 bp, Homo sapiens
agagtttgctaactcctagcttaaacagtgggaaaatgtgaatattatttatattgtaatgataggatgaatgctgaaaatcattatacaaacaatatatracttctgtggaagcagtggttataaaagtaataataggtgggcacagtggctcacacctgtaatcccaacactttagggggccgaggcaggaggattgcc

SEQ ID NO: 28149 - DNA, 201 bp, Homo sapiens
ggcttcatgacccccgcaccttctcttcccccctccctagggcttttgccaagaggcagcagcagctgaccgccatgaaggtgattcagaggaactgcgcygcctacctcaagctgcggaactggcagtggtggaggcttttcaccaaagtgagtgctctgccccagcccccttcccaggggcccccagccctggttcttc

SEQ ID NO: 28150 - DNA, 201 bp, Homo sapiens
tgatttttttgttgagacagagtctcactctgttgcccaggctggagtgcagtggtgcgatcttggctcactgcaacccccgcctcctgggttcaagcaawtctcctgcctcagcttcccgagtattatgccatcatgcccagctaatttttgtattgttaatagagatgggttttctccatgttggccagcctggtctca

SEQ ID NO: 28151 - DNA, 201 bp, Homo sapiens
atgacttgcctaaggtcacccaggtaactggcagaggagggatttgaacttgagcaacctggtcctggagcccattatgctattctgccaattgatgctayaggggagagaggcgttgcttctgcctggggttttgcaggacgtgtaggagttgtacagtacaaaatgccagggtgctttgccagtcacataaagaccagg

SEQ ID NO: 28152 - DNA, 201 bp, Homo sapiens
gcagaggttgcagtgagcagaaattgtaccactgcactccagcctgggcacaagagcaagactctgtctcaaaaaataaataaataaacaacatgaaaacrtcagaaagttctattgcagtactctctgtggcagaaagcaggcaacatgacttgcaagggttctcttattttatcagcattaagtactgaatttgacctt

SEQ ID NO: 28153 - DNA, 201 bp, Homo sapiens
gtgcgtcagatccgagctcgccatccagtttcctctccactagtccccccagttggagatctgtaagtagtagttgtcattctgggggcagattgcagggsaggggggtgttaaaagtcctatagggtattctataggggctggggtgcacttaggggtccctgttgtcaacctcgtaagggccatggtgggggcagagtt

SEQ ID NO: 28154 - DNA, 201 bp, Homo sapiens
gcccatcctgcagtttgttgttgttgttgatttttttgttgagacagagtctcactctgttgcccaggctggagtgcagtggtgcgatcttggctcactgsaacccccgcctcctgggttcaagcaattctcctgcctcagcttcccgagtattatgccatcatgcccagctaatttttgtattgttaatagagatgggtt

SEQ ID NO: 28155 - DNA, 201 bp, Homo sapiens
acatgggccctggtgtcaagtggacctacgttcaaatcctgcttctcctccatttcctatctgtgtgaaagcaggagcaattgtgggctggagcaatttamttcaaacctctctttgcctcagtttccccggatgggtgatggggataattaataactctctcattagattgctgggtagagtaaatgaaaagatctgtga

SEQ ID NO: 28156 - DNA, 201 bp, Homo sapiens
tagcattaggtatatctcccaatgctatccctcccccctccccccaccccacaacagtccccagagtgtgatgttccccttcctgtgtccatgtgttctcrttgttcaattcccacctatgagtgagaatatgcggtgtttggttttttgttcttgcaatagtttactgagaatgatgatttccaatttcatccatgtccc

SEQ ID NO: 28157 - DNA, 201 bp, Homo sapiens
tcgaactcctgacctcaggtgacccggggagcctcggcctcccaagtgctgggattacaggcatgagccgctgagcctggcccatcctgcagtttgttgtkgttgttgatttttttgttgagacagagtctcactctgttgcccaggctggagtgcagtggtgcgatcttggctcactgcaacccccgcctcctgggttca

SEQ ID NO: 28158 - DNA, 201 bp, Homo sapiens
ctgtgtgaaagcaggagcaattgtgggctggagcaatttacttcaaacctctctttgcctcagtttccccggatgggtgatggggataattaataactctstcattagattgctgggtagagtaaatgaaaagatctgtgagcccaaagcctagtactgtgcaggccttcaacaaatatcaattccccttcccctgccctt

SEQ ID NO: 28159 - DNA, 201 bp, Homo sapiens
atgtgcaggttagttacatatgtatacatgtgccatgctggtgtgctgcacccactaactcgtcatctagcattaggtatatctcccaatgctatccctcycccctccccccaccccacaacagtccccagagtgtgatgttccccttcctgtgtccatgtgttctcgttgttcaattcccacctatgagtgagaatatgc

SEQ ID NO: 28160 - DNA, 201 bp, Homo sapiens
caactaaagctataatcaacagaggttatttaaataaaatatagcatttccaggtagccactacaaagagtgaggctgatctatttatgctgagagagaaygctctttatagataataccgttgagtggaaaacacaggggcaaaccagcatatgcataatgtaaccgtgtgtgtctttaaaaagagcaggattgcatgga

SEQ ID NO: 28161 - DNA, 201 bp, Homo sapiens
ttctcccggccacagcctccctgttatccctcccctctgcttccttcgccaggccaaggcgaacctagacaagaataagcagacgctggagaaagagaacrcagacctggccggggagctgcgggtcctgggccaggccaagcaggaggtggaacataagaagaagaagctggaggcgcaggtgcaggagctgcagtccaa

SEQ ID NO: 28162 - DNA, 201 bp, Homo sapiens
tagtcccagctactcgggaggctgaggcaggagaatagcgtgaacctgggaagcagagcttgcagtgagccgagatcacgccactgcactcaagcctgggygacagatcaagactccatctcaaaaaaaaaaaaaaaaaaaagaaaagagaaaggaacgtggcctgaattagaaagtgagaataggccaggtacagtggct

SEQ ID NO: 28163 - DNA, 201 bp, Homo sapiens
gaatttgcattaatcatcatccatccattcatccatctaccatccatccatcatctgtccatccatccattcatccatccatcatccatccatcaatgctstatccattcctccatcaattctccatccatctatccatcgtctatccatcaatcctctgtccattccatctatccatctatcctctatccatccatccat

SEQ ID NO: 28164 - DNA, 201 bp, Homo sapiens
ttaattcatggctcttttttcttctttctgtttgcagatcgggaggaccagtccattctatgcacgtaagtggaactgctttttcttctgttttttttttktttttttttttttttaatctgtagtcgagatccaacctatgaaagaaaagatccatgagtgcagagatctttgatttgttcatggttccaagtgcctctc

SEQ ID NO: 28165 - DNA, 201 bp, Homo sapiens
tctcctgcctcagtctcccgagtagctgggactacaggcatgcggcaccacacccagctaatttttgtatttttagtagtgacggggtttcaccatgttgsccaggctggtctcgatctcctgactggaggtgatctgcctgcctcggcctctcaaagtgctgggattacaggcgttagccattgtacctggccaaattca

SEQ ID NO: 28166 - DNA, 201 bp, Homo sapiens
ccaaactcgggataatgaagtcttggcaaagacctcaatcctcgtgacttgaatcaggcatttcaagttaatccaaaagtttgagttaactggtgccttcrgtcaatttaacctcgagtttatcaagcagcttccaagtgacttgacccataaaagaccttgattttgaaagaaaaatatcttgctgacgtctctccaaaa

SEQ ID NO: 28167 - DNA, 201 bp, Homo sapiens
atacccacccatctacccatctacacacccttccctcctttcttctttctttcttcctatctatccatccatccttccttctttccatccatctattcgtscacctacccacccacccactcatccatttgtcttcctgtctctctacctgtccatctatccatccttccatccagccatctgtctgcctattcacccagc

SEQ ID NO: 28168 - DNA, 201 bp, Homo sapiens
caccacccactagaggcacaaagagttcaaagatcacgtctgccccacaggcccttccagagatgagcatgggcctggggtctggagtccctcattgcagkgttccttcttccagccaagcatgccatgcctgtgttggacgcctgtctacacctgagcacacttcctctcagcccctcaccttgatggtttccagctcca

SEQ ID NO: 28169 - DNA, 201 bp, Homo sapiens
caacacttgatcattgtgctgctatcttaattttgttttcaattttaggtatcatctattgactttcctccatgaaagatgaaatttagctcattcacccyctggatttgcccctatttcctcgttccaacacacatgcctcatatcagagtcccagtataattttatcttagttttgacaaactcagtgttcagagtttc

SEQ ID NO: 28170 - DNA, 201 bp, Homo sapiens
gtcctccctcccattcacccacccatccactctctcatccactcactcatccttccctcctccgtccaaccatccgtccaaccagctatatacccacccayctacccatctacacacccttccctcctttcttctttctttcttcctatctatccatccatccttccttctttccatccatctattcgtccacctacccac

SEQ ID NO: 28171 - DNA, 201 bp, Homo sapiens
tcagccaggcctggtggcgcccgcctgtagtcctggctactcaggaggctgaggtaggaggatcacctgagtccagaaaggtcaaggtttcagtgagtcaygttcacaccaccgcactccagcctaggtgacagagtgagaccccatctcaaaacaaacacaaaaccccccacagttgcaaaataaaacataggcagcttg

SEQ ID NO: 28172 - DNA, 201 bp, Homo sapiens
acactgtcaagagatcaagaccatcctggaaaacatggtgaaaccccatctctactaaaaatacaaaaattagccaggcatggcggtgtgtgcctgtaatytcagctactcaggaggctgaggcaggagaatcacttgaacccaggaggtggaggttgcagtgagccgggattacgccactgcactccagcctggcaacag

SEQ ID NO: 28173 - DNA, 201 bp, Homo sapiens
tcccacgtacctggaatatcagtgaggcccagggtttccactaagactccaagctccagtttccccatctctaacatgagaatattgagtgcttctgtgcratctgtctaccctggaggaggtctggaagtaagctgggttctctgtctgcagacgtactctggcctcttctgcgtggtggtcaacccctataaacacctg

SEQ ID NO: 28174 - DNA, 201 bp, Homo sapiens
gacagaagggagggagaagatggaggaagggaaagggagagaaaaggagaggagagagacagagagggagatcttgttaattaccaaagaaacagtccagygcacttctcaatgattccctgttgccagctgcagcaataacatccattacatacttattctgtgctggcctccaggctaagtacacttcctatgttgtct

SEQ ID NO: 28175 - DNA, 201 bp, Homo sapiens
tgatggtggctattgatacccaataattggcaaggtgaagccactgaatcgtcggagaaggaggtttcggtggagtttgatcgctcttgtagtcattgaaraatacttttgtgttgtggggacttttgctttcctagaccagcagtccccaacctttttgacaccagggaccagtttcatagaagtcagtttttccatgga

SEQ ID NO: 28176 - DNA, 201 bp, Homo sapiens
tcaggcagtaattggagtgatagggagtggctgtaaatacagatgaagcccactactcacctcctgctgtgcagtaccagtcggtggtttgagatgcctgygctagaccacctcttaactgtgaggcaatgttgtaattgacaaggacaccctgtgttcatatatttgattcctcatggtctctaggttttaacacaaaat

SEQ ID NO: 28177 - DNA, 201 bp, Homo sapiens
agcactttgggaggccaaggtggacagaccgagtccaggactttgagaccagcctaggcaacatggaaaaaccctgtatctacaaaaaatacaaaaattasccaggtatagtggcacatgcctatagtcccagacactcaggaggctgaggtgggagaatcacttgccccaggaggtcaaggctccagtgagctgtaattg

SEQ ID NO: 28178 - DNA, 201 bp, Homo sapiens
gcccagccactttggggcttttttaagccaacagcaaaaaaagactataagagagaaatttccccttggctgtcttgtttcatggattcgtggaaactccyattaaacagccggtcacagaaaaagatatgccaaggaaaattacttgacagcactcagtcaaagtgacattttaaaaagagactattgcctcctccatct

SEQ ID NO: 28179 - DNA, 201 bp, Homo sapiens
acttagaaatgctcacttgacacatagtaagctccaataggaaatgactatcatgattgagcacagcagcatgtcttcagtcctagcactttgggaggccraggcaggaggatcacttgaggccaggagttagagaccagcctggccaacatagtgagctcttgtctctacaaaaaaataattagctggccacagtgcgtg

SEQ ID NO: 28180 - DNA, 201 bp, Homo sapiens
tttattgagattgcatctcaccatgttgcccaggctggctacttaaaaaaaattttttttttcaagacagggtctcactctgccacccaggctggagtacrgtgacagagtctcagctcactgcaacctctgcctcccaggctcaagtgatcttcccacctcagcctcccaaggagctgggattacaggtacccaccacca

SEQ ID NO: 28181 - DNA, 201 bp, Homo sapiens
gccaaggcaggaggatcacttgaggccaggagttagagaccagcctggccaacatagtgagctcttgtctctacaaaaaaataattagctggccacagtgygtgagtctgtagtcctagctactctggaggctgaggcaggaggatggcttgagcccaggacttcaagaatgcagtgtgctatgatcgtgctatggtactc

SEQ ID NO: 28182 - DNA, 201 bp, Homo sapiens
cagtgacagagtctcagctcactgcaacctctgcctcccaggctcaagtgatcttcccacctcagcctcccaaggagctgggattacaggtacccaccacyacacatggctaactttttattttttgtagagacagggtcttgctatgttgcccaggctggtctcaaactcctgagctcaagcaatcctcctgctttggcc

SEQ ID NO: 28183 - DNA, 201 bp, Homo sapiens
acaaaaaaataattagctggccacagtgcgtgagtctgtagtcctagctactctggaggctgaggcaggaggatggcttgagcccaggacttcaagaatgyagtgtgctatgatcgtgctatggtactccagccttggcaacagagtaagaccctgtcacgaaagaaagaaagaaaatgaaaaccgtgaatatgcacatcc

SEQ ID NO: 28184 - DNA, 201 bp, Homo sapiens
caaggagctgggattacaggtacccaccaccacacatggctaactttttattttttgtagagacagggtcttgctatgttgcccaggctggtctcaaactyctgagctcaagcaatcctcctgctttggcctcccaaagtgctaggattacagttgtgagccaccatgcctggccttggccactttagttttgcttttttt

SEQ ID NO: 28185 - DNA, 201 bp, Homo sapiens
atattttgccagaggatgttacatatcagtgcatgtaggaattccttgttcccttttttaaaaaattggtttttatttttgttaaaagtattcatgcagayggcttagagtcaagtaatttttgaaggcttattaagaaaaatagccatcctctgctacttctcaactcctttaattgattttttttttttttggtattta

SEQ ID NO: 28186 - DNA, 201 bp, Homo sapiens
tcattgtgctgctatcttaattttgttttcaattttaggtatcatctattgactttcctccatgaaagatgaaatttagctcattcaccctctggatttgmccctatttcctcgttccaacacacatgcctcatatcagagtcccagtataattttatcttagttttgacaaactcagtgttcagagtttccattattatg

SEQ ID NO: 28187 - DNA, 201 bp, Homo sapiens
atagatgtgttattccgtacaaggtatctgttatggatttgttatcattacttttccgtgggagggcagagattgaggcaaacatgcccatttatggaagygttttccatgaggccatccccggccccctcgtcagttacccagccttgcaccgcagcccggttggtcctggccctggggatttgtctaccatgtccctca

SEQ ID NO: 28188 - DNA, 201 bp, Homo sapiens
cagttacccagccttgcaccgcagcccggttggtcctggccctggggatttgtctaccatgtccctcacccattgaagaactagtggagaaaccctaaggmgaagagatttgggaggaaagtgggattcttttttcctaccccctcttattcagaggtttgatttttttgggtggggggtgggagggaattgtctcctttc

SEQ ID NO: 28189 - DNA, 201 bp, Homo sapiens
tgacagccttttcttgaaggggaagaaatgcttctactttaaataaatgtaccaagttacgagtgcaggaagggaacgagttttagacctgggttctcatygtggatgccccagtttttgctgatgaaccttgggcaagttactctacctctctgagcttccagttttttagctggaaactgagcataatcattttgacct

SEQ ID NO: 28190 - DNA, 201 bp, Homo sapiens
atttttagttacttccaattaggtcctgcacacttttcaaggttattcttatacaaagtgcctgtcctcagttaaaagtgagtagtttcgtttgagggacrtatagaagaaggaccatgagagcaatcaaacagctgatggtgctgagaaactcttgttcttggagaagactgtcaaacgttctaaatataactattaaac

SEQ ID NO: 28191 - DNA, 201 bp, Homo sapiens
tgagacagagtctctctctctctctctgtcgcccaggctggagtgcagtggcgcagtctcaactcactgcaacctctgcctcttggactcaagcaattctygtgtctgagcctcccgagtggctggaattagaggcgcccaccaccacactggcctaatttttgtatttttagtagagacaaagtttcaccatgttggcca

SEQ ID NO: 28192 - DNA, 201 bp, Homo sapiens
ggtgaaaccccgtctctactaaaatacgaaaaattagctgggtgtggtggcgggtgcctgtagtcccagctactcaggaggctgaggcaggagaatggtgygaactcaggaggtggagcttgcagtgagccgagatggcgccactgcactccagcttgagtgacagaccgagactctgtgtcaaaataaataaataaataa

SEQ ID NO: 28193 - DNA, 201 bp, Homo sapiens
gcaatttacttcaaacctctctttgcctcagtttccccggatgggtgatggggataattaataactctctcattagattgctgggtagagtaaatgaaaakatctgtgagcccaaagcctagtactgtgcaggccttcaacaaatatcaattccccttcccctgcccttcttctggccttagaaagcaagtccctagaggg

SEQ ID NO: 28194 - DNA, 201 bp, Homo sapiens
catccatccatccaactcatttaccggcctatacactctgtcctccctcccattcacccacccatccactctctcatccactcactcatccttccctcctscgtccaaccatccgtccaaccagctatatacccacccatctacccatctacacacccttccctcctttcttctttctttcttcctatctatccatccatc

SEQ ID NO: 28195 - DNA, 201 bp, Homo sapiens
acaaaaaatagaaaaattagccaggcgtggtggcacgcacctgtagtcccagctactcggggggccgaggtggaagaattgcttgaaaccaggaggcagakgttgcagtgagccaagatcgagccactgcactccagcctgggtgacagagcgagactccatttcagaaaaaaaaaaaaaattaaactggtttcccatttt

SEQ ID NO: 28196 - DNA, 201 bp, Homo sapiens
aagcctggttaatttttcttattttttatagagtcagggttgtgctgtgttgctcaggctggtcttgaactcctggactcgagtgatcctcctgcctcaasttcccaaatagctgggactacaggcatgtgccaccatgcctggctaatttttaaatctttttctagaggcagtgtctctctgtgttgctgagctggtctc

SEQ ID NO: 28197 - DNA, 201 bp, Homo sapiens
ctcagcctccccaagtgctgggatcacaggcatgagccaccacatccggcccaccttttcactctttgtatctgaattcttttctatgtcctcttggaagkaatagattgggcattggacctaggctggggacccagttccgctcactaccagagatgtggccttgggcaagttacttcccctctgggagcctctgtttca

SEQ ID NO: 28198 - DNA, 201 bp, Homo sapiens
atcccacaagtagctgctaagtagaggaggtccagagagtggggaagtgtagccctggggaccttgggaggacaggggaggcttccttggaaggtgaagtktaggcttggctagggaacttgatataggttctatgaggctgctggggctggagcagagagaagggggagaatgtaggaggtaggagtggaggcccaagag

SEQ ID NO: 28199 - DNA, 201 bp, Homo sapiens
tcgacccgccagatgccgacagcccccttccctccagttgtgacaaccaaaaatatctctagacattgtcagatgttccctggggtgggacagttgccctygattgagaagcactcctttcatgaatctctgtaacgtcccaggggttaaggtaccttttgggttcccggattcctccacgtgtccccctgtccctgggat

SEQ ID NO: 28200 - DNA, 201 bp, Homo sapiens
gcttttttgagacagagtctcactctgttgcccaggctggagtgtagtggtgtgatctcggctcacctgagcctcagcctctccaggctcaggtgatcctmccacctcagcctccagagtagctgcatacaggcatgcaccagtacaactggctaatttttgtattttttgtagagatgaggttttgctatgttgttcagg

SEQ ID NO: 28201 - DNA, 201 bp, Homo sapiens
gatggagatgctggtatcactcggcccgtgggcttcagtgcaatgccattcagtaactgtggattgagcacctactgtatgccaggaaccacttggggtgrggacctggggataagtctgagagatgctgttattctcttctctgagcttccagacctgtggaagagcatgtagttgtcaaagaatccctcaaataaacag

SEQ ID NO: 28202 - DNA, 201 bp, Homo sapiens
ggtgggcgactataatcccagctactcgggaggctgaggcaggagaatcgcttgaacctgggaggtagaggttgcagtgagccgagattgccccactgcastccagcctgggcaacaagagcaaaactccgtctcaaaaaaaaacaaaaacaaaaacaaaaaccgtaaatattaaattgaaaaagggacatacttaaggga

SEQ ID NO: 28203 - DNA, 201 bp, Homo sapiens
gtaactgtggattgagcacctactgtatgccaggaaccacttggggtggggacctggggataagtctgagagatgctgttattctcttctctgagcttccrgacctgtggaagagcatgtagttgtcaaagaatccctcaaataaacagatgatgacacggtatgactaagagcttgggaggaaaagaagagcaggtttct

SEQ ID NO: 28204 - DNA, 201 bp, Homo sapiens
acctcaggtgatccgcccacctcagcctcccaaagtgctgggattacaggcgtgagccaatgcgcccagcgattctttcaccttcttacctcaacctcccragtagttgtgaccacaggcacaagctaccatagccggctagtttttatatttgtttctagagacgggagtctcactatgttgcccaggatgtcctcaaac

SEQ ID NO: 28205 - DNA, 201 bp, Homo sapiens
atggtggtgggcgactataatcccagctactcgggaggctgaggcaggagaatcgcttgaacctgggaggtagaggttgcagtgagccgagattgccccastgcactccagcctgggcaacaagagcaaaactccgtctcaaaaaaaaacaaaaacaaaaacaaaaaccgtaaatattaaattgaaaaagggacatactta

SEQ ID NO: 28206 - DNA, 201 bp, Homo sapiens
ggtctcgaactcccgacttcaggtgatgcacctgcttctgcctcccaaagtgctgggattgtaggtgttggacaccatgcctggcccttcagtggcatttmtgaatttccctgcaacctcgacaccctgggtttaagtcatcctttcacctttttttttcttttttgagatgaagtctcactctgttgcccaggctggagc

SEQ ID NO: 28207 - DNA, 201 bp, Homo sapiens
atttttgtatttttagtagagacagcattccaccatgttggccacgctggtctcgaactcccgacttcaggtgatgcacctgcttctgcctcccaaagtgytgggattgtaggtgttggacaccatgcctggcccttcagtggcatttctgaatttccctgcaacctcgacaccctgggtttaagtcatcctttcaccttt

SEQ ID NO: 28208 - DNA, 201 bp, Homo sapiens
tctgtttggtgctctgactaatcatgaaaagttcacgtttttatctttattttatttttatttttggtacccatggtgcattacagggaagggagacagcraaggagaattatttgttataaaatagtaaatattggccaggcacagtggttcacacctgtaatctcagcactttgggaggcagaggcaggcagatcatct

SEQ ID NO: 28209 - DNA, 201 bp, Homo sapiens
aaactcttgggctcaagagatcctcccgcctcagcctcctgagttactgagattacaggcatgaggcattgtgccaggcataagatgcacttaagcaggtrgaagagatcatatttaacctctcagtggaagttcaaaatgcccagtaccagcccagctgccctgctcacaaccccttcttgtgaagggcataaacactgt

SEQ ID NO: 28210 - DNA, 201 bp, Homo sapiens
ccatgttggtcaggctggtcttgaactcccgaccttaggtgatccacccaactcggcctcccaaagtgctgggattacaggcgtgagccacggtgtctggmctttttcttggtacttttcaacgcttatcccattttctgtcttccaagatggctttgctgttctcccctctctagttctttttaaactgcctcatgtatt

SEQ ID NO: 28211 - DNA, 201 bp, Homo sapiens
atcatctattgactttcctccatgaaagatgaaatttagctcattcaccctctggatttgcccctatttcctcgttccaacacacatgcctcatatcagartcccagtataattttatcttagttttgacaaactcagtgttcagagtttccattattatgactatgtaatgctatctagagtttacattattatgattat

SEQ ID NO: 28212 - DNA, 201 bp, Homo sapiens
aatctgtgccagaaaaaggattcaggaattcaagtcctcagccaggcgcagtggctcatgtttataatgccagcactttgggaggccaaggcaggtggatygcctgaggtcaggagttcgagaccagcctgaccaacatggtgaaacctcatctctattgaaaatacaaaaattagcccagcatggtagtaggcacctgta

SEQ ID NO: 28213 - DNA, 201 bp, Homo sapiens
ttagactgtctttgtacccctattcaggatgatgggacttgctatgagtccatttttatttgttatcctggacacttagtggcccaattaatctataaacktgtgtccacaaattctgggaaatgttgcaaattatttcattgatgctgtctttctccctgtgttctctgtttctttttcttagaagtctttttatttcca

SEQ ID NO: 28214 - DNA, 201 bp, Homo sapiens
aaaaaaatttttaatgcaaaaaattttttttaattacgaaaaattttttaaaatgtttgggagctgcctggaaaaagatcacggctcactgcagcctcaascaatccttccacctcagcctcctgaatagctaggactatgcacaatcatgcttggcttaaaaaaaaaaaaaaaattcttttttaattacaaaaaattttt

SEQ ID NO: 28215 - DNA, 201 bp, Homo sapiens
gatatggagtcttgctctgtcacccaggctgctgtgcagaggcacaattttggctcactgcaatctctgcctccagggttcaagtgattctccttcctcascctcctgagtagctgggactataggcacatgctaccatgcctggctcatttttctattttttttggtggagatggggttttaccaatgttgcccagactg

SEQ ID NO: 28216 - DNA, 201 bp, Homo sapiens
actcatgttttttgggcacttttgcctggcgagatgctaaacgctttgtggacattatcttacgtcttcataacaaccctttagagtagatactgttattmtaactggctttattttacacatatggagtctgaataacttgcttaagatagctcagctaaccagtaaggaaaagaagattctacaaatctaggtctttct

SEQ ID NO: 28217 - DNA, 201 bp, Homo sapiens
ctaccccctcttattcagaggtttgatttttttgggtggggggtgggagggaattgtctcctttccacaggtcttgaatccaaacaggtgggtcttccacrttaggcacaagcgtgtaattccaagagcagatatatagtagatttttcttgaaaaccaagttcaatattcaatccagtagaatcatagaaggccataagc

SEQ ID NO: 28218 - DNA, 201 bp, Homo sapiens
caggtcttgaatccaaacaggtgggtcttccacgttaggcacaagcgtgtaattccaagagcagatatatagtagatttttcttgaaaaccaagttcaatwttcaatccagtagaatcatagaaggccataagcaaatttaaaaatcatctcccgcacctccccaaacctcactttctcatccgggaaatggggctaatga

SEQ ID NO: 28219 - DNA, 201 bp, Homo sapiens
cttccacgttaggcacaagcgtgtaattccaagagcagatatatagtagatttttcttgaaaaccaagttcaatattcaatccagtagaatcatagaaggycataagcaaatttaaaaatcatctcccgcacctccccaaacctcactttctcatccgggaaatggggctaatgagaataactcatgttttttgggcactt

SEQ ID NO: 28220 - DNA, 201 bp, Homo sapiens
ctcataaacctcgtttctatttgggctgaaagtggtgattagaatctttaatatattaagctaccattccttacctggattgggaatgttacaaattccarttacatttgtttagggttttgtttgtttgtttttgagacagagtcttgctctgtcgcccaggctggagtgcagtggtgcgatcttggctcactgcaacct

SEQ ID NO: 28221 - DNA, 201 bp, Homo sapiens
tgggaatgttacaaattccaattacatttgtttagggttttgtttgtttgtttttgagacagagtcttgctctgtcgcccaggctggagtgcagtggtgcratcttggctcactgcaacctccgcctcctaggttcaggcacttctccagcctcagcctcctgagtagagagtagctgggtttataggcgcccaccaccat

SEQ ID NO: 28222 - DNA, 201 bp, Homo sapiens
gagtagctgggtttataggcgcccaccaccatgcctggctaattttttgtatttttagtagagatggggtttcaccatattggccaggctggtctcgaacygctgacctcaagtgattcgcctggcttggtctcccaaagtgctcagattacaggcgtgagccaccgcgcctggcttatttagggtcttgatggcatactt

SEQ ID NO: 28223 - DNA, 201 bp, Homo sapiens
acaggctaatgaatagcttgtttgtgctcaagggatgaagcagtgagttgttaggacaggactgtgaatagggctgacatattcagatgtgtcaaacatcrctaatgccatctctgagtaaattaggcttcaaacagatcgggattctaatcctggttccccaacttttgcaagggagggccttgcatttacctttcaaga

SEQ ID NO: 28224 - DNA, 201 bp, Homo sapiens
caggactgtgaatagggctgacatattcagatgtgtcaaacatcgctaatgccatctctgagtaaattaggcttcaaacagatcgggattctaatcctggytccccaacttttgcaagggagggccttgcatttacctttcaagaccccgataggcttagcaggaaaatgggaataatagataatgccactctttcatcct

SEQ ID NO: 28225 - DNA, 201 bp, Homo sapiens
cgggaggctgaggcacgagaatcgcttgagcctcagaggcagaggttgcattgagccgagatcacaccactgcactccagcctgggcaaagagtgagactyggtctcaaaaaaaaaaaaaaaaaaggcattgcaaattgcaacttgttgcagtcacatatgacagcagtccccatcctcttggcaccagagactggtttcg

SEQ ID NO: 28226 - DNA, 201 bp, Homo sapiens
ggtactactggggacctgccaagcaggtgcatttagagtgcccagtgcctctccctgcgacacatttgatgcctccctacacctggaccaggccttgagcraggatttccactgcagaggtccttccagctggcgaattgtgttgcagatcaggttcagagaacttctgttttgcctgtgtggcattcattcattcgttta

SEQ ID NO: 28227 - DNA, 201 bp, Homo sapiens
aacttttaagatacattattatttagtaaatatgatttagtttacaagtgactcagggttattctaaaaatcagtttgagaggccaggcacggtggctcaygcctgtaatcctagcactttgggaggctgaggcaggtggatcacttgaggtcaggggtttgagaccagcctggccaacatcgtgcaactttgtctctact

SEQ ID NO: 28228 - DNA, 201 bp, Homo sapiens
agctgatgaccacgctacgcaacaccacgcccaacttcgtgcgctgcatcatccccaaccacgagaagagggtgaggcccgccgcccagaccctggggctyccagaagccagggctgtcccaagcggtcacagcgtccccagggcgccctctgcccccacctaccccgaggaccccattttccatgtggggaaggctatct

SEQ ID NO: 28229 - DNA, 201 bp, Homo sapiens
taccacccacgggacgcctattggagtccccagggttgcgctccagcctgaaatggatttctccggttcagaatgaacccctgcacccttcaaagcatccrctcctggtacccttgactggaacaacctagacagagatgtctgtcccatctggctgagtgttttaggactgtcaggccccaaagcttccctggctcgatg

SEQ ID NO: 28230 - DNA, 201 bp, Homo sapiens
ttgaaaaaagtgaccttcctagggagcagatgtcctagctattagagagctcagacagttgcttctcttctgaaatcctcctgtaaatctgaacattagcrtcagggtctaagaggaggtaggagataggagagaacctgtgggttaagggcagagttttgtgacaacatccatccaaggtagaactgtcaggacctaggt

SEQ ID NO: 28231 - DNA, 201 bp, Homo sapiens
tatccgataccattttatgtaacaaaacatgaattgagtgccaactgtgtaccaggcacacacctcctccaagaaatacttagtaagtacctactgtgtayaattactctggtaggcacttttacatgtaccaccattctctttgtttttttctcatttgctgtttttattaagtgcctactgtataccaggcactcagcg

SEQ ID NO: 28232 - DNA, 201 bp, Homo sapiens
atgtaacaaaacatgaattgagtgccaactgtgtaccaggcacacacctcctccaagaaatacttagtaagtacctactgtgtacaattactctggtaggyacttttacatgtaccaccattctctttgtttttttctcatttgctgtttttattaagtgcctactgtataccaggcactcagcgagtctcacaggattgc

SEQ ID NO: 28233 - DNA, 201 bp, Homo sapiens
cttgtttcccagttttcatgtcttcctctttcttgctttactctcctgcttaaatcaagcactttgtccagtagcttcccaagaaagaatgtacgtgatcktgaggcattgagaacttccatatctgagaggcttgatgcttctctaacacttaaaggatagtttagttgggtttaaaatttcaggcaagaaagttgtttt

SEQ ID NO: 28234 - DNA, 201 bp, Homo sapiens
tttgcactgctttgtgactatttttcttctttctgtatgacttttctttttcctggagttagcaattgccttttttttccccaatcttgttttccatgtayttaaccaccaattctgccccaaaatctctttctaaatgtgttaatctccttttaatatgtccagacatgtattggatatcatattgatatcatctccttg

SEQ ID NO: 28235 - DNA, 201 bp, Homo sapiens
tttattaagtgcctactgtataccaggcactcagcgagtctcacaggattgcgatgaatagttcagatatggttccagccttcatgaagctggttcttccmactgaataacagagagtaagtgaggcagggggtactaccttcccatgcacactcccccaggctccaaagcaaaaagtttttgcctgagcccaacagggca

SEQ ID NO: 28236 - DNA, 201 bp, Homo sapiens
aaactcagtgttcagagtttccattattatgactatgtaatgctatctagagtttacattattatgattatgtagatgttattcaaagctgagctttgcaytgctttgtgactatttttcttctttctgtatgacttttctttttcctggagttagcaattgccttttttttccccaatcttgttttccatgtatttaacc

SEQ ID NO: 28237 - DNA, 201 bp, Homo sapiens
aacaatggttttattgtgcaaaagaagcggttgtctccgtaggagggtcagaaagatattttagtgagaaaagatgaaggaaaaattgcctctgcattccwggagaagggggtctctgaactgttgctcgctgagatggggccctgtgaaagactctttgcagaaagctctgctctgctgagcaaatgcacatggtggtcc

SEQ ID NO: 28238 - DNA, 201 bp, Homo sapiens
ttatcttagttttgacaaactcagtgttcagagtttccattattatgactatgtaatgctatctagagtttacattattatgattatgtagatgttattcmaagctgagctttgcactgctttgtgactatttttcttctttctgtatgacttttctttttcctggagttagcaattgccttttttttccccaatcttgtt

SEQ ID NO: 28239 - DNA, 201 bp, Homo sapiens
acaatggttttattgtgcaaaagaagcggttgtctccgtaggagggtcagaaagatattttagtgagaaaagatgaaggaaaaattgcctctgcattccakgagaagggggtctctgaactgttgctcgctgagatggggccctgtgaaagactctttgcagaaagctctgctctgctgagcaaatgcacatggtggtccc

SEQ ID NO: 28240 - DNA, 201 bp, Homo sapiens
gtgattcttgtgcctcagccacccaagcagctgggactacaggcatccgcgaccatgcccggctaattttcgtatttttagtatagatagggtttcaccaygttgcccagtttggtcttgtgaactcctggcctcaagtgatccacccacttctgcctcccaaagtgctgggattacaggtgtgagccacttcactgcacc

SEQ ID NO: 28241 - DNA, 201 bp, Homo sapiens
actgcaacctctgtctcctgggttcaagcaattcttgtgcctcagcctcctgagtagctgggactacaggcacacaccaccatgcctggctaatttttgtrtttttagtagagatggggttttgccatgttggccaggctggtttcaaactcctgacctcaggtgatctgcccgcctcaacctcccaaagtgctgagatta

SEQ ID NO: 28242 - DNA, 201 bp, Homo sapiens
gagatggaggttgcagtgagccaaagtcacaccactgcactccaacctgggcgacagagtgaggctcttgtctcaaaaaaaaaaaaaaaaaaaaaaaaagsgtaaaaatctaaagtcataaaggttaggttctaagcctggctaattacaaacagatttttacctccatgagtggcaggtgagacattggaagagtcataa

SEQ ID NO: 28243 - DNA, 201 bp, Homo sapiens
tttacggagacttgggacattaaaaacacctgtcaagaccaatcaggggccaggcacggtggctcaggcctgtaattccagcactctgggaggctgaggcrggaggatcacttgaggccgggagttcaagaccagcatggccaacatggtgaaaccccgtttctcactaaaaatacaaaattagtgggtgtagtggcacac

SEQ ID NO: 28244 - DNA, 201 bp, Homo sapiens
gtggggggatcatgagatcaggagatcgagaccatcctggctaacgtggtgaatctccgtctctactaaaaatacaaaaaaaactagccaggcacagtggyaggcgcctgtagtcccagctactcagggggtgctgaggcaggagaatggtgtgaacccaagaggcggagcttgcagtgagccgagatcacgccactgcac

SEQ ID NO: 28245 - DNA, 201 bp, Homo sapiens
gttctctgttcttagacatgatttcagtacaccacaaagcactgggagattttgttctggaagacgattccacctggttgggagttggggggaagagcctytgagagaagctccatcccacatttacggagacttgggacattaaaaacacctgtcaagaccaatcaggggccaggcacggtggctcaggcctgtaattcc

SEQ ID NO: 28246 - DNA, 201 bp, Homo sapiens
ctttggtgtggtagcacatacctgtagtcccacttcttgggaggctgaggtgggaggatcgcttgagaccaggaagtggaggttgcagtgagccgagatcmcgccactgcattccagcctgggtgagagagccagaccttgtctcaaaagaaaagaaaagaaaaccaacattgcaaattataaaaataggttaatttcagc

SEQ ID NO: 28247 - DNA, 201 bp, Homo sapiens
aggctcccaaagtacagcaggggcctggaagcatctcccagggttgaggggtcagtggaggagagctgttctcactgtgaagactcctggggcaaagcgcrgtggctcacgcctgtaatcccagcactttgggaggctgaggtgggctgatcacctgaggtcaggagttcgagaccagcctggccaacatggtgaaacttc

SEQ ID NO: 28248 - DNA, 201 bp, Homo sapiens
gatagtatgtgtgtggaggagggaaagagagtgggcaaaatatttgactgagcttgaaaaatgacattgcaggccaggcacagtggctcacgcctgtaatyctggcactttgggaagcccagatgggtggattgctcgaggtcatgagttcgagaccagcctgggcaatatggcgaaaccctgtctctacaaaaaatacaa

SEQ ID NO: 28249 - DNA, 201 bp, Homo sapiens
tactagggaggctgaggcaggagaatcgcttgaacctgggagacacaggttacagtgagctgagatcgcaccactgcacttcagcctgggtgacagaccamaactcggtctcaaaaaaaaaatctccagtgtctaggacagcaccaggcagagtgaacctttatccctcgggtcctagatattttccccgcttcattctca

SEQ ID NO: 28250 - DNA, 201 bp, Homo sapiens
ttctgacagttagccagactccacaggtaggaccagaatcttggcccttctaggcagggcctgccattacctccaaagaccagcaggtggagccttgcaarggcaatcttggagctgtaatctcaggttgtaaagtgacggctcctggagtcaggtatctgtctttttttttttttgagacggagtctcgctctgtcgccc

SEQ ID NO: 28251 - DNA, 201 bp, Homo sapiens
gcatggaccactgcacggccttagttgttttcatctctccccagcgctaggtgagaggtctcaactaatcttggcgctttagaattccatgtatatctaawgactcctcagttcatctctgagaagccctagcttcttcctagaacctcagaccaccctcccgttcccacatggatgtctaataggcagctcacaccaaac

SEQ ID NO: 28252 - DNA, 201 bp, Homo sapiens
gcctgagagatgccacgaccccgcccccaaggtagagggactcaggtataagtgccccaactttctgacagttagccagactccacaggtaggaccagaaycttggcccttctaggcagggcctgccattacctccaaagaccagcaggtggagccttgcaaaggcaatcttggagctgtaatctcaggttgtaaagtgac

SEQ ID NO: 28253 - DNA, 201 bp, Homo sapiens
cccgcctcagcctccccacgtgctgggattacaggcatggaccactgcacggccttagttgttttcatctctccccagcgctaggtgagaggtctcaactmatcttggcgctttagaattccatgtatatctaatgactcctcagttcatctctgagaagccctagcttcttcctagaacctcagaccaccctcccgttcc

SEQ ID NO: 28254 - DNA, 201 bp, Homo sapiens
aactcctgatcttgtgatccacccgcctcagcctccccacgtgctgggattacaggcatggaccactgcacggccttagttgttttcatctctccccagcrctaggtgagaggtctcaactaatcttggcgctttagaattccatgtatatctaatgactcctcagttcatctctgagaagccctagcttcttcctagaac

SEQ ID NO: 28255 - DNA, 201 bp, Homo sapiens
cagttcaagctatttttggcctatttttatatttttagtagagacggggttgcaccatgttgcccaggctggtcttgaactcctgatcttgtgatccaccygcctcagcctccccacgtgctgggattacaggcatggaccactgcacggccttagttgttttcatctctccccagcgctaggtgagaggtctcaactaat

SEQ ID NO: 28256 - DNA, 201 bp, Homo sapiens
gttgcccaggctggagtgcagtagcactatctcagctcactgcaacctctgcctcccagttcaagctatttttggcctatttttatatttttagtagagayggggttgcaccatgttgcccaggctggtcttgaactcctgatcttgtgatccacccgcctcagcctccccacgtgctgggattacaggcatggaccactg

SEQ ID NO: 28257 - DNA, 201 bp, Homo sapiens
tggtctgggtcactctgtattacttacctgatctccaaaaacatttgggtttttgtctctggtccaaaatctttagccaatggcttggcagtaaaatcctragggaagctgttgaccaggtgaggtgatgtgcaaatcctatactctctgggctctgggatatttaatttactatttatttatttattttcaagacagagt

SEQ ID NO: 28258 - DNA, 201 bp, Homo sapiens
catcttgctgtcttttgaccaaagcagattttgcacgtcgtaactgtcagagacatcaaagccagagggaatccagcctgctccaagctctccttttttgkacagagactgaatctttgcacttgatcttgtttgtgtttttaagtctgaggttagacagggtcccaggcaatggaggcgtgcgtgtccttttatttttct

SEQ ID NO: 28259 - DNA, 201 bp, Homo sapiens
tgggctcacacctgtaatcccagcactttgggaggccaaggtgggtggatcacctgaggtcaggagttctagacaagcctggccaacatggtaaaaccccrtctctactaaaaatacaaaaattagctgggcatgatggtgtgcgcctgtaatcccagctacttgggaggccgaggcaggagaatcgcttgaacctgggag

SEQ ID NO: 28260 - DNA, 201 bp, Homo sapiens
cgtgtccttttatttttctgttgtagcttttgctattttttctgacttttaaggcaactcatccacatggcaattaggaagagcccacttagggctgggcrcagcggctcatgcctgtaatcccagcactttgggagaccgaggcaggcagatcacttgaggtcaggagttcaagacctcagcctggacaacatggtgaaa

SEQ ID NO: 28261 - DNA, 201 bp, Homo sapiens
cttagggctgggcgcagcggctcatgcctgtaatcccagcactttgggagaccgaggcaggcagatcacttgaggtcaggagttcaagacctcagcctggrcaacatggtgaaaccccgtctctacaaagaatacaggaaaatagctgggcatggtggcaggtgcctgtggtcccaactatttgggaggctggggtgggag

SEQ ID NO: 28262 - DNA, 201 bp, Homo sapiens
ggctcatgcctgtaatcccagcactttgggagaccgaggcaggcagatcacttgaggtcaggagttcaagacctcagcctggacaacatggtgaaaccccrtctctacaaagaatacaggaaaatagctgggcatggtggcaggtgcctgtggtcccaactatttgggaggctggggtgggaggatcacttgagcctggga

SEQ ID NO: 28263 - DNA, 201 bp, Homo sapiens
cctgtaatcccagcactttgggagaccgaggcaggcagatcacttgaggtcaggagttcaagacctcagcctggacaacatggtgaaaccccgtctctacmaagaatacaggaaaatagctgggcatggtggcaggtgcctgtggtcccaactatttgggaggctggggtgggaggatcacttgagcctgggaggcggagg

SEQ ID NO: 28264 - DNA, 201 bp, Homo sapiens
gaggatatattttttatagatgggggtctcactctgtcacccaggctgcagtgcagtggcatgatcatggctcactgcatccccgacctcctgagcttaartgatcctcccacctcagcctcctgagtagctgggactgcaggtgcacactatcacaaccggttaatttttgtatgtttgctagagacaaggtttcaccat

SEQ ID NO: 28265 - DNA, 201 bp, Homo sapiens
gatcagcaaaacagatgcagcagtccctgcagtggggaaaactcagtccatgaacattcacaccagcagggggtgctgtctcgccttttaaccagggagcycctctgtgtccttctcaaggctgcccttgtccatttcaccttcttccaattcaaatcttgaaaactcacctctaaggcgaatgggggtgaggagatacag

SEQ ID NO: 28266 - DNA, 201 bp, Homo sapiens; identical to SEQ ID NO: 5052

SEQ ID NO: 28267 - DNA, 201 bp, Homo sapiens
ctagagtgcaatggcgtgatcttggctcacagcaacctccacctcccaggttcaagtgattctcctgcctcagcctcccgagtagctgggataacaggcawgtaccaccatgcctggctaattttgtatttttagtagagacagggttttgtcatgttggtcaggctggtctcgaactcctgacctcaggtgacccgggga

SEQ ID NO: 28268 - DNA, 201 bp, Homo sapiens
ggccactgccccctgccctcgaacatgactgggaagaacatcttgactcatcaaaaccagtatcttaagaaaaatacaggatttccttgattttttgagtkaaaacacaaggtcttgtccaatgagtcagcaaacactttccacaaaacgtcagatggtggctgggtacagtggctcacacctggaatcccagcactttgg

SEQ ID NO: 28269 - DNA, 201 bp, Homo sapiens
aaaccagtatcttaagaaaaatacaggatttccttgattttttgagttaaaacacaaggtcttgtccaatgagtcagcaaacactttccacaaaacgtcaratggtggctgggtacagtggctcacacctggaatcccagcactttgggaggctgagatgggaaaatcacttgaggccaggagttggaggccagcctagcc

SEQ ID NO: 28270 - DNA, 201 bp, Homo sapiens
ctgcaaaggctctgttcaacacaaacgatgccgtataccaccaactccatgggatcagacagatttgggagacaggaaacatggaaacaaaggactccatmttgtgaccagatgctaatatgccttgaatgacgcacaaacacatcccggatacatttctaaaaacctggcttgaatagaaattttcaaaaagattttttc

SEQ ID NO: 28271 - DNA, 201 bp, Homo sapiens
aacttgacctgtggggttctgagtgttcgcaagaatctccccgccccacctcccatcctctgtaccatctgcctcctgcttgcccacagcatggggttaamggctgaagttgggcagcaaagcctgaactgtgttttcctgttggcagggcaaattcatccgcatcaacttcgacgtcacgggttacatcgtgggagccaa

SEQ ID NO: 28272 - DNA, 201 bp, Homo sapiens
gccgtgaagctgcaggcacactccagaaattagtgtgttcttttaactcgtgtcccaaagagacagcagttcctaacatgcagtgatgagtggacacaccrtggtgcgttggaaatcccacgttcacgtctttgacaaggaagcctcctacaatgatcttgtgctttaattttacttgatggtcaccctggttacttcatt

SEQ ID NO: 28273 - DNA, 201 bp, Homo sapiens
tgctgatctagccccatcatcccgcaccatcatgcttagtgctgtggaaatccacccagtacagtagcccagcctcctagctgccctttcccatcaccccrgaccctgtgatctccatgccaccctcacctgccctcccctctgctctccctcctgccaccccgcatcgcggagaagctctcctgaaattaattagtgtgg

SEQ ID NO: 28274 - DNA, 201 bp, Homo sapiens
tggagcccctgaaatagccacccccaagtcaaacagagggactaggcagttaatgcaaacaagtgtaccaggtcaggcgaagagtacaagaaactcgaaarctcacaccccctctgaaagggcaccaacaggtgggaacccagggatctgagttgggagttgagaggagcccaattctggaagttcttgaggcaggaatcc

SEQ ID NO: 28275 - DNA, 201 bp, Homo sapiens
gaacagagggcatggaagacagctttgccacttgttagctgtatcatcttgagaaaggacttctcttctctgagcctcagtttccccttattgaaaacacygataatagttgcacttatttcctagcatactttgtgaggcttcagtgagacaatttatatcaatcatttcacacaggaatgaatcataaatcataggatc

SEQ ID NO: 28276 - DNA, 201 bp, Homo sapiens
tgggctcaagcaattctcctgcctcagcctcccaagtagctgggactataggtgtggactgtcatgtcaagctaattttaaaaaggtgggtttttttgttytgtttttgttttgttttgttttgtttttggaagtgacaggatcttgctatactggttggtctcaaactcttggcctcaggcgatcctcccactttggcct

SEQ ID NO: 28277 - DNA, 201 bp, Homo sapiens
acctcagctactagggggtggcattatccattatttaaatttccagggtggggcaaagtggctcatgcctgtaatcccacactttcggaggcagaggcggrcggattacctgaggtcaggagtttgagaccagctcggccaagatagtgaaaccctgtctccccaaaaatacaaaaattagccaggtgtggtggctggcgc

SEQ ID NO: 28278 - DNA, 201 bp, Homo sapiens
acttgaggccgggagttcaagaccagcatggccaacatggtgaaaccccgtttctcactaaaaatacaaaattagtgggtgtagtggcacactcctgtagycccagctacttgggaagctgagataagagaatcgcttgaacctaggaggcggaggctgcggtgagccgaaattgcaccactacactccagcctggacaag

SEQ ID NO: 28279 - DNA, 201 bp, Homo sapiens
gaagtgcagtggtgccatctcggctccctgcaacctccgcctcctgggctcaagcaattctcctgcctcagcctcccaagtagctgggactataggtgtgractgtcatgtcaagctaattttaaaaaggtgggtttttttgttctgtttttgttttgttttgttttgtttttggaagtgacaggatcttgctatactggt

SEQ ID NO: 28280 - DNA, 201 bp, Homo sapiens
taaatttccagggtggggcaaagtggctcatgcctgtaatcccacactttcggaggcagaggcgggcggattacctgaggtcaggagtttgagaccagctyggccaagatagtgaaaccctgtctccccaaaaatacaaaaattagccaggtgtggtggctggcgcctgtcatcccagctacttgggaggctgaggcagga

SEQ ID NO: 28281 - DNA, 201 bp, Homo sapiens
gggagttcaagaccagcatggccaacatggtgaaaccccgtttctcactaaaaatacaaaattagtgggtgtagtggcacactcctgtagtcccagctacytgggaagctgagataagagaatcgcttgaacctaggaggcggaggctgcggtgagccgaaattgcaccactacactccagcctggacaagacagggcaag

SEQ ID NO: 28282 - DNA, 201 bp, Homo sapiens
tgcttgagcccaggaatttgagaccagcctgagcaacacagtgaaacccatgtctctacagaaaatataaacatcagccaggcctggtggcgcccgcctgyagtcctggctactcaggaggctgaggtaggaggatcacctgagtccagaaaggtcaaggtttcagtgagtcacgttcacaccaccgcactccagcctagg

SEQ ID NO: 28283 - DNA, 201 bp, Homo sapiens
aatcacttgaacctagaaggtggagtttgcagtgagctaagattgcaccactgcactccagcctaggcgatagagtgagactctgtctcaaacaataaaawtaagtttccttaatggctggctttcaggaacataggctatgaggtggagcaatttttggtaaagggggaatgctgaatggattttttatgtaccagcaaa

SEQ ID NO: 28284 - DNA, 201 bp, Homo sapiens
ttgctctgtcacccaggggctagagtgcaatggtacaatcatagctcactataaccttgagctcctgggatcaagcaatcctcctgactcagcctcccaaktagctgggactacaggtgatcaccaccatggccagctattttttttttttttttttttttgtagagagggggtctggctgttgttgcctgagctggtctc

SEQ ID NO: 28285 - DNA, 201 bp, Homo sapiens
aaaaaaaaaaaaaagaccaatcaggacctccgcttgggttagtgcaacacaatggggcatgggaacgatggctcatgcttgaaatcccagcattctgggargccgagatgggaggatcacttgaggccaggagttcaagaccacactgggcaacatggcaaaaccccgtctctattaaaaatacaaaaaattcagccaggt

SEQ ID NO: 28286 - DNA, 201 bp, Homo sapiens
ggaccttcccactctctctttttctttctttttttttctttttcttttttgagacaaggtctcaccgtgtcacacaggctggagtgcatggcacaatcacrgcttactgcaacctcaacctcccaggcttaagcaaacctcccacctcagcctcccaagtggctgggactacaggtgaatgccaccatgcccagctaattt

SEQ ID NO: 28287 - DNA, 201 bp, Homo sapiens
gggtttcaccatgttggccaggctggtctcaaactcctgacctcaagtgacctgcctgcataggcctcccaaagtgctgggattctaggcctgagccaccrcgcctggccccaacacactttttttttcctgtagggcaactcacatgcctacaggagctggttccataaaataagtttcccttaactaggacagaagtag

SEQ ID NO: 28288 - DNA, 201 bp, Homo sapiens
taaaacaaattcaagtttttttaagtgtacagcttgagtgagttttttcaacttaaaaaatttatttcttaattgacaaataatcatacatgttcatgggktccataatgatttttttagttgtttggttggatggttttgagacagggtctcgctctgtggcccaggctggagtgcagtggcatgattacaactcactgc

SEQ ID NO: 28289 - DNA, 201 bp, Homo sapiens
agaatattcctctgcagcacccccagacattacataccattgtccctgagtggactgagccctggaaggaccttcccactctctctttttctttctttttytttctttttcttttttgagacaaggtctcaccgtgtcacacaggctggagtgcatggcacaatcacggcttactgcaacctcaacctcccaggcttaagc

SEQ ID NO: 28290 - DNA, 201 bp, Homo sapiens
tttctttcttcttttttttttttttgagatggaatttcacttttgttgctcaggctggagtgaagtggagcgatcttggctcattgcaacctccacctccsgggttgaagtgattctcctgcttcagcctcccgagtagctgggattgcagggatgtgccaccatgcctggctgatttttgtatttttagtagagacgggt

SEQ ID NO: 28291 - DNA, 201 bp, Homo sapiens
taccttcaaagaatattcctctgcagcacccccagacattacataccattgtccctgagtggactgagccctggaaggaccttcccactctctctttttcyttctttttttttctttttcttttttgagacaaggtctcaccgtgtcacacaggctggagtgcatggcacaatcacggcttactgcaacctcaacctccca

SEQ ID NO: 28292 - DNA, 201 bp, Homo sapiens
tgctgggatcataggtgtgaaccactgcgcccaacaatcctgtaccttcaaagaatattcctctgcagcacccccagacattacataccattgtccctgartggactgagccctggaaggaccttcccactctctctttttctttctttttttttctttttcttttttgagacaaggtctcaccgtgtcacacaggctgga

SEQ ID NO: 28293 - DNA, 201 bp, Homo sapiens
ctccatttcggtccgatggagccgcttataccaagctgcttatagttcacccccacggaccccgtgtcctgtttttctgcccatgtccctgctttgtcttragctggttaacaccttgttgtcctttaagactcagtgcagggaatacctccccacctggaggtttccctgaccacccccaatgtgggttagggccttccc

SEQ ID NO: 28294 - DNA, 201 bp, Homo sapiens
atttacaaaaacaacaggggaccagatttgccaacctgtgatataagccttatatattgattcaactaaaaatagctgggggtggctgggcacggtggctsacacctgtaatcccagcactttgggaggctgaggcgggtggatcacctgatgtcaggggttcaagactagactagccaacatgatgaaaccccgtctcta

SEQ ID NO: 28295 - DNA, 201 bp, Homo sapiens
gtagagatgaggtctcattatgttgcccaggctggtctcgaactcctggcctcaagcaatcctcccgcctcggtctcccaaagtgctggaattacagatgkgatccaccacgcccggtcattctaacaatattgattattagatgttgccctagacacagcctactgtgcgtatgtgtaaatacgaattgaatcatcccac

SEQ ID NO: 28296 - DNA, 201 bp, Homo sapiens
tgaaggagggatgtcaaccacgcatagatcctggtggccatatgtcctcacttagccagcaactcagttctttggagcccagcagcaagaggtagaagggrctgtaagccagtgtttccaggacagcccctgcagctatggtcagagagtcaggaacggggggccggacaggcctatagagtgtgttgtctctgtccctct

SEQ ID NO: 28297 - DNA, 201 bp, Homo sapiens
ggtggatcacttgaggtcaggagtttgagaccagcctggccaacttggcgaagccccgtctctactaaaaatacaaaaattagctgggtgtgatggtgcaygcctgtaatcctagttactcgggaagctaaggcaggagaatcgcttgaacccagaggcagaggttgcagtgagccaagattgcaccactgcactccagca

SEQ ID NO: 28298 - DNA, 201 bp, Homo sapiens
ggccggtgcctccgtctgcaggtttgtgggtgggaagatggtaggatggagatctgaccacggcatggggtgtctccagtgttcgccattccagatgtcaytttgcgtcctcagaggggactctggggcagccaccatggccggcttgtctggaggcccttggagatctaggatgggcgctggtcgtggctttggagaact

SEQ ID NO: 28299 - DNA, 201 bp, Homo sapiens
gagataagatcaggataattagcatatccatcatctcaagcatttgccattacttttattttgctacttcctatataatgacatttatcatctctttgtgytgggaacattcaatgtccttcttctagctcttggaaacgatgtaatattttattgttcactttactcatcctatagtggatagaacattcttaatgagtt

SEQ ID NO: 28300 - DNA, 201 bp, Homo sapiens
actgtattggccaggctggtcttgaactcctgacctcgtgatctgcccacctcagcctcccaaagtgctgggattacaggtgtgagccaccgtgcccagcyggctagcttctttcacttagtataatgttgtcaaggttcatccacgttgtatcatggattcatactatttatatattttttaagacagggtctgtctctg

SEQ ID NO: 28301 - DNA, 201 bp, Homo sapiens
acaggtgtgagccaccgtgcatggcctcctctggcaactcttgattgcctgtcaccatagatatgccttttctattttgccattactttttttttttttckagacagagtctcgctctgtcgccgaggctggagtgcagtggcgcgatctcagctcactgcaacctccgcctcctgggttcaagcaatcctcttgcctcag

SEQ ID NO: 28302 - DNA, 201 bp, Homo sapiens
tctcccgcacctccccaaacctcactttctcatccgggaaatggggctaatgagaataactcatgttttttgggcacttttgcctggcgagatgctaaacsctttgtggacattatcttacgtcttcataacaaccctttagagtagatactgttattctaactggctttattttacacatatggagtctgaataacttgc

SEQ ID NO: 28303 - DNA, 201 bp, Homo sapiens
gtctcaccatgttgcccaggctggtcttgaactcctgacctcaggtgatccactcacctcagcctcccaaggtgctgagattacaggcgtgagccaccgcrcccggccgccattaccttctatctcaataaccacacttacgtttgcaccagcctaatagtttttcgtattgaaggagtaatagagcgtgtggcctttctg

SEQ ID NO: 28304 - DNA, 201 bp, Homo sapiens
cccggccgccattaccttctatctcaataaccacacttacgtttgcaccagcctaatagtttttcgtattgaaggagtaatagagcgtgtggcctttctgrtttgtttcactgagcatgatgcttttgagactcatttattttattgcataatttctttccttttactgagtttccagttatataccttgggttgtttgtt

SEQ ID NO: 28305 - DNA, 201 bp, Homo sapiens
aacgtattggtaactgttctcagatctctctttgggaaggaaatgggtcttcagagcctggctccacctcagaggcctctttaagagtagaaggtgatggrtaatgtctgcttaatcacatctagttctttgatgacctctgtatcttttgggtttctctggtggtaaacaagagagactgactctgtcatctagtagagg

SEQ ID NO: 28306 - DNA, 201 bp, Homo sapiens
caccccccaccccagctgtgacaatcagcagtgtctccagacaatatcccctagtggggatcggtgggggcaacattgtccctggctcggaaccactgatsgaatttattatgacaacatatccctttgccacaaaaacaaatgatgggctaaccgtgtgtgtgcaggtgaagccactgctgcaggtgacacggcaggagg

SEQ ID NO: 28307 - DNA, 201 bp, Homo sapiens
cacaggcctgtggaggtgcatccagggatatgtgtccctgctgggacagatgatgagacgggggcttggagagggttggtcatctgatcaaggccacacarctgggattgggactggaacacagtgagcccactctgttctattgccctgccttgcatgtgctaaccccttttctcctaacagcaagcctgaatggaggat

SEQ ID NO: 28308 - DNA, 201 bp, Homo sapiens
aaaatacaaaattagtgggtgtagtggcacactcctgtagtcccagctacttgggaagctgagataagagaatcgcttgaacctaggaggcggaggctgcrgtgagccgaaattgcaccactacactccagcctggacaagacagggcaagagcatgactctgtctcaaaaaagaaaaaaaaaaaaaagaccaatcaggac

SEQ ID NO: 28309 - DNA, 201 bp, Homo sapiens
agtgagaccctgtctctatgaaaaatgcaaacaaaaattagctgggtgtggtggcctgcatgtgtagtcccagctacttggtaggctgaggtggaaggatygctggagcccaggaggcggaggttgcagtgagccgagatcacaccaccgcagtctagcctgggtgacagagtgagaccctgtctccaaaaaaaaaaaaag

SEQ ID NO: 28310 - DNA, 201 bp, Homo sapiens
tgagcagccaatatcgcaccactgcactccaacctggacaaaggtgaaactccctctcaaaaaaaaaaaaaaaaaatagctggaggaaaggaaaggtagtrtaagaaagctgcatttttgcctaccatagcaggaagtcactagatactatctaaacttgacatatccagaaatcgcctattacagcgattgtgctttgcc

SEQ ID NO: 28311 - DNA, 201 bp, Homo sapiens
cctgcatgtgtagtcccagctacttggtaggctgaggtggaaggatcgctggagcccaggaggcggaggttgcagtgagccgagatcacaccaccgcagtytagcctgggtgacagagtgagaccctgtctccaaaaaaaaaaaaaggccaggcatgattgctaacgcttgtaacccccagcacttgggaggtcaaggtgg

SEQ ID NO: 28312 - DNA, 201 bp, Homo sapiens
gaaatcgcctattacagcgattgtgctttgcctctggtcttccaataggccaaaagcacctgttacttttggcactgaggactggtttcctggaagaaaakttttccacagactgggcgggcagggttggggggatggtgtggggatgattcacgtgtattacatttactgtgcactttattattacattgtaatatacaa

SEQ ID NO: 28313 - DNA, 201 bp, Homo sapiens
tgacagcagggctgagcttttacgcgtagttggtgcttaagagaagccaggctggagccaactgtttggttatgcagttaagaaactgaaaattggccgcrcactgtggctcaggcctgtaatcccagcactttgggaggccgaggcgggcggatcacgaggtcaggagttcgagaccatcctggctaacacggtgaaacc

SEQ ID NO: 28314 - DNA, 201 bp, Homo sapiens
gtgagccgagatcacaccaccgcagtctagcctgggtgacagagtgagaccctgtctccaaaaaaaaaaaaaggccaggcatgattgctaacgcttgtaasccccagcacttgggaggtcaaggtgggaagatcgcctggaaaattaatctgaaaactcacctctagaaatctcaatgagaagcagactacagtctcagag

SEQ ID NO: 28315 - DNA, 201 bp, Homo sapiens
atcttgtgtcaggctcgctacaaaacttcattaagtttctttttctctctctgcaaaaatgtagctaatttctcccctgtctatttcacaggattattgcraaaattatataagaggatcccaccgtctgggtttttttcatcattatattccttgtgccaagcacaggcctgctgcatagtagatactaagtaaatattt

SEQ ID NO: 28316 - DNA, 201 bp, Homo sapiens
ctccatctcaaaaaaaaaaaaagttcaggaattcaagcttcaggtacagtgagatctaggtgttcaaaagatttttctagaacctaatttcttgtcttctrtctctctcgactacattgtttctctataggatgcagtttgttgacagcaacatagctgggttccagcccttatattctttgggtttatgtccaaagaaca

SEQ ID NO: 28317 - DNA, 201 bp, Homo sapiens
aaagcctgaaagagctgaattctattaaatcctggttggcaggttttttcctcgggtccacgtcacgagctcattctccgcttcaaggttcctttcgactycacaacgtgaagccagggggaaggcctccttaaactgggggttttcgccaaaaaagccagggtcaccccccgggaaagtccctatttaggggtttatcgg

SEQ ID NO: 28318 - DNA, 201 bp, Homo sapiens
tggcctcatcaggaacatgtgggcagggtttaggggagggggagtgatcgaggcagtggatttactcaggcttttcctggaggggttgctctggtgatcarttgatattgatcaaaatcatccaaccaatggccaagaaacacactgggtcttgagaacaggacagctcagaaagaaattcttggtcgggacactgtgttt

SEQ ID NO: 28319 - DNA, 201 bp, Homo sapiens
cagcctcccaaagtgctgggattacaagtgtgagccactgagcctggccctgattttctttaggcaagaaaattaatgacactgttagagatcagatctgyactgtcccatcgggtggctggtttcaggaacatagtctgggctagaagttagtgccagtttctcaaaggttctacagatttaaaaagaaaaaaaagggct

SEQ ID NO: 28320 - DNA, 201 bp, Homo sapiens
tgtccctggcactgtgcggggtgcaggagatacagtagtgtgtgggtcacagtccaggaggtaacatttaggcagagctctaaaagaggagagggaaccakctgtgggaagatgaggggaaaagtgttccaagtggagagaacagcatattgaaggctctaaggtggcaagacttccctctcgtgaaatgaagggagcata

SEQ ID NO: 28321 - DNA, 201 bp, Homo sapiens
gtgttcaccaccatgcccacctaatttttctattttagtagaggcagggtttcaccatgttggccaggctggttttgaactcctgacctcaagtgctccayccgcctcagcctccaaaagtgctgggattacaggcatgagccaccacaccaagcctccccttaggaattttattacttatttacttattcattaagatgg

SEQ ID NO: 28322 - DNA, 201 bp, Homo sapiens
ggttctacagatttaaaaagaaaaaaaagggctggttgcagtggctcacgcctgtaatcccagcactttgagaggccgaggtgggtggatcacaatgtcaygagatcaagaccatcctaacacagtgaaaccccgtctcgactaaaaatacaaaaaattagctgggcatggtggcacacgcctgtaatcccagctactcag

SEQ ID NO: 28323 - DNA, 201 bp, Homo sapiens
ctgggattacaggcgcctgccatcatgcctggctaatttttgtatttttagtagagacggggttttgccatgttggccaggctggtctcgaactcctgacstcaagtgatctgacctccttggccacccgaagtgctgggattacagctgactgagtgtctaccctgtccctggcactgtgcggggtgcaggagatacagt

SEQ ID NO: 28324 - DNA, 201 bp, Homo sapiens
tgagatggaggcttgctattgtcacccaggctggagtgcagtggcacgacctcggctcactgcaacctctgcctcctgggttcaagcaattctcttggctsagcctcctgggtagctgggattataggcgcccaccaccatgccccactaattttttttgtatttttagtagatactgggtctcgccatgttggccaggct

SEQ ID NO: 28325 - DNA, 201 bp, Homo sapiens
aggcttgctattgtcacccaggctggagtgcagtggcacgacctcggctcactgcaacctctgcctcctgggttcaagcaattctcttggctgagcctccygggtagctgggattataggcgcccaccaccatgccccactaattttttttgtatttttagtagatactgggtctcgccatgttggccaggctggtcttaa

SEQ ID NO: 28326 - DNA, 201 bp, Homo sapiens
tgaatgctgtcttttggctgagttcgtctgcctcgagttagttagttcgttcctcccttccttccttccttccttccttcctccctccctccctccctctmtctttcttcctttctttctctgtctttctgtcttcttttttctttcttcttttttctttttctttcttttgagatggggtcttactctgttgcccaggct

SEQ ID NO: 28327 - DNA, 201 bp, Homo sapiens
ctggcttctgtctttgtgctttccaagtttacaatgatcaacctacaaaaatacttaggcaggcaaggacccatgttcaaagatgcacaccatcattcackaatgtggaaaactggaaacctcaatgtcaacagaggactgaatggaaaacgatgcagttgttaagaactgtaagtactaatatggaagaaagctcaggat

SEQ ID NO: 28328 - DNA, 201 bp, Homo sapiens
ccagcacaccaggatgctgccagccgtcaccacccttgctgtgttgtgtctcctcactggtttacttctttgctgtctgctaattctgccccaaggttcayctcttatggcctgggagtggtggcattcttttgtcatttctggaattacatttaactataccagaaagtgcaaaccaatggttcctgagcccacaggaga

SEQ ID NO: 28329 - DNA, 201 bp, Homo sapiens
ctcatgcctctgaagctttgtttccttttctgtaaaatggatgcaagaatagtgccagcctcttgggagccgggcatagtggctcatgcctgtaatcccarcactttgagaaactgaggcaggtggctcacttgagcccaggagtttgagaccagcctgggcaacacaacgagaccccatctctgcaaaaataaattagcc

SEQ ID NO: 28330 - DNA, 201 bp, Homo sapiens
accccgtctctactaaaaatacaaaaattagctgggcatgatggtgtgcgcctgtaatcccagctacttgggaggccgaggcaggagaatcgcttgaaccygggagatggaggttgcagtgagccaaaatcgcgttattgtactccagcttgggcaataagagcaaaacttcatctctaaataaatacataagtaaaagac

SEQ ID NO: 28331 - DNA, 201 bp, Homo sapiens
tgaaccaccacgcccagccagtatgttggatatttctaaagaggcccgtctgtagggagctagagggaaaattggactctttggggcccaggtcttccatytaagacgtatcatcaccatctagggagtttcaggacaggcctgtgtattcatctcacctgctgtcctcaaatagaaatcagaaaaaaaaagggcatatga

SEQ ID NO: 28332 - DNA, 201 bp, Homo sapiens
ccaaggtgggtggatcacctgaggtcaggagttctagacaagcctggccaacatggtaaaaccccgtctctactaaaaatacaaaaattagctgggcatgrtggtgtgcgcctgtaatcccagctacttgggaggccgaggcaggagaatcgcttgaacctgggagatggaggttgcagtgagccaaaatcgcgttattgt

SEQ ID NO: 28333 - DNA, 201 bp, Homo sapiens
attaaaaaatttattagctgggtgcgtgggctcacacctgtaatcccagcactttgggaggccaaggtgggtggatcacctgaggtcaggagttctagacmagcctggccaacatggtaaaaccccgtctctactaaaaatacaaaaattagctgggcatgatggtgtgcgcctgtaatcccagctacttgggaggccgag

SEQ ID NO: 28334 - DNA, 201 bp, Homo sapiens
atgagctaagccaaattcaataacaattttaaaatgcagaaaggaggattgttaaacttaggacaatacatgttgtctaccagatctttatttctctttcyggatatctgaagtgattattcagatttagatgggatttcctcatttctctgcccttttttttttttttttttttttttttttggatgaagtcttgctctg

SEQ ID NO: 28335 - DNA, 201 bp, Homo sapiens
ttgggtttctttaattctgcacacatatctgtaaacactttctttattaaatgttcctgagttaatatcttaagcacactgttcattttctgtgccacctgttaaatgatgagcatttaatatgattgtcagcatccaaaaaagatcctgcgtagtgcttagttcggtgcccaacacatagtaagtgctcaatgaacggtg

SEQ ID NO: 28336 - DNA, 201 bp, Homo sapiens
cattagaaatgtgttgggagggctgggcacagtggctcatgcctgtactcccagcactttgggaggccgaggtgggcagatcacctgaggtcagaagttcragaccacgctggccaacatgatgaaatgccgtctctactaaaaatacaaaaagtagccaagggtggtggtgcgcatctgtaatcccagctactggggagg

SEQ ID NO: 28337 - DNA, 201 bp, Homo sapiens
gtgagccaagactgtaccactgcactccagcctgggtgacagaataagactctgtctcaaaaaaaaaaaaaaaaaggaaatgggaggctgaaggtttgatmgagggagattgcaagatgaggtggaatcattccaaggtgggttcacatctcagcccttgaagaggttatttcctctctcgaagccttggttttcctatcc

SEQ ID NO: 28338 - DNA, 201 bp, Homo sapiens
cttttttttttttttttgagatgggggcttactctgtctttgaggctggagtgcagtggttctatcgtagctcagtacagcttccaagtcctggattcaarcgatcctctcacctcagcctcctgagtagctgtggaccacaggtgtgcaccaccacacctggctaattaaaaaaaaaaaaaaaaacttctgtagagactg

SEQ ID NO: 28339 - DNA, 201 bp, Homo sapiens
tatattgcccaggctggtctcaaactcctggcctcaagccatctcctgccttgacttttcacggcgctgggattacgggtgtgagccactgtgcctggccrtaactattaaatatgtcctccaatccaagtgctgtacattgacacattgtattttatttaacacagcatcccctgagttaaaaatgtttgccccttttag

SEQ ID NO: 28340 - DNA, 201 bp, Homo sapiens
tgagactacagagatgtaccaccatgctcagctaattaaaaaaaaacaactgttttttgtttgtttgttttgagacagagtttcacccctgtcacccaggytggagtgcaatggcacgatctcagctcactgcaacctccacctcctgggttcaagtgattctcctgcctcagcctcctgagtagctgggattacaggcac

SEQ ID NO: 28341 - DNA, 201 bp, Homo sapiens
ggcctgaaccaccacgcccagccagtatgttggatatttctaaagaggcccgtctgtagggagctagagggaaaattggactctttggggcccaggtcttycatctaagacgtatcatcaccatctagggagtttcaggacaggcctgtgtattcatctcacctgctgtcctcaaatagaaatcagaaaaaaaaagggcat

SEQ ID NO: 28342 - DNA, 201 bp, Homo sapiens
aacatggtaaaaccccatctctgctaaaaatacaaaaattagctgggcatggtggcacatgcctgtaatcccatctactcaggaggctgaaacagaagaawctcttgaacccgggaggtggaggttccagtgagcagagatcctgccactgcactccagcctgggtgacagagcaagactccatctcaaaaaaagaaaaga

SEQ ID NO: 28343 - DNA, 201 bp, Homo sapiens
agatccaatgtgatcaggcccctgcatagttttctacacatttcttaccctaccacctctcattcacttatgtcccagccacactgccttctttctcttcyttgaacacccaagcctggcagggtgctgtggctcatgcctgtaatcctgatactttgggaggccacagcgggtagatcacttgaagccaggagttcgaga

SEQ ID NO: 28344 - DNA, 201 bp, Homo sapiens
tggcctcccaaagcactgggattacaggtatgagcacccggccaaaagagaaggcagtttccaagtgctccttaatttttcgagttaaggaaaaaacacasatatcaccctaatttcccaaatttcctagaggaaaaacggtaaaaggaaagagacatacatagggttcagagcagggcttcgagtcagagctctgagtgt

SEQ ID NO: 28345 - DNA, 201 bp, Homo sapiens
aaaaaacaaaaacaaaaatcaaacgggcacggcggtgcgtgcctgtagtcccagctactcagaaggatgaagcaggaaaaatcacttaagcctgagaagcrgaggctgcagtgagccaagatcactgcattccagcctcccagcctgggcgacagaacaagaccccatctcaaaaaaataaaaagggggtagagtgttaat

SEQ ID NO: 28346 - DNA, 201 bp, Homo sapiens
gagggcatcgagtggaacttcatcgactttgggctggacctacagccctgcatcgagctcatcgagcgaccggtgaggggcacgtgggcgtgcggggctcygtcacaccttgtacacgtgtgtggcctctgtggagccgacgtggaccccacactctccccatgcacatagcattcccccacccaatccatcacccagtcc

SEQ ID NO: 28347 - DNA, 201 bp, Homo sapiens
gttcaagcgattctcctgccttggcctcttgagtagctgggattatagccatgtgccaccacacccggctaatttttgtatttttagtagagacagagttycatcacgttgtccaggctggtctcgaactcttgacctcaaatgatctgcccgccttggcctccaaaagtgctgggattacgggcgtgagccaccatgcct

SEQ ID NO: 28348 - DNA, 201 bp, Homo sapiens
ttttgtatttggtcagtgacatttcaaatttgggaggttttatattcaacaagaggatttttgaccaggcgcggtggctcacacctgtaatcccagcactwtgggatcagccgaggtgggcggatcacttgagtccaggaatttgataccagcctgggcgacatggcaagactgtgtctccacctaaaatacaaaagttag

SEQ ID NO: 28349 - DNA, 201 bp, Homo sapiens
gaatggcttgaacccgggaggcggagcttgcagtgagccgagatggcgccactgcactccagcctgggtgacagagcgagactcaaaaaaaaaaaaaaaamaagtaaaactcttgggtaggtgggtgggttaaggagagataacaaacccagtctcagacattcacagcttgacatgtccatgacacaccaagatgcaata

SEQ ID NO: 28350 - DNA, 201 bp, Homo sapiens
gcaagaattatgaactcggccgggcgcggtggctcatgcctgtaatcccagcactttgggaggccgaggcgggcggatcacgaggtcaggagatggagacyatcctggctaacacggtgaaaccccgcctctactaaaaatagaaaaaatcagccgggcgccgtggcaggcgcctgtagtcccagctactcgggaggctga

SEQ ID NO: 28351 - DNA, 201 bp, Homo sapiens
tggctcacacctgtaatcccagcactttgggatcagccgaggtgggcggatcacttgagtccaggaatttgataccagcctgggcgacatggcaagactgygtctccacctaaaatacaaaagttagccaggtgcctttagtcccagctactccggaggatgaggtgggagaatcacttgagcccacgatgaagaggttgc

SEQ ID NO: 28352 - DNA, 201 bp, Homo sapiens
ctagaagttagtgccagtttctcaaaggttctacagatttaaaaagaaaaaaaagggctggttgcagtggctcacgcctgtaatcccagcactttgagagsccgaggtgggtggatcacaatgtcacgagatcaagaccatcctaacacagtgaaaccccgtctcgactaaaaatacaaaaaattagctgggcatggtggc

SEQ ID NO: 28353 - DNA, 201 bp, Homo sapiens
tacctctcaagaggaggcaaccaatcaaatgttgccagcaccaatgaacttgtactttatttaggctcagaaagatcttttaggctaatgaaaatgccctrtatttatgaaatgttctcgttctctgtggctttctcttttttgagacagggtctcaccctgacacccaggctggagtgcagtgatgtaatcatagctcac

SEQ ID NO: 28354 - DNA, 201 bp, Homo sapiens
taacacggtgaaaccccgcctctactaaaaatagaaaaaatcagccgggcgccgtggcaggcgcctgtagtcccagctactcgggaggctgaggcaggagratggcgtgaacccaggaagcggagcttgcagtgagtcgagatcgcgccactgcaccgtctgcctgggcgacaaggcaaaactctgtctcaaaaaaaaaaa

SEQ ID NO: 28355 - DNA, 201 bp, Homo sapiens
atcagccgaggtgggcggatcacttgagtccaggaatttgataccagcctgggcgacatggcaagactgtgtctccacctaaaatacaaaagttagccagrtgcctttagtcccagctactccggaggatgaggtgggagaatcacttgagcccacgatgaagaggttgcagtgagccaagatcacgtcactacactccag

SEQ ID NO: 28356 - DNA, 201 bp, Homo sapiens
tcgctggagcccaggaggcggaggttgcagtgagccgagatcacaccaccgcagtctagcctgggtgacagagtgagaccctgtctccaaaaaaaaaaaaaggccaggcatgattgctaacgcttgtaacccccagcacttgggaggtcaaggtgggaagatcgcctggaaaattaatctgaaaactcacctctagaaatc

SEQ ID NO: 28357 - DNA, 201 bp, Homo sapiens
gtttcacaatgttggccaagctggtctcaaactcctgacctcaagttatcctcccacctcagcctcccaaagttctgggattataggcatgagccatcacrctcggcctacttgtgatcaatcttacttcatcttcacaccctcccatttctcttacgcatcctccagtttctctctctctctctccttctttttctctct

SEQ ID NO: 28358 - DNA, 201 bp, Homo sapiens
gcactccagcctgggcaagagagtgagaccttgtctaaaaaaaaagaaagtaggaatgaagatggagggaacagaaatggactccaaaaatatttagaagscaaacttaccagaacttgatgaattatgacttttcggggcaggggagagagaaaaaggaggtgaggacatcttctggggctctaccttaggcaattgggt

SEQ ID NO: 28359 - DNA, 201 bp, Homo sapiens
ctttcgtggagaagctgtgcacggagcagggcagccaccccaagttccagaagcccaagcagctcaaggacaagactgagttctccatcatccattatgcygggaaggtaccagccacagggcccaggggactctgtctcaggggacccccagtggctgctcagcgcagagacagtctgagagtggcagaaccttgggctg

SEQ ID NO: 28360 - DNA, 201 bp, Homo sapiens
aggcggaggctgcggtgagccgaaattgcaccactacactccagcctggacaagacagggcaagagcatgactctgtctcaaaaaagaaaaaaaaaaaaaagaccaatcaggacctccgcttgggttagtgcaacacaatggggcatgggaacgatggctcatgcttgaaatcccagcattctgggaggccgagatgggag

SEQ ID NO: 28361 - DNA, 201 bp, Homo sapiens
ggaatccagcctgctccaagctctccttttttggacagagactgaatctttgcacttgatcttgtttgtgtttttaagtctgaggttagacagggtcccakgcaatggaggcgtgcgtgtccttttatttttctgttgtagcttttgctattttttctgacttttaaggcaactcatccacatggcaattaggaagagccc

SEQ ID NO: 28362 - DNA, 201 bp, Homo sapiens
aggctggagtgcaatggcgtgatctctgctaactgcaacctctccctccgggttcaagagattctcctgcctcagcctcccaaatagctgggattacaggyacctgccaccacacccagctaatttttgtatttttagtagagaagggtttcgccatgttggccaggctggtctcaaactcctgacctcaggtgatccacc

SEQ ID NO: 28363 - DNA, 201 bp, Homo sapiens
agagaggttcaacagtagataccagtcagaaaaaagacctactggggtgaaacactccaggtagaaaccccaaataaagggaaacccacaggaccttgccyagcagacttggaactctacaggatgtttctcttgactaacaaaatggtttcagatttttaaaaagctatgacagtgacacactaatgcttttattattga

SEQ ID NO: 28364 - DNA, 201 bp, Homo sapiens
gctaagaagcaggctacagtctcagaggtttatgacacctttttttttttttttggagacggagtctcactctgttgcccaggctggagtacagtagcgcratcttggctcactgcaccctccacctcccgggtccaagcaactctcctgcctcaacatctggagtagctggaattataggcacgcaccactgcacccagc

SEQ ID NO: 28365 - DNA, 201 bp, Homo sapiens
aatattttccagggtggagtggggaggatggttttgggatgaaactgtcccacctcatcatcaggcattggttagattctcataaggaacgtacaacctakatcccttgcaggtggagttggcaatagggtttgtgcttctgtgaaaatctaatgctgcttatctgacaggaggcggagcttaggcagtgatggtcactca

SEQ ID NO: 28366 - DNA, 201 bp, Homo sapiens
tgagccaccgtgcctggccgcccagctaaatttttaaattatgtatagatatggggtcttgctgtgttgcccaggctggtcttgaattcctgggctcaagmgatctccctgcctcggcttcctgaagtgctgggattatgagcacgagccactgtacctggcctcagcctgcttttcttgtatagactctaaatccttcct

SEQ ID NO: 28367 - DNA, 201 bp, Homo sapiens
aaattactctgaaaactcgaacgcacctctaggaatctcaatgagaagctaagaagcaggctacagtctcagaggtttatgacacctttttttttttttttggagacggagtctcactctgttgcccaggctggagtacagtagcgcaatcttggctcactgcaccctccacctcccgggtccaagcaactctcctgcctc

SEQ ID NO: 28368 - DNA, 201 bp, Homo sapiens
ccagcactttgggaggccgcagcaggtgggtcacctgaggtcaggagttcaagaccagcctggccaacatggtctctgctaaaccctatctctactaaaartacaaaaattatctgggcatggtcgtgggcacctgtaatcccagctactcgggaggctgaggcacgagaatcgcttgagcctcagaggcagaggttgcat

SEQ ID NO: 28369 - DNA, 201 bp, Homo sapiens
aaagactgtatgacttggctgggtgtggtggctcacgcctgtaaccccagcaccaaggcaggtggattacttgaggtcagcagtttgagaccagcctggcyaacatggcgaaagcccgtctctgctaaaaataaaaaataaaaaaaatttaaaaattagccagctgtgagattacaggcacacaactgtaacctcagctac

SEQ ID NO: 28370 - DNA, 201 bp, Homo sapiens
taggataaattcccagaaatgcgcttgctgagttaaagggcatgcgtatctaaaattaatagatattgcaaatgactggctaaagacattgcagaccaggygcagtggctcacgcctgtaatcccagcactttgggaggccgcagcaggtgggtcacctgaggtcaggagttcaagaccagcctggccaacatggtctctg

SEQ ID NO: 28371 - DNA, 201 bp, Homo sapiens
taaaaatataaaaaaaatgagccgggcgtggtggcgcatgcctgtaatcccagctactgggaggctgaggcgggagaattgctggaacccgggaggcggasgttgtggtgagccgagatcacgccattgcactccagcctggccaacaagagtgaaactccgtctcaataaaataaaataatgataataataataataata

SEQ ID NO: 28372 - DNA, 201 bp, Homo sapiens
tggaatcccagcactttgggaggctgagatgggaaaatcacttgaggccaggagttggaggccagcctagccgagagagacccccgtctctataaaaaaaaggtgttttttttttgttgttgttagtaagccaggcaggatagtgcacacctgtactcccaacctcttggaaggctaaggcaggaggatcatgtgagccag

SEQ ID NO: 28373 - DNA, 201 bp, Homo sapiens
aggaaaatgggaataatagataatgccactctttcatccttggactttttgtctaattatatgaatttatctgtaggataaattcccagaaatgcgcttgmtgagttaaagggcatgcgtatctaaaattaatagatattgcaaatgactggctaaagacattgcagaccaggtgcagtggctcacgcctgtaatcccagc

SEQ ID NO: 28374 - DNA, 201 bp, Homo sapiens
cctcaggtgatccactcacctcagcctcccaaagtgctgggattacaggcgtgaaccaccacgcccggcctttttacacttttttttttttgccttttccyccctcttttgtgtggagaatggggtcttgttatattttccaggcaggtcttgaactcctgggctccagctttcctcatgcctgtgccttcctaagagctg

SEQ ID NO: 28375 - DNA, 201 bp, Homo sapiens
tctttctaactccagagtttcacagattaccctcatgggaggatttgatgagctaatgtgtatgaagggtttagcacagtgcctggcccctggtaagcttyagtgatggttatttatagcaaacacaaccagagagttcaagatgtttgctcagtatggcatggctcatctttggcagaaccgggaagcctaaactatgtg

SEQ ID NO: 28376 - DNA, 201 bp, Homo sapiens
caggtgatccactcacctcagcctcccaaagtgctgggattacaggcgtgaaccaccacgcccggcctttttacacttttttttttttgccttttcccccytcttttgtgtggagaatggggtcttgttatattttccaggcaggtcttgaactcctgggctccagctttcctcatgcctgtgccttcctaagagctggga

SEQ ID NO: 28377 - DNA, 201 bp, Homo sapiens
cagagtctcgctctatcacccaggctgcaatgcagtgctgcaatctcgtctcactgcaacctctgctttccaggttcaagcgattctcctgcctcagtctyccgagtagctgggactacaggcatgcggcaccacacccagctaatttttgtatttttagtagtgacggggtttcaccatgttggccaggctggtctcgat

SEQ ID NO: 28378 - DNA, 201 bp, Homo sapiens
cctctgtcaacaaaagggtcatttgcgaattcctcttctcagtgatcatgaatctctgggccttgatttttttttttttttttttttgagacggagtctcrccctgtcgcctaggctggagtgcagtggccacatctcggctcactgcaagctccgcctcctgggttcatgtcattctcctgcctcagcctccctcccgag

SEQ ID NO: 28379 - DNA, 201 bp, Homo sapiens
taaaaaaaaaaaaaacaactcacccaggttgaccccaaagggcccccagatacccaggtgggctccaaagtctccatttgcttccacgatctgcaggtgcrttaggtaagattacactagaatttcccgcagagccacctgtgtcaatgccactctcgtgcccaaccaaatgggtaaaacgagagaaagtgtggctactgc

SEQ ID NO: 28380 - DNA, 201 bp, Homo sapiens
gagtgtaatggtgcgattgtaactcactgcagcctcaaactcctgggttcagcaatcctgcctcagcttcccaagtagctgagactacagagatgtaccamcatgctcagctaattaaaaaaaaacaactgttttttgtttgtttgttttgagacagagtttcacccctgtcacccaggctggagtgcaatggcacgatct

SEQ ID NO: 28381 - DNA, 201 bp, Homo sapiens
tcctcttctccaaattaaaaaaaaaaaaaacaactcacccaggttgaccccaaagggcccccagatacccaggtgggctccaaagtctccatttgcttccrcgatctgcaggtgcgttaggtaagattacactagaatttcccgcagagccacctgtgtcaatgccactctcgtgcccaaccaaatgggtaaaacgagaga

SEQ ID NO: 28382 - DNA, 201 bp, Homo sapiens
ccaccacgcccagccagtatgttggatatttctaaagaggcccgtctgtagggagctagagggaaaattggactctttggggcccaggtcttccatctaagacgtatcatcaccatctagggagtttcaggacaggcctgtgtattcatctcacctgctgtcctcaaatagaaatcagaaaaaaaaagggcatatgaaggt

SEQ ID NO: 28383 - DNA, 201 bp, Homo sapiens
agaggcccgtctgtagggagctagagggaaaattggactctttggggcccaggtcttccatctaagacgtatcatcaccatctagggagtttcaggacagkcctgtgtattcatctcacctgctgtcctcaaatagaaatcagaaaaaaaaagggcatatgaaggtcctgagacccaaaatatcttctgacagcagattaa

SEQ ID NO: 28384 - DNA, 201 bp, Homo sapiens
aggataatctatgcaaagacctcaggagaatatttaaaaataagtatgtatcacaaaaagcagccctcttccctggaggcaaacatgattcacaggttcaygtatgtacacacacacacacacacacacacacacacacacaccccaaacataagaaaaagtcactccttgtatgttttgcagtatgattttttttccact

SEQ ID NO: 28385 - DNA, 201 bp, Homo sapiens
agaaaaagtcactccttgtatgttttgcagtatgattttttttccacttaaccctaccttatagttttttctgtctgttcataactatctagtcagacttmaaatatgtttttgaataggtaagacatgcaaatatgaaataaaatagtgtataagggaatatagaacttcccccttcgttcctatttctcgcccttccag

SEQ ID NO: 28386 - DNA, 201 bp, Homo sapiens
gtctcccgcccgccgctcccgccgctcccggggagggggaccggcccggcccggcccggcccgggaacctcggaggagctggtgccgcgcggggagcggarcgcccgggctgcccgcgggtccccggcctggcgcggggccagcccaccgcctcgacttccttttatggcctgtgtgtgcgtgcgtggacaggagcgggga

SEQ ID NO: 28387 - DNA, 201 bp, Homo sapiens
actctggggctcaaacaatcctcctacttcactctctagttgggactacaggcacacactgctgtgctcgactaattattattattattattattattatyattattattattattattattttgtagagacagggatcttgctatgttacctaggctgttcttgaactcctgggctcaagcgatccttccgctgcagcct

SEQ ID NO: 28388 - DNA, 201 bp, Homo sapiens
acattagaaagcaaatcgacgttataaataattaattgggccagcaacagtgacccacccctataatcccagcactttgggaggccgaggcaggcagatcrcctggggtcaggagttcaagaccagcctggccaacatggtgaaaccccatctctattaaaaatataaaaattagccaggcatggtggtgcacacctgcag

SEQ ID NO: 28389 - DNA, 201 bp, Homo sapiens
ccgtgtccttgcttccttcatgggtcctctcaacttctctgcgctgagatcccccgcaggcagatcgcggtggagtgttggtgcgatggtgcttgaccccycagcttcccctgctattgggtttctccaacgaggagacatggtcttcgcttctcagagtctgtggggccagggacaggggccattcatggtccccctctc

SEQ ID NO: 28390 - DNA, 201 bp, Homo sapiens
tgacccacccctataatcccagcactttgggaggccgaggcaggcagatcgcctggggtcaggagttcaagaccagcctggccaacatggtgaaaccccayctctattaaaaatataaaaattagccaggcatggtggtgcacacctgcagtcccagctactcaggaggctgaagcaggggaatcgctgaacctgggaggc

SEQ ID NO: 28391 - DNA, 201 bp, Homo sapiens
ctttgactaaccagtctcttggcacccttagaatgaagttgagagcgtcacagggatgcttaacgaggccgaggggaaggccattaagctggccaaggacrtggcgtccctcagttcccagctccaggacacccaggtgagtgtcctgccacatcatccaggggacctggggggtggccttcctcggggcaggtccctggg

SEQ ID NO: 28392 - DNA, 201 bp, Homo sapiens
aatcaaactgctgatggacaggaagtgagggagacgaggtgatgaggaggaagccccaggttccagccaggcgatgctagtgtcaccaagaaccagagagwtcatgaggcagccattgccgaagcaaagagatgaaaacccagaggggggcactgctttgcccctcggccctcagctaagccctccttgggtgcttctgtt

SEQ ID NO: 28393 - DNA, 201 bp, Homo sapiens
aagggtcagacacacctgggcacaagtcccagccccaaacttcctagatgccacagagtgggccaagtcccttaaccttctggggcatgggctctttaccygcagaatgggactcatcatagctcatggggtgcacgaggctgtcatgaggattaaataagatgctgcccacacagcactcagcaataagccaaagcccta

SEQ ID NO: 28394 - DNA, 201 bp, Homo sapiens
atgtacaacctgttttgatgtcagaccttggcactcacatcctatgttaatctcatatagtctggcatgtcaagaagcagacctggggacatggatagaargtgtttgatgtctctgcaacataactgtctggtcccagaaaagtttttggccacattgtaagagaggaaaccaagggacctgggggttcattctgctggg

SEQ ID NO: 28395 - DNA, 201 bp, Homo sapiens
ccccaaccggatcgtcttccaggagttccgccaacggtaagtcccaaggtctggcccaggtagggcagggggtgagcgggactgggtggaggaatggatgytggaggtacccggggtgacttctgctctgtgtttcaagctacgagatcctggcggcgaatgccatccccaaaggcttcatggacgggaagcaggcctgca

SEQ ID NO: 28396 - DNA, 201 bp, Homo sapiens
agggggtgagcgggactgggtggaggaatggatgctggaggtacccggggtgacttctgctctgtgtttcaagctacgagatcctggcggcgaatgccatycccaaaggcttcatggacgggaagcaggcctgcattctcatggtgagcccagaagtccaccagagacctcccaacctctggccgcaagccacctgctgct

SEQ ID NO: 28397 - DNA, 201 bp, Homo sapiens
cattcttccttctcgtgcatgcctgtgtgggtgtgccctcagcatatgcttacaaggtttattgggtgatccaacgctagccgcaagagctattattagcycccttttacagctgggaaaacagactcagaggagtggagaacttgctgcagatttgttaagtgtcagagccaaatatacacttggattatcctgactcca

SEQ ID NO: 28398 - DNA, 201 bp, Homo sapiens
agctgagatcgtgccaccgcactccagcctgggcaacaagagcgaaactctatctcaaaaaaaaaaaaaaaaaaaaaagaaagaaagaaaaaagaaacagytagtgcagctggggagtacgggagcccccttaggaatgatgcacatagttgtgttttctgagtggtgtttggatctcagctaagtccagggcatgttgtg

SEQ ID NO: 28399 - DNA, 201 bp, Homo sapiens
ttgtagagatgaggttttgctatgttgttcaggctggccttgaactcctgagcccaagcaatccacctacctcggcctcccaaagtgctgggattataggygtgacccacagtgcctggccagcaccttccttgttaaattgcatgtgtcagccacctccctcggtgtcctcccagcctctgggcagtctggctccccatt

SEQ ID NO: 28400 - DNA, 201 bp, Homo sapiens
ggatcccccagcagcctgttaccagaaagaagggcagacgcagggagcctgggtctgtgctcagtccccgctgggttttctccttttatggtcagcctacmgtgctctggcttcccagacagaatccaccagcttgtgtttgggcttgggccgaaatagctggtctgtggggagctgggtacctcctgggagtcctcaggc

SEQ ID NO: 28401 - DNA, 201 bp, Homo sapiens
ctgcgccgcctacctcaagctgcggaactggcagtggtggaggcttttcaccaaagtgagtgctctgccccagcccccttcccaggggcccccagccctgsttcttcactctggagccttcacatttgggacaggaggtggtcgcaagtgggtgtggaatggagggctcgaactcagaccttgagcattggcggttctctg

SEQ ID NO: 28402 - DNA, 201 bp, Homo sapiens
gctggagtggagtggcacactcatagctcactccagcctccaactcctgggctcaagtgatcctcccctctcagcctcccaagtagctgggaccacaggcrcagatcatcacgcctggctaattttttgattttttgtagagatgaggtctcattatgttgcccaggctggtctcgaactcctggcctcaagcaatcctcc

SEQ ID NO: 28403 - DNA, 201 bp, Homo sapiens
tcctgtctcctacaccccttcactggccagttctgctttcatgtttttatttattatatattttttgagacagagtttcactctttcacccaagctagagygcagtggcacaataatagctccctgtaacctcgaactcctaggctcaagcaattttcctgcctcagccttccaaatagctggggctacaggcacacacct

SEQ ID NO: 28404 - DNA, 201 bp, Homo sapiens
gctgtaatcccagcactttgggaggccgaggcgggtggatcacaaagtcaagaaatcaagaccatcctggccaagatggtgaaaccctgtctctactaaaygtacaaaaattagctgggcgtggtggcaaacgcctgtagtcacagctactcaggaggctgaggcaagagaatcacttgaacctgggaggcagaggttgca

SEQ ID NO: 28405 - DNA, 201 bp, Homo sapiens
gttacattccatcacttcttcctgatttttgttgttgttgttagaagcaaatctaacccccactcaaggggaggagaattaggctccacctttttggagtmgcaaagaacttgtggatagattttaaaaccaccatggtacctactgtgctcattttatagatgaggaggttgaggttccatgaagcagagcagcttaccc

SEQ ID NO: 28406 - DNA, 201 bp, Homo sapiens
gagtttgggaccagcctgggtaatattactaagttaccttactaggccctgtctctacaaaaaaaatgaaaacaaaaaacaaaaaaaccattagccaggcrtagtggcatgcacctgtagtcccagctgctcaggaggctgagatggaaggatctgttagcccaggagttccagactgcagttagctatgatcgtgctact

SEQ ID NO: 28407 - DNA, 201 bp, Homo sapiens
aaattagccaggcgtggtcgtgggcacctgtagtcccatctactcgggaggctgaggcaggagaatagcttgaacccaggaggcagaggttgcagtgtgcrgagaccgcaccattgtactccagcctgggctaaaagggcaaaactctgtctcaggaaaaaaaaaaaaaaagaaaaaaaacccttccttttccaatttgat

SEQ ID NO: 28408 - DNA, 201 bp, Homo sapiens
tggtagttacgtaacattgtgaatgtactaaatgctcctgaattatgcactttagttatttttttatctttattactattttttgagatggagtctccctstgtcacccaggctggagtgcagtggcgcgatctcagctcactgcaaactccacctccctggttcacgcgattctcctgcctcagcctcctgagtagctgg

SEQ ID NO: 28409 - DNA, 201 bp, Homo sapiens
ttactgctccattaattttaacaaatgtgtattgtgtaactaccaccaccacagtcaccacatagaatgttagttattgattgattgattgagatggagtstcactctgttacccaggctggaatgcagtggcatgatcttggttcactgcaacctccacctcccaggttcaagcaatacttgtgccttagccaccccagt

SEQ ID NO: 28410 - DNA, 201 bp, Homo sapiens
tgagcacctactgtgtgtcaggcattgttccttgtacccgggatcaggcacagcccttgaccttcaggagctcattggttcaggggaaaagcattgaaaaygaacaattttgtaattgttggaaacctaatagagctgcatgaagtggaagaagtcagatttataatcattcagaggtggtataaaatgaacatcattttt

SEQ ID NO: 28411 - DNA, 201 bp, Homo sapiens
aagatcatgcctgcactccagcctgggtgaaagattgagactctgtctcttctttctttttttttttatttaaaaaaaaggccaggcacggtggctcacgsctgtaatcccagcactttgggaggccgaggcgggtggatcacaaagtcaagaaatcaagaccatcctggccaagatggtgaaaccctgtctctactaaat

SEQ ID NO: 28412 - DNA, 201 bp, Homo sapiens
tgggaagtggggtgggagatgtcaagtcagatccaccacagccccgacacggggaggaagaggttaaagcctttgcggccggaaccgactcagggaagacsttctcaagcatcccgcacagacactgcctgctcgaccccctttctctagggatccggagcgtctgcgaccgcctggggccggggctgagactcccgtccc

SEQ ID NO: 28413 - DNA, 201 bp, Homo sapiens
tcagaaagtgaacactcatagggctggcattcagatgaagatctagaggtcaaccctcacaagcccccctcacgttctgtccttgcaatcattgcacaccsgagactcattcattccttatctgagttctatcaccgtagattaattctgcctggttttggacctcagttcaatagtcacagaacctgtgctttttgtgac

SEQ ID NO: 28414 - DNA, 201 bp, Homo sapiens
acaaagtgagactccatctcaaaataataataacctaataaacacatataacaacatgattttttaagacacaggtttttgctgtgtctctcaggccgaastgcagtggtacaatcacagctcactgcaatctcaaactcttgggctcaagagatcctcccgcctcagcctcctgagttactgagattacaggcatgaggc

SEQ ID NO: 28415 - DNA, 201 bp, Homo sapiens
aatagtgccttaccacgtacagcatggcgggactcgccttgtgccttgactcctccgtccctgatctgattattttcagatgctcctattcacccagtagragaggactgctattttttaaatggtaaagtgcatatgacataaaatttaccattttaaacattttaaagaaaacagtgccattaagtgcattcacaatgt

SEQ ID NO: 28416 - DNA, 201 bp, Homo sapiens
agctgtgtaacctggtgacaacctcaccatgcctcactttgccctcctgtcaaacaggcggtggggaaatcactgttactgagtagttgtgaagatgccaygcggagatgcctctgccatcttctagagactgagtcactggggtttcttcttagatatggacattgggaggtcccagaaagagatcagagggtggtggga

SEQ ID NO: 28417 - DNA, 201 bp, Homo sapiens
ctgtgtaacctggtgacaacctcaccatgcctcactttgccctcctgtcaaacaggcggtggggaaatcactgttactgagtagttgtgaagatgccatgmggagatgcctctgccatcttctagagactgagtcactggggtttcttcttagatatggacattgggaggtcccagaaagagatcagagggtggtgggagg

SEQ ID NO: 28418 - DNA, 201 bp, Homo sapiens
tggtaccacctacttgggaggctgaggcgagaggatcacttaagcccagaaactcaaggttgtagtgagccaagatcaccccactacactgcagcctgggygacagagcaagaccctgtctcaaaaaaaaaaaaaagtaaacaacattctcttctgttcttgctcttcagacttaactgctcccgtcactggttgggtttc

SEQ ID NO: 28419 - DNA, 201 bp, Homo sapiens
tgacctcatgatccgcccgcctcggtctcccaaagtgctggcattacaggcatcagccaccacgccaggcccaagagctcagtcttgaagcagagaattastgagtaattctcttgatattttactcaggatccatggagggcctgttatcctctccaaactgcagttcataccactaatcttcctcctacccagcttttc

SEQ ID NO: 28420 - DNA, 201 bp, Homo sapiens
ccccactacactgcagcctgggcgacagagcaagaccctgtctcaaaaaaaaaaaaaagtaaacaacattctcttctgttcttgctcttcagacttaactrctcccgtcactggttgggtttctttaattctgcacacatatctgtaaacactttctttattaaatgttcctgagttaatatcttaagcacactgttcatt

SEQ ID NO: 28421 - DNA, 201 bp, Homo sapiens
ccactacactgcagcctgggcgacagagcaagaccctgtctcaaaaaaaaaaaaaagtaaacaacattctcttctgttcttgctcttcagacttaactgcycccgtcactggttgggtttctttaattctgcacacatatctgtaaacactttctttattaaatgttcctgagttaatatcttaagcacactgttcatttt

SEQ ID NO: 28422 - DNA, 201 bp, Homo sapiens
atcctgcgtagtgcttagttcggtgcccaacacatagtaagtgctcaatgaacggtggctgttatttaagccagtgaggtccggggaggtaaagtggcagstcggaggagtggagctgagatttgaacccagagctcttcaaaactccacagtttggccaggtgcaatggctcacaactataatcccagtgctttgggagg

SEQ ID NO: 28423 - DNA, 201 bp, Homo sapiens
aaaaaaatacaaaaaaattagctgggcatggtggcgggtgcctgtagtcccagctattcaggaggctgaggcaggagaatggtgtgaacctggggggcggrgcttgcagttagcagagatcgcaccactgcactccagcctgggtgacagagcgagactctgtctcaaaaaaaaaaaaaaaagaaaagaaaagaaactgaa

SEQ ID NO: 28424 - DNA, 201 bp, Homo sapiens
gcaggcagatcatctgaggtcaggagttcgagaccagcctggccaatgtagtgaaaccccatctctactaaaaatacaaaaaattagccaggcatggtggygggcgactataatcccagctactcgggaggctgaggcaggagaatcgcttgaacctgggaggtagaggttgcagtgagccgagattgccccactgcactc

SEQ ID NO: 28425 - DNA, 201 bp, Homo sapiens
ggtcccagaaaagtttttggccacattgtaagagaggaaaccaagggacctgggggttcattctgctgggtctctccctggaaggcttgacgatgaaatcrctcagaagaacaatgccctgaagaagatccgggagctggagggccacatctcagacctccaggaggacctggactcagagcgggccgccaggaacaaggc

SEQ ID NO: 28426 - DNA, 201 bp, Homo sapiens
caggaggaggagatgcaggccaaggaggatgaactgcagaagaccaaggagcggcagcagaaggcagagaatgagcttaaggagctggaacagaagcactygcaggtacctgtatggatgcatggctggggttgctggggaacaggacttggccccgtggggctcacccgcctcctccccaccacctgcgtgcagctgacc

SEQ ID NO: 28427 - DNA, 201 bp, Homo sapiens
aaaaggctctgtcctgtagatgatttaagttgtttgcagccagacaacacatgtgtcacacagggtttctggaagaacctgagttggggagattggggcaygtccctgtgcaggttcaggatgctgcagggcagggctctgttgacagcagggtgtggcttcatgacccccgcaccttctcttcccccctccctagggctt

SEQ ID NO: 28428 - DNA, 201 bp, Homo sapiens
ggccgaggtgggcggatcacgaggtcaagagttggagaccagcctggccaacatggtgaaaccctgtctcaaaatacaaaaattagccaggcgtggtggcrggcgcctgtaatcccagctactcgggaggctgaggcaggagaattgcttgaacccgggaggcggaggttgcagtgagctgagattgcgccactgcactcc

SEQ ID NO: 28429 - DNA, 201 bp, Homo sapiens
ggagattggggcatgtccctgtgcaggttcaggatgctgcagggcagggctctgttgacagcagggtgtggcttcatgacccccgcaccttctcttccccmctccctagggcttttgccaagaggcagcagcagctgaccgccatgaaggtgattcagaggaactgcgccgcctacctcaagctgcggaactggcagtggt

SEQ ID NO: 28430 - DNA, 201 bp, Homo sapiens
tggccaggtagcggggctggcaaggggcatttgctgtgtgtccatgtatcccctgggcccctgctcattcgctcattcgcagtggctgtcttggtcaaggyggccccaggcccttggcatgaacttcgtttcccaggccaggcctcccacaagccttctcgaccctgttcactcccccagatcctcaccttcgactttctt

SEQ ID NO: 28431 - DNA, 201 bp, Homo sapiens
tgatgatggccgggcgcggtagctcacgcctgtaatcccagcacattgggaggccaaggcaggggaatcacctgaggtcaggagttcgagaccagcctgaycaacatggagaaactctgtctctactaaaaatataaaaaaaatgagccgggcgtggtggcgcatgcctgtaatcccagctactgggaggctgaggcggga

SEQ ID NO: 28432 - DNA, 201 bp, Homo sapiens
ttcttctcttccctgcaaacacatcatgtctttgcagttgatctcacctactcccatggtgttgctgctgcctcttcgacatccaggcttttctcatctakacccccttctgaatttccgattgcccaatgagtcaatttccaccgtcatctcaaacacccctgtctaaggcgggaatgaccttcctttccccagcccctc

SEQ ID NO: 28433 - DNA, 201 bp, Homo sapiens
tctgccagtccttctaaatgtcccccacccatttcctctggtttttccctcttcctggctcttagctggatttacactaatgctaatactgcagcagccastatgaatgattatttacctgctcactcggtgctaagttcttttcaagcaatacctttgcagacacctggccaggtgtactgccggtgtctttgaggagga

SEQ ID NO: 28434 - DNA, 201 bp, Homo sapiens
ggatcatttaagcccaggaatttgaggctgcagtgagccatcatcacaccactgcactccagcctgggccgcagagccagaccctgtctctgaaaataaayaaataaataaataagttagtcagaaacagctggtgtaggctgggcatggtggctcctacctgtaatcccagcactttgggaggccaaggtgggtggatca

SEQ ID NO: 28435 - DNA, 201 bp, Homo sapiens
gcactttgggaggccgaggcaggaggattgcttgagcccaggagtttgagaccagcctgggcaacatggcgagacccctatctctaccaaaaaaaaaaaaactttaaaaattagctgggcatggtagcatgtgcccgtagtcccaactacttgggaggctgaggcaggaggatcatttaagcccaggaatttgaggctgca

SEQ ID NO: 28436 - DNA, 201 bp, Homo sapiens
ggagcagggtgggtttttggaaagaggcctgcaggggcgggacagtgggtgtgagggcaggggcaacgctgcaatcgaggggtctggggtcgcagagaagsgggtggcaggatggaggaataggagagagagagaaaagaaacgagggtcatctaggagaggagtatggggaggaaggaagaggagaaagaggatggagcc

SEQ ID NO: 28437 - DNA, 201 bp, Homo sapiens
ccatggcctgtgggttgggcttggcatgtgcaggacctgctgggctggtagaaaaagaaccttggaggtgatgatgatgatgatgatgatgatgatgatgdtggccgggcgcggtagctcacgcctgtaatcccagcacattgggaggccaaggcaggggaatcacctgaggtcaggagttcgagaccagcctgaccaaca

SEQ ID NO: 28438 - DNA, 201 bp, Homo sapiens
gctgagtgcggtggctcacacctgtaatcccagcactttgggaggctgaggcgggtggatcacctgaggtcaggagttcgaaaccagcctgaccaacatgktgaaaccccatctctactaaaaatataaaattagccgggcgtggtggtgggcacctgtaatcccagctacttaggaggccgaggcaggagaatcgcttga

SEQ ID NO: 28439 - DNA, 201 bp, Homo sapiens
tcggtcactggcggtgtgagcaagaacagtttctacacagtggaggaggaaagacgaagaactgagtgcaggagtaactgggaggtgaaaaagaggaaagmgatggaattctggagaattacctaaaagacgatgaaataaattagccaacagctagaggatgtgggcggtaggggccttggctctcaggactttgagctg

SEQ ID NO: 28440 - DNA, 201 bp, Homo sapiens
tggtggtgggcacctgtaatcccagctacttaggaggccgaggcaggagaatcgcttgaacccgggaggtggaggttgcagggggccaagattgcgctgtygcactccagcctgggcaacaggagtgaaactccatctcaaaaacaaacaaacaaaaccatggactcaaggtcaaggtttagcttctaattctggctccat

SEQ ID NO: 28441 - DNA, 201 bp, Homo sapiens
ggtaaccgaaggaggcagagaagaaacagagtgagagagatgagaatcaggaagactgtgctgtcctgggagtgggcggtttcaagggaaaaaagggaaasattccagtgtcacaaggatgcaacagagaagcagggaagataagggctggaaaatatccacaaggctgagcgaaagtcggtcactggcggtgtgagcaag

SEQ ID NO: 28442 - DNA, 201 bp, Homo sapiens
ggggctggaatggaaattacgcataaaataataattataattattatttgagacagactcttgctctatcacccaggctggagtgcagtggcgtgatctcrgctcactgcaacctctgcctcctgggttcaaatgattcttgtgcctcagcctcccgagcaactgcgattttacaggcatgcgccaccacgcctggctaat

SEQ ID NO: 28443 - DNA, 201 bp, Homo sapiens
tgggagatggaggttgcagtgagccaaaatcgcgttattgtactccagcttgggcaataagagcaaaacttcatctctaaataaatacataagtaaaagamaataaaaaataacaaatttatttcttttgttgtgttggccctaggtcaagtagtcaatagccacctgtggctagtggctggtgtactgggtagcataagt

SEQ ID NO: 28444 - DNA, 201 bp, Homo sapiens
aggaaccctaggtgaattcaagtcaagcaacaaattcatttgcaagaattatgaactcggccgggcgcggtggctcatgcctgtaatcccagcactttggraggccgaggcgggcggatcacgaggtcaggagatggagaccatcctggctaacacggtgaaaccccgcctctactaaaaatagaaaaaatcagccgggcg

SEQ ID NO: 28445 - DNA, 201 bp, Homo sapiens
agaatgttcccattatcatagaaagttctgttggactgcttggactagatgattggggcttggagtgtgatgttgtggggcacgggtcgccagactgatgygcagaggtcacccaacccggcctatgtctatgtcttctctctgaaaggccttgctcaccctcgagcaggttacctcatgcctctgaagctttgtttcctt

SEQ ID NO: 28446 - DNA, 201 bp, Homo sapiens
acataaaaaataaactataaactaagttcctgccaagttaattcggcttacacccacaaatggttcagtggagcttggaggttagaagcaaggtggagtcsgttaggtcagatcttgttcagtgtctcagttataattttgcagtggcagtttcattctcaggtgtttgttatgtattagagtccctaaatctggcaaatt

SEQ ID NO: 28447 - DNA, 201 bp, Homo sapiens
cccaactcataggtgacggagttcccttcaagccacagattctgttttttttgtgtgtgtgtgtgtttttttttttttttatcagagtcccatacctcacsggtattttctcaatcagtgaacacctcaagtactagcccatgtgttttgagtaaaaagggctcctttcaacgaggatccccttctagaggctttgactaa

SEQ ID NO: 28448 - DNA, 201 bp, Homo sapiens
gccagggatgctgccaaacatcccacagtgtggtcaggcggggtgactcatgcttgtaatcccagcactttgggaggctgaggcgggcggatcacctgagstcaggagttcgagaccagcctggccaacatggtgaaacctcgtccttgctaaaaatacaaaaattagccgggcgtggtggctcacacctgtaatcccagc

SEQ ID NO: 28449 - DNA, 201 bp, Homo sapiens
gtaacttactctcccagcccataatagcagcatgcatgagtcttgttaataggcgggtagtgaggtgataccaggtccgtggtctggcatgcatgactttkccctctgtgatgaagataaactttctcctccgttctgcaaggctcgcctcaaacgatgtgcccttgagaaggttctggcagacctcttgtgctcttggat

SEQ ID NO: 28450 - DNA, 201 bp, Homo sapiens
tttaattagaggccatgggcctggctggagatagagctgtgtgatcagggggctaaagtaagaggaggagggtggtttcacataaaattagagagaggtargggggtgcttccaggccctggggaggagtttaaactttcgtctaaaatggatgacaggctgggcatggtggctcatgcctgtaatcctagcacttcggga

SEQ ID NO: 28451 - DNA, 201 bp, Homo sapiens
tcaagtgattctcctgcctcagcctcccgagtagctgggataacaggcatgtaccaccatgcctggctaattttgtatttttagtagagacagggttttgycatgttggtcaggctggtctcgaactcctgacctcaggtgacccggggagcctcggcctcccaagtgctgggattacaggcatgagccgctgagcctggc

SEQ ID NO: 28452 - DNA, 201 bp, Homo sapiens
ccatccatcatccgtctatcctctatccatgaattattcatccatcaatccatcctctattcatccatctatcctctactcatccgtccatcattcacccattcatctacccacccatccatccatccgtccattcatccatgaacccatcctctatccatttattcattcatccatccatccaccttccacctaccatcc

SEQ ID NO: 28453 - DNA, 201 bp, Homo sapiens
ggaaaatgaattttattctaggtggtttgtttgtgttgtagaaaagtggctgtataactagggttgcaagtaacccgagctggcttaaaccaaagggaaaktgactaactcagaatgttgagaagttcagggaggttaggcacagtggttcaggtctgtaatctcagcgctttgcggggccaaggtgggcggatcacttta

SEQ ID NO: 28454 - DNA, 201 bp, Homo sapiens
tccatccatcatccgtctatcctctatccatgaattattcatccatcaatccatcctctattcatccatctatcctctactcatccgtccatcattcacccattcatctacccacccatccatccatccgtccattcatccatgaacccatcctctatccatttattcattcatccatccatccaccttccacctaccatc

SEQ ID NO: 28455 - DNA, 201 bp, Homo sapiens
tttccctcttggtgcccaggttggagtgcaatggtgtgatctcagctcactgcaacctccacctcctgggttcaagcgattctactgcctcagcctcccawgtaactgggattataggcatgtgccaccacacccggctaattttgtatttttagtagagatggggtttcaccatgttacccaggatggtctcgatctcct

SEQ ID NO: 28456 - DNA, 201 bp, Homo sapiens
tccctgttttgtagatgaggataagtgagactcagagaggttaagggacttgcccagggtcacacagcgaagaagtagcaaagtgaaggttcaaattcaaktaccccatacccagttctgagcccttagccactgccctttactgcctccaggtcaagggcttgagtgaggacaggttgggctgtaaatgatacctacatt

SEQ ID NO: 28457 - DNA, 201 bp, Homo sapiens
cctgtgagacgggttggagcctgtctcctgaactgtgacctcaaccatgggaaaatctagtatccagtaaggaaaaatcatgacaatagtgccttaccacrtacagcatggcgggactcgccttgtgccttgactcctccgtccctgatctgattattttcagatgctcctattcacccagtagaagaggactgctatttt

SEQ ID NO: 28458 - DNA, 201 bp, Homo sapiens
gcatgatctcagctcactgcaacctctgcctcctggaactcaagggatcctatctcagtctccttagtagctgggactacaggcatgtagcacgatgcccrgctaatttttttgtgtttttggtagaggtggggtcacaccgtattgcccaaacagatctcgaactcctgagctcaagcaatcttcaccacttcggcctcc

SEQ ID NO: 28459 - DNA, 201 bp, Homo sapiens
ggttgctgaagctcagatgtgcttagtcccaccactggaaggtgggcagagctgggattcagacaaggtctgtgtgagtccagggccagggtgactacctrtgattagtagcaaagggctcttggggtaataggcttagagcaggaggtgatggtcgtgggctggagcaggaggggacagtgccagaggccttgttagctt

SEQ ID NO: 28460 - DNA, 201 bp, Homo sapiens
accctccaccctataccaaacctctggggttgggaaaatcatgatccagagccaaggtggatgggcccccctgctcattggaactccaagcccaagtcccygaaccatgaaccccaaaggacatttttccagttctggttctgcttctggaatgcccagggggtcaggagaagccctccttccaaactttagcaggtgaca

SEQ ID NO: 28461 - DNA, 201 bp, Homo sapiens
tctctattaaaaatacaaaaaattagccatgcgtggtggtgagcgcctgtagtcccagctgcttgggaggctgaggcaagacaatcgcttgagcctggggsacaagcagtgagtgcagtgagctgagatcacgccactgcactccagcctgtgtgacagagcaagactgtctcaaaaataaataaagtatgctttccagac

SEQ ID NO: 28462 - DNA, 201 bp, Homo sapiens
cttaagggtcacatctagagagagaaggatggagagttctctagtagggctgcaagtccagaagcttctctgtgaagctgggctaggagtgtttactttgragtggctgcagctttaagtatttattcctgatcgctgcactgcgggaagtcccatcctttatagccaggtgggctttcccagccggggtctctcccatcc

SEQ ID NO: 28463 - DNA, 201 bp, Homo sapiens
actccaacgtgacacgtggaggttgcagtgagccgagattgtgccactgcactgcagcctgggtgacacagtgggacccttccacacacatacacacacamaaaaaaaaccccaaaaaacaaaagtccaaccggcagcccatttggtacacacactggaagccttcttaattatgggtcgaatgaggcatatgatcacagc

SEQ ID NO: 28464 - DNA, 201 bp, Homo sapiens
aacccgggaggcggaggttgtggtgagccgagatcacgccattgcactccagcctggccaacaagagtgaaactccgtctcaataaaataaaataatgatrataataataataataataataataataataataataatacctactttttgttgagcacttactgatgtgccaggctatctcggagtgtgtgctgtatctt

SEQ ID NO: 28465 - DNA, 201 bp, Homo sapiens
aactgttttaattatgtcctgagtgcctctgccccctgagcaccttgaatcttgcctactctcaacagggttgagattcctatagcctccatcattcttcmgacaaatcattctacccaaggtgtccacagccaaagcaagccacgtaaacctctccaagcctcatccacacggcaacatgggcctccttcacacatatca

SEQ ID NO: 28466 - DNA, 201 bp, Homo sapiens
aggaaccgctgaagccctttatcttctcaggaaacgtgcctggggccttacacatccgaggctgggtggggagtctggggaggaggaagggagagaggcaygtttaaggatggggtgtgaggtgacatgagccccagggatctgggctgggaagctcagccccaggcgggtcctgatgatggccggccgcccccagctcca

SEQ ID NO: 28467 - DNA, 201 bp, Homo sapiens
ctgaggcaggagaattcccctgaacctgggaagcgcagaggttgcagtgagccgagattgcaccaatgcactccaacctgggtgacagcaagactcagtcwcacacacacacacacacacacacacacacacacacacacacacacaccaaaaaacatgggtacacttcacataaaaactctgggtttccattatctagaa

SEQ ID NO: 28468 - DNA, 201 bp, Homo sapiens
atttacaattcagtgacgctgaccccggatatgcctagaagtcacctctgggtcttgtgttgtagttgttagccgaggagaaaaacatctcttccaaataygcggatgagagggacagagctgaggcagaagccagggagaaggaaaccaaggccctgtccctggctcgggcccttgaagaggccttggaagccaaagagg

SEQ ID NO: 28469 - DNA, 201 bp, Homo sapiens
ttaccagaaagaagggcagacgcagggagcctgggtctgtgctcagtccccgctgggttttctccttttatggtcagcctacagtgctctggcttcccagmcagaatccaccagcttgtgtttgggcttgggccgaaatagctggtctgtggggagctgggtacctcctgggagtcctcaggcccacagcgggggaggaac

SEQ ID NO: 28470 - DNA, 201 bp, Homo sapiens
ggctcaaacatacgtgcgtgtgtgtgtgtgtgtgtgtgtgtatgtgtgcgtgtgtatacccatgtacaccatgagaaagtctgagaatcactgctttccakattggacatgggctgtggtagcccgggcactgctagctggctttaggacttgaagaagacaaggtctgctgatctagccccatcatcccgcaccatcatg

SEQ ID NO: 28471 - DNA, 201 bp, Homo sapiens
attcgcatctgccggcagggcttccccaaccggatcgtcttccaggagttccgccaacggtaagtcccaaggtctggcccaggtagggcagggggtgagcrggactgggtggaggaatggatgctggaggtacccggggtgacttctgctctgtgtttcaagctacgagatcctggcggcgaatgccatccccaaaggctt

SEQ ID NO: 28472 - DNA, 201 bp, Homo sapiens
gcaggtctagtggtttcgaagcacaaggatttggccaggtgtggtggctcacacctgtaatctccgtgctttgggaggccgaggcaggaggctcacttgasggtcaggagttcgagaccagcctggtcaacatggcaaaaccacatctctacttaaaatacaaaaattagccaggtgtggtggtgggcacctgtaatccca

SEQ ID NO: 28473 - DNA, 201 bp, Homo sapiens
tgcacctgtagtcccagctactcaggaggctgaggcaggagaattgcttggatccgggaggcagaggttgcagtgagccaagatcacacactgccctccakcctgggtgacagagcgagactctggctcaaacatacgtgcgtgtgtgtgtgtgtgtgtgtgtgtatgtgtgcgtgtgtatacccatgtacaccatgagaa

SEQ ID NO: 28474 - DNA, 201 bp, Homo sapiens; identical to SEQ ID NO: 5006

SEQ ID NO: 28475 - DNA, 201 bp, Homo sapiens
gcaatggggtgctggaaggcattcgcatctgccggcagggcttccccaaccggatcgtcttccaggagttccgccaacggtaagtcccaaggtctggcccwggtagggcagggggtgagcgggactgggtggaggaatggatgctggaggtacccggggtgacttctgctctgtgtttcaagctacgagatcctggcggcg

SEQ ID NO: 28476 - DNA, 201 bp, Homo sapiens
ctggcctcacatgatctgcctgccttggcctcccaaagtgctgggattataggtatgagccactatgcccggcccacatatttatttataaagactaattstatctatcatgccttatctcttgggtacatttcagagcaaattacagatgtcagtacatttccccttccacacctcaacattgcatattaattagagttt

SEQ ID NO: 28477 - DNA, 201 bp, Homo sapiens
ccacggaggacgccaaactgcggctggaagtcaacatgcaggcgctcaagggccagttcgaaagggatctccaagcccgggacgagcagaatgaggagaaraggaggcaactgcagagacaggtgcgtgctgccggggaggccagcagagggaggtcgggtggcctttttcattcctatcaccactctcatggttggtgtg

SEQ ID NO: 28478 - DNA, 201 bp, Homo sapiens
cagaattgtacggtgaacacctttaaggccaccacctggattcagtcattgacactgtattatatgaactttatcagatacttattttgagacaggatctrgctctgtcacccaggctggagtgcagtggtgtgatctcagctccccgcaacctccaccactgggttcaagcgattctcctgcttcagcctttcatgtagc

SEQ ID NO: 28479 - DNA, 201 bp, Homo sapiens
gaggcaggagaattcccctgaacctgggaagcgcagaggttgcagtgagccgagattgcaccaatgcactccaacctgggtgacagcaagactcagtctcwcacacacacacacacacacacacacacacacacacacacacacaccaaaaaacatgggtacacttcacataaaaactctgggtttccattatctagaaaa

SEQ ID NO: 28480 - DNA, 201 bp, Homo sapiens
ggagggaggaagccatcaagcagctacgcaaactgcaggtgggtgacactaggagcttggggcatgggtggagggagggcacagttcccctcaggccaccraagtcagcagagcgggctccaggaagcaagcctgcacctgccattggtgtgggttcagctggggtttttctggaaccattcaggatttggtggctgtctc

SEQ ID NO: 28481 - DNA, 201 bp, Homo sapiens
atccatccatcatccgtctatcctctatccatgaattattcatccatcaatccatcctctattcatccatctatcctctactcatccgtccatcattcacccattcatctacccacccatccatccatccgtccattcatccatgaacccatcctctatccatttattcattcatccatccatccaccttccacctaccat

SEQ ID NO: 28482 - DNA, 201 bp, Homo sapiens
tgtgacttttctgggtaccagcaccatgagggtcacctgcacacatggtgatgccttagtttctagcctgaagaaggaatgaggtgcttatttattcactraatgtatttactgaatacctattgagtagtattccaagtaattcagtttctatacttttaataccactcttccctaagatttcattctgtaaaattccaa

SEQ ID NO: 28483 - DNA, 201 bp, Homo sapiens
aattcagccaaagtgacttgaaggacctacaagttgacagcagggctgagcttttacgcgtagttggtgcttaagagaagccaggctggagccaactgttyggttatgcagttaagaaactgaaaattggccgcgcactgtggctcaggcctgtaatcccagcactttgggaggccgaggcgggcggatcacgaggtcagg

SEQ ID NO: 28484 - DNA, 201 bp, Homo sapiens
gacgacctggttgttgatttggacaaccagcggcaactcgtgtccaacctggaaaagaagcagaggaaatttgatcaggtagagggcgtggggtgtccccyactctggccatggacgctgggttggggaatcagctctgcagagtatgacgcgtggctctggcctgtgcctgcatcccctctccactctgtggggagccat

SEQ ID NO: 28485 - DNA, 201 bp, Homo sapiens
tggagaaggaggccttagccattgttaggaaggaaatcccaaaacgatcagacttttatttgcaaatgcatccagtcagcccagaaccaccaacatcttcrgtctctgtattcaattttattttgcttgttgtgaaattcagccaaagtgacttgaaggacctacaagttgacagcagggctgagcttttacgcgtagttg

SEQ ID NO: 28486 - DNA, 201 bp, Homo sapiens
cgcaccaccagccacctggaactgagagccatgctcgtgcaatgggaacttctttgtggtcaactgcagaaaatccaaggggtgggtgtgcaaagctgaaytgggcagcagaacttgggggagtaaggacatctgagcttgtcctccctgttgactcatgcaggctcagatgaaggactttcaaagagagctggaagatgc

SEQ ID NO: 28487 - DNA, 201 bp, Homo sapiens
catccaggtaggaggtttggggctttgctgcgccatggtttctggccccagggatccactgccctctttgacctttgcagtccggcaagctggatgcgttyctggtgctggagcagctgcggtgcaatggggtgctggaaggcattcgcatctgccggcagggcttccccaaccggatcgtcttccaggagttccgccaac

SEQ ID NO: 28488 - DNA, 201 bp, Homo sapiens
atcccccgcaggcagatcgcggtggagtgttggtgcgatggtgcttgaccccccagcttcccctgctattgggtttctccaacgaggagacatggtcttcscttctcagagtctgtggggccagggacaggggccattcatggtccccctctcaccctaccctggacgctgtccttgtagctctccgactcgaagaagaag

SEQ ID NO: 28489 - DNA, 201 bp, Homo sapiens
tgacctggtgctttctggcaaatcattgatggcggactccaaaaataaaaagaatcgggcacggtggctaacgcctgtaatcccagcactttgggaggccraggtggggggatcatgagatcaggagatcgagaccatcctggctaacgtggtgaatctccgtctctactaaaaatacaaaaaaaactagccaggcacagt

SEQ ID NO: 28490 - DNA, 201 bp, Homo sapiens
gcttccctcctctatgtattcacggggcctcccctgagctcagaggaagaacatgtactttcaagggtggctgagttgtcagggtggactcttggtggggmttggcctttccctggcagacaacagccttcctccctcccacctaggacctcgccgccgctgagagggctcgcaaacaagcggacctcgagaaggaggaac

SEQ ID NO: 28491 - DNA, 201 bp, Homo sapiens
gaccacgctacgcaacaccacgcccaacttcgtgcgctgcatcatccccaaccacgagaagagggtgaggcccgccgcccagaccctggggctcccagaarccagggctgtcccaagcggtcacagcgtccccagggcgccctctgcccccacctaccccgaggaccccattttccatgtggggaaggctatctgaatctc

SEQ ID NO: 28492 - DNA, 201 bp, Homo sapiens
acatgcctgtcatcccagctactcaggaggctgaggtgggagggtcacttgaacccaggagttcgagattgcagtgagtcaagattgtgccactgcactcyggcctgagcaagaagcaaaactctgtctcaaaaaacaaaagtaataataactaacattttggcataccaggcattgttctaagcattttatataaatgtt

SEQ ID NO: 28493 - DNA, 201 bp, Homo sapiens
acctgggaggcggaggttgcagtgagccgagatcgcgccactgcactcctgcctggacgacagagtgagactccgtctcaaaaaaaaaaaaaaaaaaaaaagagtaaaggttgatctaactcttctgacagctttgtctctgaaggctgaaggcagggtgcctctagacaattgaggtaaaggcatcccttcctccaggta

SEQ ID NO: 28494 - DNA, 201 bp, Homo sapiens
cagcagcagctgaccgccatgaaggtgattcagaggaactgcgccgcctacctcaagctgcggaactggcagtggtggaggcttttcaccaaagtgagtgmtctgccccagcccccttcccaggggcccccagccctggttcttcactctggagccttcacatttgggacaggaggtggtcgcaagtgggtgtggaatgga

SEQ ID NO: 28495 - DNA, 201 bp, Homo sapiens
ctgcaataggtcaggacctgggttcactgctccatcaatcccacattgctcggccctcactagcaccacacagggtgggtggcagcctccccatttgatcratggggaaaactcagcacacctacttggccccagaactgagagtcaaacctggggacccagcttcgctgccctcagaatgttactcttccctcctgggta

SEQ ID NO: 28496 - DNA, 201 bp, Homo sapiens
cagtttcacccattagatgatgagggcaatacccctgaggcatgactccaaggagggggcatcttttaaggcgggggagggtagaggcccccaccatggcygcccttcccccaggaacgcactccaggacgagaagcgccgcctggaggcccggatcgcccagctggaggaggagctggaggaggagcagggcaacatgga

SEQ ID NO: 28497 - DNA, 201 bp, Homo sapiens
tgaatccgggaggcagaggttgcagtgagcagccaatatcgcaccactgcactccaacctggacaaaggtgaaactccctctcaaaaaaaaaaaaaaaaaatagctggaggaaaggaaaggtagtataagaaagctgcatttttgcctaccatagcaggaagtcactagatactatctaaacttgacatatccagaaatcg

SEQ ID NO: 28498 - DNA, 201 bp, Homo sapiens
agagggtgaggcccgccgcccagaccctggggctcccagaagccagggctgtcccaagcggtcacagcgtccccagggcgccctctgcccccacctacccygaggaccccattttccatgtggggaaggctatctgaatctcagacccattccccatccctggaggaaaaggaggaagggaggatgcatccagagactttt

SEQ ID NO: 28499 - DNA, 201 bp, Homo sapiens
ttaagtgcattcacaatgttgtacagctatcaatttcaagacagggtcttgctctgtcacccaggggctagagtgcaatggtacaatcatagctcactatwaccttgagctcctgggatcaagcaatcctcctgactcagcctcccaagtagctgggactacaggtgatcaccaccatggccagctatttttttttttttt

SEQ ID NO: 28500 - DNA, 201 bp, Homo sapiens
ccgggtccgcaaagccacacagcaggtgagggccgcctggacaccacagtcacgctgcctactgtctctcctgcagcaggatcctgcaccagtcaacacaygcgtggcggcttcctgtgtgcaggccctggattgagggacaagagggtggtggggcctgagagtagagatccagggcccttacaccagtgcccaggctgc

SEQ ID NO: 28501 - DNA, 201 bp, Homo sapiens
ttgaatccgggaggcagaggttgcagtgagcagccaatatcgcaccactgcactccaacctggacaaaggtgaaactccctctcaaaaaaaaaaaaaaaaaatagctggaggaaaggaaaggtagtataagaaagctgcatttttgcctaccatagcaggaagtcactagatactatctaaacttgacatatccagaaatc

SEQ ID NO: 28502 - DNA, 201 bp, Homo sapiens
caatcctcctgactcagcctcccaagtagctgggactacaggtgatcaccaccatggccagctattttttttttttttttttttttgtagagagggggtcyggctgttgttgcctgagctggtctcaaacacttagcctgaagcaatcctcccaccttggcctcccaaagtgctgggattacaggcatgagccactacact

SEQ ID NO: 28503 - DNA, 201 bp, Homo sapiens
ggcacgtgccaccactgcccggctaatttttgtatttttaatagagacggggtttcaccatgttggccaggcaggtctcgaactcctgagctcaagtgatytacctgcctctgcttccaaaagtgctgggattacaggcgtgcgccaccacgcccggcctggaagaagctcttgagtggagttttacaggatgaaggagag

SEQ ID NO: 28504 - DNA, 201 bp, Homo sapiens
tttgtattctagatgatagaactggaaagatgttaggcttttagaaagaaccaaatattgctaaatgcatccaaactcgggataatgaagtcttggcaaakacctcaatcctcgtgacttgaatcaggcatttcaagttaatccaaaagtttgagttaactggtgccttcagtcaatttaacctcgagtttatcaagcagc

SEQ ID NO: 28505 - DNA, 201 bp, Homo sapiens
cacctctttccagcctctgggaaccacaagtctgttttctgtctccatggctttgcctactctagacacttcacataaatgagatgatagagtacgtgacytttcgtgcctggcttctttcactaggcatattttcaagcttcatccacattggagagctcatgtcagtgttggtctctgttttgcagatggggaaggtat

SEQ ID NO: 28506 - DNA, 201 bp, Homo sapiens
agctgctattataaacgtggccagttctctgctgcacctggccagttctcctcttttacacacacacacacacacacacacacacacacacacacacacayatattctggtcttagtttccccttctggggaaatggggtaatgccttcatggtccccatttcataaactgcctctgaggccatgtgaaataatgtggcca

SEQ ID NO: 28507 - DNA, 201 bp, Homo sapiens
ttgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaataaaacttta

SEQ ID NO: 28508 - DNA, 201 bp, Homo sapiens
ctgagatttgaacccagagctcttcaaaactccacagtttggccaggtgcaatggctcacaactataatcccagtgctttgggaggctgaaatgagagaaytgcttgagcccaggaatttgagaccagcctgagcaacacagtgaaacccatgtctctacagaaaatataaacatcagccaggcctggtggcgcccgcctg

SEQ ID NO: 28509 - DNA, 201 bp, Homo sapiens
caaaccatgtcgtgctgatctaaacatatcagtcatttacactttagtgtgaattacttcaactgggtttattcttagatacttggctgagatcatcagcyagcttcctgatacatggggtgggattcctcagaggataaaggggcttgcatctgcccagtgaccaatgggataaccggttttttggtaaatttttctttc

SEQ ID NO: 28510 - DNA, 201 bp, Homo sapiens
attgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaataaaacttt

SEQ ID NO: 28511 - DNA, 201 bp, Homo sapiens
cattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaataaaactt

SEQ ID NO: 28512 - DNA, 201 bp, Homo sapiens
ccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaataaaact

SEQ ID NO: 28513 - DNA, 201 bp, Homo sapiens
catatgtatacatgtgccatgctggtgtgctgcacccactaactcgtcatctagcattaggtatatctcccaatgctatccctcccccctccccccacccyacaacagtccccagagtgtgatgttccccttcctgtgtccatgtgttctcgttgttcaattcccacctatgagtgagaatatgcggtgtttggttttttg

SEQ ID NO: 28514 - DNA, 201 bp, Homo sapiens
accacagcagaccagaatcctgtggcttctcaaatgaccaagcctgacatattgaaaagcagatcgtcttgctttgaaaaaccttctccacccacccccgmaaccaatttcagctgattaaattcaatcactcatgccttaagactggcaatgatttgttgacttcaacttgaatatctgcatcttatttgtgccgtgtgt

SEQ ID NO: 28515 - DNA, 201 bp, Homo sapiens
cacctcccaggttcaagtgattctcctgcctcagcctgccgagtagctgggactacaggcatgtgccaccatgccctgctaattttttgtatttttggtaraaacagggtctcactgtgttgcctaggttggtcttgaactcctgagtgtgagcaatctgccctccttggtctcccaaagtgctgggatcataggtgtgaa

SEQ ID NO: 28516 - DNA, 201 bp, Homo sapiens
tcactgcagcctcaaactcctgggctcaagcaaccctcctgcctcagcctcctagtagctgggactacaagcacgcatcatcatgcctggctgatattttktttaagggatggggtcttgctataatgcccagtctggtctcgaactcctgggctcaagcaatcctcctgccttggcctcccaaaatatgggattatacat

SEQ ID NO: 28517 - DNA, 201 bp, Homo sapiens
tgttactggtccattgggcacagggtaatttgaaggtagatttggaagcatgggggtcataaactcatctttatatgtgggcaaatacagtatcagatctyggcggatgcccatgcgttgtgtatagttggccagctcttcatggaatgcctgaggttgggtgttctctctgattcaagccctacttgtctcccacagaac

SEQ ID NO: 28518 - DNA, 201 bp, Homo sapiens
ccgagattgtgccactgcactccagcctgggtaacagagtgagactctgtgtccaaaacataaaaaataaactataaactaagttcctgccaagttaattyggcttacacccacaaatggttcagtggagcttggaggttagaagcaaggtggagtccgttaggtcagatcttgttcagtgtctcagttataattttgcag

SEQ ID NO: 28519 - DNA, 201 bp, Homo sapiens
tgaggcaggagaactgcttgaacgcaggaggcggagattgcagtgcgccgagattgtgccactgcactccagcctgggtaacagagtgagactctgtgtcmaaaacataaaaaataaactataaactaagttcctgccaagttaattcggcttacacccacaaatggttcagtggagcttggaggttagaagcaaggtgga

SEQ ID NO: 28520 - DNA, 201 bp, Homo sapiens
gaggggcagctcctccgaagataacttggggtctggaaaattaggctgtatgggtcagttgacaaatggatggtgtatgtgggtcttggccagggtcccayatcagaatctagtgctgatagcctccttgtctgaatgacataggccctccaagaatgattcatttcatttgggacaggggtcagttttgcttctaatctt

SEQ ID NO: 28521 - DNA, 201 bp, Homo sapiens
cccagaagaatgagagtgcccggcagcagctcgagcggcagaacaaggagctccggagcaagctccacgagatggagggggccgtcaagtccaagttcaartccaccatcgcggcgctggaggccaagattgcacagctggaggagcaggtcgagcaggaggccaggtatgcgggtgtggagttccgaacccagtttgcag

SEQ ID NO: 28522 - DNA, 201 bp, Homo sapiens
agaacaaggagctccggagcaagctccacgagatggagggggccgtcaagtccaagttcaagtccaccatcgcggcgctggaggccaagattgcacagctrgaggagcaggtcgagcaggaggccaggtatgcgggtgtggagttccgaacccagtttgcaggggggtgatggacagcaggagtcatagtgaagtcaggga

SEQ ID NO: 28523 - DNA, 201 bp, Homo sapiens
gtcgggtggagcttctgtggggctccttgtcttctgacttcataccaagatgctcacgccccgcccccacgccatgtgctcaggtgaactccttcgagcarctgtgcatcaactacaccaacgagaagctgcagcagctcttcaaccacaccatgttcatcctggagcaggaggagtaccagcgcgagggcatcgagtgga

SEQ ID NO: 28524 - DNA, 201 bp, Homo sapiens
gatagagtgagactctgtctcaaacaataaaaataagtttccttaatggctggctttcaggaacataggctatgaggtggagcaatttttggtaaaggggraatgctgaatggattttttatgtaccagcaaacatggtatattagcagttacagtgcaggaccctgtggaatgggccagggaaaaatgttgacattcctt

SEQ ID NO: 28525 - DNA, 201 bp, Homo sapiens
tcgctcctccccattctctctcagctggggaccttacttcctacttaactcaaaagcagaaatgatcatgaaacgtgcacaagctcccactgcctcatcaycctacctccgtgcacctctgtacacttctattttttttccatttctatgctgaaccctctggcaccaaccgaggccaacacctccattggacccgaccct

SEQ ID NO: 28526 - DNA, 201 bp, Homo sapiens
taattagtgtggcgtgtttacggtctctctcgcctccatcccgtcagaccccactcttggaacagagggcatggaagacagctttgccacttgttagctgyatcatcttgagaaaggacttctcttctctgagcctcagtttccccttattgaaaacactgataatagttgcacttatttcctagcatactttgtgaggct

SEQ ID NO: 28527 - DNA, 201 bp, Homo sapiens
aagcgcggtggctcacgcctgtaatcccagcactttgggaggctgaggtgggctgatcacctgaggtcaggagttcgagaccagcctggccaacatggtgraacttcatctctactaaaaacacaaaaatcagctaggcgtggtggcagatgcctgtaatcccagctactcgtgaggctgagacaggacactcctttgcaa

SEQ ID NO: 28528 - DNA, 201 bp, Homo sapiens
tgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaataaaa

SEQ ID NO: 28529 - DNA, 201 bp, Homo sapiens
catcgcggagaagctctcctgaaattaattagtgtggcgtgtttacggtctctctcgcctccatcccgtcagaccccactcttggaacagagggcatggargacagctttgccacttgttagctgtatcatcttgagaaaggacttctcttctctgagcctcagtttccccttattgaaaacactgataatagttgcactt

SEQ ID NO: 28530 - DNA, 201 bp, Homo sapiens
gttcatgcctgtaatcccaaatcccagcaccttgggaggccaaggcaggaagatcattgacatcaggagttggagacaagcctgaccaacatagtgcaacmccatctgtactaaaaatacaaaaattagccaagcacgtggggcatgcctgtaatcccagctactcgggaggctgagacaaggggatcacttgaatccagg

SEQ ID NO: 28531 - DNA, 201 bp, Homo sapiens
catggaatgttctctgagttgcttctccaagcagagagatatgtgtgcagggccacccatgcttaccatttccctactgaggctcttaggatacttttgtragatattaatagctacttgtggccatgaaacaaactaataactagcttctggcagctttaaatctcactttgacctcagtgtgctctaagcaacgtgggc

SEQ ID NO: 28532 - DNA, 201 bp, Homo sapiens
aaaagggttcatgccaacagatggaggattgggttccatccttggtttcatggcttagctgaggcaggtagatagggccatctttggagatacttgttgarcctctagggccaggaacatgagccattcctgcctaaaggacatcctacacagggcctgcttgggcagtgtggccaatgcatactcacctgtcccacagaa

SEQ ID NO: 28533 - DNA, 201 bp, Homo sapiens
gcaggaagatcattgacatcaggagttggagacaagcctgaccaacatagtgcaacaccatctgtactaaaaatacaaaaattagccaagcacgtggggcmtgcctgtaatcccagctactcgggaggctgagacaaggggatcacttgaatccaggacgtagaggttgcagtgagccaagatcgcacccctgcactccag

SEQ ID NO: 28534 - DNA, 201 bp, Homo sapiens
ctgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaataaa

SEQ ID NO: 28535 - DNA, 201 bp, Homo sapiens
tacaaaaataaataaataaagtgcatttcagcatatcaatgctcgggccaggccacaccaacagaagacacagtaagagacagacacttaggtctatccayggcgacagctacaaatacaaggaaaagggtcaagttcaggcactgatgatgttggcatgggattttccagaatggcaactgactctcagtgaagcgctga

SEQ ID NO: 28536 - DNA, 201 bp, Homo sapiens
aactctgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaa

SEQ ID NO: 28537 - DNA, 201 bp, Homo sapiens
tagtcgtcttcccaccaacaaagaaatgcccgtggtgctccttgtaaatttccaccagtctcagctgtggtgattccacttgtagctgagatttgtatgcrgatgaggcttttgcttcatctttctctgggagctacaaaaaggaggatgtgtggacaaatcaaaacagaaacaaatagcagcttcctgctttgtcctgta

SEQ ID NO: 28538 - DNA, 201 bp, Homo sapiens
cctacgtgagtaactgagagtgttttcctggtgtgtaggggaggcacggagtgaacttagatctgcatgatcctcttgcacccaccgagtcccgtagctgstggtagaaatggggtaggccctagagtttcacaacttaaatcagtaaatgcaccaaaataccatcctgtgggtgtctgatgccagggaagggtgtggggg

SEQ ID NO: 28539 - DNA, 201 bp, Homo sapiens
ttctggcacagctattcaactctgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagat

SEQ ID NO: 28540 - DNA, 201 bp, Homo sapiens
ccattccagatgtcactttgcgtcctcagaggggactctggggcagccaccatggccggcttgtctggaggcccttggagatctaggatgggcgctggtcrtggctttggagaactttccttctccaaacaaatgcaggaaactcaagattcagcatcctagaattgtctctggcaagttggtttccagccatagtgagtg

SEQ ID NO: 28541 - DNA, 201 bp, Homo sapiens
gccaccacacccggctaattttgtatttttagtagagatggggtttcaccatgttacccaggatggtctcgatctcctgacattgtgatctgcccgcctcrgcctcccatagtgctgggattacaggcatgcaccatcacaccaggctaattttgtatttttagtagagatggggctttaccatgttggtcagactggtct

SEQ ID NO: 28542 - DNA, 201 bp, Homo sapiens
agtagctgggactacaggcacccgccagcacgcccggctaattttttgtatttttagtagagacacggtttcaccatgttagccaggatggtctcgatctsctgacctcatgatccgcccgcctcagcctcccaaagtgctgagattacaggtgtgagccaccatgcccagccgagttgttccttttgactaaagaattgg

SEQ ID NO: 28543 - DNA, 201 bp, Homo sapiens
cttctggcacagctattcaactctgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcaga

SEQ ID NO: 28544 - DNA, 201 bp, Homo sapiens
ccagagcccaacataattatttgttgcggttgctgaaaagagttaagtgtttcttctgaacggtgaaggctggcagcaggcagatctgatttttccttctyctgcccactctcttcctcctacccaaagtctcccctcacgtgaccagcccttcctgtgaagtcgaggtgataaactcaagagagaaccagcgcagagagg

SEQ ID NO: 28545 - DNA, 201 bp, Homo sapiens
ggcttctggcacagctattcaactctgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgca

SEQ ID NO: 28546 - DNA, 201 bp, Homo sapiens
tggcttctggcacagctattcaactctgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgc

SEQ ID NO: 28547 - DNA, 201 bp, Homo sapiens
atcccagcactttgggaggctgaggtgggaggattgcttgagtgcagcagtctgaggccaacctggacaacacagtgagatcctatctctacaaaaaaaaatttaaaaattagccagatatggtggtgcatgcctgtagtcctagctgcttgggagggtgaggtcatggggaaaaggggattgcttgagcccaggagttca

SEQ ID NO: 28548 - DNA, 201 bp, Homo sapiens
ccaggcacacacctcctccaagaaatacttagtaagtacctactgtgtacaattactctggtaggcacttttacatgtaccaccattctctttgtttttttctcatttgctgtttttattaagtgcctactgtataccaggcactcagcgagtctcacaggattgcgatgaatagttcagatatggttccagccttcatga

SEQ ID NO: 28549 - DNA, 201 bp, Homo sapiens
tgaacccgggaagcggaggttgcagtgagccaaaatcgcaccactgcactccaacctgggcgagagtgagactctgtctcaaaaacaaaaacaaaaaaaamaaaaaaaaaacgggttgtataccaacgaggtgatggaggctggggtggtcgggtaacaagaggctttaggagtagctgggatctaattaatcttcaaaac

SEQ ID NO: 28550 - DNA, 201 bp, Homo sapiens
gctgaaattgtgccactgtactccagcctggggacagagtgagactccatctcaaaaaaaaaaaaaaaaaaaaaagtagataattccaaataaacctgtttggacctatgtaagaaaactaaggttttcttgttcactctatttttttagagatgaggtcttgctctgtcacccaggctggagtgcagtggtgtgatcatg

SEQ ID NO: 28551 - DNA, 201 bp, Homo sapiens
gttccagtgagcagagatcctgccactgcactccagcctgggtgacagagcaagactccatctcaaaaaaagaaaagagtaataataataataataataawaaaagaaaagagcctcttaaaacactgttatcttggccaggaaggtttaaaaacttaatcctcaggaaagaaatgaatctgagatgctttaggaggtgcg

SEQ ID NO: 28552 - DNA, 201 bp, Homo sapiens
ctctaacacagagcttggggggctgatgtgtgggtcccagcctagaagaaacccacaggtgtcttccttggctcccgaaaagatcattcaatccatcttakttagaccctgggtgactgtgttgcagatcagaaggagaattacagttcttatttgggatctgcttttgtgtgaccttggccgagtcagttaactcctcgg

SEQ ID NO: 28553 - DNA, 201 bp, Homo sapiens
tagacctcagctactagggggtggcattatccattatttaaatttccagggtggggcaaagtggctcatgcctgtaatcccacactttcggaggcagaggygggcggattacctgaggtcaggagtttgagaccagctcggccaagatagtgaaaccctgtctccccaaaaatacaaaaattagccaggtgtggtggctgg

SEQ ID NO: 28554 - DNA, 201 bp, Homo sapiens
ggagtgcagtgacacaatcatagctcactgcatctttgaactcctaggcggcactgatcctcctgcctcagcctcctgactagctgggactacaggtatasgccactacgccaagctaattttttttttaagagatggggtcttactatgttgcctaggctggtctcaaattcctgggctcaagcgatcctcctgccttgt

SEQ ID NO: 28555 - DNA, 201 bp, Homo sapiens
gatcagaaggagaattacagttcttatttgggatctgcttttgtgtgaccttggccgagtcagttaactcctcggggctatggtttcatcatctataaaaytgagggtttgaaccaggtcccccgatttaaagctctcttgccaagacttttcaaccttacctgccagaatccccattctagaaagggagcctttttcaga

SEQ ID NO: 28556 - DNA, 201 bp, Homo sapiens
cactcctggtacccttgactggaacaacctagacagagatgtctgtcccatctggctgagtgttttaggactgtcaggccccaaagcttccctggctcgayggacagtcgatggcacagctgtggcatgcctccctcttctctccctgccatcatccctaagtgtcttccctcagccctgtccctggtgcaccagtgtgtc

SEQ ID NO: 28557 - DNA, 201 bp, Homo sapiens
gtttcactgtgttggccgggctggtctcgaactcttgacctcaggtgatccacccaccttggcctcccaaagtgccgggattacaggtgtgagccactgcrcccggccatccctgtgtgtctgaaagccagtgttccttccacttccctcccttccctccctgttcctcatttctgctgcaggccccgggagcaccccctg

SEQ ID NO: 28558 - DNA, 201 bp, Homo sapiens
ggccgaggcgggcagaccacttgaggtcaggagttcgagaccacctggccaatatggtgaaaccctgtctctactaaaaatacaaaaattatccaggcgtrgtggcatgcacctgtagtcccagctactcaggaggctgaggcaggagaattgcttggatccgggaggcagaggttgcagtgagccaagatcacacactgc

SEQ ID NO: 28559 - DNA, 201 bp, Homo sapiens
agggtgattcggtcagtgtgtagggacacggtgcatggacaggacaagttcaacaggcattagcagtcagctgccgaggacccaccgtcaagggccatgcrgtggccaccttcacagtcacaccacagaagatccagaacctctggcatctgcctccgtgcggggcattaggtagagagccacttttctgcaggcaatgga

SEQ ID NO: 28560 - DNA, 201 bp, Homo sapiens
ttcacagtcacaccacagaagatccagaacctctggcatctgcctccgtgcggggcattaggtagagagccacttttctgcaggcaatggaggctgagacytttcttctttactagcccaggggtattgatggccctgcagagacgggttttgattacctctcactggatcccccagcagcctgttaccagaaagaagggc

SEQ ID NO: 28561 - DNA, 201 bp, Homo sapiens
ggaatgcagcgttagcaaggacttggcacactgcccacacacagccagtgctggagaaggaggccttagccattgttaggaaggaaatcccaaaacgatcmgacttttatttgcaaatgcatccagtcagcccagaaccaccaacatcttcagtctctgtattcaattttattttgcttgttgtgaaattcagccaaagtg

SEQ ID NO: 28562 - DNA, 201 bp, Homo sapiens
tgagctcagaatctagtttcttcagaggaaagatgtaagctggctctgggtccccagtggctttaggctccaaaactccagggtaccttggcattgacctytgtgtctgctctgcccttctctccccacctcagccatattgaaggtggtatcatcggtcctgcagcttggaaatatcgtcttcaagaaggaaagaaacac

SEQ ID NO: 28563 - DNA, 201 bp, Homo sapiens
attgtgtatctccatctcctggaatgcagcgttagcaaggacttggcacactgcccacacacagccagtgctggagaaggaggccttagccattgttaggraggaaatcccaaaacgatcagacttttatttgcaaatgcatccagtcagcccagaaccaccaacatcttcagtctctgtattcaattttattttgcttgt

SEQ ID NO: 28564 - DNA, 201 bp, Homo sapiens
taggtgacttgcttttggagggcttcaacaactacaccttcctctccaatggctttgtgcccatcccagcagcccaggatgatgagatgttccaggaaacygtggaggccatggcaatcatgggtttcagcgaggaggagcagctatgtaagcctcacaccttgagtctggagggtagcttgcctggataccagtggaacc

SEQ ID NO: 28565 - DNA, 201 bp, Homo sapiens
taaaagttcacttaattgagctcttaaaaagtggcaagtatattgcagaactgaatttttaagattttagttaatttagatagcggttcctgccttggacrgtatgatgctgaaatatttctcatctctgtccattcctctgactccaccgcctcttcctagttcagggtcccgtcacctctcaccagggcctctgtagca

SEQ ID NO: 28566 - DNA, 201 bp, Homo sapiens
gtattcttgtccccatataacggaagaggaaactgaggcccccagaaggctaagggactagcataggccttgtgtcttagcctgttaaggctgctatatcraaataccatagactgggtggcttttaaacagatatttgtttctcgtggttctggaggctgggaagtccaagatcaagcttggtatctggtgagggcctag

SEQ ID NO: 28567 - DNA, 201 bp, Homo sapiens
tcaagcgctgctcaaagtcttcgagagacatgatcgtggcgctggcgaagagaaaagcagagttatccaagaggacaaaccgcagcatccctccagcaccrcggatccaggaggtgcgaagggtcagacacacctgggcacaagtcccagccccaaacttcctagatgccacagagtgggccaagtcccttaaccttctgg

SEQ ID NO: 28568 - DNA, 201 bp, Homo sapiens
ggggaaaactcagcacacctacttggccccagaactgagagtcaaacctggggacccagcttcgctgccctcagaatgttactcttccctcctgggtagcrtggtatagatagtgtagtattcttgtccccatataacggaagaggaaactgaggcccccagaaggctaagggactagcataggccttgtgtcttagcctg

SEQ ID NO: 28569 - DNA, 201 bp, Homo sapiens
cgtgccagggattgtggcttagcaagcagaaccaaggctggatatcagctgcagtcactggagcagtgcacaacctgcaccgctgtgtaaggctggcagtrgttggtgaggctgtctacgtgacgatgcgtgagggctttaaacggttcaagccttgataaagggaaaggaattatgatggcccagacccttgaccagatc

SEQ ID NO: 28570 - DNA, 201 bp, Homo sapiens
agcattgcagttgtgtcacatagacagtaagttcctgaggacctataaactccatccttcttgcatgtgcatcattgtatctccagcacattttctggtgmctggcacatagtagctgctcagtatttgttgaatcaatgaattattagagttatttatagaaaagaacctaccagggtcaggatggatggggtgggttat

SEQ ID NO: 28571 - DNA, 201 bp, Homo sapiens
gaaagtcatcccatgtgaattgggtgtgacagggatggaggtggaagaccagaggaacacccgcagtatccccagaatccctaactccctccaaaccagayctgctagaaaaatcacgggcaattcgccaagccagagacgagaggacattccacatcttttactacatgattgctggagccaaggagaagatgagaagta

SEQ ID NO: 28572 - DNA, 201 bp, Homo sapiens
gctattataaacgtggccagttctctgctgcacctggccagttctcctcttttacacacacacacacacacacacacacacacacacacacacacatatattctggtcttagtttccccttctggggaaatggggtaatgccttcatggtccccatttcataaactgcctctgaggccatgtgaaataatgtggccattgg

SEQ ID NO: 28573 - DNA, 201 bp, Homo sapiens
acaagaaactcgaaaactcacaccccctctgaaagggcaccaacaggtgggaacccagggatctgagttgggagttgagaggagcccaattctggaagttyttgaggcaggaatccaggtgtgcctgagagatgccacgaccccgcccccaaggtagagggactcaggtataagtgccccaactttctgacagttagccag

SEQ ID NO: 28574 - DNA, 201 bp, Homo sapiens
ccacaagggcaagaaagacacaagtatcacggtgagtggcagttcccaatcagaggccatgatttagccaaccggtctccagcttgcagcccaaccgagayacaaacagaacatcattgcaagaactcaggccccatctgactacccctcccctgaagactcaaagagggaccgtctttttggcgagcaggcctgttgagt

SEQ ID NO: 28575 - DNA, 201 bp, Homo sapiens
tgctattataaacgtggccagttctctgctgcacctggccagttctcctcttttacacacacacacacacacacacacacacacacacacacacacatatattctggtcttagtttccccttctggggaaatggggtaatgccttcatggtccccatttcataaactgcctctgaggccatgtgaaataatgtggccattg

SEQ ID NO: 28576 - DNA, 201 bp, Homo sapiens
ggtgaccacagactgggctcttctctttgggaggcttgtcctggggacaggggacactgattgaacaggaaatagcccctggcctggctcagtgtagtccwctgagtacctactgccgccgtgcaaggcccccaggtcacggaggtgaagtcaggctgtccctgctcccaggaagctgtatcattaatttattcccctggc

SEQ ID NO: 28577 - DNA, 201 bp, Homo sapiens
ctggcctcttctgcgtggtggtcaacccctataaacacctgcccatctactcggagaagatcgtcgacatgtacaagggcaagaagaggcacgagatgccrcctcacatctacgccatcgcagacacggcctaccggagcatgcttcaaggtgagtgaactcagggctgcacggggccagctccagggagcccctcctgtc

SEQ ID NO: 28578 - DNA, 201 bp, Homo sapiens
tgagcctaggaattctcagctgcagtgagctatgattgcatcactgcactccagcctgggccacagagtgagatcttgtctcaaaaaaaaaaaaaaaaaaatcatacaaggtaagtgtttttattatacccattttataatggggtaaagaaactgaggtatggagaggctaaatgacttgcctaaggtcacccaggtaac

SEQ ID NO: 28579 - DNA, 201 bp, Homo sapiens
ctttgttcaggtgaccacagactgggctcttctctttgggaggcttgtcctggggacaggggacactgattgaacaggaaatagcccctggcctggctcartgtagtccactgagtacctactgccgccgtgcaaggcccccaggtcacggaggtgaagtcaggctgtccctgctcccaggaagctgtatcattaatttat

SEQ ID NO: 28580 - DNA, 201 bp, Homo sapiens
tagtcccagctagtcaggaggctgaggcaggagaatggcttgaacccgggaggcggagcttgcagtgagccgagatggcgccactgcactccagcctgggygacagagcgagactcaaaaaaaaaaaaaaaacaagtaaaactcttgggtaggtgggtgggttaaggagagataacaaacccagtctcagacattcacagc

SEQ ID NO: 28581 - DNA, 201 bp, Homo sapiens
agaatatataaataatgaggatagactgtgcatatatatatttacataatatataatatgtattatatttaatatatttatatttatatatatatatatttgaaggtctggaagcaactaaagctataatcaacagaggttatttaaataaaatatagcatttccaggtagccactacaaagagtgaggctgatctattta

SEQ ID NO: 28582 - DNA, 201 bp, Homo sapiens
aacgcagaatcaagattttcacatttccaccccactttctgtacccatttaaaaaataatgcatttggggctgggcacagtggctcatgcctgtaatcccwtcactttgagagcccgaggctggtggatcacttgaggtcaggagtttgagaccagcctggccaacttggcgaagccccgtctctactaaaaatacaaaaa

SEQ ID NO: 28583 - DNA, 201 bp, Homo sapiens
tatagaatatataaataatgaggatagactgtgcatatatatatttacataatatataatatgtattatatttaatatatttatatttatatatatatatatttgaaggtctggaagcaactaaagctataatcaacagaggttatttaaataaaatatagcatttccaggtagccactacaaagagtgaggctgatctat

SEQ ID NO: 28584 - DNA, 201 bp, Homo sapiens
agcactttgacaggccaaggtaggcagatcgcttgagcctgggagtttgagaccagcctgggtaacatggagaaactccgtctctactaaaaatagaaaaatatcagccagctgtggtggcacatgcctgtgttcccagctactcaggaggctgagatgggaggatcacctgagcacaggaggcagaggttgcggtgagcc

SEQ ID NO: 28585 - DNA, 201 bp, Homo sapiens
taattcatggctcttttttcttctttctgtttgcagatcgggaggaccagtccattctatgcacgtaagtggaactgctttttcttctgttttttttttgkttttttttttttttaatctgtagtcgagatccaacctatgaaagaaaagatccatgagtgcagagatctttgatttgttcatggttccaagtgcctctct

SEQ ID NO: 28586 - DNA, 201 bp, Homo sapiens
aatcccagcacactgggaggctgaggcaggcagatcatgagggcaggagttcgagaccagcctggccaatatggtgaaactccgtctctactaaaaaaaaatacaaaaattagctgggcgtggtggcgggcacccatactcccagctactcaggagactgaggcggtagaatcacttgaacctgggaggtggaagttgcag

SEQ ID NO: 28587 - DNA, 201 bp, Homo sapiens
attaatgccatcagcctctgacccagctccaaaccagctgtctagtaacccccgtcgcgcatcctcaacatccggttccccctcttgcattgctgcaatcrtttggtgaaagcacaacccaaatgaaactcaagcttggctgggcacgggactcacacctataatcccagcactttgggaggccaaggcaggtgaatcgct

SEQ ID NO: 28588 - DNA, 201 bp, Homo sapiens
tctatccatccattttcccacccatctgcccatccacccacccacctactcacctactcatctgcttatccaccctcccgtccatctgtctattcatccayccacccacccatccatctacctacccatctacccacccttccattcacccatctacccttccttcctttcttccttccttccgtccactcatcttcccat

SEQ ID NO: 28589 - DNA, 201 bp, Homo sapiens
tttttgcctgagcccaacagggcaggggaactctgaaagtggatggttgatgataggtagacaacaatggttttattgtgcaaaagaagcggttgtctccrtaggagggtcagaaagatattttagtgagaaaagatgaaggaaaaattgcctctgcattccaggagaagggggtctctgaactgttgctcgctgagatgg

SEQ ID NO: 28590 - DNA, 201 bp, Homo sapiens
tttatttttagcttaatatattttggatatttttctgtgtccatccacaaagctctgcctggttcttttcaatggctgcctattttatttatgtatttatwtcttatttgtttttgaaacagagtcttgctctgttgcccagcctggcatgcagtggcacgatctcggctcactgcaacgtccgcctcctgagttcaagca

SEQ ID NO: 28591 - DNA, 201 bp, Homo sapiens
ttgaacctgggaggtggaggttgcagtgagccaagatcgcgccactgccctccagcctgggcaacaagagtgaaactccatctcaaaaaaaaaaaaaaaamaaaacaaaaagcaccacccactagaggcacaaagagttcaaagatcacgtctgccccacaggcccttccagagatgagcatgggcctggggtctggagtc

SEQ ID NO: 28592 - DNA, 201 bp, Homo sapiens
ttacttccctgaaccagtatgcaatcatgggatttataggaggttcttaaaagtagctctaaaggacagacattttcctttccatttaaaaaactgagccrggtgcagtggctcacacctgtaatcccagctctttgggaggccgaggtgggtggatcacttgaggtcaggagttcgagaccagcatggccaacatggtga

SEQ ID NO: 28593 - DNA, 201 bp, Homo sapiens
ctacaacctccacctcctgggctcaagccattgtcccacctcagcctcttgagtagctgagaccacagggattgtgccactatgcccagctaatgtttgcrtttttttttgtagagatagggtttcaccatgttgcccaggctggtttcggactcccgggctcaagcaatccacctgcctcagcttcccaaagtgctggaa

SEQ ID NO: 28594 - DNA, 201 bp, Homo sapiens
gattgtgccactgcactccagcctgggcaacagagcaagactccatctcaaaaaaaaaacaggctgggcacagtggctcacgcctgtattcccagcactttgggaggctgaggcaggcggatcctgaggtcaggagatcaagaccatcctagctaacacggtgaaaccccgtttctactaaaaatacaaaaaatttagcca

SEQ ID NO: 28595 - DNA, 201 bp, Homo sapiens
aatacacatcagcataatgccctaactggaatatgaagaagaaataacataagacaattcataatgaaagtgtgcatttcaggccaggcgaggtggctcaygcccgtagtcccagtactttgggagactgaggcgggcagatcacttgagctcaagagtttgagaccagcctgggcaacatggggaaaccccatctctaca

SEQ ID NO: 28596 - DNA, 201 bp, Homo sapiens
ccaggagttccagactgcagttagctatgatcgtgctactgcacttcagcctgggcatcagagtgacacctcatctcttaaaaaagaaaagaaaaaaaaaagcagatcttattgacttttgtgctttcggtacctggctcaggactcgtttgttgaatgaatatgtgaacacgtgaatatgcattttccattgcttctacc

SEQ ID NO: 28597 - DNA, 201 bp, Homo sapiens
cactgcagcctcaacctcctgggctcaagcaatgctcctgcctcagcctcttgagtagcttagactacaggtgtgcactaccatgtccaatgaattttttrtttttatttttttgtagagacagagtctcgctatgttgcccaggctggccttgaactcctggtctcaagcaattctccctcctcagcctctcaaagggct

SEQ ID NO: 28598 - DNA, 201 bp, Homo sapiens
ggggagatggaggttgcagtgagccaaagtcacaccactgcactccaacctgggcgacagagtgaggctcttgtctcaaaaaaaaaaaaaaaaaaaaaaaragcgtaaaaatctaaagtcataaaggttaggttctaagcctggctaattacaaacagatttttacctccatgagtggcaggtgagacattggaagagtca

SEQ ID NO: 28599 - DNA, 201 bp, Homo sapiens
tgtgaaaacagccaggcgtggtggcatgcacctgtagtcctagctacttgggagggtgaggcaagaagactgcctgagaccaggaggttgaggctgcagtragctatgatcacgccgctgcactcccgcccaggccacagagtgagaccacgacacttaaaaaaaacaagcaaaaaaaaaaaaaacccaaaatcaccagcc

SEQ ID NO: 28600 - DNA, 201 bp, Homo sapiens
tcacttgaatctgggaggtggaagttgcagtgagcagagatcgcaccactgcactccagcctgggcgacagagcaagactgtcttaaaacaaaaacaaaaacaaaaaacaactaatagtctgtgggaaacaccacgtgggaaacaccactcacactgcctacaatacaaccccaaagttattgaatgcgtggagtataaag

SEQ ID NO: 28601 - DNA, 201 bp, Homo sapiens
tggatcgtttgaggccaggagttcaagaccagcctgggtcacatggcaaaatcccatctctgctaaaaatacaaaaattagccaggcgtggcagtgtgcaygtgcatgtagtcccagctactcaatactgaggctcaaggactgctggaactcaggaggcagaggttgcagtgagccaagatcatgccactgcactccagc

SEQ ID NO: 28602 - DNA, 201 bp, Homo sapiens
tgacaccttgtaatcagaaaggggttaaatatctttggttgaatatcctgtcctgccgattcagaatcactgctgtctataacctcttccctagatcactrttttagatgatgatgataaagatgatattaacggcaattaccaagctcttaaatgtgctgtgggtaaaacaattttaagctctttctgaatccagtctct

SEQ ID NO: 28603 - DNA, 201 bp, Homo sapiens
gacctgtggggttgtccctcttcctctcctctgctgatccctcacctcgaaacctgcttgccactagaccgccccagggtatcaacttagttctcttttgrgcagagtcttgctctgttgcccaggctggagtgcagtagcactatctcagctcactgcaacctctgcctcccagttcaagctatttttggcctattttta

SEQ ID NO: 28604 - DNA, 201 bp, Homo sapiens
ccccttcttaatttagttaccctaaggaacaatttgtatagaaaacgcagaatcaagattttcacatttccaccccactttctgtacccatttaaaaaatmatgcatttggggctgggcacagtggctcatgcctgtaatcccttcactttgagagcccgaggctggtggatcacttgaggtcaggagtttgagaccagcc

SEQ ID NO: 28605 - DNA, 201 bp, Homo sapiens
gatcatttgagatcaggagtttgagaccagcctaggcaaaatagcaagacccccatctctacaaaaaataagccgggcatagtggcccacacctgaggtgsgaggatcccttgagcccatgagtttgagcctgcagtaagctatgattgcaccactgcactccaccctgggcatatagtgagacccttcccccaaccaaaa

SEQ ID NO: 28606 - DNA, 201 bp, Homo sapiens; identical to SEQ ID NO: 4988

SEQ ID NO: 28607 - DNA, 201 bp, Homo sapiens
agaagcaagctctgtgatgcctacagtgcaggtatgttgtgagaactgaacgtaaacacagcaaagtgccctgctggttcctggcctagggcaagcacctraagtgtgagctgctcttagcatctccatggtcctcctgacattaacctgccttcccagcagtacatatgacttttcccagcctctgcagggatagcatgc

SEQ ID NO: 28608 - DNA, 201 bp, Homo sapiens
agttccgaacccagtttgcaggggggtgatggacagcaggagtcatagtgaagtcagggaacctcttccagcatcagttctggcttgtaagaagcaagctstgtgatgcctacagtgcaggtatgttgtgagaactgaacgtaaacacagcaaagtgccctgctggttcctggcctagggcaagcacctaaagtgtgagct

SEQ ID NO: 28609 - DNA, 201 bp, Homo sapiens
tccgtgcggggcattaggtagagagccacttttctgcaggcaatggaggctgagacctttcttctttactagcccaggggtattgatggccctgcagagaygggttttgattacctctcactggatcccccagcagcctgttaccagaaagaagggcagacgcagggagcctgggtctgtgctcagtccccgctgggtttt

SEQ ID NO: 28610 - DNA, 201 bp, Homo sapiens
tgtgtagggacacggtgcatggacaggacaagttcaacaggcattagcagtcagctgccgaggacccaccgtcaagggccatgcagtggccaccttcacartcacaccacagaagatccagaacctctggcatctgcctccgtgcggggcattaggtagagagccacttttctgcaggcaatggaggctgagacctttctt

SEQ ID NO: 28611 - DNA, 201 bp, Homo sapiens
cggtcagtgtgtagggacacggtgcatggacaggacaagttcaacaggcattagcagtcagctgccgaggacccaccgtcaagggccatgcagtggccacmttcacagtcacaccacagaagatccagaacctctggcatctgcctccgtgcggggcattaggtagagagccacttttctgcaggcaatggaggctgagac

SEQ ID NO: 28612 - DNA, 201 bp, Homo sapiens
gtaacctcgaactcctaggctcaagcaattttcctgcctcagccttccaaatagctggggctacaggcacacacctctgtccacagctaattaaaaaaaawttttttttcatagagataggggtctcgctttgagtctcaaactcctcgcctcaagcaatccttctgcctcagcctcccaaagcactgggattacaggcat

SEQ ID NO: 28613 - DNA, 201 bp, Homo sapiens
ttaaaaaaagatgtaactgatgacctaaaaatgaaaaatacatgtataaaaaattttttttcaaaagagaaaaaaggaaatatttgtatggaaaatgatasaatagacaaagtcaacaaacaaaagattaccacggaaaaaattattttcaatgcaggagaaaagattagtagtaaaaatatacaaagggccaggcacagt

SEQ ID NO: 28614 - DNA, 201 bp, Homo sapiens
gttctgttgctgtcaggcctggggtggtttcagctcagcagatgttggttccgcctgacaacttgacctgtggggttctgagtgttcgcaagaatctcccygccccacctcccatcctctgtaccatctgcctcctgcttgcccacagcatggggttaacggctgaagttgggcagcaaagcctgaactgtgttttcctgt

SEQ ID NO: 28615 - DNA, 201 bp, Homo sapiens
taccaccatgctcagctaattaaaaaaaaacaactgttttttgtttgtttgttttgagacagagtttcacccctgtcacccaggctggagtgcaatggcaygatctcagctcactgcaacctccacctcctgggttcaagtgattctcctgcctcagcctcctgagtagctgggattacaggcacatgccaccatgcccag

SEQ ID NO: 28616 - DNA, 201 bp, Homo sapiens
gtcccagacactcaggaggctgaggtgggagaatcacttgccccaggaggtcaaggctccagtgagctgtaattgcaccatggcactctactctgggcaayggagcgaggcccagtctcaaaaaaaaaaaaaaaaaaaaaaaaaaaaaaaaaggcagtgtttaacagtgctggcacaactgggctatccacctaaagaaaa

SEQ ID NO: 28617 - DNA, 201 bp, Homo sapiens
gagctcctgacctcaggtgatccactcacctcagcctcccaaagtgctgggattacaggcgtgaaccaccacgcccggcctttttacacttttttttttttgccttttcccccctcttttgtgtggagaatggggtcttgttatattttccaggcaggtcttgaactcctgggctccagctttcctcatgcctgtgccttc

SEQ ID NO: 28618 - DNA, 201 bp, Homo sapiens
tatagtggcacatgcctatagtcccagacactcaggaggctgaggtgggagaatcacttgccccaggaggtcaaggctccagtgagctgtaattgcaccayggcactctactctgggcaatggagcgaggcccagtctcaaaaaaaaaaaaaaaaaaaaaaaaaaaaaaaaaggcagtgtttaacagtgctggcacaactg

SEQ ID NO: 28619 - DNA, 201 bp, Homo sapiens
tagttctttttaaactgcctcatgtatttttacactttttggtttgtttgtttttttttgggggatggagtttccctcttgtcgcgcaagctggagtgcaygatctctgctcactgcagcctccacctcccaggatcaagcgattctgcagcctcagcctcctgagtagctgggattacaggtgcatgccaccatgcccag

SEQ ID NO: 28620 - DNA, 201 bp, Homo sapiens
attttctgtcttccaagatggctttgctgttctcccctctctagttctttttaaactgcctcatgtatttttacactttttggtttgtttgtttttttttkggggatggagtttccctcttgtcgcgcaagctggagtgcacgatctctgctcactgcagcctccacctcccaggatcaagcgattctgcagcctcagcct

SEQ ID NO: 28621 - DNA, 201 bp, Homo sapiens
ctgaaagacaggcaggaaggcaccaaacgccaggaaagtgtggtcttaccccgactttccgcagtaggtctcccacaatgttgagggctgatatccgggcygcaggtgtgaggggggtccccccggtggagtcgtccaggcctgggtgtgcaaagggaagagcatgtaactcaccaacctatagtcatgtctgtgcgttaa

SEQ ID NO: 28622 - DNA, 201 bp, Homo sapiens
tcaaggaaagggagaaagacatttgccttacttgccaatttataaaacttgcaaatataaaagatgcattctggttttataaggaatttgcaggggcagcrggactaagcatttttcattatacatgttttgccagtgactttgtagaacaggggtcaagactttttctgtaaaaggccagatagtaaatcttcaggcttt

SEQ ID NO: 28623 - DNA, 201 bp, Homo sapiens
cattttctgtcttccaagatggctttgctgttctcccctctctagttctttttaaactgcctcatgtatttttacactttttggtttgtttgtttttttttgggggatggagtttccctcttgtcgcgcaagctggagtgcacgatctctgctcactgcagcctccacctcccaggatcaagcgattctgcagcctcagcc

SEQ ID NO: 28624 - DNA, 201 bp, Homo sapiens
ttttacttaagcacaaaaggatccctccctgtaattaacataaaagctgaaaggccaaattctttgccctaggctttcaagatttttttttttttttttttgagaccaagtctcactttgtcacccagcggtgcgatctcagctcactgcaacctccgcctcccggattcaaacaattttcctgcataagcctctcaagta

SEQ ID NO: 28625 - DNA, 201 bp, Homo sapiens
aaagatgcattctggttttataaggaatttgcaggggcagcaggactaagcatttttcattatacatgttttgccagtgactttgtagaacaggggtcaaractttttctgtaaaaggccagatagtaaatcttcaggctttgcaggccaggtggcttctggcacagctattcaactctgccattgtaatacaagagcagc

SEQ ID NO: 28626 - DNA, 201 bp, Homo sapiens
ccattttctgtcttccaagatggctttgctgttctcccctctctagttctttttaaactgcctcatgtatttttacactttttggtttgtttgtttttttttgggggatggagtttccctcttgtcgcgcaagctggagtgcacgatctctgctcactgcagcctccacctcccaggatcaagcgattctgcagcctcagc

SEQ ID NO: 28627 - DNA, 201 bp, Homo sapiens
aaaatttttaatgcaaaaaattttttttaattacgaaaaattttttaaaatgtttgggagctgcctggaaaaagatcacggctcactgcagcctcaaccavtccttccacctcagcctcctgaatagctaggactatgcacaatcatgcttggcttaaaaaaaaaaaaaaaattcttttttaattacaaaaaattttttaa

SEQ ID NO: 28628 - DNA, 201 bp, Homo sapiens
aaaaaatttttaatgcaaaaaattttttttaattacgaaaaattttttaaaatgtttgggagctgcctggaaaaagatcacggctcactgcagcctcaacyaatccttccacctcagcctcctgaatagctaggactatgcacaatcatgcttggcttaaaaaaaaaaaaaaaattcttttttaattacaaaaaatttttt

SEQ ID NO: 28629 - DNA, 201 bp, Homo sapiens
tcccagcactctgggaggccaaggcaggaggatggcttgacatcaggagtttgagaccagcctgggccacaaagtaagatcccatctcagtttttttttttgttttgttttttacttttttagacgctgtgtcacccaggctggagtgcactggtgagatcacagctcactgcagcctcaacctcccaggctcaaccaatc

SEQ ID NO: 28630 - DNA, 201 bp, Homo sapiens
cagcattaaggagagacaggggtgtcctactggctggagctaaaatccacctcagaggccaggtgcactggcacacacctgtaatcccaacactttgagargctaagacaggtggatcgtttgaggccaggagttcaagaccagcctgggtcacatggcaaaatcccatctctgctaaaaatacaaaaattagccaggcgt

SEQ ID NO: 28631 - DNA, 201 bp, Homo sapiens
atcacttgctcccagaagtttcaggctgcaatgcactatggtggcaccactgccctccagcctgggtaacagagcaagaccctgtttccaaaaataaatawaagaaaaaacatctgtgctttttttgtttttttgttgttttttgttttgttttgtttttgagacagagtctagctctgtcgcccaggctggagtgcagtg

SEQ ID NO: 28632 - DNA, 201 bp, Homo sapiens
gcttcacgtccccaactgcttcatggcattaggtttgtcttcccaaagaaggcaaccagcacttcccctttcaccgtccatcatacctagccctgggcacmcacagttttgactcttccatgaagcagctcatcaaaatgtacattgggagtttaatgagaaaaagaaaaccacacagacatgccagggccccacccagac

SEQ ID NO: 28633 - DNA, 201 bp, Homo sapiens
ggagggggccgtcaagtccaagttcaagtccaccatcgcggcgctggaggccaagattgcacagctggaggagcaggtcgagcaggaggccaggtatgcgsgtgtggagttccgaacccagtttgcaggggggtgatggacagcaggagtcatagtgaagtcagggaacctcttccagcatcagttctggcttgtaagaag

SEQ ID NO: 28634 - DNA, 201 bp, Homo sapiens
ctcatggccttcactctcctccccaggccgagcagctcagcaacgagctggccacagagcgcagcacggcccagaagaatgagagtgcccggcagcagctygagcggcagaacaaggagctccggagcaagctccacgagatggagggggccgtcaagtccaagttcaagtccaccatcgcggcgctggaggccaagattg

SEQ ID NO: 28635 - DNA, 201 bp, Homo sapiens
agtggagttttacaggatgaaggagaggacagggtgcccgggatcaagggactcgtgcagaggccaaacaaggcaggaagaggcatggtctcagtgcgctstcttgggcttccctgagtccgcctcatggccttcactctcctccccaggccgagcagctcagcaacgagctggccacagagcgcagcacggcccagaaga

SEQ ID NO: 28636 - DNA, 201 bp, Homo sapiens
gctgaggcaggcagatcatgagggcaggagttcgagaccagcctggccaatatggtgaaactccgtctctactaaaaaaaaatacaaaaattagctgggcstggtggcgggcacccatactcccagctactcaggagactgaggcggtagaatcacttgaacctgggaggtggaagttgcagtgagctgagatcgtgccgc

SEQ ID NO: 28637 - DNA, 201 bp, Homo sapiens
ctggctgtgtaactacagatgagtcttctaatcttctccaagcctcagtttcacccattagatgatgagggcaatacccctgaggcatgactccaaggagkgggcatcttttaaggcgggggagggtagaggcccccaccatggccgcccttcccccaggaacgcactccaggacgagaagcgccgcctggaggcccggat

SEQ ID NO: 28638 - DNA, 201 bp, Homo sapiens
aaagagaatgagaagaaagccaagagcttggaagcagacctcatgcagctacaagaggtaaagcctcgccttgctaggagagcctcagatgcgggtgtcayggtagcaccccttggcagctccagtctgtgcattcccagatttcatttcgtcctcctctggggtccacctgtctagaaagacacacgcttccctcctcta

SEQ ID NO: 28639 - DNA, 201 bp, Homo sapiens
cgcttatcccattttctgtcttccaagatggctttgctgttctcccctctctagttctttttaaactgcctcatgtatttttacactttttggtttgtttktttttttttgggggatggagtttccctcttgtcgcgcaagctggagtgcacgatctctgctcactgcagcctccacctcccaggatcaagcgattctgca

SEQ ID NO: 28640 - DNA, 201 bp, Homo sapiens
tgaggcagaagccagggagaaggaaaccaaggccctgtccctggctcgggcccttgaagaggccttggaagccaaagaggaactcgagcggaccaacaaartgctcaaagccgaaatggaagacctggtcagctccaaggatgacgtgggcaagaacgtaagtggctctgggtggtttttctcgtccatgtttcgcctgcc

SEQ ID NO: 28641 - DNA, 201 bp, Homo sapiens
ggggcagcacacatctctattcctcgcccagcttcacgagtatgagacggaactggaagacgagcgaaagcaacgtgccctggcagctgcagcaaagaagmagctggaaggggacctgaaagacctggagcttcaggccgactctgccatcaaggggagggaggaagccatcaagcagctacgcaaactgcaggtgggtga

SEQ ID NO: 28642 - DNA, 201 bp, Homo sapiens
catgcagacggcttagagtcaagtaatttttgaaggcttattaagaaaaatagccatcctctgctacttctcaactcctttaattgattttttttttttttggtatttaccaccatatctctgaaaacaacacttgatcattgtgctgctatcttaattttgttttcaattttaggtatcatctattgactttcctccatg

SEQ ID NO: 28643 - DNA, 201 bp, Homo sapiens
tttctttaattctgcacacatatctgtaaacactttctttattaaatgttcctgagttaatatcttaagcacactgttcattttctgtgccacctgttaaatgatgagcatttaatatgattgtcagcatccaaaaaagatcctgcgtagtgcttagttcggtgcccaacacatagtaagtgctcaatgaacggtggctgt

SEQ ID NO: 28644 - DNA, 201 bp, Homo sapiens
atcctgtgtttttttaatgttctaatgtagtcccagcaccttttgcatggcatctgggacgtacagaatgaatgaatgaatgaatgaatgaatgaatgaaygaacgaacgatcagtagtttctgtttctgttggatgggcctaggctggatagcataatggaccatgctcatacctgggggcgggccaggctgggcttggt

SEQ ID NO: 28645 - DNA, 201 bp, Homo sapiens
cagggtcccacatcagaatctagtgctgatagcctccttgtctgaatgacataggccctccaagaatgattcatttcatttgggacaggggtcagttttgcttctaatcttgcttttaaataacaatgaacaatggttaagtatttgctgtgtgccaggaatttaccaaatccttttttcttgatgtactacactgttcag

SEQ ID NO: 28646 - DNA, 201 bp, Homo sapiens
gctggagtggagtggcacaatctcagctcactgcaacctctgccacctgagttcaagcagttctcctgcctcagcttcccgagtagctgggattacaggcrcgcgccaccacaccttgctaatttttgtatttttagtagagatgaggtttcactgtgttggccgggctggtctcgaactcttgacctcaggtgatccacc

SEQ ID NO: 28647 - DNA, 201 bp, Homo sapiens
gaaggctttctaccatagtaagtgggagcaaatggatgggtggtcagcagctgggtccttttgctgagctgggccagggaccccatggcgtgagaatagctgttgtgaagggccttgtaatgtctggtttggcctgaggaaccagagaagtctgggatctctaggctttgttcctggaacatagtgactgatttgaagcca

SEQ ID NO: 28648 - DNA, 201 bp, Homo sapiens
caaaaagcagccctcttccctggaggcaaacatgattcacaggttcatgtatgtacacacacacacacacacacacacacacacacacaccccaaacatamgaaaaagtcactccttgtatgttttgcagtatgattttttttccacttaaccctaccttatagttttttctgtctgttcataactatctagtcagacttc

SEQ ID NO: 28649 - DNA, 201 bp, Homo sapiens
catgccactgcactccagcctgggtgagagagactcttaaatttcttttttaaatccaccttgaaggccaggtgtggtggcccacgcctgtaatgccagcrctttgggaggccaaggtaggagaactgcttgagctcaggagttccagaccagcctgggcaacaatatcaagacctcatctcaatttaataaaataatcca

SEQ ID NO: 28650 - DNA, 201 bp, Homo sapiens
tttttgtatttttagtagagacgggtttcaccatgttggctaggctggtctccaactcctgacctcaggtgatccacttgcctcggcctcccaaagtgctrggatcacaggcctgaaccaccacgcccagccagtatgttggatatttctaaagaggcccgtctgtagggagctagagggaaaattggactctttggggcc

SEQ ID NO: 28651 - DNA, 201 bp, Homo sapiens
aaggctttctaccatagtaagtgggagcaaatggatgggtggtcagcagctgggtccttttgctgagctgggccagggaccccatggcgtgagaatagctsttgtgaagggccttgtaatgtctggtttggcctgaggaaccagagaagtctgggatctctaggctttgttcctggaacatagtgactgatttgaagccag

SEQ ID NO: 28652 - DNA, 201 bp, Homo sapiens
ttctttcttcttttttttttttttgagatggaatttcacttttgttgctcaggctggagtgaagtggagcgatcttggctcattgcaacctccacctcccrggttgaagtgattctcctgcttcagcctcccgagtagctgggattgcagggatgtgccaccatgcctggctgatttttgtatttttagtagagacgggtt

SEQ ID NO: 28653 - DNA, 201 bp, Homo sapiens
cttgagccttccctttcatcagaatccggggttaagggattggctattaaaacagtctcagatcctgccagaaaggaccatgtctgtgagtgacatatgarcagttcttcatctcctcccaatgagtgagtgtggcttgtgttcagtcattctcatttactgagcacctactatgtgacatagtagccatcaactccaatt

SEQ ID NO: 28654 - DNA, 201 bp, Homo sapiens
ataaacaaataaataaataagttagtcagaaacagctggtgtaggctgggcatggtggctcctacctgtaatcccagcactttgggaggccaaggtgggtrgatcacctgaggtcaggagtttgagacccacctggccaacatgggaaaccccatctctactaaaaatacaaaaattagccaggcatggttgtgggcacct

SEQ ID NO: 28655 - DNA, 201 bp, Homo sapiens
gcaggcgctcaagggccagttcgaaagggatctccaagcccgggacgagcagaatgaggagaagaggaggcaactgcagagacaggtgcgtgctgccgggkaggccagcagagggaggtcgggtggcctttttcattcctatcaccactctcatggttggtgtggaaacttcgttttctttatttttttttgaaacagagt

SEQ ID NO: 28656 - DNA, 201 bp, Homo sapiens
acttttttccctaacccttccattgcgttttaaatttctggtatatattttattaaattccaaaaattctattttatttttaaatgtttctttcatatgayattctttttctgtggttgcaatatcctgtttctcagaggatatttaatgcagagtctatttcctccaagatacatattttcctaattgttttaacttctg

SEQ ID NO: 28657 - DNA, 201 bp, Homo sapiens
ggaagtcaacatgcaggcgctcaagggccagttcgaaagggatctccaagcccgggacgagcagaatgaggagaagaggaggcaactgcagagacaggtgygtgctgccggggaggccagcagagggaggtcgggtggcctttttcattcctatcaccactctcatggttggtgtggaaacttcgttttctttattttttt

SEQ ID NO: 28658 - DNA, 201 bp, Homo sapiens
tccatctaagacgtatcatcaccatctagggagtttcaggacaggcctgtgtattcatctcacctgctgtcctcaaatagaaatcagaaaaaaaaagggcrtatgaaggtcctgagacccaaaatatcttctgacagcagattaaaaataaatgaatcaaagcttcaaattcctgctatgcttctctggacagattagatt

SEQ ID NO: 28659 - DNA, 201 bp, Homo sapiens
cccggccatgcatcctgtgggaggccaaagccacctccctgatctcctgaggtgccgctcacggtgggtttctcaatcgtcttcatgaagttgagcctcayagaatggggctgcccgctctgccggcaggtccatgagctggagaagtccaagcgggccctggagacccagatggaggagatgaagacgcagctggaagag

SEQ ID NO: 28660 - DNA, 201 bp, Homo sapiens
cctgggcaataagagcgaaactccatctcaaaaaaaaaaaaaaaaaaaaaagaaacattaaaaaatttattagctgggtgcgtgggctcacacctgtaatyccagcactttgggaggccaaggtgggtggatcacctgaggtcaggagttctagacaagcctggccaacatggtaaaaccccgtctctactaaaaatacaa

SEQ ID NO: 28661 - DNA, 201 bp, Homo sapiens
atctaattttttttttctctgtaatgcagtggcggggagaaattagccacattttgcataggaggaaacagaaacttgaaaacaaaaatttttttagagatggaatctcactctgttgcccacgctgaagggccagtggcacaatatagttcactgtagcctcaaattcttgggctcaagagatcctcctacctcagtctc

SEQ ID NO: 28662 - DNA, 201 bp, Homo sapiens
cactccagcctgggcaataagagcgaaactccatctcaaaaaaaaaaaaaaaaaaaaaagaaacattaaaaaatttattagctgggtgcgtgggctcacayctgtaatcccagcactttgggaggccaaggtgggtggatcacctgaggtcaggagttctagacaagcctggccaacatggtaaaaccccgtctctactaa

SEQ ID NO: 28663 - DNA, 201 bp, Homo sapiens
gcttgaatccaggaggtggaggtgcagtgagccaagactgtaccactgcactccagcctgggtgacagaataagactctgtctcaaaaaaaaaaaaaaaaaggaaatgggaggctgaaggtttgatcgagggagattgcaagatgaggtggaatcattccaaggtgggttcacatctcagcccttgaagaggttatttcct

SEQ ID NO: 28664 - DNA, 201 bp, Homo sapiens
agtgcagtggcactatcttggctcactgcaacctctgcctcctgggtttgagcaattctgcctgagcctcccaagtggctgggattacaggtgcacaccaycacacctggctaatttttgtattttcagtagagacggggtttcaccatgttggccaggctggtcttgaactcctggcctcaagtgatttgcccacctcgg

SEQ ID NO: 28665 - DNA, 201 bp, Homo sapiens
atggtgcacgcctgtaatcctagttactcgggaagctaaggcaggagaatcgcttgaacccagaggcagaggttgcagtgagccaagattgcaccactgcmctccagcatagacaacagagcaagactccatctcaaacaacaacaacaaaaatcattttgaacaaatgcatttaaatatatttgtctttccacccttttt

SEQ ID NO: 28666 - DNA, 201 bp, Homo sapiens
tggttttagcaattactggtagaacttgccaacttgccaagaccctttctttcttcctttctttctttttttttttttgagacggagtctcactctgtcgyccaggctggagtgcagcggcgcatctccactcacccactcactgcaagctccgcctcccaggttcacaccattctcctgcctcagcctccagagtagctg

SEQ ID NO: 28667 - DNA, 201 bp, Homo sapiens
gcttccctgggccaccccagaaaaagaagaattgtcttgggccacacgtaaaatacactagcactaatgatagctgatgagctaaaaaaaaaaaaaaaaaatcgcgaaaaaatatcatactgttttaagaaagtttatgaatttgtatcgggccacattcaaagccgtcctgggccccatgcagcctgtgggctgcaggtt

SEQ ID NO: 28668 - DNA, 201 bp, Homo sapiens
ccttatgtgaaaggcagaaccaaatagactccagaatgagacccaggtttgggtcccagctctgacacttctttttttttgagatggaggctgactctgtygccaaggctggagtgtagtggtatgatgtcggcttacggcaacctccacctcccgggttcaagtgattctcctgactcagcctcccaagtagctggggct

SEQ ID NO: 28669 - DNA, 201 bp, Homo sapiens
agaaaaaaaaaaaaaaaaaaaagaagtccactttacttgtcatagtgcttagaacaaatgaaacactctcctagccctcttgggatgtaattggctaccayctgcacaaactcttcattattgcacaagaatatcaatatacttaatgctactgaactgtgtttaagtggccgaggtggtgaatgttagctgtattttacc

SEQ ID NO: 28670 - DNA, 201 bp, Homo sapiens
ggcatggtagcgcatgcctgtagtcccagctacttgggaggctgaggcacgagaatcacttgaacccagaaacgtggaggttgcagtgagctgagattgcrtcactgcactccagcctgggtaacagagcgagactctgtgtcaaaaaaaaaaaaaaaaaaagacttagcaactattattactagtattagtattattaat

SEQ ID NO: 28671 - DNA, 201 bp, Homo sapiens
gcccagagtttatgtcccactccccatcccaggcaaagtgggagaccatagccacggatagggcacattgatgtctttgtttttttttttgtctgtctgtytgtttgtttgtttgtttgttttttgagatggagtctcattctattgcccaggctggagtgcagtggcacgagctcagctcactgtaatctccgcctcctg

SEQ ID NO: 28672 - DNA, 201 bp, Homo sapiens
agaaggaaaggggttggggtgggggagcacagtaacttactctcccagcccataatagcagcatgcatgagtcttgttaataggcgggtagtgaggtgatrccaggtccgtggtctggcatgcatgactttgccctctgtgatgaagataaactttctcctccgttctgcaaggctcgcctcaaacgatgtgcccttgaga

SEQ ID NO: 28673 - DNA, 201 bp, Homo sapiens
agaagacaaggtctgctgatctagccccatcatcccgcaccatcatgcttagtgctgtggaaatccacccagtacagtagcccagcctcctagctgccctytcccatcaccccggaccctgtgatctccatgccaccctcacctgccctcccctctgctctccctcctgccaccccgcatcgcggagaagctctcctgaaa

SEQ ID NO: 28674 - DNA, 201 bp, Homo sapiens
atttctttcgatggcctgattcaagcgctgctcaaagtcttcgagagacatgatcgtggcgctggcgaagagaaaagcagagttatccaagaggacaaacsgcagcatccctccagcaccgcggatccaggaggtgcgaagggtcagacacacctgggcacaagtcccagccccaaacttcctagatgccacagagtgggc

SEQ ID NO: 28675 - DNA, 201 bp, Homo sapiens
cttgagcctcagaggcagaggttgcattgagccgagatcacaccactgcactccagcctgggcaaagagtgagactcggtctcaaaaaaaaaaaaaaaaaaggcattgcaaattgcaacttgttgcagtcacatatgacagcagtccccatcctcttggcaccagagactggtttcgtggaagacaatattttccagggtg

SEQ ID NO: 28676 - DNA, 201 bp, Homo sapiens
tggccaacatggtctctgctaaaccctatctctactaaaaatacaaaaattatctgggcatggtcgtgggcacctgtaatcccagctactcgggaggctgwggcacgagaatcgcttgagcctcagaggcagaggttgcattgagccgagatcacaccactgcactccagcctgggcaaagagtgagactcggtctcaaaa

SEQ ID NO: 28677 - DNA, 201 bp, Homo sapiens
cccattgaagaactagtggagaaaccctaaggagaagagatttgggaggaaagtgggattcttttttcctaccccctcttattcagaggtttgatttttttgggtggggggtgggagggaattgtctcctttccacaggtcttgaatccaaacaggtgggtcttccacgttaggcacaagcgtgtaattccaagagcagat

SEQ ID NO: 28678 - DNA, 201 bp, Homo sapiens
ctctggggctcaaacaatcctcctacttcactctctagttgggactacaggcacacactgctgtgctcgactaattattattattattattattattatthttattattattattattattttgtagagacagggatcttgctatgttacctaggctgttcttgaactcctgggctcaagcgatccttccgctgcagcctc

SEQ ID NO: 28679 - DNA, 201 bp, Homo sapiens
aactggccaacccatcagggtttgaacctggagttaaaactgtgacgaagagagctgtgtggggagcgtacagggaacagtcaaactgctgctcctctgcrctgaatttgagcatccttctgagtcaagcgcttggaaaacagtgctaaaaaagaaaaagacttaagggtcacatctagagagagaaggatggagagttct

SEQ ID NO: 28680 - DNA, 201 bp, Homo sapiens
cggccggaaccgactcagggaagacgttctcaagcatcccgcacagacactgcctgctcgaccccctttctctagggatccggagcgtctgcgaccgcctsgggccggggctgagactcccgtccctgtgcgcacctgttccgtgcgcccttgtgcggtgcgcacctgttccgtgcacccttgtcccgagcgccccagctc

SEQ ID NO: 28681 - DNA, 201 bp, Homo sapiens
taggacttgaagaagacaaggtctgctgatctagccccatcatcccgcaccatcatgcttagtgctgtggaaatccacccagtacagtagcccagcctccyagctgccctttcccatcaccccggaccctgtgatctccatgccaccctcacctgccctcccctctgctctccctcctgccaccccgcatcgcggagaagc

SEQ ID NO: 28682 - DNA, 201 bp, Homo sapiens
gtgtgtgtgtgtgtgtatgtgtgcgtgtgtatacccatgtacaccatgagaaagtctgagaatcactgctttccagattggacatgggctgtggtagcccrggcactgctagctggctttaggacttgaagaagacaaggtctgctgatctagccccatcatcccgcaccatcatgcttagtgctgtggaaatccacccag

SEQ ID NO: 28683 - DNA, 201 bp, Homo sapiens
ggggaacaaccaggtctagagttcagtgactgatcagcctcaggagctttgcaggcggccctagggctcaggcttcctgtggaacacgtgcttggcaatgwataggacctgggggcctgacttagcttctttctgcacctgaggtcctctagcagcacctagtggtcccatttttccacgttatgtgccctggataagagg

SEQ ID NO: 28684 - DNA, 201 bp, Homo sapiens
tctggacctgtcgtcctcttagagagttggtctgtgatcggctccacttcttaggtaggaaattgatgaaaacagagtttacccagaagaatgctggtatygcaaggaacaagtagagcatctctttcatgaacctgagcggtgaagtggagccaagttagaaatttctggacgtgggggaacaaccaggtctagagttca

SEQ ID NO: 28685 - DNA, 201 bp, Homo sapiens
tgtgatgctcaaatgatctgtcccttagctgagtgaccttgggctggttactccacctctctgtgcctcatcagcaaaatggggatgataatgaatggtayctgcctcatagaaatgtgagaatagagtgaatgaactcatataaagctctaggcaccatgcgaggtgcagagtaagggctggctacgtagtgtctatcgt

SEQ ID NO: 28686 - DNA, 201 bp, Homo sapiens
tacccctgccccctaccaatctcctgcccagaggctgggagagtccaagagccacctctatctttccagcctcttaggtttcttccagaacaaatctcccsttaacagcaggcattgtggtgcagtggttatacatgtgtggaccggacccctggtttgaaccctaaacaagcagcctaggctgcatgtgatgctcaaatg

SEQ ID NO: 28687 - DNA, 201 bp, Homo sapiens
tgttggcagggcaaattcatccgcatcaacttcgacgtcacgggttacatcgtgggagccaacattgagacctgtatcctttccctgagcctgggccaaaygggtacccctgccccctaccaatctcctgcccagaggctgggagagtccaagagccacctctatctttccagcctcttaggtttcttccagaacaaatct

SEQ ID NO: 28688 - DNA, 201 bp, Homo sapiens
aggcaatgagcctgagtatctgtggagtccagctgagctcatttctttatgttcatctaccaattggcatttgaggagtttccagttggggttattacagkcagtgctgggtgaacatcattgtgtgtcttttgatgaacatgttcatgcatttctgttgagtgtatacatatatgagtggacaagttttgatgaagctaa

SEQ ID NO: 28689 - DNA, 201 bp, Homo sapiens
cttaacgcctcactgcaggcaatggtaccctcctacaatatactccatgttgcagccagagggaccttcgtaaatacaaatatgattatgtttctccccarcttaaaatccttttgtgtttccccatagtccacaagggaacgaagaaacaccaccaacagcgtccacatggccttcacgacatggccctgtggacacatc

SEQ ID NO: 28690 - DNA, 201 bp, Homo sapiens
gataatgctttaggaacagttctctgactattggtgaagatgtcccagataattgccaaatggatatcattttgccaccaatatcaggagtgtatagacartctcctaaaatgcacccagggaccccagttgacatccttctgtggttgtttctttcaactgattggaggagtgaggctttggactgggggtgatcgagag

SEQ ID NO: 28691 - DNA, 201 bp, Homo sapiens
tccaaatttatttgtgtctctgtcttacccagtttacccaattctctccatctttaagtttctttggtgccaccttctggttggcccagttctatgaagtytgaatattccttcctgcctcccagtctctgaaatgtcctcgagtgaaagatgaggttgtggaggaccccgggacttgcctgcacatactactctgccttc

SEQ ID NO: 28692 - DNA, 201 bp, Homo sapiens
tttgtattaaaattaattgctttttagaaatattgggtaaagtccattttgtttaaagttccaaccctttcaaaagctataaagtccaaatgagattggarcaccaggaagacagggggaagagtcattctgttacctggttttctcccctgcctgacttctgacctgagcagaggccaagggggtgcacttgtgtgtgag

SEQ ID NO: 28693 - DNA, 201 bp, Homo sapiens
tgatggggatggcattgaatctataaattaccttggcctgcccagcttttaaagccagcttctctggaaagtctttccaggattctgtagaggttttcttmttattatttatttatttacttgtttttttctgaggatttccatagcactttcaaaattatcctgttatagagcacctgactggcttgaaactacgcattt

SEQ ID NO: 28694 - DNA, 201 bp, Homo sapiens
acaacccatcacccagtttaataactggaatattgtcatcgctggaggccgtgtttccctactgatcacaccctcctccctcatcacatccgcttccctcycctctgtatcaccaccttcctgagtttcatgataataacgacatagttttactgtctacacatgcatccagaatgatttagtttagcctggttttgaact

SEQ ID NO: 28695 - DNA, 201 bp, Homo sapiens
agggccacagttgaaaaggagaggtccaaagcaagggatggtttggagactgagaagatggaggcagtaccttcatgaagtacccctccagaagctgatgygcttctgcatgtgaaaggtggcctttcctttcctgagctgaagcttctgtgttgaaggagatggagggggcagaggacttgagggaggtttccagtcctg

SEQ ID NO: 28696 - DNA, 201 bp, Homo sapiens
agtttcattacctattgaataaatacaaaagaacatttaaaatgtgtattgaattataaagaacagcagtacaacccatcacccagtttaataactggaakattgtcatcgctggaggccgtgtttccctactgatcacaccctcctccctcatcacatccgcttccctcccctctgtatcaccaccttcctgagtttcat

SEQ ID NO: 28697 - DNA, 201 bp, Homo sapiens
agcagtgtgctttaaagtttaaggaaaacaatttgtttaccaaattaacaagaaattaattgatcattgactaaataaggtataataatagaaaaaattgktctctgtttatgaaaattctgcttcgggaatgaaaatcttacagactaaataaacctgcactcaccagcaggggggaaactgtgggagatgagaaatggg

SEQ ID NO: 28698 - DNA, 201 bp, Homo sapiens
gttacattctgaaaatattggtgtcccaatttacataatcacatatggaatataggagggaatacctattttaccagtattggaaatcaatagtttttctycttacaaatttcatgttttaagcaagtaactttcttgctttctgctgctgcttttgttataagtccttataccatggtgattaagaggagccctggaacc

SEQ ID NO: 28699 - DNA, 201 bp, Homo sapiens
ttcactgggaactaacacccggcgccgctcagacatctctattcccgcctctccgacccggtctcacttcgctcctgggcagctgcgcggagaactggggwaggtgtttgactttgggagtggttcccacacgctggattctcgttacctgctcttgagcccaggaaaagggcgggaacctacgaaagggaagcccagtga

SEQ ID NO: 28700 - DNA, 201 bp, Homo sapiens
attcactgggaactaacacccggcgccgctcagacatctctattcccgcctctccgacccggtctcacttcgctcctgggcagctgcgcggagaactgggrtaggtgtttgactttgggagtggttcccacacgctggattctcgttacctgctcttgagcccaggaaaagggcgggaacctacgaaagggaagcccagtg

SEQ ID NO: 28701 - DNA, 201 bp, Homo sapiens
gaaaatggacacatattcatgctcataggttggaataattaatgttaaaagtacaatgctacccaaacaatttacagattgaatgcaatccctgtcaaaawaccaatgtcattcttcacagaaatagaaaaaaaaaaaaaccctataatttgtatggaaccacgaaaaaccccaaatagccaaagcgcattatcgcttctt

SEQ ID NO: 28702 - DNA, 201 bp, Homo sapiens
cccacaaatttgataaactacatgacgtggatcaatttcttgaaagacacaatccgccaaaagtcacacaacaggaaatagaacatttgaataggcctatwtctactaaaaaaattaatcaataattaatagccatctaaaataattaccagacccagatgggctcactggtaaattctaaaaacaaattaagaaaacgtt

SEQ ID NO: 28703 - DNA, 201 bp, Homo sapiens
ggaatttgcctgctctgggtttatctacctcagaaggtgactctggatcccaggaatctcctgatgaatccatttcatttttgaacatcagcctgatctastactgttgtaatacttgggacacagggagccaacctctacttttcctggtggcttggctcctccttccctctatatcctctttctttggctgaaattaaa

SEQ ID NO: 28704 - DNA, 201 bp, Homo sapiens
tttgatgaacatgttcatgcatttctgttgagtgtatacatatatgagtggacaagttttgatgaagctaagaagagagagttctaaatatattattattkggaatattattctttattctgcatggaaggtctatttgaaagcccaatgattattgcacaaaagtcctggaagaagggtagggatcaatcttggcagtga

SEQ ID NO: 28705 - DNA, 201 bp, Homo sapiens
tttgaggagtttccagttggggttattacaggcagtgctgggtgaacatcattgtgtgtcttttgatgaacatgttcatgcatttctgttgagtgtatacrtatatgagtggacaagttttgatgaagctaagaagagagagttctaaatatattattatttggaatattattctttattctgcatggaaggtctatttga

SEQ ID NO: 28706 - DNA, 201 bp, Homo sapiens
aattatacccacttttcagtaatcgaactttaatttttccgttaggaaaaaaagacagtgcagatgatgtttaaggaagctaagtttaaaatggggtatgyggatgaggtacacacccaggtcctggagctgccctatgtggaagaggagctgagcatggtcattctgcttcccgatgacaacacggacctcgccgtggta

SEQ ID NO: 28707 - DNA, 201 bp, Homo sapiens; identical to SEQ ID NO: 5174

SEQ ID NO: 28708 - DNA, 201 bp, Homo sapiens; identical to SEQ ID NO: 5176

SEQ ID NO: 28709 - DNA, 201 bp, Homo sapiens
ctgaattactgtagcttaataataagttttgaaaacacttaagtgacataagttttccaactttatttttcaaagttgttttatctgctttcagtcctctrtctttccctgtgaattttataatttgcttgttgacttgtacaaagcctgctgcaattttgattaggactgtgtgaattctaaatatcaatttggagagaa

SEQ ID NO: 28710 - DNA, 201 bp, Homo sapiens
ccccacttctctattgcagacaatccctctgctttcagcagtccctggcccatggtggtggcctacgcgccagctccccagcctcttttcataccaaataytgagccgggttatctttctaaagccccaatgcactcatatgagacgtttgtttaaaaaccatgcatggctttccagaccataatctcaagttcaaactcc

SEQ ID NO: 28711 - DNA, 201 bp, Homo sapiens
tccattccaaagggcctcacccagggctgctctccgggcccctcccgcttccctgcctcgggctctgcgtagaccgcgccctcttccctgggtccactcgsaggggcagactcgtctccccagttctcccagcacaccctgatggctgggtctcagtctccgtttcgcgcgcgcgctctcccctcgccctcctctgtctct

SEQ ID NO: 28712 - DNA, 201 bp, Homo sapiens
gcttagtttataagctaagattaggaatagctgaaaagaatttggactttaggttaattcctcatctttatttgcaaattatatatggtaaatcataaaaytattgattttctgatgtggcacaatgaagaagtaagccagtgatattagttgtttctgtagctgtgaaattatgtttttggtttttcctagggttttaca

SEQ ID NO: 28713 - DNA, 201 bp, Homo sapiens
aagaatgcttatttccccacaaattgcaataaactctcatattctttataggtaagatttcagaggtactggatgctgggacagtcgatcccctgacaaasctggtccttgtgaatgccatttatttcaagggaaagtggaatgagcaatttgacagaaagtacacaaggggaatgctctttaaaaccaacgaggtaggga

SEQ ID NO: 28714 - DNA, 201 bp, Homo sapiens
acttgtgagctttatctttagtgaaattctttgaaatggaatttttcatcctaaaggtataaatattttcatggcattttctttttcctacccttccaccmtccctgtgttccttcctccatttataaaaacataattctaagttacattctgaaaatattggtgtcccaatttacataatcacatatggaatataggagg

SEQ ID NO: 28715 - DNA, 201 bp, Homo sapiens
tttctttctttctttctttctttctttctttcttctctctctcttctttctttctctctctctcccttccttccttcattgcttccttccttgcttccttscttccttccttccttgcttccttccttccttccttgcttccttccttccttctttccttgcttccttccttccaagacagagtatcgctctgtcacccag

SEQ ID NO: 28716 - DNA, 201 bp, Homo sapiens
tccaccacctcggcctcccaaagtgctgagattacagacatgagccaccgcaccaggccggaagtagtttgctttctctagctgcttgtgaccaagcatamaatgttttaccagtgaattccttagatattgtccttgagatgaaggattctggagaggatcaggaaaagagacagattcagtagttatcatccagattta

SEQ ID NO: 28717 - DNA, 201 bp, Homo sapiens
tgggtgaatttttccttcctggggacccttgcgaagacctggagttttagatcccataactgagaggtgctactgacatctagtggatggaagccagaagwgctgcaaaaatcctacaatgcttatatgagacaaggaagtgtcctggccccaaatgtcaatgctgcattgcccacgttgagaaaccctgtgctagacaat

SEQ ID NO: 28718 - DNA, 201 bp, Homo sapiens
taattacatgttctttttgtttgatttgccacactttgtcaaatagtaacttaaaatagcagacagttatttaaaaacacgtttaacagatggaaagatcrcctaggcgtgcaagaagtcatcaatatgtgattcatcagtttgccttcagattattttcttacactgagagatttaaataatttccaaaccactgaaaaa

SEQ ID NO: 28719 - DNA, 201 bp, Homo sapiens
attcatctttgattcttcctgctccctcttcctctcatggtccaagaagtgatgccaaatttatgtcctggaaattcctcaaggccatgtcctcctctccwtttctcctgcctctgtttcatttcagctttcctcatctctcatccatgctgcgtccttaacgcctcactgcaggcaatggtaccctcctacaatatactc

SEQ ID NO: 28720 - DNA, 201 bp, Homo sapiens
catggttggcagctgcgtttttagaccaagtatcataaatagcacaagaaatccgagtcattttgttagggtttgcaaaaggcatatccacttataccaakacttagataacattcgtttcttttaggatgtgcttatagggaggcctgagaagaggcataggtaggcagacagggttgcttttgagacactctctatctt

SEQ ID NO: 28721 - DNA, 201 bp, Homo sapiens
tttgtaccaaagccagctacttagcttcagggagagaatgagactgaagattacaaggagacatccacattatatgtgggctgagagaggaaagagggagyatcagaggttgccgggtttgctactctcattcctcttcctcctctgcccaacacttggacttggaaagaagtctgaaaggtggggaataatcagcccata

SEQ ID NO: 28722 - DNA, 201 bp, Homo sapiens
aggttggaataattaatgttaaaagtacaatgctacccaaacaatttacagattgaatgcaatccctgtcaaaataccaatgtcattcttcacagaaatakaaaaaaaaaaaaaccctataatttgtatggaaccacgaaaaaccccaaatagccaaagcgcattatcgcttcttgactgaaaactcccggacagttgggg

SEQ ID NO: 28723 - DNA, 201 bp, Homo sapiens
tctaaaatggatttgtagaagggaggaagggaatgaagctttgaggttttcataaatattgccaaattgctctccacagttttgtagccatttacattctrcagggggtatttataggatcctcagttccacccaccatcagcagaactgcataatgttaacctttaaaacttttggaagggtggggccaagatggccgac

SEQ ID NO: 28724 - DNA, 201 bp, Homo sapiens
tgtttctagttccatgtctgctaataaagacaaaatttcctctttctttcacatttagatagcttttttttttctttgccttattgcactgacttgattaraagtagtgaaaacagacatccttgtctggttcctgatcttaggggaaagcacgaaggctcccatcattaaacgtgatattagctgtaggcttttcatagg

SEQ ID NO: 28725 - DNA, 201 bp, Homo sapiens
gttgccgggtttgctactctcattcctcttcctcctctgcccaacacttggacttggaaagaagtctgaaaggtggggaataatcagcccatatgattctwccactgcagagagagcctctgagtgttacagccaggagcaacagggtggcaccctcttcttcagggaaacacacacctctttgcactgccttgtggatag

SEQ ID NO: 28726 - DNA, 201 bp, Homo sapiens
tttgtcagatttatccttaagtatattctattttgtgctattataagtggtgttgctttttaatttcaatttctgattaattgttgctagtatatggaaawataatacaggtttttttttgtatctcagccttatatcttgcaaacttgctaaaatcacttagttctagtagctgtgtttctagttccatgtctgctaata

SEQ ID NO: 28727 - DNA, 201 bp, Homo sapiens
ctatcttgtgcctctttgcacctgcacgcactgtgtttcctacatgggatatctgtgtttacaaccaaactcccaggggccaaattatatcctttgtaaasgacttcaaaccaccaggcatttgctggaagtttcacggaggaaaacaagcatttttcatcttttaatctgttttgctggtcaaagaggaaaaggagtgga

SEQ ID NO: 28728 - DNA, 201 bp, Homo sapiens
gacaatccctctgctttcagcagtccctggcccatggtggtggcctacgcgccagctccccagcctcttttcataccaaatactgagccgggttatctttstaaagccccaatgcactcatatgagacgtttgtttaaaaaccatgcatggctttccagaccataatctcaagttcaaactcctaaatgtggcataagggt

SEQ ID NO: 28729 - DNA, 201 bp, Homo sapiens; identical to SEQ ID NO: 5179

SEQ ID NO: 28730 - DNA, 201 bp, Homo sapiens
ggactttctttgcaactccgtaacccagtttcagcaactcttggggaaaatggggcatctttttggagtcactttaaaaagtaattttttttttttttgtstttccagtagcctcatatttcaggccagcctatctcaaacaaaccctccaaatttggtgaaatgtatctagctgttttcacaggaagtgatgacagaaat

SEQ ID NO: 28731 - DNA, 201 bp, Homo sapiens; identical to SEQ ID NO: 5169

SEQ ID NO: 28732 - DNA, 201 bp, Homo sapiens
ttggagaaagctctttgggagagtataatggcagcgttaaaagtcagtgttggtttctgttcccaggcactttgtttatacaaagacggagatattcaccraggtttccagtcacttctcagtgaagttaacagaactggcactcagtacttgcttagaactgccaacagactctttggagaaaagacgtgtgatttcctt

SEQ ID NO: 28733 - DNA, 201 bp, Homo sapiens
ccttccagtaagtagtattcacatattgatgacaaagaaattgaaagtaagttagactacagaagagcagataataaagtataactgtactgacttaaaaygtgcttggaattacacttctgaaattacaattttagattttatgatgacttctgaattacgtcctttgtaaattgttactgatacacccatccctgttat

SEQ ID NO: 28734 - DNA, 201 bp, Homo sapiens
tttctttctttctttctttctttctttctttctttctttcttctctctctcttctttctttctctctctctcccttccttccttcattgcttccttccttscttccttccttccttccttccttgcttccttccttccttccttgcttccttccttccttctttccttgcttccttccttccaagacagagtatcgctctg

SEQ ID NO: 28735 - DNA, 201 bp, Homo sapiens
gtcaattctcctgcacgcagccctgcttctcccccttaattccctgtccctgagtgaccacatcattcaacacgctgtacagagctcctccccagtcccawgtgtggttattcggctgcctcctgctgaggtagcctctcaaattctcttaaatttgcccgccctcttctgaattgcacctacaactgacacaatcgtctt

SEQ ID NO: 28736 - DNA, 201 bp, Homo sapiens
atattttcatggcattttctttttcctacccttccaccatccctgtgttccttcctccatttataaaaacataattctaagttacattctgaaaatattgrtgtcccaatttacataatcacatatggaatataggagggaatacctattttaccagtattggaaatcaatagtttttcttcttacaaatttcatgtttta

SEQ ID NO: 28737 - DNA, 201 bp, Homo sapiens
aattgaattctaggaaaaaaagttgatctgacctcctcagatatgtttactgaataccttctttgcattggacattttgcatagattatttaatccttagkgataataaacccatgaggaatctgagactcagaagttaagtagcttgaacaagttcttgtagctagcaacgaggtagaatgtggatccaatgtctggtaa

SEQ ID NO: 28738 - DNA, 201 bp, Homo sapiens
tggtgggtgggaggtaggggtcggtgggtgaatttttccttcctggggacccttgcgaagacctggagttttagatcccataactgagaggtgctactgayatctagtggatggaagccagaagtgctgcaaaaatcctacaatgcttatatgagacaaggaagtgtcctggccccaaatgtcaatgctgcattgcccacg

SEQ ID NO: 28739 - DNA, 201 bp, Homo sapiens
tagatgacgagttagtgggtgcagtgcaccagcatggcacatgtatacataactaacctgcacaatgtgcacatgtaccctaaaacttaaagtataataawaaaaaaaaaagatctcgcctagtgttatctcacttttcaactacatgcaagtccattaatttcataaaagcacaatgaccaaatgacactgaaacaaata

SEQ ID NO: 28740 - DNA, 201 bp, Homo sapiens
aaagtccaaatgagattggaacaccaggaagacagggggaagagtcattctgttacctggttttctcccctgcctgacttctgacctgagcagaggccaasggggtgcacttgtgtgtgagtgtgtgcacatgtattgtggctgcagggtagatattgatgggaaataccacatactgaccagcacctgagtgttgaaaag

SEQ ID NO: 28741 - DNA, 201 bp, Homo sapiens
gaaataacattctggacacaggatttggcaaatattttatgacaaagatgccaaaagcaattgcaacggaaacaaaaattgagatatgggacataagtaarctgaaaagttctgcagggcaaaagaaactatcaacagtgtaaacagacaacctatagaaatggagaaaatatttgcaaactatgcctctgatagaggtct

SEQ ID NO: 28742 - DNA, 201 bp, Homo sapiens
cagtttgccttcagattattttcttacactgagagatttaaataatttccaaaccactgaaaaataggcagaggcagcaattttggaaaagcatgaattaygggaggattaagtgaaatagtgtacatcgatcagttacgtggtactgagaattcaaaaacgttacatgaaaaggtgatatttcatcaggacttcacagtt

SEQ ID NO: 28743 - DNA, 201 bp, Homo sapiens
caacctctggcaactatatccctaccaggcatttgcttctatggtccagccccagcctgcccacaccctccagcaaggacatatggcttctcgtaagccasctttggccatctgacaagtttcatagccactgcagactgcatgttcctgtggcagccacaccttcaaagagctctgaatatcagccttgggacattcagt

SEQ ID NO: 28744 - DNA, 201 bp, Homo sapiens
ctgcttgtgaccaagcataaaatgttttaccagtgaattccttagatattgtccttgagatgaaggattctggagaggatcaggaaaagagacagattcastagttatcatccagatttaatgacaggcttgcctgagaactccattcattgctgtgccagatatcaatttattgtctatcagctctaaatctacctttgt

SEQ ID NO: 28745 - DNA, 201 bp, Homo sapiens
gaggaatgtaacacaagtgtggacttatatcttctggagtgatttgaggaatatataatctgtttgattcaaaatggtgatgtatgaccttatctacaaaygaggtgtgggataatgctttaggaacagttctctgactattggtgaagatgtcccagataattgccaaatggatatcattttgccaccaatatcaggagt

SEQ ID NO: 28746 - DNA, 201 bp, Homo sapiens
atactagtgttgacttcagatgtagttttctttctttctttcttttctttctctttctttctttctttctttctttctttctttctttctttctttctttytttctttcttctctctctcttctttctttctctctctctcccttccttccttcattgcttccttccttgcttccttccttccttccttccttgcttcctt

SEQ ID NO: 28747 - DNA, 201 bp, Homo sapiens
tttctttctttctttctttcttctctctctcttctttctttctctctctctcccttccttccttcattgcttccttccttgcttccttccttccttccttscttgcttccttccttccttccttgcttccttccttccttctttccttgcttccttccttccaagacagagtatcgctctgtcacccaggctggagtgcag

SEQ ID NO: 28748 - DNA, 201 bp, Homo sapiens
caagtttcatagccactgcagactgcatgttcctgtggcagccacaccttcaaagagctctgaatatcagccttgggacattcagtcatgttagtttgctyaggtgggtataataaaataccataggctgggtgtggtggctcatgcctataatcccagcactttgggaagccaaggtgggcagatcaccggaggtcagga

SEQ ID NO: 28749 - DNA, 201 bp, Homo sapiens
tatcaatttattgtctatcagctctaaatctacctttgtggactttgtgatagtaaacctggatcctgtaacaagaacttgactgactggcccagtgttcrgctttgccaatagagggagctggagagacactgtaagaagatagaagtagaaatgcactttctggattctgatcttcttaggattattcagtgtaggcac

SEQ ID NO: 28750 - DNA, 201 bp, Homo sapiens
tatcttatggttctggaagtcctaagtccaaaatggtacagcatagcaatgttattttctggagtctctagaagaaaatctgttccttgccttttctggcytctcgaggaggttgcattccttcatcagtggcccctatccctctgacctctgcttccgtcctcatgtctctgtctctgactctgcccctcctgcctctct

SEQ ID NO: 28751 - DNA, 201 bp, Homo sapiens
caggttttatcagctcctttgggtaaatggtaagggtcatgattgctggatcatatttttagttttataaaaaacttccacactgtcttccaaagtgactrtacaatattgtattcccaccagcaatgaatgagagttcctgttgctccacgttttcaccagcatttagtgttgtcagtgtgttttcactttcatttagtt

SEQ ID NO: 28752 - DNA, 201 bp, Homo sapiens
gaactgtaaggaaattaattgtttaggagagaaatgagatgtgatgaaggtgagaaagagcggattgaagcagcatgaaggtgatagaaatggcagagctkttgatcatttagtgaagagaactgggaagggatgcacccaggtttctgagagatgtccagttgtacacaggtaacgtctacagctcaagagccaggttag

SEQ ID NO: 28753 - DNA, 201 bp, Homo sapiens
tctcaaaataataagagctatttatgacaaacccacagccaatatcatactgaatgggcaaaagctggatgcattccctttgaaaaccggcacaagataargacgccctctctcaccactcctattcaacatattattggaagttctggccagggcaatcaggcaagagaaagaaataaagcatattcaaataggatgaga

SEQ ID NO: 28754 - DNA, 201 bp, Homo sapiens
aaagaagacatttatgcggccgacaaacatatgaaaaaagctcatcatcgctggtcattagagaaatgcaaatcaaaaccacaatgagataccatctcacrccagttggaatgacgatcattaaaaagtcaggaaacaacaggtgctagagaggatgtggagaaataggaatacttttacactgttggtgggagtgtaaat

SEQ ID NO: 28755 - DNA, 201 bp, Homo sapiens
tattcatgctcataggttggaataattaatgttaaaagtacaatgctacccaaacaatttacagattgaatgcaatccctgtcaaaataccaatgtcattyttcacagaaatagaaaaaaaaaaaaaccctataatttgtatggaaccacgaaaaaccccaaatagccaaagcgcattatcgcttcttgactgaaaactcc

SEQ ID NO: 28756 - DNA, 201 bp, Homo sapiens
gctcataggttggaataattaatgttaaaagtacaatgctacccaaacaatttacagattgaatgcaatccctgtcaaaataccaatgtcattcttcacaraaatagaaaaaaaaaaaaaccctataatttgtatggaaccacgaaaaaccccaaatagccaaagcgcattatcgcttcttgactgaaaactcccggacag

SEQ ID NO: 28757 - DNA, 201 bp, Homo sapiens
aatgcaactgctgtgatcagtgataagggaacacactgatgatttagattgaacagggagagttatattgttttctagggcacagctaaaaagacattccmtcaacccccttgcagccagaaagaccctgagccctcagaacttcactgacacaacccatattttctttccataactggccaacttttccctttgtaccaa

SEQ ID NO: 28758 - DNA, 201 bp, Homo sapiens
gcaaaatcctgaacaacatattcacaaatgaaatcaaactatgtgtaaaatagttggattatacattgtgactaagtaagattgattgcaggtgtacaagrctaattcaacatttgaaaatcaaaggaatccgtcatatcaacaggtaaaaaacagaaaaaatcctcaaaaaattgctagcaactccaattcaacaacaca

SEQ ID NO: 28759 - DNA, 201 bp, Homo sapiens
cctttcctttcctgagctgaagcttctgtgttgaaggagatggagggggcagaggacttgagggaggtttccagtcctgagggcttgctgaacaagctgaygttgatctgatactcacagatcatagcatggaccatgcacacctgattggcgtatctagtggctgttggggaatgcagcataaaattcctctcccaccaa

SEQ ID NO: 28760 - DNA, 201 bp, Homo sapiens
atggagatattcatcgaggttttcagtcacttcttgttgcaattaacagaactgacactgaatatgtgcttagaactgccaacgggctctttggagaaaartcttatgatttcctcacagtaagtcatacttgtttattaggaaaataaagatagcaatgtggtgggaagtaggagaatgaatatgggctatgaattcctg

SEQ ID NO: 28761 - DNA, 201 bp, Homo sapiens
aaggcttgcttttgaggctgactctcactttttctgtgagtcctgtggacagtatttaattgcctctgtctttgtttgtttgcctgaaaaggaaaaactastttaatgccaatttatttggttggctggaaataaaaacttctgattcctgtgtttttataacacaatctaattgtggcattggcacctaaagtattattt

SEQ ID NO: 28762 - DNA, 201 bp, Homo sapiens
cactttaaaaaaatatataagctcacttttttgtttaagtaagagacacccttctgttgaaaaatatcttaggaggaagcgaaatatcttaggaggaagcraaacatccaacagtgaagatactttggttaatacagttgttccccacttccttgtctcagccactcaattcccctttcctcctgtgctctaagagaccca

SEQ ID NO: 28763 - DNA, 201 bp, Homo sapiens
tttgatgcagaccttctctgatggatgacctctgtgaagcaaatggcacttttgccatcagcttatttaaaatattgggggaagaggacaactcaagaaaygtattcttctctcccatgagcatctcctctgccctggccatggtcttcatgggggcaaagggaagcactgcagcccagatgtcccaggtatgtgtgcttg

SEQ ID NO: 28764 - DNA, 201 bp, Homo sapiens
gtatccgtgaacctaaaataaagtttttaaaaaagaatctgagatggaatatttacaacatatgcgatagggaagggttaatacaaaacaagagaagcaamaaaaaaaaaaataaaaacttttgattataaatgggattaaacacttttatgtgtattgagaatttctatctcttctgtgaattgcctatttacatatcct

SEQ ID NO: 28765 - DNA, 201 bp, Homo sapiens
ttctcaggctgtggacctcctcaagccaagcaccttgcccagtaccaggcaagaataggtggcccatacatttttgttaattgcacgcatgcaccttgaartggagtgtgacctgtccaagcacttattgtagaaatgcagtaagagaaaacaaaatgcttttgcatttgtgggaacctttaccaaatgagactaaactca

SEQ ID NO: 28766 - DNA, 201 bp, Homo sapiens
tatccgtgaacctaaaataaagtttttaaaaaagaatctgagatggaatatttacaacatatgcgatagggaagggttaatacaaaacaagagaagcaacmaaaaaaaaaataaaaacttttgattataaatgggattaaacacttttatgtgtattgagaatttctatctcttctgtgaattgcctatttacatatcctc

SEQ ID NO: 28767 - DNA, 201 bp, Homo sapiens
gcctatataacaaacttgcttaggtatccgtgaacctaaaataaagtttttaaaaaagaatctgagatggaatatttacaacatatgcgatagggaagggktaatacaaaacaagagaagcaacaaaaaaaaaaataaaaacttttgattataaatgggattaaacacttttatgtgtattgagaatttctatctcttctg

SEQ ID NO: 28768 - DNA, 201 bp, Homo sapiens
tgaggacgatactgttgccagaaagcaaaagtgttgggatagtgtaaaaagaaagtaaccaatttacagagattcccagtagacaagttgtgagaatttgytcaagaacaaaaaccagtatgtgttaattgaaatacatgttacaacaaagccaagaaagagtcctttagtaaattcagataaaacaagtaaaatgggcca

SEQ ID NO: 28769 - DNA, 201 bp, Homo sapiens
cctgattggcgtatctagtggctgttggggaatgcagcataaaattcctctcccaccaatactagtgttgacttcagatgtagttttctttctttctttcttttctttctctttctttctttctttctttctttctttctttctttctttctttctttctttctttcttctctctctcttctttctttctctctctctccc

SEQ ID NO: 28770 - DNA, 201 bp, Homo sapiens
gcgtatctagtggctgttggggaatgcagcataaaattcctctcccaccaatactagtgttgacttcagatgtagttttctttctttctttcttttctttctctttctttctttctttctttctttctttctttctttctttctttctttctttctttcttctctctctcttctttctttctctctctctcccttccttcc

SEQ ID NO: 28771 - DNA, 201 bp, Homo sapiens
tagtggctgttggggaatgcagcataaaattcctctcccaccaatactagtgttgacttcagatgtagttttctttctttctttcttttctttctctttctttctttctttctttctttctttctttctttctttctttctttctttctttcttctctctctcttctttctttctctctctctcccttccttccttcattg

SEQ ID NO: 28772 - DNA, 201 bp, Homo sapiens
agtggctgttggggaatgcagcataaaattcctctcccaccaatactagtgttgacttcagatgtagttttctttctttctttcttttctttctctttctttctttctttctttctttctttctttctttctttctttctttctttctttcttctctctctcttctttctttctctctctctcccttccttccttcattgc

SEQ ID NO: 28773 - DNA, 201 bp, Homo sapiens
gtgatcccataggcctgaccataggcaactacaaggcaggctgcatgggggaggtggggggaagctgccctgctcacagatttggtgcacagccagggcaytgaagtgtccagtgggagctgcagtcaaggactcaggcccttgagccaggccatgcctttatgcatctctacattccgagctcagacagcttcactcaga

SEQ ID NO: 28774 - DNA, 201 bp, Homo sapiens
ttgcttccttccttgcttccttccttccttccttccttgcttccttccttccttccttgcttccttccttccttctttccttgcttccttccttccaagasagagtatcgctctgtcacccaggctggagtgcagtggtgcaatctcagctcattgcaacctccacctcctgggttcaagcatgtctcctgccccagcctc

SEQ ID NO: 28775 - DNA, 201 bp, Homo sapiens
ttgaaaagaatgtatattctgctgttttggggtgtagtgctctgtaaatgtgaattccatgaagttggtgatagtgttgttcaggtcttctatataattascaatgttgtgtctgcctgttctagcaattgttgagagatgagtgttgacatgtccaactataattgttgacaggtccagctctaggtcaaaatcccatat

SEQ ID NO: 28776 - DNA, 201 bp, Homo sapiens
gaacctgcaggttcaatgagggaaaggtcaaaggggatgcaggcacatgcgaagagggaccaaacatggggagaaaccttactttataacaacccactctyggaggaattaatccattccatgagagctaattgtacctcactgactaccaggagaacaggaccaaggctttcacaagggatccacccacatgacgcagac

SEQ ID NO: 28777 - DNA, 201 bp, Homo sapiens
ggaagaagacgaatccctgaatagaccaataacaggctctgaaattgaggctataattaacagcctaccaaccaaaaaaagtccaggaatgtttatatggwcttcagaggagagaataagttggcattgatcaggagaactgtaaggaaattaattgtttaggagagaaatgagatgtgatgaaggtgagaaagagcggat

SEQ ID NO: 28778 - DNA, 201 bp, Homo sapiens
gacccggtctcacttcgctcctgggcagctgcgcggagaactggggtaggtgtttgactttgggagtggttcccacacgctggattctcgttacctgctcytgagcccaggaaaagggcgggaacctacgaaagggaagcccagtgaagtgctcagcgcacctgttgctccagacctttccctggggctgtccttctttac

SEQ ID NO: 28779 - DNA, 201 bp, Homo sapiens
acaatctaattgtggcattggcacctaaagtattattttgtattaaaattaattgctttttagaaatattgggtaaagtccattttgtttaaagttccaaccctttcaaaagctataaagtccaaatgagattggaacaccaggaagacagggggaagagtcattctgttacctggttttctcccctgcctgacttctgac

SEQ ID NO: 28780 - DNA, 201 bp, Homo sapiens
attgttctgtattccattatactaatatactacaatccatttatccattctgtttttgatggacatttgggttgtttcttttttattattatactttaagytctagggtaaaagtgcacaatatgcaagtttgatacataggtatacatgagccatgttggtttgccgcacccatcaactagtcatttacattaggtattt

SEQ ID NO: 28781 - DNA, 201 bp, Homo sapiens
aatgggcgcggagctggggggtgaaagtcctgcctgggctccactcatcctgcaggagctggaagtaggtacaatgaggcctcccaccctggtgaagtttwtgttgggcgctggaaggggctgtgaggcctgggacctccaggaaaaacaacagcagcagtatttatttgtcggtaccgaaactcgtatgctctcagtatt

SEQ ID NO: 28782 - DNA, 201 bp, Homo sapiens
agggaggggaacatcacacactggggcctgtcatgggggtggggtctaggggagggtagcattaggagaaatacctaatgtagatggcagattgatgggtrcagtaaaccaccatggcatgtgtatacctacgtaacaaacctgcacgttctgcacatgtaccacagaacttaaagtataataattaacagtaataaaaaa

SEQ ID NO: 28783 - DNA, 201 bp, Homo sapiens
aggactcctctaaggctcaaatacatccctgtcctggtagctgctgggtgctgttcccggaatttgcctgctctgggtttatctacctcagaaggtgactytggatcccaggaatctcctgatgaatccatttcatttttgaacatcagcctgatctactactgttgtaatacttgggacacagggagccaacctctactt

SEQ ID NO: 28784 - DNA, 201 bp, Homo sapiens
cagttaaaatgtaaagatgagattgatgcaatagttcagttcattcagaactattgaaactattgattcaatagttcagacaggatgattaaacacacctacacacacacacacacacacacacacaccccaacctaagttcatgcttgcttcaccctgagtccaaagctcttatgctaaggttggatcaaatccaaattt

SEQ ID NO: 28785 - DNA, 201 bp, Homo sapiens
gaaaagtattaaaataagcattaccatcaccctaggaaatataaaaagatagagtgaagataaagtgtataaaacccacagtattactagtggggtgctaraaataagttttataatcactgttgtacagttgtattttaaaacatgtttgaaagtcttaggagaatctagtttaacagatttataagtgttgatttattc

SEQ ID NO: 28786 - DNA, 201 bp, Homo sapiens
ttccatgagaaagcttctctgtgaatgttctcaaaaaagcaaacacagcttcttccaaggataatgtcaatttttgtgtccttctccatttaccaaactgttttttttttctcacctggtaatatttgatctgctggaacaatagcttgttctattcaatactaagatgtactaatgaagattttatatctatcagcataa

SEQ ID NO: 28787 - DNA, 201 bp, Homo sapiens
catgggggtggggtctaggggagggtagcattaggagaaatacctaatgtagatggcagattgatgggtacagtaaaccaccatggcatgtgtatacctaygtaacaaacctgcacgttctgcacatgtaccacagaacttaaagtataataattaacagtaataaaaaattaattaatgaaaaataaaatatataatctg

SEQ ID NO: 28788 - DNA, 201 bp, Homo sapiens
ttctgcacatgtaccacagaacttaaagtataataattaacagtaataaaaaattaattaatgaaaaataaaatatataatctgatacatttggatatatrtatatatacacgtacacacctgtaaaaacaaactagatagtgaacatatccatcacaccaaagtatccccttctcctttatactgcctctcacccacctc

SEQ ID NO: 28789 - DNA, 201 bp, Homo sapiens
gaccaatgaattgatgagactgtacccaggctaagcaaaaagaaaagcctaaattactaatatcagaaatgaaagtggtgaaatgctaaaaatcccatgtmcagtaaaaaatcataaaggaatactcaggacagctctgtgcccacaaatttgataaactacatgacgtggatcaatttcttgaaagacacaatccgccaa

SEQ ID NO: 28790 - DNA, 201 bp, Homo sapiens
ctaagcaaaaagaaaagcctaaattactaatatcagaaatgaaagtggtgaaatgctaaaaatcccatgtacagtaaaaaatcataaaggaatactcaggmcagctctgtgcccacaaatttgataaactacatgacgtggatcaatttcttgaaagacacaatccgccaaaagtcacacaacaggaaatagaacatttga

SEQ ID NO: 28791 - DNA, 201 bp, Homo sapiens
gctggtcattagagaaatgcaaatcaaaaccacaatgagataccatctcacgccagttggaatgacgatcattaaaaagtcaggaaacaacaggtgctagrgaggatgtggagaaataggaatacttttacactgttggtgggagtgtaaattagttcaaccattgtggaagacggtgtggtaatttctcaaggatctgga

SEQ ID NO: 28792 - DNA, 201 bp, Homo sapiens
gtttacaagaaatgctgtgtgatgattcatatacgactgctgtgtaggaatagtgactataggcacctaggttgacaggcacagtggttacaaaaaccaayctgaaggcctaaatattaaaccaggagactttgaaagccaacttgtggatagaactctgtgttacgcaaatcagatgcacgagaacctcaaatagtattt

SEQ ID NO: 28793 - DNA, 201 bp, Homo sapiens
tttctttctttctttcttctctctctcttctttctttctctctctctcccttccttccttcattgcttccttccttgcttccttccttccttccttccttscttccttccttccttccttgcttccttccttccttctttccttgcttccttccttccaagacagagtatcgctctgtcacccaggctggagtgcagtggt

SEQ ID NO: 28794 - DNA, 201 bp, Homo sapiens
ttttctcccttctcaccaatacttggtactaccagtgttgttactttcagcgtgtaccggcttttggttgcatttccctaatgcctaattatgttcagcayttaaaaaaatgtgcttaggccgggcgcggtggctcacgcctgtaatcccagcactttgggaggccgaggcgggcggatcacgaggtaaggagatcgagac

SEQ ID NO: 28795 - DNA, 201 bp, Homo sapiens
ggtgtaagtttaactttttaaggatctgccaaattgcctttgaaagtggttgtatcatttaacattcccagtaaagcctaggagagttctggtttttctcycttctcaccaatacttggtactaccagtgttgttactttcagcgtgtaccggcttttggttgcatttccctaatgcctaattatgttcagcatttaaaaa

SEQ ID NO: 28796 - DNA, 201 bp, Homo sapiens
tgaatatttatatatatacatctttgtatggacatatgtcttcatttcttttgtatatagatacatagaagtagaatggctgggtcatatggaaggtgtargtttaactttttaaggatctgccaaattgcctttgaaagtggttgtatcatttaacattcccagtaaagcctaggagagttctggtttttctcccttctc

SEQ ID NO: 28797 - DNA, 201 bp, Homo sapiens
taatctgtatactaaacccctgaaacatgaaatttgcctatataacaaacttgcttaggtatccgtgaacctaaaataaagtttttaaaaaagaatctgaratggaatatttacaacatatgcgatagggaagggttaatacaaaacaagagaagcaacaaaaaaaaaaataaaaacttttgattataaatgggattaaac

SEQ ID NO: 28798 - DNA, 201 bp, Homo sapiens; identical to SEQ ID NO: 5177

SEQ ID NO: 28799 - DNA, 201 bp, Homo sapiens
ctcaaacaacttatttttttccccatgagcatatcatcagccttggccatggttttcatgggggcaaagggaaacactgcagctcagatgtctcaggtacrtaaagccacttcaagacaacaataagtgctatcaatttatcagttgagctggacttctgcatttcaagtcttgaagaaattcctcctttaacagacaact

SEQ ID NO: 28800 - DNA, 201 bp, Homo sapiens
acaacattttcatcatcccagaaagttccgatggacactgctggtctaggattgtatatgtttcccatgtaatttatggaacaacagactcatatttataktctgttgttctaaaatgtagaggcaaatatagcacttgctgtgttaatcctcactcaacaaatttaataatttacaggagtgacagcttctatagtcacc

SEQ ID NO: 28801 - DNA, 201 bp, Homo sapiens
ctcctatgtaatgttattgtactatgcatattgttttatactttgttagcttttccttaaaaatatgtcctaaattccttccatctcagtatatgtggatytgtattactctttttaacccttgtctggtattcctaagtatggctgtaccatggtataatagacctttcttgcattgacgagtatttaagcttatttact

SEQ ID NO: 28802 - DNA, 201 bp, Homo sapiens
aaacgtgaatcaacggtgaaaaaaggacaatagccaatgtgtacactttttataaaaaccaccctccaaggaccaggcactggccctctctccggtgcccrcagacatccacacaggcccaaagaatcagggattgcacaagccagagcaatcgaacggttctgagtcatctgccggaagccttgccctcaatcaaggcgg

SEQ ID NO: 28803 - DNA, 201 bp, Homo sapiens
cctctttctttcacatttagatagcttttttttttctttgccttattgcactgacttgattagaagtagtgaaaacagacatccttgtctggttcctgatyttaggggaaagcacgaaggctcccatcattaaacgtgatattagctgtaggcttttcataggtgccctttaacaggtgaagaaggtctcttttattcgta

SEQ ID NO: 28804 - DNA, 201 bp, Homo sapiens
gctaaaatcacttagttctagtagctgtgtttctagttccatgtctgctaataaagacaaaatttcctctttctttcacatttagatagcttttttttttytttgccttattgcactgacttgattagaagtagtgaaaacagacatccttgtctggttcctgatcttaggggaaagcacgaaggctcccatcattaaacg

SEQ ID NO: 28805 - DNA, 201 bp, Homo sapiens
tcaatttctgattaattgttgctagtatatggaaatataatacaggtttttttttgtatctcagccttatatcttgcaaacttgctaaaatcacttagttytagtagctgtgtttctagttccatgtctgctaataaagacaaaatttcctctttctttcacatttagatagcttttttttttctttgccttattgcactg

SEQ ID NO: 28806 - DNA, 201 bp, Homo sapiens
gctttaatgagataatcttcataaaagaactgacacagagcgtaacacagttgaaaatgaatcagccaaaacaaagatgtggtgaaaatgactgtttctcrtaattgctttgcagatatttttaattttctatgcatgatgacactataatgtatgcattaaatagtttgactagatgtttcagcaatgaaaatcttttaa

SEQ ID NO: 28807 - DNA, 201 bp, Homo sapiens
tgcacgcatgcaccttgaagtggagtgtgacctgtccaagcacttattgtagaaatgcagtaagagaaaacaaaatgcttttgcatttgtgggaacctttmccaaatgagactaaactcagtgttttgtgtttgcaggactttaaagaatactgtcagaagttctatcaggcagagctggaggagttgtcctttgctgaag

SEQ ID NO: 28808 - DNA, 201 bp, Homo sapiens
cagatttatccttaagtatattctattttgtgctattataagtggtgttgctttttaatttcaatttctgattaattgttgctagtatatggaaatataawacaggtttttttttgtatctcagccttatatcttgcaaacttgctaaaatcacttagttctagtagctgtgtttctagttccatgtctgctaataaagac

SEQ ID NO: 28809 - DNA, 201 bp, Homo sapiens
tatgcatgatgacactataatgtatgcattaaatagtttgactagatgtttcagcaatgaaaatcttttaaaactaattttggctaattacactggttgcwttcgctgacaatgctttcatgacttttctagtttttgaaaagaaaagtaccgaagtaatttcttgttatttaaaaacacaaacaacacatataaaccaag

SEQ ID NO: 28810 - DNA, 201 bp, Homo sapiens
agttaaaatgtaaagatgagattgatgcaatagttcagttcattcagaactattgaaactattgattcaatagttcagacaggatgattaaacacacctacacacacacacacacacacacacacaccccaacctaagttcatgcttgcttcaccctgagtccaaagctcttatgctaaggttggatcaaatccaaattta

SEQ ID NO: 28811 - DNA, 201 bp, Homo sapiens
gatgttctcaactcagccacttgtcacctgtgtgcactcagcaaaagtctggcaaatgctctggtcctgaatttctacatccataaattgagggcaaaatkatagttgcccttcctacttcaagatttttttcttaagcacaaatgttacactgtgtatgccacactgctaaacaccatcgcctaattcatcaggggccca

SEQ ID NO: 28812 - DNA, 201 bp, Homo sapiens
taaataatttccaaaccactgaaaaataggcagaggcagcaattttggaaaagcatgaattatgggaggattaagtgaaatagtgtacatcgatcagttaygtggtactgagaattcaaaaacgttacatgaaaaggtgatatttcatcaggacttcacagttatcttgtgaggtgtagctattactgcttccttgttcta

SEQ ID NO: 28813 - DNA, 201 bp, Homo sapiens
tcctaactacagtcacatttcctctccatgccatactgatacagaagtataaaattccaaagtaaaagcaaaattatggaaagggaaattaaatatttagytgtgagcagtttgagagaaagattgggaaacaattctataatgcatggttcataaattagttgtttcagctcatttaatttccaccaaatgttctgcttt

SEQ ID NO: 28814 - DNA, 201 bp, Homo sapiens
tactttaagttttagggtacatgtgcacaatgtgcaggtttgttacatatgtatacatgtgccatgttggtgtgctgcacccattaactcgtcatttaacwttaggtgtatctcctaatgctatccctcacccctcccccccaccccacaacaggccccgggtgtgatgttccccttcctgtgtccatgtgttctcattgt

SEQ ID NO: 28815 - DNA, 201 bp, Homo sapiens
gaggctctacaacatgtatgtttcattgcttacatttgtcttggtaacaatctagacattttcatataagcattgtcttagtctgttttgtgttgctatayaggaatacctgaggctgggtagtttataaagaaagaaggcttatttggctcatattctgcagaatatacaagaggtatggcactggcatccccaggcttc

SEQ ID NO: 28816 - DNA, 201 bp, Homo sapiens
tgtgcaggtttgttacatatgtatacatgtgccatgttggtgtgctgcacccattaactcgtcatttaacattaggtgtatctcctaatgctatccctcayccctcccccccaccccacaacaggccccgggtgtgatgttccccttcctgtgtccatgtgttctcattgttcaattcccaccatttctataacagtgcct

SEQ ID NO: 28817 - DNA, 201 bp, Homo sapiens
ccttgcccagtaccaggcaagaataggtggcccatacatttttgttaattgcacgcatgcaccttgaagtggagtgtgacctgtccaagcacttattgtasaaatgcagtaagagaaaacaaaatgcttttgcatttgtgggaacctttaccaaatgagactaaactcagtgttttgtgtttgcaggactttaaagaatac

SEQ ID NO: 28818 - DNA, 201 bp, Homo sapiens
gggtgattgtcgggtaattgtcagtcggccgtttggttcacagcaggcttgtgacactgcatcctttgaacaataggcgctagattttccagtagataacytcaaggagcctggtgccagggagtgatgaccctcagcaaacctcttggcggcaggtgcagtgtgagtttacccacatcctgcattcatgataaacagttt

SEQ ID NO: 28819 - DNA, 201 bp, Homo sapiens
atattaaagtcagtggagagcgtttgacaaggatgctcctgtgatgttttgtggatagtggcagctcatgatgtcctgtaagtgtctgggtgtctcagctscctcttctcaggctgtggacctcctcaagccaagcaccttgcccagtaccaggcaagaataggtggcccatacatttttgttaattgcacgcatgcacct

SEQ ID NO: 28820 - DNA, 201 bp, Homo sapiens
cctcaggaggcggaggttgcagtgaaccttcattgaacctgcaggttcaatgagggaaaggtcaaaggggatgcaggcacatgcgaagagggaccaaacayggggagaaaccttactttataacaacccactcttggaggaattaatccattccatgagagctaattgtacctcactgactaccaggagaacaggaccaag

SEQ ID NO: 28821 - DNA, 201 bp, Homo sapiens
gttggacagatcatctcctctgatgtttatgggagaagtcaagccatagagttattttctctagatcagatcatcaatacagtctggcaaattcacatctktgataagtaggataaagtataattctgtcccacaagaaagcaaaatattccaattttgttacattttaaacttttgctaacattatatttttaatagaca

SEQ ID NO: 28822 - DNA, 201 bp, Homo sapiens
actcttggaggaattaatccattccatgagagctaattgtacctcactgactaccaggagaacaggaccaaggctttcacaagggatccacccacatgacrcagacacctctccctaagtggaacactggcacagcagggactgaatcgcagtgtgggttttcgtggagacaaaaatccacacccaaaccacagccattat

SEQ ID NO: 28823 - DNA, 201 bp, Homo sapiens
catcttgaattaatttttgtataaggtgtaaggaagggatccagtttcagctttctacatatgccagttttcccagcaccatttattaaatagggaatccrttctccatttcttgtttttgtccggtttgtcaaagatcagatggttgtagatgtgtggtattatttctgaggcctctgttctgctccattggtctatatc

SEQ ID NO: 28824 - DNA, 201 bp, Homo sapiens
ggagaacaggaccaaggctttcacaagggatccacccacatgacgcagacacctctccctaagtggaacactggcacagcagggactgaatcgcagtgtgkgttttcgtggagacaaaaatccacacccaaaccacagccattatgttttggattgtccagacatccactttataactcagtaatcttttgaatttaggat

SEQ ID NO: 28825 - DNA, 201 bp, Homo sapiens
caggaccaaggctttcacaagggatccacccacatgacgcagacacctctccctaagtggaacactggcacagcagggactgaatcgcagtgtgggttttsgtggagacaaaaatccacacccaaaccacagccattatgttttggattgtccagacatccactttataactcagtaatcttttgaatttaggattgtgct

SEQ ID NO: 28826 - DNA, 201 bp, Homo sapiens
ctccctaagtggaacactggcacagcagggactgaatcgcagtgtgggttttcgtggagacaaaaatccacacccaaaccacagccattatgttttggatkgtccagacatccactttataactcagtaatcttttgaatttaggattgtgctgttagtaagcagtacaaatttgtctggggaatgttaatgaaaaatgac

SEQ ID NO: 28827 - DNA, 201 bp, Homo sapiens
cctttcaaaagctataaagtccaaatgagattggaacaccaggaagacagggggaagagtcattctgttacctggttttctcccctgcctgacttctgacytgagcagaggccaagggggtgcacttgtgtgtgagtgtgtgcacatgtattgtggctgcagggtagatattgatgggaaataccacatactgaccagcac

SEQ ID NO: 28828 - DNA, 201 bp, Homo sapiens
tgagcagaggccaagggggtgcacttgtgtgtgagtgtgtgcacatgtattgtggctgcagggtagatattgatgggaaataccacatactgaccagcacytgagtgttgaaaaggaatggaagtggggacatgagatgaaggaagaggaaagatggaagaaatcagaagtagcagtttgcaactaagagcagttaaaatg

SEQ ID NO: 28829 - DNA, 201 bp, Homo sapiens
gtttctttggtgccaccttctggttggcccagttctatgaagtctgaatattccttcctgcctcccagtctctgaaatgtcctcgagtgaaagatgaggtygtggaggaccccgggacttgcctgcacatactactctgccttccaacatctgcagaccctagtataagctctggagaggtcttatgatgtgaggatagtg

SEQ ID NO: 28830 - DNA, 201 bp, Homo sapiens
acttcaaaaaagtgaagaggttaaagatgaaggagtgaaggtaaatatttgcttaactaatgtagtgagttaagtaatggattcaatcacagatgatttartccactagtttacatattttactcacccaaggttagagtttactatttagacacttaacatttcttggcttactggacaatgtgagtcacctctccagaa

SEQ ID NO: 28831 - DNA, 201 bp, Homo sapiens
tttctttggtgccaccttctggttggcccagttctatgaagtctgaatattccttcctgcctcccagtctctgaaatgtcctcgagtgaaagatgaggttrtggaggaccccgggacttgcctgcacatactactctgccttccaacatctgcagaccctagtataagctctggagaggtcttatgatgtgaggatagtga

SEQ ID NO: 28832 - DNA, 201 bp, Homo sapiens
aaatgatagttgcccttcctacttcaagatttttttcttaagcacaaatgttacactgtgtatgccacactgctaaacaccatcgcctaattcatcagggrcccagaaagacagaactccagcctgtctctcaaccaagcctctgccttatgtgtcaaagggatttttgtaaaagaatgcttatttccccacaaattgcaa

SEQ ID NO: 28833 - DNA, 201 bp, Homo sapiens
gcagtggagaagagcagaaaggggtagaaaggtgaaatgtgttggacagatcatctcctctgatgtttatgggagaagtcaagccatagagttattttctytagatcagatcatcaatacagtctggcaaattcacatctttgataagtaggataaagtataattctgtcccacaagaaagcaaaatattccaattttgtt

SEQ ID NO: 28834 - DNA, 201 bp, Homo sapiens
ttgatcaaatctaccttccatctctggtcatatgatttggattggaggagaatttcttctaagccttggaattatgtttgcatgatgctattactctctgkatttagttagatacctttttgcaatatcagtggcaactatgcctatttattgccttaaaagtcaaagttatacaatcctgagcacaagaaaaaaaagtta

SEQ ID NO: 28835 - DNA, 201 bp, Homo sapiens
tatgtttgcatgatgctattactctctgtatttagttagatacctttttgcaatatcagtggcaactatgcctatttattgccttaaaagtcaaagttatmcaatcctgagcacaagaaaaaaaagttagcagatgtaaagcctaactttaccttcccttttgaatattaaaatggctggtatcaatagttgttagcttgg

SEQ ID NO: 28836 - DNA, 201 bp, Homo sapiens
atgctattactctctgtatttagttagatacctttttgcaatatcagtggcaactatgcctatttattgccttaaaagtcaaagttatacaatcctgagcmcaagaaaaaaaagttagcagatgtaaagcctaactttaccttcccttttgaatattaaaatggctggtatcaatagttgttagcttgggatttgacatcc

SEQ ID NO: 28837 - DNA, 201 bp, Homo sapiens
cttgttgcaattaacagaactgacactgaatatgtgcttagaactgccaacgggctctttggagaaaagtcttatgatttcctcacagtaagtcatacttstttattaggaaaataaagatagcaatgtggtgggaagtaggagaatgaatatgggctatgaattcctgcaggtggtcctgaactcagaactccacgcacg

SEQ ID NO: 28838 - DNA, 201 bp, Homo sapiens
acataatacagtctatgacctatgtcttttcctaagtccttagttctttttttttccacttaccccaagacatgaagtgacaatttctcttttgtaccttstacatctgctgccattacagtatttttaaaaaatctattacttaataattctttgtattaattctcttctcttcaaatctctgatgtagtttgtttgcaa

SEQ ID NO: 28839 - DNA, 201 bp, Homo sapiens
cagacacaatccagctattttaacaaatgcctaaggcatggaaagagtggctgcttccaagaaaacagattgcagaagcagggaggcaaagatgactatcvggcgccctctactggacgatctaggcaatgacattcccaaattgctctctgagcctgatgattcaataaaggggctctcaaaggaggagactgaagagtt

SEQ ID NO: 28840 - DNA, 201 bp, Homo sapiens
cagttcaaaatacattctgattttccttttgatttcttttttgactcatgaattatttgaaagtgtaatttttagtttccagttttgatgatttccaaagrttttatgttattgacttctaattgaatctcaccatagtcagataacatgtttttaatgacttgtattcttttaagatattgagatttattttatgcccct

SEQ ID NO: 28841 - DNA, 201 bp, Homo sapiens
actccatgttgcagccagagggaccttcgtaaatacaaatatgattatgtttctccccagcttaaaatccttttgtgtttccccatagtccacaagggaaygaagaaacaccaccaacagcgtccacatggccttcacgacatggccctgtggacacatcagacgttgtcttgcagtgcctcatccacactatctgtacca

SEQ ID NO: 28842 - DNA, 201 bp, Homo sapiens; identical to SEQ ID NO: 5171

SEQ ID NO: 28843 - DNA, 201 bp, Homo sapiens
aatgcttatttccccacaaattgcaataaactctcatattctttataggtaagatttcagaggtactggatgctgggacagtcgatcccctgacaaagctrgtccttgtgaatgccatttatttcaagggaaagtggaatgagcaatttgacagaaagtacacaaggggaatgctctttaaaaccaacgaggtagggaaag

SEQ ID NO: 28844 - DNA, 201 bp, Homo sapiens
atcatatacttggaaacgtaaggcttgcttttgaggctgactctcactttttctgtgagtcctgtggacagtatttaattgcctctgtctttgtttgtttscctgaaaaggaaaaactagtttaatgccaatttatttggttggctggaaataaaaacttctgattcctgtgtttttataacacaatctaattgtggcatt

SEQ ID NO: 28845 - DNA, 201 bp, Homo sapiens
tttagttattctgagagatgggtttcccttcagggcccagcatttaaattgtccatactcagaaaataaatacaattaatcctcgtgaatatcgacttgcrgacaaattccttacctaggaaaacagaccagttctacttttcattgcattatttcaaaaattagatttgttcattcttggattcatctttgattcttcct

SEQ ID NO: 28846 - DNA, 201 bp, Homo sapiens
aaggtgagacagtttcatttctgttgatttggaattactatacaacgaggcttagattgactgggatgggacttcccagggtgttgccactgtgacctgcrtaccacaggcctgtttgtatgtgtttgctgagtttacaggccagcaatgcaactctgtcatttcttatcagatcatgaagtactgatttctaaaactaat

SEQ ID NO: 28847 - DNA, 201 bp, Homo sapiens
ggcctgcccagcttttaaagccagcttctctggaaagtctttccaggattctgtagaggttttcttattattatttatttatttacttgtttttttctgargatttccatagcactttcaaaattatcctgttatagagcacctgactggcttgaaactacgcatttccatatgtgtgtcttctttagggtgtaagcttct

SEQ ID NO: 28848 - DNA, 201 bp, Homo sapiens
agagaatgtacttgtgtaaatcgaatgtacctgataggataggtacaccggtctcaaaaaaattggcactaacgcagtcagaacacatttcaagttaaaamtaggaattaactacagcaaaacagcaccacagatcacatacacggacactccatttcatcatttagcccaacttctcctagagagtgaacactccattcc

SEQ ID NO: 28849 - DNA, 201 bp, Homo sapiens
agcaggaggtgggggcctctgccaggtaccgggcggggcaggcacggaggtgcccaggttcccgcggaggccacctcttccctggagtgcgtgagagaggsgaagggaggaaggccagagcaggaatcagagcgaggcaaaggcgggcaggaactaggagaatgacggcgggaggcggccgggaaagagagtcgcggggct

SEQ ID NO: 28850 - DNA, 201 bp, Homo sapiens
acatctacggctcgagacaggttagagattttgaagaaataagttaaaagttgaaacatgaacctatggatatagtggaggtcatacaagaagatcatatyataatgaaaagaagagggcttagaatggtaggaaaggaatcaggataccaagcaaaggagtcaggaaagaagggaagggtgctctggaaatcctgggaag

SEQ ID NO: 28851 - DNA, 201 bp, Homo sapiens
tggccaaggcaattagaaaatgattagtatccttatcaggagcaatttcagagaatgtttgggtggacgtctaactacagtggagtcaaacgtgaatcaayggtgaaaaaaggacaatagccaatgtgtacactttttataaaaaccaccctccaaggaccaggcactggccctctctccggtgcccacagacatccacac

SEQ ID NO: 28852 - DNA, 201 bp, Homo sapiens
cggccgggaaagagagtcgcggggctgtgggggtcgccctggcaccagccggggtcccaagccccaccgcgagacccggcgaaggccgagggccgggtccsgagaacaggtgcgcccagacccgccctgaataggaagctgcccctggagagggagcgtctgtttctaggcttgcgatttgctgcgctgtgatttgctgcc

SEQ ID NO: 28853 - DNA, 201 bp, Homo sapiens
tccttacctaggaaaacagaccagttctacttttcattgcattatttcaaaaattagatttgttcattcttggattcatctttgattcttcctgctccctsttcctctcatggtccaagaagtgatgccaaatttatgtcctggaaattcctcaaggccatgtcctcctctccatttctcctgcctctgtttcatttcagc

SEQ ID NO: 28854 - DNA, 201 bp, Homo sapiens
acataaatgctctttgaataaactcacttttggatgttgtatggggatgggggagtggaggaggtagttcgtaggtatttggggctcccaggaggaggacratatcatatacttggaaacgtaaggcttgcttttgaggctgactctcactttttctgtgagtcctgtggacagtatttaattgcctctgtctttgtttgt

SEQ ID NO: 28855 - DNA, 201 bp, Homo sapiens
atatcagtggcaactatgcctatttattgccttaaaagtcaaagttatacaatcctgagcacaagaaaaaaaagttagcagatgtaaagcctaactttacsttcccttttgaatattaaaatggctggtatcaatagttgttagcttgggatttgacatccatcaaatatgatactctcatattgcacaaagatatgaaag

SEQ ID NO: 28856 - DNA, 201 bp, Homo sapiens
tgccttaaaagtcaaagttatacaatcctgagcacaagaaaaaaaagttagcagatgtaaagcctaactttaccttcccttttgaatattaaaatggctgrtatcaatagttgttagcttgggatttgacatccatcaaatatgatactctcatattgcacaaagatatgaaagttaaaaatatatttgatgcaggcttta

SEQ ID NO: 28857 - DNA, 201 bp, Homo sapiens
tctttctttctttctttctttctttcttctctctctcttctttctttctctctctctcccttccttccttcattgcttccttccttgcttccttccttccytccttccttgcttccttccttccttccttgcttccttccttccttctttccttgcttccttccttccaagacagagtatcgctctgtcacccaggctgga

SEQ ID NO: 28858 - DNA, 201 bp, Homo sapiens
acatcttttctaaccagatccttcagcccaagggcctgaatatttatcttaacttcgataaagaatttttagttggaagcttccatgagaaagcttctctrtgaatgttctcaaaaaagcaaacacagcttcttccaaggataatgtcaatttttgtgtccttctccatttaccaaactgttttttttttctcacctggta

SEQ ID NO: 28859 - DNA, 201 bp, Homo sapiens
gtggcaactatgcctatttattgccttaaaagtcaaagttatacaatcctgagcacaagaaaaaaaagttagcagatgtaaagcctaactttaccttcccytttgaatattaaaatggctggtatcaatagttgttagcttgggatttgacatccatcaaatatgatactctcatattgcacaaagatatgaaagttaaaa

SEQ ID NO: 28860 - DNA, 201 bp, Homo sapiens
agttgccctctgatttaaccctgaatagtcccctcattagactcagaagcagagttctgagccatgctctttgtcttttgtcaaacaatctctcccactcrcagtagtatgtattgcatgaagattaatgtaatgaattggttagaattttctaaactgttaaaaaatgtttttaacatttgaaaggagttaggtacaaat

SEQ ID NO: 28861 - DNA, 201 bp, Homo sapiens
aatctctggcacacatttaaagcagtgtgtagagggaaatttatagcactaaatgcccacaagagaaagcaggaaagatctaaaattgacaccctaaaatmacaattaaaagaactagagaagcaagagcaaacacattcaaaagctagcagaaggcaagaaataactaagatcagagcagaactgaaggaaatagagaca

SEQ ID NO: 28862 - DNA, 201 bp, Homo sapiens
ctcctgggttcaagcaattctcgtgcctcagacccctgagtagctgggactacaggcgtgtgccaccacagccggctaatttttgtatttttagtagatayagggtttccccatgttggccaggctggttttgaactcctgacctcaggtcatctgccctccttggcctcccaaaattctgggattacaggtatgagccac

SEQ ID NO: 28863 - DNA, 201 bp, Homo sapiens
atatttgatctgctggaacaatagcttgttctattcaatactaagatgtactaatgaagattttatatctatcagcataaatgtgcagaaacagtaattayacacacctagagtttctgtgagttagatatatcctatttttagtaaattatacccacttttcagtaatcgaactttaatttttccgttaggaaaaaaaga

SEQ ID NO: 28864 - DNA, 201 bp, Homo sapiens
gccgtggtaagctccaggcaatgagcctgagtatctgtggagtccagctgagctcatttctttatgttcatctaccaattggcatttgaggagtttccagytggggttattacaggcagtgctgggtgaacatcattgtgtgtcttttgatgaacatgttcatgcatttctgttgagtgtatacatatatgagtggacaag

SEQ ID NO: 28865 - DNA, 201 bp, Homo sapiens
gaggtagcccagtgacttctgtcatcttccactcgactccacaggcagccccgcgcccaccatccactggtccaagctgcgttccccactgccctggcagyaccggctggaaggtgacacactcatcataccccgggtagcccagcaggactcgggccagtacatctgcaatgccactagccctgctgggcacgctgaggc

SEQ ID NO: 28866 - DNA, 201 bp, Homo sapiens
gtaaggcccttcccgtctctgtatggcaagagcgctggacccaggagtttccaaggcctttgttactttctgctatctgcgactccatgagctagacacamccaggccggagggattggggaagtgggcccaggggcacaggctggcagcaccaagacacgagaaggaccaggtcaatcctctctcaccctcccccatgca

SEQ ID NO: 28867 - DNA, 201 bp, Homo sapiens
gtctggacgccccacattcatggtgtggccctgagtaaggcccttcccgtctctgtatggcaagagcgctggacccaggagtttccaaggcctttgttacyttctgctatctgcgactccatgagctagacacacccaggccggagggattggggaagtgggcccaggggcacaggctggcagcaccaagacacgagaagg

SEQ ID NO: 28868 - DNA, 201 bp, Homo sapiens
ctgggcctcagtttcctccactgtaaagtgagtgggttggacctctaggattctgtgaatgaagcttccaccagccctaccagctgagaccctgagcttcygagagaactcttgggtaccggcacagttgggcttggggacattccttgtcctggggactttgccctgataactgtcccctcgctgctctgacagacccat

SEQ ID NO: 28869 - DNA, 201 bp, Homo sapiens
agctgaatcctttcctgggcctcagtttcctccactgtaaagtgagtgggttggacctctaggattctgtgaatgaagcttccaccagccctaccagctgrgaccctgagcttccgagagaactcttgggtaccggcacagttgggcttggggacattccttgtcctggggactttgccctgataactgtcccctcgctgc

SEQ ID NO: 28870 - DNA, 201 bp, Homo sapiens
attccaggtcaggcaaggttagacctgcagttgctttctgtacccaaacctcatgcaaacaccagcctgcttggggaccccaggggataaaatacgtttgsgggacgagttcaccagcctgcaaatcaggagacctgggtttttctcttggctctgcagctgaatcctttcctgggcctcagtttcctccactgtaaagtg

SEQ ID NO: 28871 - DNA, 201 bp, Homo sapiens
tgctggtcaggcccatgcccaggtcacgtggcacaagcgcgggggcagcctcccggcccggcaccaggtaggaggcaggagctcaggaagcctgaaggacmctgtagctgcagtacaagagcataggcttgaccgggcgcagtggctcacgcctgtaatcccggcactttgggaggccaaggcaggaagatcacgaggtca

SEQ ID NO: 28872 - DNA, 201 bp, Homo sapiens
ccactagaaacagggagctcactactcctgagtctgccccatcgatctttacacaatcttggcttggtagagcacagactgtttcctctagcacatacccrttagacccgagttctgctccttccttctagacctctgcacattgacaataggtaatcaggcctttatttatcctgtacttccaagtccaaaacacattag

SEQ ID NO: 28873 - DNA, 201 bp, Homo sapiens
atggaatcaggaagttgagagcgggctgggcacagcagggccaccaccagccccacagcaccttggtgcaaaatagaaaaggacatctctggctgggcgcrgtggctcatgtctataatcccagcactttgggaggccgaggcaggtggatcacttgaggtcaggagttcaaagccagcccggccaacatggcgaaacgaa

SEQ ID NO: 28874 - DNA, 201 bp, Homo sapiens
ccccatctctattaaaaatataaaaattagccgggcatagtggcaggcgcctgtaatcccagctactcgggaagctgaggcaggagaatcgcttgaacccrggaggcggaggctgcagtgagccaagatcacgccattgcactccagcctgggcaacagagcgagactcagtctcaaaaaaaaaaaaaaaagtacctcaca

SEQ ID NO: 28875 - DNA, 201 bp, Homo sapiens
ttcatctatgaaatggagcagtactgcccacctgcttggtcatggtgtggtttttttattattttattttattttattttattttattttattttattttwtttttttgagagagagtctcgctctgtcacccaggctggagtgcagtggcgcgtgatctcggctcactgcaagctccgccttccgggttcacaccattct

SEQ ID NO: 28876 - DNA, 201 bp, Homo sapiens
tgaacccacagcgaaacagccgcctgacaggagaattcactgtggaacccgtgcccgagggtgcccagctctcttttggcaactttgcccaactcggccaygagtccttctactggcagctgccggagacataccagggagacaaggtgggccccagccaagcaccagggtcagccgtgactcagacatgagttcacctct

SEQ ID NO: 28877 - DNA, 201 bp, Homo sapiens
cggtgttgccacctgctgcctgttactgtccatctgagcactgagcccagcgaccctcatccccgcctcagtaccctcacatgcccccattatttctctcrcagtcctgatctcaacaggaccccattccgcaccttaacaccctcccgtgccccatcccccaccaaggcaccccggtgctcaggctgacgccccctcctt

SEQ ID NO: 28878 - DNA, 201 bp, Homo sapiens
ggctgcctgccctgcttctgtatgggcatcacccagcagtgcgccagctctgcctacacacgccacctggtgagagcctgtgctgcccagccccaggcggwgttgccacctgctgcctgttactgtccatctgagcactgagcccagcgaccctcatccccgcctcagtaccctcacatgcccccattatttctctcgcag

SEQ ID NO: 28879 - DNA, 201 bp, Homo sapiens
accagagacagggagccaattcagaaacacagattactccggcccaaagcacagcatagagatgcctcccagaggtgaacagtgtggactgggagagggcygtgggtgggaggacagactgagcagaagtggggaaggaggggcgccggcctgtgatgttccagggtcacccctgggaggacactggagggaggggttctg

SEQ ID NO: 28880 - DNA, 201 bp, Homo sapiens
acatagggctggcagggcagggatgccctggggtctgaaatgtagacacatgtgatctagagatgatgtcatgcccaggggtggggagtacggggagaccrtgttgctagcatcccccagtgatggccgaggaacccaactggggtccccatagagggacaggatcacccagggcccttcctcaccatggccaccctctgc

SEQ ID NO: 28881 - DNA, 201 bp, Homo sapiens
ccacccctgctgagcccagccctctgcccctttggccccaggccttaggagcccggtcatctccatcgacccgcccagcagcaccgtgcagcagggccagratgccagcttcaagtgcctcatccatgacggggcagcccccatcagcctcgagtggaagacccggaaccaggagctggagggtgagccaggctggtgggc

SEQ ID NO: 28882 - DNA, 201 bp, Homo sapiens
gccagcggcccaggccctgagcaagaagcctccttcacagtcaccgtcccgcccagtgaggggtcttcctaccgtgagtatggcagatgccatgggcaagrggggaagggagggccctgaagctaagcccacccctgctgagcccagccctctgcccctttggccccaggccttaggagcccggtcatctccatcgacccg

SEQ ID NO: 28883 - DNA, 201 bp, Homo sapiens
cgaagcctctgtcatccctggtgagtgactcccagtgacatggaaagctggaggaggcagagaggcctccggggtggtgagatccaagggacccctcttgmtgacagggcagaaggcccacaccggagctggctgcagggccctgcccaggccgactccacctgtcagagtaaccaccgccttcccgtcacactttgcttt

SEQ ID NO: 28884 - DNA, 201 bp, Homo sapiens
ggatctgaactgcgtggtgcccgggcaggcccacgcccaggtcacgtggcacaagcgtgggggcagcctccctgcccggcaccaggtatggcagccccccrggaccaccttgctggaggggctggatgggactgttccagccccctcccaacccaccccatttgcacacagacccacggctcgctgctgcggctgcaccag

SEQ ID NO: 28885 - DNA, 201 bp, Homo sapiens
gggcaggcccacgcccaggtcacgtggcacaagcgtgggggcagcctccctgcccggcaccaggtatggcagccccccgggaccaccttgctggaggggcyggatgggactgttccagccccctcccaacccaccccatttgcacacagacccacggctcgctgctgcggctgcaccaggtgaccccggccgactcaggcg

SEQ ID NO: 28886 - DNA, 201 bp, Homo sapiens; identical to SEQ ID NO: 5210

SEQ ID NO: 28887 - DNA, 201 bp, Homo sapiens; identical to SEQ ID NO: 5212

SEQ ID NO: 28888 - DNA, 201 bp, Homo sapiens
tagtatgccagtcaggtggaggagggtgcaacctcagacttgggactgctgcaggccaggattcattcattcattcattcattcatgcatgcatgcatcakttatttgctgaccaccccatgtgtgccaggcactgatacaggtaaaacaaaacagaccaaattctggctcttgtgggaagaggtgtattctcactgggga

SEQ ID NO: 28889 - DNA, 201 bp, Homo sapiens
actctggccccagcctcagatgccagcccaccgccggtcaagattgagtcctcatcgccttctgtgacagaagggcaaacactcgacctcaactgtgtggkggcagggtcagcccatgcccaggtcacctggtacaggcgagggggtagcctgcctccccacacccaggtatgtgggccctgagcctatggcaggggaccc

SEQ ID NO: 28890 - DNA, 201 bp, Homo sapiens
gtgaatctctttggaggagaatctgtaacccacatgtttttatgaggatgcacgtattttctttttcttttctttttcttttttttttcaagacagtctcrctccgtcacccaggctggagtgcagtggcgccatctgggctcactgcaagctccacctcctgggttcacgccattctcctgcctcagcctcccgagtagc

SEQ ID NO: 28891 - DNA, 201 bp, Homo sapiens
aactcctgagctcaagcaacccacccgcctcggcctcccagagtgctgggattacaggcgtgagccaccacacctggcctttttactttttttttttttttgagacagggtctcagtctcgttctgcctcctgggttcaagtgaatctcatgcctcagcctcccgagtagctgggactacagacatgagccactgtgcctg

SEQ ID NO: 28892 - DNA, 201 bp, Homo sapiens
cattttgggaggctgaggcaggacaatcgcttgagtccaggagtttgagaccagcctgagcaacatagggagaccccatctctatttaaaaaaaaaaaaaaaagtgcctgagcaacatagggcgaccccatctctatttaaaaaaaaaaaggtgaaaaaaaaaataaaaaatttttaaaaatcactgtgctgtacacacct

SEQ ID NO: 28893 - DNA, 201 bp, Homo sapiens
aggcgaacacctgaggtcaggagttcgagaccagcctggccaacatggtgaaaccctgtctctactaaaataacaaaaattagctgggcgtggtggcgggygcctgtaatctcagctacttaggagactgaggctgtagaattgcttgaacctgggaggcggaggttgcagtgagcctagatcatgccacttcactccagc

SEQ ID NO: 28894 - DNA, 201 bp, Homo sapiens
gaaccctctgtgtgcatgtgggcggcctggagttaacccttgggtgccagcctggagagggggggcatgcatctttcttcctaattagtgtgggcctttctgactaccatgtccgtgggtagaggaccctgcccatggctctagctccaggactttgggaggtcttagctcgcctgctccctccatttcatcagaaccgca

SEQ ID NO: 28895 - DNA, 201 bp, Homo sapiens
ctgggggaatgagaagtgcctccacctcccaggctagcccagctgctccaggcctcaatggaacgggaagggaaagaagccatgtcccaaatggcctctgrtcctagtatctgggccccaggggaagggctgagggcatcagggtggcatctcagctcactgacctctcccctgtgccccagccccaggtggagccccacc

SEQ ID NO: 28896 - DNA, 201 bp, Homo sapiens
tgtgacccccaaggcagcgtcagcagccagtgtgatgctgctggtcagtgccagtgcaaggtcagtccgaatccctgtccctgcggggcctgctctgcccygctgcccagaccctgcggggaaatcaggcagcatctggtggaagccgagacctgggcatggggggcagggcatgggggacagggcaggggctgcccgggg

SEQ ID NO: 28897 - DNA, 201 bp, Homo sapiens
agagtgagtaggattggggaggtcattggggtcgggttacccagagtccctagggcggagctaggacagaagcctttactcccctttggctttgcctgtcygagcctgtttcttcatctgtaaaatggggataggagaaggccccaccacctccgagggctgtcgtgagagtgttgagtactcacatcagaaatcagagct

SEQ ID NO: 28898 - DNA, 201 bp, Homo sapiens
gctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctgga

SEQ ID NO: 28899 - DNA, 201 bp, Homo sapiens
gtcattggggtcgggttacccagagtccctagggcggagctaggacagaagcctttactcccctttggctttgcctgtccgagcctgtttcttcatctgtmaaatggggataggagaaggccccaccacctccgagggctgtcgtgagagtgttgagtactcacatcagaaatcagagctcccgctcagtggtgagcagag

SEQ ID NO: 28900 - DNA, 201 bp, Homo sapiens
gctgctccaggcctcaatggaacgggaagggaaagaagccatgtcccaaatggcctctggtcctagtatctgggccccaggggaagggctgagggcatcarggtggcatctcagctcactgacctctcccctgtgccccagccccaggtggagccccacccatccgcatcgagccctcctcctcccgagtggcagaagggc

SEQ ID NO: 28901 - DNA, 201 bp, Homo sapiens
tgtgccaccacgcctggctaatttttgtatgtttagtagaaacagggtttcaccatgttggccaggctggtctcaagctcctgatctcaagtgatgcgcckgcctcagcctcccaaagtgctgggattacaggcgtgagccaccacgcccagcccaattgcaaagcattctatcagttgttttcaactccctgatgtctta

SEQ ID NO: 28902 - DNA, 201 bp, Homo sapiens
agggcggagctaggacagaagcctttactcccctttggctttgcctgtccgagcctgtttcttcatctgtaaaatggggataggagaaggccccaccaccyccgagggctgtcgtgagagtgttgagtactcacatcagaaatcagagctcccgctcagtggtgagcagagtggagggaagaggggtgctgggtggcgggt

SEQ ID NO: 28903 - DNA, 201 bp, Homo sapiens
ggaagagagatcaaagttttctcgaaatcaaatttccactagaactttcccacctttctggattgctgcccctcaagatgggtgtatcaggcaggcccagrctgcagccctcagcctcccccttgccacccacaggtgtgaatgtgacaatgcctgcgcagcccggcacgccacccctctcctccacgcagctgcagatcg

SEQ ID NO: 28904 - DNA, 201 bp, Homo sapiens
tctctctctgcttctctccatctcgtctccctcgctgtcaatgtcccttcttgcctccttctctgtctctactctgcaggctcagggcagcccctgggccrcccgcccgtggctggcatgatggtctcggagcctgatgaggagtcccctctcagtaagtgacccaggccctggccaggtgggagcgctgctctccctctg

SEQ ID NO: 28905 - DNA, 201 bp, Homo sapiens
caggcccatgcccaggtcacgtggtacaagcgcgggggcagcctccccgcccggcaccaggtacaggggccaggatggggaggattccaggtcaggcaagrttagacctgcagttgctttctgtacccaaacctcatgcaaacaccagcctgcttggggaccccaggggataaaatacgtttgcgggacgagttcaccagc

SEQ ID NO: 28906 - DNA, 201 bp, Homo sapiens
tgagggttaagtgagttagtgcatgtaatgtgcttagagcgtgcctggcatgccagaagtgctttataagtgttaactattattatcatttttttttttttgagagggagtctcgctctgtcacccaggctggagtgcagtggcgcgatctcaactcactgcaacttccgccttccaggttcaagcgattctcctgtctca

SEQ ID NO: 28907 - DNA, 201 bp, Homo sapiens
ggcagcctccccgcccggcaccaggtacaggggccaggatggggaggattccaggtcaggcaaggttagacctgcagttgctttctgtacccaaacctcaygcaaacaccagcctgcttggggaccccaggggataaaatacgtttgcgggacgagttcaccagcctgcaaatcaggagacctgggtttttctcttggctc

SEQ ID NO: 28908 - DNA, 201 bp, Homo sapiens
tgttactttctgctatctgcgactccatgagctagacacacccaggccggagggattggggaagtgggcccaggggcacaggctggcagcaccaagacacragaaggaccaggtcaatcctctctcaccctcccccatgcaacctcacagacaacgtccacatcagtcccaatggctccatcatcaccatcgtgggcaccc

SEQ ID NO: 28909 - DNA, 201 bp, Homo sapiens
cccttcttaggttatatcagccactctcaagccaccgcgcccccaggatcaactggagctggtcttcactgccaccaccttcagcccctgccttgatcccyggagcctggcctctctcacccaccccctgtgcccacagctccaggactggcccagcccatctacatcgaggcctcctcttcacacgtgactgaagggcag

SEQ ID NO: 28910 - DNA, 201 bp, Homo sapiens
gtctgcggctcccccaggtctcaccagctgattctggagaatatgtgtgccgtgtggagaatggatcgggccccaaggaggcctccattactgtgtctgtrctccacggcacccattctggccccagctacaccccaggtgaggagccaggtgtggctgggccggggctgagccctaggagctcccaaggaagatgcctgt

SEQ ID NO: 28911 - DNA, 201 bp, Homo sapiens
atctgtgcatggcagtcccagggtgtgggtaccagaggcctgggcatctgaaggctcccagctcaccctccccgctctcaccccaccttggccaggtccayggcccactgctgaggctgaaccaggtgtccccggctgactctggcgagtactcgtgccaagtgaccggaagctcaggcaccctggaggcatctgtcctgg

SEQ ID NO: 28912 - DNA, 201 bp, Homo sapiens
gccatcccacaccactggccctgggccatttccacaccgtgaccctgctgcgcagcctcacccagggctccctgattgtgggtgacctggccccggtcaaygggacctcccaggtgagacccaaccccatactgctacttccagccctcatcccgcccttgcccagcctctgttgccattcctgacttccccacctcccca

SEQ ID NO: 28913 - DNA, 201 bp, Homo sapiens
aatgggcctccagcttgtggttagaggctggggagggaagaagccatattcggctggccatgtggaggcagaagggtgtggccctagtcccagaaaggccrcctgtcggccgtccccactagggcctggtcacagcccagagccttctgccccagggctacaggttacagcccaagagttcaggcctctgagcagccgctc

SEQ ID NO: 28914 - DNA, 201 bp, Homo sapiens
ggggcaggacgccccctaccatgggcagagaggcaggtattgagctctgtggagacagaacttgaagccaggggaggggagaacccaccagccagggctcrggcttccatctcggactgaactccgctgggggcaggcgagtgccccaggagtgggaggaaacctgggtgcagaaatgaggaagctgtgtttgtggggccc

SEQ ID NO: 28915 - DNA, 201 bp, Homo sapiens
atgacgcctcatacatgtgctctttcttttcttttcttttctttttttttttttttttttgagatggagtctcgctcccatcgcgtaggctggattgcagwggcgcgatctcggctcactgcaacctccacctcccggtttcaaacaattctccttcctcagcctcctgagtagctgggattacagctgtgtgccaccacg

SEQ ID NO: 28916 - DNA, 201 bp, Homo sapiens
ttactattcagatggcaatgacgcctcatacatgtgctctttcttttcttttcttttctttttttttttttttttttgagatggagtctcgctcccatcgygtaggctggattgcagaggcgcgatctcggctcactgcaacctccacctcccggtttcaaacaattctccttcctcagcctcctgagtagctgggattac

SEQ ID NO: 28917 - DNA, 201 bp, Homo sapiens
gcctaagtgcttgttaagtgggaattactattcagatggcaatgacgcctcatacatgtgctctttcttttcttttcttttctttttttttttttttttttgagatggagtctcgctcccatcgcgtaggctggattgcagaggcgcgatctcggctcactgcaacctccacctcccggtttcaaacaattctccttcctc

SEQ ID NO: 28918 - DNA, 201 bp, Homo sapiens
ggatgggcaagctgagtaactttgtgcaagtcatttcacatccctgagcctctgtttcctcatgtgaaggatgaaggtatcacctacctctcaaggtccttaggggagttaaatgaggtggtgtcgaatggaaagcagaacagtgcgtgaaacactccataaatagaagcagcaattatttcaatcaagtcgctgtatttc

SEQ ID NO: 28919 - DNA, 201 bp, Homo sapiens
aatcccagcactttgggaggctgaggtgggtggatcacttgaggtcaggagttcaagaccagcctggccaacatggtgaaaccccatctctactaaaaatrcaaaaattagccaggcgtggtggcgggcgcctataatcccagctactcaggaggctgaggcaggagaatcacttgaacctgggaagcagggttgcagtga

SEQ ID NO: 28920 - DNA, 201 bp, Homo sapiens
acatggtgaaaccccatttctactaaaaatacaaaaattagccaggcgtggtggcgtacgcctgtaatcccagctactcaggaggctgaggcaggaaaatygcttgaacccgggaggtggaggttacagtaggccaagaccgtgcccctgcactccagcctgggcaacagagcaagactcagtctcagaaaaaaaaaacaa

SEQ ID NO: 28921 - DNA, 201 bp, Homo sapiens
aatctagccaggcgtggtggcttgcacctgtagtcccagctacttgagaggctgaggcaggaggatctgttgagcctaggaggttgaggctgcagtgagcyatgatcacaccattgcactccagcctggacaacagagtgagaccccatccctaaaaacaaaacaaaacttagttacttcccaaagttgtcccccagtata

SEQ ID NO: 28922 - DNA, 201 bp, Homo sapiens
ggagggaggattgcttgtggccaggagttcaagaccagcctgggtaacacagagagaccccatctctacaaataattaaaaacaaaaaatctagccaggcrtggtggcttgcacctgtagtcccagctacttgagaggctgaggcaggaggatctgttgagcctaggaggttgaggctgcagtgagctatgatcacaccat

SEQ ID NO: 28923 - DNA, 201 bp, Homo sapiens
gccgctgtggcggtcgcagtgacaccaggtgagagtgtaagccaggccgaggcccagccaggttcctagagaagttaaggttggagaggaggccgggtgcrggggctcacgcctgtaaccccagcactttgggaggccaagacgggaggattgcttgaggcaaagagttcgagaccagcttgggcaacgtagcaagaccct

SEQ ID NO: 28924 - DNA, 201 bp, Homo sapiens
aatgacttgtataaaacttagttacctggccaggcatggtggcttatgcctgtaatccaagtactttgggaggctggggagggaggattgcttgtggccakgagttcaagaccagcctgggtaacacagagagaccccatctctacaaataattaaaaacaaaaaatctagccaggcgtggtggcttgcacctgtagtccc

SEQ ID NO: 28925 - DNA, 201 bp, Homo sapiens
gaatggatcgggccccaaggaggcctccattactgtgtctgtgctccacggcacccattctggccccagctacaccccaggtgaggagccaggtgtggctrggccggggctgagccctaggagctcccaaggaagatgcctgtggcttcttcagtgggaccaggacaggggggcattccaggcaggctttgacccttcagc

SEQ ID NO: 28926 - DNA, 201 bp, Homo sapiens
cgggcatcctgacagttaaataggagggggaggctggagaggcagcgaccacatcaggtggtatcctgtatgtcctgtcccgcaagaagcctgatgcttgwtagtgcaagattaaggataatcttcaggctcttctctgtggtcctgggtggtgtgtctgggcgcgtgtccatgttcctgctgtgagcttgtccagcttct

SEQ ID NO: 28927 - DNA, 201 bp, Homo sapiens
ggtagcctgcctccccacacccaggtatgtgggccctgagcctatggcaggggacccagggtgcaggggctgtggcggaggcggggcctgtacgctgggcsggggaggcggcacactgccccacacgttccaccagcagaagccaggcctcatctccctccctcccagtttctagcatgggatggctcggagcagagccag

SEQ ID NO: 28928 - DNA, 201 bp, Homo sapiens
acgagttggcccgtggcatgctggagccagtgcagcggccggacgtggtcctcgtgggtgccgggtaccgcctcctctcccgaggccacacacccacccamcctggtgctctgaaccagcgccaggtccagttctctgaggtgggtggcgcctgagcccttagggctgggagcaaagggggatttaggctgggtaggcact

SEQ ID NO: 28929 - DNA, 201 bp, Homo sapiens
ctaatattggccctgcacctgcctctcccttttatgccctatctgtccccctggccagccgttgtccagctgcctctggggcagctgacccatctcacccrcggcaggcccggtcagagcgcacagacatcgcgacactgctcatcccagccatcacgactgctgacgccggcttctacctctgcgtggccaccagccctg

SEQ ID NO: 28930 - DNA, 201 bp, Homo sapiens
tctcgcccatctcggtttccctgtgcctagctcagtgcctggcacacagtaagtctcaggtaggcagagtgagggaggagctggaagactataggcacctyataggcacgaggtgtcaagtgtgcccacagctgcccgtgctgatccaccctgttgtgccaggtggactcctatggcggctccctgcgttacaacgtgcgc

SEQ ID NO: 28931 - DNA, 201 bp, Homo sapiens
gacagaagcctttactcccctttggctttgcctgtccgagcctgtttcttcatctgtaaaatggggataggagaaggccccaccacctccgagggctgtcrtgagagtgttgagtactcacatcagaaatcagagctcccgctcagtggtgagcagagtggagggaagaggggtgctgggtggcgggtttggggctccagc

SEQ ID NO: 28932 - DNA, 201 bp, Homo sapiens
tttcttcatctgtaaaatggggataggagaaggccccaccacctccgagggctgtcgtgagagtgttgagtactcacatcagaaatcagagctcccgctcwgtggtgagcagagtggagggaagaggggtgctgggtggcgggtttggggctccagccatggctttcttccacctcaggagacagccaggtgccagggccc

SEQ ID NO: 28933 - DNA, 201 bp, Homo sapiens
ctgggtggcgggtttggggctccagccatggctttcttccacctcaggagacagccaggtgccagggcccataggctgcaactgtgacccccaaggcagcrtcagcagccagtgtgatgctgctggtcagtgccagtgcaaggtcagtccgaatccctgtccctgcggggcctgctctgccccgctgcccagaccctgcgg

SEQ ID NO: 28934 - DNA, 201 bp, Homo sapiens
gggctcagtgcctggtgagtagctctcagggagggcagggctggggacccagggtgggaggccccccactcttgcaacggcaggatcaggaggccaagccrcagactgcacctgccttgagaccaggagccccatctcatctcacctcctagccggctattgaccctttgccctctgtccccagcacttggggtcaccccc

SEQ ID NO: 28935 - DNA, 201 bp, Homo sapiens
gttccgcacctcaattaaagccaagcgtggtggtgcgcgcctgtagtcctagctactcaggaggctgaggcaggaggatcaccggagcccaggagtttgargctgcagtgagctaggatcatgccactgcactccagcctgggcgacagagcaaaaccctgcctctaaaacaagacaaacaaacaaaaacccttaattatt

SEQ ID NO: 28936 - DNA, 201 bp, Homo sapiens
accgccccggccagagacaaccatcatgcgacagccaccagtcacccacgctcctcagcccctgcttcccggttccgtcaggcccctgccctgtgggcccmaggaggccgcatgccgcaatgggcactgcatccccagagactacctctgcgacggacaggaggactgcgaggacggcagcgatgagctagactgtggtgc

SEQ ID NO: 28937 - DNA, 201 bp, Homo sapiens
aggtccttctatggtcaagtcccaagttccttttggctctttctgggagcctctttcctgtctggttccatctgctctcccagatgtgaaatacagagctsctggaaccttttgatcttcagctttttacaaatgaagtctctgctcttgctgacttattccttgctatgggcccttatctgaccctggatcctcagaccc

SEQ ID NO: 28938 - DNA, 201 bp, Homo sapiens
ctgtgggagcccaggggagcggtctctaccccagccagggcagatcaggaagatcaggagacaatggctgagccaagtcctgaggaatgagtaggaactgrccgaggaaggctggcagagcctttcccagtcacacgcaggtaatccctgtgccaggccaactccctctgggagccaccccttcttgtccagccttcctct

SEQ ID NO: 28939 - DNA, 201 bp, Homo sapiens
atgtactttgggaggccaaagtgagaggattgcttgagcccaggagtttgagaccagcctgggcaacatagcaagaccccatctctatcaaaagtcaaaamattagctgggcatggtggcatgcacctgtaatcccagctactcaggaggctgcagtgggaggatagcttgagccttagagtttgaggctgcagtgagctg

SEQ ID NO: 28940 - DNA, 201 bp, Homo sapiens
ttttcaccatgttggccagcctggtcttgaactcctgacctcaagtgatctgccggcctcggcctcccaaagtgctgggattacaggcgtgagccactgcrcccagcccgggggctggttcttgaaatagaggtggcctcaccttctgccccagtgctcaggcaccagctgcagggtgggagatgggaggtgttcacccag

SEQ ID NO: 28941 - DNA, 201 bp, Homo sapiens
gctgcggctgcaccatgtgtccccggccgactcgggtgaatacgtgtgccgggtgatgggcagctctggccccctggaggcctcagtcctggtcaccatcraagcctctggctcaagtgctgtccacgtccccggtgagggtccctgcagtgggacgggaaggccgggggagggaggaagggacagagaccagggggcaga

SEQ ID NO: 28942 - DNA, 201 bp, Homo sapiens
cgcagcccggcacgccacccctctcctccacgcagctgcagatcgacccatccctgcacgagttccagctagtcgacctgtcccgccgcttcctcgtccaygactccttctgggctctgcctgaacagttcctgggcaacaaggtgaggggcctgggctgccaccctgggtggggaaagaattcctgtgggctctgctcct

SEQ ID NO: 28943 - DNA, 201 bp, Homo sapiens
caggactctgtctgcagggggcggtgggcccagagtccaagtgagcccagagaggacccaggtccacgcaggccgcaccgtcaggctgtactgcagggctkcaggcgtgcctagcgccaccatcacctggaggaaggaagggggcagcctcccaccacaggtgaggagatgggcccacccaggaggaggaggcccacaggc

SEQ ID NO: 28944 - DNA, 201 bp, Homo sapiens
aaggaagggggcagcctcccaccacaggtgaggagatgggcccacccaggaggaggaggcccacaggctctgcagagagtcccagccaccttccctccccsttcacgccccaccccacctcctcctctgtggctcccttcacctccaagatggtggtctcctgcccctgcatcccagcagggagcccctgccgtcctcttg

SEQ ID NO: 28945 - DNA, 201 bp, Homo sapiens
actctgagcaggcttggtgggtgctgaccccacgtctactcgtcagggggccccggcggccagctccctgcgaaggcacaaatccacggcggcatcctgcrcctgccagctgtcgagcccacggatcaggcccagtacttgtgccgagcccacagcagcgctgggcagcaggtggccagggctgtgctccacgtgcatggt

SEQ ID NO: 28946 - DNA, 201 bp, Homo sapiens; identical to SEQ ID NO: 5197

SEQ ID NO: 28947 - DNA, 201 bp, Homo sapiens
aaacccctgcttctttctgaaactcctgggttcctacctgccccaattcactggctgtgcggtccagggcgcgtccctgctcttctctgcccagtttcccygtaacatgggcgagtcaggctcttcttttcttccagtgcatgaggccattgaattcaatatggggccctcagcccagccctggggttctgcttcccttca

SEQ ID NO: 28948 - DNA, 201 bp, Homo sapiens
cagagccagcactcctattcacgctgggtcttgtcacgcccagggtctctggcatcagcatggacgtggctgtgcccgaggaaaccggccaggaccccgcrctggaagtggaacagtgctcctgcccacccgggtaccgtgggccgtcctgccaggtgagtcctgggccccacgccagcccagccagccccctccatggtg

SEQ ID NO: 28949 - DNA, 201 bp, Homo sapiens
accaggaagtttgtggaaaggggcctgacccagttccactgcagggagggccgcagaggttccatccaagtcgacggtgaggagctggtcagcggccggtscccaggtcccaacgtggcagtcaacgccaagggcagcgtctacatcggtaagtctggggctccttctcagggcaggggcaggaacggcactcccttaggg

SEQ ID NO: 28950 - DNA, 201 bp, Homo sapiens
aaaggacagaaggagggagaccagttcagaagttattagaacaacccagacgagagctggtggtggctcagaccaggtgatggcagagcaggtgtgagaarggtcagagtctggagagctttcaaaggacttgtcactggcttggttatgggttataggctatgggttaagcggggagtaaaagatgactcagtgaggcct

SEQ ID NO: 28951 - DNA, 201 bp, Homo sapiens
cctcccaaagtgctgggattacaggcgtgagccaccgcacctggccagggttgctatttttatataaaggagtcagggaagaacttaaagagacccaccargaagcaaaggaacgagcttgcaatgcagatctcagaagaaaagtcttctggtagaggacacagctactgcaaaggccagaacaaagctggagtgtggagg

SEQ ID NO: 28952 - DNA, 201 bp, Homo sapiens
tgaacgcccggggcatggtgtttggcattcctgacggtgtccttgagctcgtcccacaacgaggtactgccggagggcaggtgtcaccgggtgtgggggcrgagccgggctgcccaccacagccggctgcagcccccgcccatgccgcccagcaggcccctgccctgacggccacttctacctggagcacagcgccgcctg

SEQ ID NO: 28953 - DNA, 201 bp, Homo sapiens
aggaagatcacgaggtcaggagtttgagaccagcctgaccaacataatgaaaccccatctctactgaaaatccacaaattagccgggcgtggtggtgcgcrcctgtaatcccagctactcgggaggctgaggcaggagaatcgcctgaacccaggaggcggaggttgcagtgagccgagatcgtgccgttgcactccagcc

SEQ ID NO: 28954 - DNA, 201 bp, Homo sapiens
tacaggcgtgagccactgcacccagcccgggggctggttcttgaaatagaggtggcctcaccttctgccccagtgctcaggcaccagctgcagggtgggaratgggaggtgttcacccagacctgcccttggtctcgaagaacgaagcggggtggggtcaggctgaagggcctgtgcccttcccaggccctagtagaaagg

SEQ ID NO: 28955 - DNA, 201 bp, Homo sapiens; identical to SEQ ID NO: 5208

SEQ ID NO: 28956 - DNA, 201 bp, Homo sapiens
ggctccatctaagcggtgcagtacagcacagccacttacagactgtgtgacccttttgtgcctcactttccctgtctgtaaaacggagagtcttaacaatrtctcccatacaggctggtctggggccaggctccctagaaagaagcctgagacggggattggggtgcatgtgattcacaaggagagggacgcaggaggggg

SEQ ID NO: 28957 - DNA, 201 bp, Homo sapiens
tacaatgagtgtgtggccctggagtatcgctgtgaccggcggcccgactgcagggacatgtctgatgagctcaattgtggtgaggggatgtccggggccaygagtggtttgggtgccaggggagggccagggtcctacacctgggtcttggagcccatcaaggactatgagggtttggtgcaggcagaggatgggggcata

SEQ ID NO: 28958 - DNA, 201 bp, Homo sapiens
gaatggtgtgaaccccggagacggagtttgcagtgagccgagatcgcaccactgcactcgagcctgggtgacagagcgagaatctgtctcaaaaaaaaaaatggacgtttgctgaatgaatttctctggagaatagagaccttacctctctcatcacccaacctgctaacactcccttacactcccctttctcagttcacc

SEQ ID NO: 28959 - DNA, 201 bp, Homo sapiens
aggggaggggcaggactctgagcaggcttggtgggtgctgaccccacgtctactcgtcagggggccccggcggccagctccctgcgaaggcacaaatccayggcggcatcctgcgcctgccagctgtcgagcccacggatcaggcccagtacttgtgccgagcccacagcagcgctgggcagcaggtggccagggctgtgc

SEQ ID NO: 28960 - DNA, 201 bp, Homo sapiens
catccatccgccacagctcacagtgcagcccgggcaactggcggagttccgctgcagcgccacagggagccccacgcccaccctcgagtggacaggtgagrccgtgatgggaatgacattcaaggcctgactctcctgggtgtgggaggggaggggcaggactctgagcaggcttggtgggtgctgaccccacgtctactc

SEQ ID NO: 28961 - DNA, 201 bp, Homo sapiens
atcaaggtacccatggccctaggctcctcagccccaagagccatcccagtgggaggggaggcaggggcctgtccctgccctagtgggatgctgtccttgtrcatggggctggatgtgagaaagagtgtatctgcaccaacaagctcttgtctcctccccaccaggctccgagctccacttccccagcgtccagccctcgga

SEQ ID NO: 28962 - DNA, 201 bp, Homo sapiens
tttgggaggccaaggcaggaagatcacgaggtcaggagtttgagaccagcctgaccaacataatgaaaccccatctctactgaaaatccacaaattagcckggcgtggtggtgcgcgcctgtaatcccagctactcgggaggctgaggcaggagaatcgcctgaacccaggaggcggaggttgcagtgagccgagatcgtg

SEQ ID NO: 28963 - DNA, 201 bp, Homo sapiens
atactctgccagtcagaggtgaacctgtctttgctactccagaacagggtctggtggaaaggtggtgatgatggtggtggcgatggtgtgatggtgttgtsgggggcaggggctcaggggtgggctctgggacagcctgcccaaatgtgttcttgagcagcacgggcatccggtggcacccacgctctggggttggggttg

SEQ ID NO: 28964 - DNA, 201 bp, Homo sapiens; identical to SEQ ID NO: 5222

SEQ ID NO: 28965 - DNA, 201 bp, Homo sapiens
aaataaataaataaaataaaaattatctatatataatattcattcatagggttgttgtaaggattgagttaaatgcagtggtgtctgtagctggatgggaygctccccgcacagccacatcataggtgttaggtaaatgtcagccgttctcctcatcatttggtggagggtagcagagggtcccctactcttgtcccctgc

SEQ ID NO: 28966 - DNA, 201 bp, Homo sapiens
ctaatataataggcgaggcagtggtatagtgggtaagagtatagacttggagccagcctgcttgggttcaaatcctagctctcccacttactagctgtggractttgggtgagtcgcttaacctctctgtgcctcatataaaatggagatgagtaacatctttccctaaagatttggataaaattttatgtgagagtaaaa

SEQ ID NO: 28967 - DNA, 201 bp, Homo sapiens
cagcaaaaggatgtggggagagaagatccaggggatgggtcacggggagggacgacaagacagggacaggaacgggaacagccccagggctgggactgcargaagtggtgacatccctcctctgggacccctctacccaactgggcccctagcccttcttacaaaccccctatccactctctcctgccccggcctgcccca

SEQ ID NO: 28968 - DNA, 201 bp, Homo sapiens
attcccccagggcagcctggaatgtacagggagagagctaggccatagagcatcaagaagaaaaaagaaaccttgtcctcatctgcagggagtgcctgctytgctgggagagacctgcagcatagtctgagggcagagacataacccagtcaacaaacagacctaatagagagtaaaacaaggacaacagatgcagggcag

SEQ ID NO: 28969 - DNA, 201 bp, Homo sapiens
gataactgtcccctcgctgctctgacagacccatggctcccagctgcggctccacctcgtctcccctgccgactcaggcgagtatgtgtgtcgtgcagccrgcggcccaggccctgagcaagaagcctccttcacagtcaccgtcccgcccagtgaggggtcttcctaccgtgagtatggcagatgccatgggcaaggggg

SEQ ID NO: 28970 - DNA, 201 bp, Homo sapiens
tcgggaggctgaggcaggagaatcgcttgaacccgggaggtggacgttgcagtgagctgagatcgtgccactgcactccagcctgggaacagagcgagacyccgtctcaaaaaaagtattgagtccctcccactcttttcgtggcctgccctccccacccagaagcgaggagctgtggaaacagagcccagcgctccacag

SEQ ID NO: 28971 - DNA, 201 bp, Homo sapiens
ccctgcatgtgtaggtgtctttgccatggccaagtccctggattctcttatttaaactgcaggcagaataggctttgctgtccttccttaaaatgtctgartatggccgggcgcggtggctcacgcctgtaatcctagcaccttgggaggccgaggcaggcagattgcctgagctcaggagtttgagaccagcctgggcaa

SEQ ID NO: 28972 - DNA, 201 bp, Homo sapiens
ctaatttttgtgtttttagtagagaaggggattcgccatgttggccaggctggtctcgaactcctgacctcatgtgatccacccacctcagcctcccaaartgctgggattaccggcgtgagccactgcactcgtcctgagcctcagtttctttatctgtaaagtggagagaacaatgccaaccatgtaggctgagttgga

SEQ ID NO: 28973 - DNA, 201 bp, Homo sapiens
caaggtggagcttatcctgggctcggcagcagcctgaggtcacgtggagttgacaccacgcctgtccccattcagcccagatactgagctctgcctccgcrctgctgggcccagggatgagcctgtcagtgtggctgcatgtgccaaagctaattctccaacacagtggaatgtgttccctgcagcctggagacgggcagg

SEQ ID NO: 28974 - DNA, 201 bp, Homo sapiens
cgtgaccctgctgcgcagcctcacccagggctccctgattgtgggtgacctggccccggtcaatgggacctcccaggtgagacccaaccccatactgctamttccagccctcatcccgcccttgcccagcctctgttgccattcctgacttccccacctccccagggcaagttccagggcctggatctgaacgaggaactc

SEQ ID NO: 28975 - DNA, 201 bp, Homo sapiens
gcagcggcccgatgggcagccagccacacgggagcacctgctgatggcactggcaggcatcgacaccctcctgatccgagcatcctacgcccagcagcccrctgagagcaggtgtctggagccagggcaggaggaccagcatgggcttggggaggggctccatctaagcggtgcagtacagcacagccacttacagactgt

SEQ ID NO: 28976 - DNA, 201 bp, Homo sapiens
gggcccgaattcaggcctccgcaagctcctgtctaaccctggtcccaggtgacctcctatggaggagagctgcgcttcacagtgacccagaggtcccagcygggctccacacccctgcacgggcagccgttggtggtgctgcaaggtaacaacatcatcctagagcaccatgtggcccaggagcccagccccggccagccc

SEQ ID NO: 28977 - DNA, 201 bp, Homo sapiens
actgtgtgtggggtctgttttagagatgggggaggccactgccgcatgtcccatgccccacgtgtgctgtggatgtgtctagtgtgtgctgcttgccctckttgtgcctgccagaaaccgagctgcctgacacagggccctggagcccactccagccacacagcacctacagcttcccgcacctgcctcctgccgcctctg

SEQ ID NO: 28978 - DNA, 201 bp, Homo sapiens
ggaccaagcgccagtcccaggccacggcccccatcccagccctttctcctcctcccagttgcatggggcctctgaggagcctggtcacttcagcctgaccmacgccgcaagcacccacaccaccaacgagggcatcttctcccccacgcccggggaactgggattctcctccttccacagactcttatctggaccctactt

SEQ ID NO: 28979 - DNA, 201 bp, Homo sapiens
gctgtggcctgcatgtgtgtggtgtggtggttgcatgcgtgtggcatgtcaactgtgtgtggggtctgttttagagatgggggaggccactgccgcatgtsccatgccccacgtgtgctgtggatgtgtctagtgtgtgctgcttgccctcgttgtgcctgccagaaaccgagctgcctgacacagggccctggagcccac

SEQ ID NO: 28980 - DNA, 201 bp, Homo sapiens
ctggagtatcgctgtgaccggcggcccgactgcagggacatgtctgatgagctcaattgtggtgaggggatgtccggggccacgagtggtttgggtgccargggagggccagggtcctacacctgggtcttggagcccatcaaggactatgagggtttggtgcaggcagaggatgggggcataggaagggtgatgacagag

SEQ ID NO: 28981 - DNA, 201 bp, Homo sapiens
aactgtcaagatcattaaaaacaaggaaatcctgagaaactgccacagccaaggggagcctaaagaggcatgatgactattaatgaatgtaacatgaggcygggtgcggaggctcacgcctgtaatcccagcactttgggaggccaaggcgggtggatcacttgaggtcaggagtttgagaccagcctgtccaacatggag

SEQ ID NO: 28982 - DNA, 201 bp, Homo sapiens
gagtgcagtggcatgatctcggttcactgcaacctccatctcccgagttcaagcctttctcgtgcctcagcctcccgagtagctggcactacaggcacgcrccaccacgcttggctaatttttgtgtttttagtagagaaggggattcgccatgttggccaggctggtctcgaactcctgacctcatgtgatccacccacc

SEQ ID NO: 28983 - DNA, 201 bp, Homo sapiens
cagggttgcaggttataggaacaggggtctcctgagggctccctctgactcacccccattctggccagacccacggctccctgctgagactctaccaagcrtcccccgccgactcgggcgagtacgtgtgccgagtgttgggcagctccgtgcctctagaggcctctgtcctggtcaccattgagcctgcgggctcagtgc

SEQ ID NO: 28984 - DNA, 201 bp, Homo sapiens
tggggtgtcatgagggtgagccctcaagcaaccagatgggacagctaaaaaccaaggaaagggccaggcatggtggcacgtgcctgtaatcccagcacttkgagaggctgaggcaggaagatcacttgagcccaagagtttgagaccagcctgggaggccaaagtgggtggatcacctgaggtcaggagttcgagaccacc

SEQ ID NO: 28985 - DNA, 201 bp, Homo sapiens
ccgtgatgggaatgacattcaaggcctgactctcctgggtgtgggaggggaggggcaggactctgagcaggcttggtgggtgctgaccccacgtctactcrtcagggggccccggcggccagctccctgcgaaggcacaaatccacggcggcatcctgcgcctgccagctgtcgagcccacggatcaggcccagtacttgt

SEQ ID NO: 28986 - DNA, 201 bp, Homo sapiens
cggactgtcaaaggggtcgcctccaacaggatgcgcctacatatctgtgcatggcagtcccagggtgtgggtaccagaggcctgggcatctgaaggctccyagctcaccctccccgctctcaccccaccttggccaggtccacggcccactgctgaggctgaaccaggtgtccccggctgactctggcgagtactcgtgcc

SEQ ID NO: 28987 - DNA, 201 bp, Homo sapiens
gacctcggctcactgcaatctccacctctggggttcaagcgattctcctgcctcagcctcctgagtagctgggattacaggtgtgctccaccacgcccagytaatttttgtatttttagtagagacggggtttcaccatgttggtcaggctggtctcgaactcctgacctcatgatccgcccagcccggcctcccaaagtg

SEQ ID NO: 28988 - DNA, 201 bp, Homo sapiens
ccttgccttcaaggtgcttccattccaacggaggtacagacaataaccttgtgagcccagaaccagactggggttgaggtcactgtgaacagcaaggagtygggacaaagagagtttctttctagtcatccttatttaggcataaatacacacaacaaaatatacccattttcagggtacagtcagtaatgagatatgtat

SEQ ID NO: 28989 - DNA, 201 bp, Homo sapiens
ggtcactgtcaactcaggtgatactaggctgaggaaatgcattgcaaagtggcatgcagtgtggctgagaggctttgcaagagtgactcccagtgatctcrtatctgcttcattgcatacccctggtcacagaggtgatatagcacagtggtagctgcttaggtattggagcccgaccaccagggttcaaatctcagccct

SEQ ID NO: 28990 - DNA, 201 bp, Homo sapiens
ggagatccacttctgcaccaaatctcactgaaaagctgctccgggccatgtcctgtgcctgacactgaagattccagatggaatgagacagttgcctgctmtcaggcagctcgcaggctgtgggagccccagcaggatactgtgtcaacactccggagggccttaacaggctttctggaggggtgacaaaaggctagacgt

SEQ ID NO: 28991 - DNA, 201 bp, Homo sapiens
ctctactgaaaatccacaaattagccgggcgtggtggtgcgcgcctgtaatcccagctactcgggaggctgaggcaggagaatcgcctgaacccaggaggyggaggttgcagtgagccgagatcgtgccgttgcactccagcctgggcgacagagcaagactccgtctcaaaaaaaaaaaaccacaggctttgaactcagg

SEQ ID NO: 28992 - DNA, 201 bp, Homo sapiens
gggttctatttctgaccttggagctgctaatggccctccttgggacctgaggcacatgctgcacagtcccaggccactgccagctcaggcatcccatgggkccattctgagagctggtcaggttggggacagggactggccaaccctgggctccctggtattgctctctgcttaggcctcatggccagcccagaggtccag

SEQ ID NO: 28993 - DNA, 201 bp, Homo sapiens
agtttcagggcctataaaatggtaacaatggtacgtaccagccgggcacggtggcttacgcctgtaatcccagcactttgggaggccgaggtgggcgaatygcctgaggtcgggagttcgagaccagcctggccagtatggtgaaaccccatctctattaaaaatataaaaattagccgggcatagtggcaggcgcctgta

SEQ ID NO: 28994 - DNA, 201 bp, Homo sapiens
aggagctcttttgtccccccgcccctgcactgtctctggattttgatggggtgagctcactccatccccacatgcctggagcctggccctgggcagctgcrgccgccctggggactgtgcagtgctcagaccttcctgcctagctgcgggggcagtcgggggctcagtcccaggcttgggctacaaggagggtggggtgga

SEQ ID NO: 28995 - DNA, 201 bp, Homo sapiens
tggccagtcatggtgtggtttaaatgagacagtgtctatggaaagtacttgtgagcacacggaagacgtcctgtagaagggaggtgtctcactgtcatcckcatccttgggcgcagcctgggtagtaaagcttgctggttccctatgggccagaggagctcatcatcaagaagtcatgggtgggtcaatgggcctccagct

SEQ ID NO: 28996 - DNA, 201 bp, Homo sapiens
agcctgtggtgaccgtggcagggaggcaggtgggcaggcaggagctcttttgtccccccgcccctgcactgtctctggattttgatggggtgagctcactscatccccacatgcctggagcctggccctgggcagctgcagccgccctggggactgtgcagtgctcagaccttcctgcctagctgcgggggcagtcggggg

SEQ ID NO: 28997 - DNA, 201 bp, Homo sapiens
tacgtgtgcaccggctccaacatgtttgccatggaccagggcacagccactctacatgtgcagggtacacctcccatctatacctgattctcccaccctgkctctcccccattcccaccagaattagcacagcatttcttcattctgctgatcatttctgagcacctgctgcatgcctggtcctggtctaggctctgcaga

SEQ ID NO: 28998 - DNA, 201 bp, Homo sapiens
ggcacctacgtgtgcaccggctccaacatgtttgccatggaccagggcacagccactctacatgtgcagggtacacctcccatctatacctgattctcccmccctggctctcccccattcccaccagaattagcacagcatttcttcattctgctgatcatttctgagcacctgctgcatgcctggtcctggtctaggctc

SEQ ID NO: 28999 - DNA, 201 bp, Homo sapiens
cctaccatgcaccctctgcatgatactaatcctaatgcttattaagcacttactgtataagtaattctagtgcttattaagcacttactgtataagtaaaygcctcactaagtgccttacctgcttgatcccatttacccagccgattctctctgagcctcagtttcttcatccagaaaacggaaataataataacacaag

SEQ ID NO: 29000 - DNA, 201 bp, Homo sapiens
gcacctgctctgtggatgcgcggcttccgctcctgcatggctgtgacttctctgtccctgtctgtgtctctctcaagctccatctccctgaggaagaacaytggtcaccagccactagagaggcctagcagggcccagcccttgtcccgggccacttccagcctctggccactccatagagggcctgtcagtgggagcaca

SEQ ID NO: 29001 - DNA, 201 bp, Homo sapiens
gatcctccttcgattttccagtttatttccgagccctggtgaatttcactcgctccatcgagtacagccctcagctggaggatgcaggctccagagagttycgagaggtgtccgaggctgtggtagacacggtgaggtgaagggggtttgggaagctcgcgggtgtggcggggcaggaccgaggatggggtgaaggcctct

SEQ ID NO: 29002 - DNA, 201 bp, Homo sapiens
atttaaccatggttaggggtacagttcagtggcattaaatatattctgatagagtttggatctgtgttcccacccaaatctcaggtcaaattgtaattccyagtgttggaggtggggcctggtaggaagtgattagatcatgggggtggatttctcatgaatagtttagcaccatccgtttggtgctgttctcaagatagt

SEQ ID NO: 29003 - DNA, 201 bp, Homo sapiens
ctactcaggaggctgaggcaggagaatgatgtgaacctgggaggtagagctttcagtgagcagagatcgtgccacagcactgcagcctgggtgacagagcragaccctcaaaaaacaaacaaacaaacaaaattagctgagtgtggtggcacatacctgtagtcccagctattcaggaggctgaggcgagaggattgcttg

SEQ ID NO: 29004 - DNA, 201 bp, Homo sapiens
ggctggtcttgaactcctgacctgaggtgatccacccgccttggcctcccaaagtgctgggattacaggcgtgagccaccgcgcccagccacatgtgctcyttcagtggctcccctgggtcttgggttcttatctggactgagggtggattcggccagagctccaggcagcctctcccatgggctgtccttcagctccaac

SEQ ID NO: 29005 - DNA, 201 bp, Homo sapiens
catacatcgatgcctcccgcaggtcagccccagctccgggtcggggggggtttggctggggacagtgcaacaggccagagaatattctgggcagggaggcrggagacttggattcagatctctacctgatcactaagttatcccatgctcctggacctctctaggcctctgtttccttttctgtataatgggccccctgac

SEQ ID NO: 29006 - DNA, 201 bp, Homo sapiens
tttaaaggatggagaggaaagaagggtgtgggcaagatggctggctgggcacagcccaagacagctgggcactcccttctcccctccttctttgtcctcaytgggccaggctgtggcctgcatgtgtgtggtgtggtggttgcatgcgtgtggcatgtcaactgtgtgtggggtctgttttagagatgggggaggccactg

SEQ ID NO: 29007 - DNA, 201 bp, Homo sapiens
ggcttctttggggacgccatgaaggccacggccacttcctgccggccctgcccttgcccatacatcgatgcctcccgcaggtcagccccagctccgggtcrgggggggtttggctggggacagtgcaacaggccagagaatattctgggcagggaggcgggagacttggattcagatctctacctgatcactaagttatcc

SEQ ID NO: 29008 - DNA, 201 bp, Homo sapiens
accagctcttcatggagccgtgcccaggtacctctgcaaggtgggcgggcaggaccgccaagccctgggccggatggaccaagcgccagtcccaggccacrgcccccatcccagccctttctcctcctcccagttgcatggggcctctgaggagcctggtcacttcagcctgaccaacgccgcaagcacccacaccaccaa

SEQ ID NO: 29009 - DNA, 201 bp, Homo sapiens; identical to SEQ ID NO: 5422

SEQ ID NO: 29010 - DNA, 201 bp, Homo sapiens
cagccacatgtgctctttcagtggctcccctgggtcttgggttcttatctggactgagggtggattcggccagagctccaggcagcctctcccatgggctstccttcagctccaactctgtgcctgcagaacaatgtggtggggcgcttgtgcaatgaatgtgctgacggctctttccacctgagtacccgaaaccccgat

SEQ ID NO: 29011 - DNA, 201 bp, Homo sapiens
gtgccaggtggactcctatggcggctccctgcgttacaacgtgcgctacgagttggcccgtggcatgctggagccagtgcagcggccggacgtggtcctcrtgggtgccgggtaccgcctcctctcccgaggccacacacccacccaacctggtgctctgaaccagcgccaggtccagttctctgaggtgggtggcgcctg

SEQ ID NO: 29012 - DNA, 201 bp, Homo sapiens
gcaggaagggggctcctgggtggggtcatggaagtgctgatggcggccccctctctcccctagctgtgcccccggatacgagggcaaccccatccagcccrgcgggaagtgcaggcccgtcagtgagtatggctgccaccatcccctgacacccacctcccaacccaacctgggctgcacaccaggcaccctccctccctg

SEQ ID NO: 29013 - DNA, 201 bp, Homo sapiens
ctgtgcttgtgttggacacagtaattctcatgataggtcatgtgtgttgagctctcactatgtgctaggcagcatcctttacaaatcacaaatcacaactrtgtgagacaggtcctgctactgccccatttcataaataaggcaagaggggcttggtaacttacccaaagccccgcagctgggaggtgggaatgccgggat

SEQ ID NO: 29014 - DNA, 201 bp, Homo sapiens
cccactgtatactaggtgcccagaacagtgcctgacacccagtaggtactcaacaaatacttgttgttgctgattacatctcttttttgcttatagacgamctgggcagtggggacctgggcagcggggacttccagatgggtaagttgctgcaggcctcctgcaggtctccctcctgtcccccagggaagccccagagcc

SEQ ID NO: 29015 - DNA, 201 bp, Homo sapiens
gaggtggcagattcaagactcattttagaggtaggatcagcaggacttgactggtcggtgagggcaaaagaaaagggtgggccgggcacggtgggtcacgyctataatcccaacactttgggaggccaaggtgggcagatcatgaggtcaggagttcgagaccagcctggccaacgtcgtaaaaccctgtctctagtacaa

SEQ ID NO: 29016 - DNA, 201 bp, Homo sapiens
agcccaccctccttaggcagctttactgtagcagtctcatcccacttctgacacccaactctgtactttagctgggcttaactttttaaatgctttttctytttttttttttttaaactgagacagggtctcactgtgttgcccaggctggtcttaaactcctgggctcaagcagtcctcctgcctcagtgctggcattac

SEQ ID NO: 29017 - DNA, 201 bp, Homo sapiens
ccatctgagcactgagcccagcgaccctcatccccgcctcagtaccctcacatgcccccattatttctctcgcagtcctgatctcaacaggaccccattcygcaccttaacaccctcccgtgccccatcccccaccaaggcaccccggtgctcaggctgacgccccctcctttttcccctgccagatctccacccactttg

SEQ ID NO: 29018 - DNA, 201 bp, Homo sapiens
gagtctcgcttttgtcacccaggctggagtgcaatggcacaatctcggctcactgcaagctccgcctcctgggttcacgccattctcctgcctcagcctcyggagtagctgggattacaggcacctgccaccatgcctggcgaatttttgtatttttagtagagatgggatttcaccatgttggcaggctggtctctaact

SEQ ID NO: 29019 - DNA, 201 bp, Homo sapiens
gacacacatcctagcctgcggttcaccttcagccccctggccccctgccccagccaggccagagtcttcccacaaaacccctgcttctttctgaaactccygggttcctacctgccccaattcactggctgtgcggtccagggcgcgtccctgctcttctctgcccagtttccccgtaacatgggcgagtcaggctcttct

SEQ ID NO: 29020 - DNA, 201 bp, Homo sapiens
agcacagcatagagatgcctcccagaggtgaacagtgtggactgggagagggccgtgggtgggaggacagactgagcagaagtggggaaggaggggcgccrgcctgtgatgttccagggtcacccctgggaggacactggagggaggggttctgggtctgctggctgtgggtggggcacgttgggaacagaggccaacctt

SEQ ID NO: 29021 - DNA, 201 bp, Homo sapiens
ctgccttatgggaaattcctgtaaatgaaagcagacctggagtttgttcgccggcaccgtcaggcaatggggaatagagaaccttgcagagcaaagaggcygctcagcatcatcaccaccatgtctggggctacagaggaactgagaaatgtcctgtttcccaggcaaccatgcaccctggcctcttggtttgggcaggga

SEQ ID NO: 29022 - DNA, 201 bp, Homo sapiens
gcctcagctgtccacgtgaaggtcctctgcagcagaagtaaggactccccagtcatgagcaacacagtgcccaagtccagtgggcttgtctgcaacaaagmatctatcggctcatgcaactgcagagtctaagcatgtatggtgtcaggcatggccttatccaggggctcattagggctttatcttggttctccagcttct

SEQ ID NO: 29023 - DNA, 201 bp, Homo sapiens
catgtcccatgccccacgtgtgctgtggatgtgtctagtgtgtgctgcttgccctcgttgtgcctgccagaaaccgagctgcctgacacagggccctggakcccactccagccacacagcacctacagcttcccgcacctgcctcctgccgcctctgactccagtctgcttcctttccacctgcagtgccccagttcccaa

SEQ ID NO: 29024 - DNA, 201 bp, Homo sapiens
agcttaagcaacatagcgaaatgctgtctctaaaaaaataaatcggccgggcatggtggctcattcctgtaatcccagcattttgggaggctgaggcaggrcaatcgcttgagtccaggagtttgagaccagcctgagcaacatagggagaccccatctctatttaaaaaaaaaaaaaaaagtgcctgagcaacatagggc

SEQ ID NO: 29025 - DNA, 201 bp, Homo sapiens
cagcctgggcaacagagcaagactccatctcaaagaaaaaaaaaaaattcagcttcctggctgggtgcggtggctcatgcctataatcgcagcactttggragactggggcaggcagaacacctgaggacaggagtttgagaccagcctggccaacatggggaaaccctgtctctactaaaaatacaaaaactagccgggt

SEQ ID NO: 29026 - DNA, 201 bp, Homo sapiens
cctcttaagaatacacatagcaggctgggcgtggtggctcacacctgtaatcccaacactttgggagactggggcaggcgaacacctgaggtcaggagttygagaccagcctggccaacatggtgaaaccctgtctctactaaaataacaaaaattagctgggcgtggtggcgggcgcctgtaatctcagctacttaggag

SEQ ID NO: 29027 - DNA, 201 bp, Homo sapiens
tatttacaaaccatgttaagttatctgaaagaaaagtacagcctgctctgaggtaatacgagaagtcccatcctcttggaagcctccctggctctccaggstgggccagtgccctcctctgcacccgcacagccctgatatgcttcctgcactctcattttcatgtagaatttccatgttgggttcccaactagtaagtcc

SEQ ID NO: 29028 - DNA, 201 bp, Homo sapiens
tttgtatttgttagtagagatggggtttcaccgtgtcagccagttggccttgaactcctgacctcaggtgatccacccgcctcggcctcccagagtgctgrgattacaggcatgagtcactgtgcccagcccattttgctttttataaacaccacggagatgagtgtccttgtaatgaaatctttgtgcccttccatgatt

SEQ ID NO: 29029 - DNA, 201 bp, Homo sapiens
catcctcacgtttgggccacactctccgggggttaaaacccagttcatgcccttgagggggcccaccagagacagggagccaattcagaaacacagattaytccggcccaaagcacagcatagagatgcctcccagaggtgaacagtgtggactgggagagggccgtgggtgggaggacagactgagcagaagtggggaag

SEQ ID NO: 29030 - DNA, 201 bp, Homo sapiens; identical to SEQ ID NO: 5193

SEQ ID NO: 29031 - DNA, 201 bp, Homo sapiens
aaatgaacaaagaggtaggcttgatgcagtttggtattgagatgaatgtctgccctggtggcagaggagagaaagcaaagtcctgtgggacagagctgggkagcctcagctgtccacgtgaaggtcctctgcagcagaagtaaggactccccagtcatgagcaacacagtgcccaagtccagtgggcttgtctgcaacaaa

SEQ ID NO: 29032 - DNA, 201 bp, Homo sapiens
tgctagagtaggaatagtatgccagtcaggtggaggagggtgcaacctcagacttgggactgctgcaggccaggattcattcattcattcattcattcatkcatgcatgcatcagttatttgctgaccaccccatgtgtgccaggcactgatacaggtaaaacaaaacagaccaaattctggctcttgtgggaagaggtgt

SEQ ID NO: 29033 - DNA, 201 bp, Homo sapiens
gtgtttgataaatgctggttagctgagtgaacacacaaatgaacaaagaggtaggcttgatgcagtttggtattgagatgaatgtctgccctggtggcagrggagagaaagcaaagtcctgtgggacagagctggggagcctcagctgtccacgtgaaggtcctctgcagcagaagtaaggactccccagtcatgagcaac

SEQ ID NO: 29034 - DNA, 201 bp, Homo sapiens
cctgctgccctgtcctgcaattctcagacctatctctgtctcctgtcctggcatttccctgcgccccacagggggaggcgtactttgcgcggatgcgccgrgctcaccaggtaggcccaggacgtgcgtggtgtgaagttggtgtggtggggcgtggtgccttctcgggtgctcccagccctgcgtggggagatgcgcagt

SEQ ID NO: 29035 - DNA, 201 bp, Homo sapiens
ccttgtcccgggccacttccagcctctggccactccatagagggcctgtcagtgggagcacagaccgtcgagcccctcaggggaccacactgtgccaggcrttctggtagagaagggtgggcggggcattgctggcgcccagagatgccagccccactggtggtgcctttgacatgggtcttgtccatgtgagcaagatag

SEQ ID NO: 29036 - DNA, 201 bp, Homo sapiens
ctcagacacttgcttcctggacacggatggccaagccacatgtgacgcctgtgccccaggctacactggccgccgctgtgagaggtgagggagagccttgkgggctgcaggaagggggctcctgggtggggtcatggaagtgctgatggcggccccctctctcccctagctgtgcccccggatacgagggcaaccccatcc

SEQ ID NO: 29037 - DNA, 201 bp, Homo sapiens
tggcttctttggggacgccatgaaggccacggccacttcctgccggccctgcccttgcccatacatcgatgcctcccgcaggtcagccccagctccgggtyggggggggtttggctggggacagtgcaacaggccagagaatattctgggcagggaggcgggagacttggattcagatctctacctgatcactaagttatc

SEQ ID NO: 29038 - DNA, 201 bp, Homo sapiens
ggccctacctgggcacctgctctggttgcagttgcaatggccatgccagctcctgtgaccctgtgtatggccactgcctggtgagtagtgccagcagacayttgaacactaaaataggagaagggacaatgtgtgagattccctgtgttcatgagctcagcacaagcctccagaatgactgtcatgactgccagatgaact

SEQ ID NO: 29039 - DNA, 201 bp, Homo sapiens
tggaggacttcgtgtccctggcgatggtgggcggccacctggagttccgctatgagttggggtcaggtaagcacccagcaccaaatgcggggctctgcacrccaagccttgtgcccccctcggctcttcaagccccagggaggcatgggaggataaatgcagggatcagggcaagtcccctcttcctgtgcatttcgtctc

SEQ ID NO: 29040 - DNA, 201 bp, Homo sapiens
agagcgggcctgtggaggacttcgtgtccctggcgatggtgggcggccacctggagttccgctatgagttggggtcaggtaagcacccagcaccaaatgcrgggctctgcacaccaagccttgtgcccccctcggctcttcaagccccagggaggcatgggaggataaatgcagggatcagggcaagtcccctcttcctgt

SEQ ID NO: 29041 - DNA, 201 bp, Homo sapiens
tggacgtggagttcaagccactcgcccctgacggggtcctgctgttcagcggggggaagagcgggcctgtggaggacttcgtgtccctggcgatggtgggyggccacctggagttccgctatgagttggggtcaggtaagcacccagcaccaaatgcggggctctgcacaccaagccttgtgcccccctcggctcttcaag

SEQ ID NO: 29042 - DNA, 201 bp, Homo sapiens
gctgccccgggccttcctgggggacaaggtaacaaggatttggggggattataggggtgtcatagaatcccaaaatatcagagggccctttgtcaaggccytttatgacacaaatggggagaccgaggctcacggtgggtagagacttgcctggggtctcatgttcaggtcagagcacagctgagactgaactcagctctg

SEQ ID NO: 29043 - DNA, 201 bp, Homo sapiens
tgtcagtgccggggagccccgctcctctgctcgttggacccggatcagcagcacccctgccaagttggagcagcggacatatgggctcatggacagccacrcggtgctgcaggtgaagccggggctgcctctctgggtctgaggcccagtccatggcccagccttgagcgggtgcttggaggagatagtagtggatgggca

SEQ ID NO: 29044 - DNA, 201 bp, Homo sapiens
tactccagaacagggtctggtggaaaggtggtgatgatggtggtggcgatggtgtgatggtgttgtggggggcaggggctcaggggtgggctctgggacarcctgcccaaatgtgttcttgagcagcacgggcatccggtggcacccacgctctggggttggggttgccctatccctgttcgttggacacagccaggtact

SEQ ID NO: 29045 - DNA, 201 bp, Homo sapiens
tcagaggtgaacctgtctttgctactccagaacagggtctggtggaaaggtggtgatgatggtggtggcgatggtgtgatggtgttgtggggggcaggggytcaggggtgggctctgggacagcctgcccaaatgtgttcttgagcagcacgggcatccggtggcacccacgctctggggttggggttgccctatccctgt

SEQ ID NO: 29046 - DNA, 201 bp, Homo sapiens
ctccttccatccgtctacccaggcccaggtggaaggcctcacttgcagccactgccggccccaccacttccacctgagtgccagcaacccagacggctgcstgccctgcttctgtatgggcatcacccagcagtgcgccagctctgcctacacacgccacctggtgagagcctgtgctgcccagccccaggcggtgttgcc

SEQ ID NO: 29047 - DNA, 201 bp, Homo sapiens
aaggtgggtcatcggctgggaagcaagggttcctagcttagggaggcaaggctaggctcttggagggaggagagtcagcccccaccctggtcagactggcycagcactgggatggggacttatagtccctgcttccttccactctgggatactgggtggagaaggacctaccccaggacaaggccctgtggctctttatgg

SEQ ID NO: 29048 - DNA, 201 bp, Homo sapiens
ggaggactccaggcgtgcctggcacagagccagcactcctattcacgctgggtcttgtcacgcccagggtctctggcatcagcatggacgtggctgtgccygaggaaaccggccaggaccccgcgctggaagtggaacagtgctcctgcccacccgggtaccgtgggccgtcctgccaggtgagtcctgggccccacgcca

SEQ ID NO: 29049 - DNA, 201 bp, Homo sapiens
gacgtggctgtgcccgaggaaaccggccaggaccccgcgctggaagtggaacagtgctcctgcccacccgggtaccgtgggccgtcctgccaggtgagtcmtgggccccacgccagcccagccagccccctccatggtgcttcccgctccttctccatgagccctccacacctccccagccctggccatccagtgccccta

SEQ ID NO: 29050 - DNA, 201 bp, Homo sapiens
gagagggacgcaggaggggggaggggccatgcagggatatggtttcaggtcaagtctagccccagcctcagcccacagggagctctggagagtcattcgcsggagagtgatcgttctttcaggcccgtgggctcttgtagcctgtatcagcctgtcattggggaccccaggggaacgaggtggtataacctctccaggtga

SEQ ID NO: 29051 - DNA, 201 bp, Homo sapiens
aatgtctcccatacaggctggtctggggccaggctccctagaaagaagcctgagacggggattggggtgcatgtgattcacaaggagagggacgcaggagrggggaggggccatgcagggatatggtttcaggtcaagtctagccccagcctcagcccacagggagctctggagagtcattcgccggagagtgatcgttct

SEQ ID NO: 29052 - DNA, 201 bp, Homo sapiens
aacggagagtcttaacaatgtctcccatacaggctggtctggggccaggctccctagaaagaagcctgagacggggattggggtgcatgtgattcacaagkagagggacgcaggaggggggaggggccatgcagggatatggtttcaggtcaagtctagccccagcctcagcccacagggagctctggagagtcattcgcc

SEQ ID NO: 29053 - DNA, 201 bp, Homo sapiens
tctgtaaaacggagagtcttaacaatgtctcccatacaggctggtctggggccaggctccctagaaagaagcctgagacggggattggggtgcatgtgatycacaaggagagggacgcaggaggggggaggggccatgcagggatatggtttcaggtcaagtctagccccagcctcagcccacagggagctctggagagtc

SEQ ID NO: 29054 - DNA, 201 bp, Homo sapiens
ctccgtcctctccatagatccttggccagtgggtggtaacccagtcagaggctggtggacctggcccaccggccttccgtaccaggacaggtggcctggcrttgggaaggagcactggttagggagtcaggtgaccacagttcaagtcccagtcattctttatgcagcctttgtatctgcattgtacctttgcttttgcca

SEQ ID NO: 29055 - DNA, 201 bp, Homo sapiens
catcagggaaatgaccaggaacctgcaaaaaaggctgagcgggggatggggaaggtaagtgtgtggggttctgggaaactgcatttcacccctgttcaackgtacatggcagccctacctccatcccactcctaattgggtgtggtgggcaggtgggacatctttagatccccaggaaggttattcctgggtgatttgttc

SEQ ID NO: 29056 - DNA, 201 bp, Homo sapiens
ctgtgacgagcgtggcagcatggggacctccggggaggcctgccgctgtaaggtacgcgtgccatctgccacccacccaggggccttgggcccagcaccayagctgggaggaggaagaaggaagctccgtcctctccatagatccttggccagtgggtggtaacccagtcagaggctggtggacctggcccaccggccttc

SEQ ID NO: 29057 - DNA, 201 bp, Homo sapiens
gcaagttaagtttgagatttcgcctatacatccacgcagagatgctgagcagggaggaggttatgtggctgaagttcaaagacaagtcccacaggtgataygatataaatgagacccacaagggaatgagcctggatggaggacaaggggacataggacctgggtctcatggcacaaagcatacagcatcagggaaatgac

SEQ ID NO: 29058 - DNA, 201 bp, Homo sapiens
aggtccagttctctgaggtgggtggcgcctgagcccttagggctgggagcaaagggggatttaggctgggtaggcactgatgtgtgacccctgccaccttyacccatacccaggagcactgggtccatgagtctggccggccggtgcagcgcgcggagctgctgcaggtgctgcagagcctggaggccgtgctcatccaga

SEQ ID NO: 29059 - DNA, 201 bp, Homo sapiens
aacagctgtttgccacggtcctcgcagcctctggagatctggacagggccccagcagcactgtgacagggctgtcgggaggactaataagaccctgccagyggaggactccaggcgtgcctggcacagagccagcactcctattcacgctgggtcttgtcacgcccagggtctctggcatcagcatggacgtggctgtgcc

SEQ ID NO: 29060 - DNA, 201 bp, Homo sapiens
aggctactttaagcaccatcttacagataaggaaactgaggcccttgcccaggcttacaacacacctggacttggtctcctgttcctcagccctgtgtagmtctcctgcctgcagggttgttccagccctgaaagtctgtgggtctcttagcaagaaagaccctgagaagtctggctgcaaagaatccccttgtcctttct

SEQ ID NO: 29061 - DNA, 201 bp, Homo sapiens
caaatatgtcttcatggcactgggagtttagtgtggggagaaacaaaacacatgaatagaatttatgtctaaaggagatagatgctagtgagaaaaattaygcatgttggtgggggcagggctgccgcttttcttttcttttctttttttttttttttttttgagacggagtctcgctctgtcgcccaggctggagtgcag

SEQ ID NO: 29062 - DNA, 201 bp, Homo sapiens
tgtcaagggaattcccatgtagggtgactgtgtgtgtgtgtgtgtgtgtgtgtgtgtgtgtgtgtgtgtgtacatagaagagggttggactagacgacccrtcataacaacagcaacaataagagctagccattttatatcaatgtgctcattttagcttatacctctaggaggcaggctactttaagcaccatcttacag

SEQ ID NO: 29063 - DNA, 201 bp, Homo sapiens; identical to SEQ ID NO: 5211

SEQ ID NO: 29064 - DNA, 201 bp, Homo sapiens
agacttccctgagtttgtcactctgtgtttccattttacagagaggttgtcacttgccgagttcaattagctggaagtgataggaggacttgaactcacayggtctggctccagggcctaaggtctatgagtggagctacttcccaaggaagagggtgtacatgtactgagcattgaggcagggtctcactctgtcgccca

SEQ ID NO: 29065 - DNA, 201 bp, Homo sapiens
ctcgcctcctgggctgctggagcccacaggccctgtcctctcacctcccggcaggcggagcccctgacgtggccacgctgaccgggggcagattctcctcrggcatcacaggctgtgtcaagaacctggtgctgcactcggcccgacccggcgccccgcccccacagcccctggacctgcagcaccgcgcccaggccgggg

SEQ ID NO: 29066 - DNA, 201 bp, Homo sapiens
tcaccatcgtgggcacccggcccagcaaccacggtacctaccgctgcgtggcctccaatgcctacggtgtggcccagagtgtggtgaacctcagtgtgcayggtgaggggacgttgaccctgtggggctctgccctgtttccagccctgattctcagctcagagcctccaagtttaaatcctccttccaccattgactctg

SEQ ID NO: 29067 - DNA, 201 bp, Homo sapiens
cactgcagggagggccgcagaggttccatccaagtcgacggtgaggagctggtcagcggccggtccccaggtcccaacgtggcagtcaacgccaagggcarcgtctacatcggtaagtctggggctccttctcagggcaggggcaggaacggcactcccttagggctagagctcgcccagccttcctcgcctcctgggctg

SEQ ID NO: 29068 - DNA, 201 bp, Homo sapiens
tgccgagtgttgggcagctccgtgcctctagaggcctctgtcctggtcaccattgagcctgcgggctcagtgcctggtgagtagctctcagggagggcagrgctggggacccagggtgggaggccccccactcttgcaacggcaggatcaggaggccaagccgcagactgcacctgccttgagaccaggagccccatctca

SEQ ID NO: 29069 - DNA, 201 bp, Homo sapiens
acagttgggcttggggacattccttgtcctggggactttgccctgataactgtcccctcgctgctctgacagacccatggctcccagctgcggctccaccwcgtctcccctgccgactcaggcgagtatgtgtgtcgtgcagccagcggcccaggccctgagcaagaagcctccttcacagtcaccgtcccgcccagtgag

SEQ ID NO: 29070 - DNA, 201 bp, Homo sapiens
atatccggggccttcaaatgccagtgggtagcatcctaactgggtcagtgtagacaggagggtaggtcactgggtaacctggtcctgactgtgacctcccrgagcctggacttggggctctgcctgaaggttttccatttccatgtgtaggtctccacgaggctgcaggatgcctgggagctgggtggggcttgggagagg

SEQ ID NO: 29071 - DNA, 201 bp, Homo sapiens
ccacccaggcactcccccacccccagcccatcttttttttttttttttttttttgagacgaagtttcgctcttgttgcccaggctggagtgcagtggcacratctcagctcactgcaacttccacctcccgggttcaagcgattctcctgcctcagcctcctgagtagctgggaatacaagtgtctgccaccacccctggc

SEQ ID NO: 29072 - DNA, 201 bp, Homo sapiens
tgtgatgggcagacctctggcatcaggacccccctccctccagagtcacctccgtgtcttttcactggcctatgtgccccccagaggcctgtgggcccgaygccacctgtgtgaaccggcctgacggtcgaggctacacctgccgctgccacctgggccgctcggggttgcggtgtgaggaaggtgaggggagccaggcct

SEQ ID NO: 29073 - DNA, 201 bp, Homo sapiens
aggccaggagcatcgaggaggccagcgccacccctcagagctgggggcctgtgggaagagaaagtccactcaggcctcggcctgggtcctctgccccgtcyccatcacctagagagggacaggtatgattttggtgggaagagtaggagcaaggtgtaaccttccaaagctgcgtcttgtctcgtggggtccctgcctgct

SEQ ID NO: 29074 - DNA, 201 bp, Homo sapiens
gggtgtgatgggcagacctctggcatcaggacccccctccctccagagtcacctccgtgtcttttcactggcctatgtgccccccagaggcctgtgggccsgacgccacctgtgtgaaccggcctgacggtcgaggctacacctgccgctgccacctgggccgctcggggttgcggtgtgaggaaggtgaggggagccagg

SEQ ID NO: 29075 - DNA, 201 bp, Homo sapiens
cagctgagtctcagagggttagggggcctgtccaacatcagacagagagccagggggttagaacccaaagagtctgaccccagagcctagtatcattcccrtgtgcccgaagcccctctagggatggcctccctgatcctataaggctgggccactcaactgcagccccctggggagacctggctgggacatgggtagcac

SEQ ID NO: 29076 - DNA, 201 bp, Homo sapiens
cccacccagggatgctgctgtacaatgggcagaagcgagtcccagggagccccaccaacctggccaaccggcagcccgacttcatctccttcggcctcgtkgggggaaggcccgagttccggtgagacccccagcctccccacctacagggggactggacacagggctttggtctggcaagtgctaccctgggctccatta

SEQ ID NO: 29077 - DNA, 201 bp, Homo sapiens
tgagacccccagggtcctagtgtcagctggggaggctgggtggggcactctgaggccatgatgggccctacggatgataaaacgattcccaagccagaggmtctcgaagtcacctggccacatgtctgcccagcctgagccccttattgagtgagggcccccaaagaggacccctgtcatattggagctcctcccagcccc

SEQ ID NO: 29078 - DNA, 201 bp, Homo sapiens
cgaggagatcgtcttccatgacctcaacctcacggcgcacggcatctcccactgccccacctgtcgggaccggccctgccaggtgaccccacaccccacayaccacctggctgccgtggcctccacccctagccatggctggcccctgtggggattatggggggtactgaatgttctcggccttacttctgggggctgctt

SEQ ID NO: 29079 - DNA, 201 bp, Homo sapiens; identical to SEQ ID NO: 5227

SEQ ID NO: 29080 - DNA, 201 bp, Homo sapiens
gggtggtgccctacttcacgcagaccccctactccttcctaccgctgcccaccatcaaggatgcctacaggaagttcgagatcaagatcaccttccggccygactcagccgatggtgagcaggagggttaatttgcggggtgggctggcctgggttgagggacctcgtggagtaactgccatcatggcaggagccctggct

SEQ ID NO: 29081 - DNA, 201 bp, Homo sapiens
ctgccccagccaggccagagtcttcccacaaaacccctgcttctttctgaaactcctgggttcctacctgccccaattcactggctgtgcggtccagggcrcgtccctgctcttctctgcccagtttccccgtaacatgggcgagtcaggctcttcttttcttccagtgcatgaggccattgaattcaatatggggccctc

SEQ ID NO: 29082 - DNA, 201 bp, Homo sapiens; identical to SEQ ID NO: 5233

SEQ ID NO: 29083 - DNA, 201 bp, Homo sapiens
cattctgagagacagaggtgccagtgtacccagattataggagcccaggctttggcatctccttggcctgagggtggcctccagctataccacttactgcygctgtgtctttgggcaagtctcttggcctccctggtcctattttcccaaagatagaggcaggcagatggactcagttctttctggcactgagaggcagaa

SEQ ID NO: 29084 - DNA, 201 bp, Homo sapiens
tggctgggtgacgctgtggttgtgacagtgatgtgccagccataactggcatggggaatgcaggtggagtgaggggtgggggccgggtaatgtgatgagtkgttcgatgacagctggtggccgcatcatgctggctgtgagttggacagtgttgtgcagcaggggctaggcatggcgagggccgctgtgggttatgtgggc

SEQ ID NO: 29085 - DNA, 201 bp, Homo sapiens
tctggtagagaagggtgggcggggcattgctggcgcccagagatgccagccccactggtggtgcctttgacatgggtcttgtccatgtgagcaagatagcrcttctgtgcctctgagcgtggctgggtgacgctgtggttgtgacagtgatgtgccagccataactggcatggggaatgcaggtggagtgaggggtggggg

SEQ ID NO: 29086 - DNA, 201 bp, Homo sapiens
gaggaccaggaagtttgtggaaaggggcctgacccagttccactgcagggagggccgcagaggttccatccaagtcgacggtgaggagctggtcagcggcmggtccccaggtcccaacgtggcagtcaacgccaagggcagcgtctacatcggtaagtctggggctccttctcagggcaggggcaggaacggcactccctt

SEQ ID NO: 29087 - DNA, 201 bp, Homo sapiens
cggagcccaggagtttgaagctgcagtgagctaggatcatgccactgcactccagcctgggcgacagagcaaaaccctgcctctaaaacaagacaaacaarcaaaaacccttaattattgcacccagagatcaagcttgctcttctgcatcatcaggcccaggtctaaagactgctgggggtccagccctcctctctcact

SEQ ID NO: 29088 - DNA, 201 bp, Homo sapiens
cgttcagcgggggaaagaaagagcttgggaaacagggacagacttctgagtctggagtctcgatatcagagggaggggactctgtcgtggggccggggagraccaggaagtttgtggaaaggggcctgacccagttccactgcagggagggccgcagaggttccatccaagtcgacggtgaggagctggtcagcggccggt

SEQ ID NO: 29089 - DNA, 201 bp, Homo sapiens
ttccttctactgtgcctttggtctcctgttttaacctcctgagtctcttttttttctctagaccgaacagccctagttcatccttcacaggtgtggttctyggccctgtctccatctcagttccctgtctctgggaagaccctgactcagtggaactcagaatggaacaaactccatcccctactatggtgtagcccaatt

SEQ ID NO: 29090 - DNA, 201 bp, Homo sapiens
ggaggcgacacatgggtgggaaggcagcgagtgtggacaactcctgcaagagtcttggctctgaagggaggccaggaagtgggtcattgactgcgagagcrtgaggtcaagggggagttttcggaaatgggaaatcctagaatgcactctggaccgaagtgatcgcatgagaaggaggagacgctgatgttgcgagagcag

SEQ ID NO: 29091 - DNA, 201 bp, Homo sapiens
catgggggcacctgccagggcacccgctgcctctgcctccctggcttctctggcccacgctgccaacaaggtacccaggcctggcttctctccacttcatytctgtcttggggccccggagctcgacatagtacccacgggtgtctatgcccaccaactggaccctgcccttctccataggctctggacatggcatagcag

SEQ ID NO: 29092 - DNA, 201 bp, Homo sapiens
cgtgaatgaaatcccaggttcccctccatcaagcctagagtctggtggtggagagaggaccacagcagcttcgattcttgggcggtttgctgtgtgccagktgatgcatctgagtacaagggcctggtgcatgtgagcacaatgtcatgcactcctcgcagcaacccaggtggtacatgcagtcaatatccccattaggaa

SEQ ID NO: 29093 - DNA, 201 bp, Homo sapiens
gtccctcggtgtccctgtccccacaggtgtcagtgaatggcaaacggctggacctcacctacagtttcctaggcagccagggcatcgggcaatgctatgayagctccccatgtgagcgccagccttgccaacatggtgccacgtgcatgcccgctggcgagtatgagttccagtgcctgtgtcgagatggattcaaaggtg

SEQ ID NO: 29094 - DNA, 201 bp, Homo sapiens
ctggctcagctccagccccctgtgtgtcaagacccgtccctgatagcctcccctccctaggaccccttcccacgtctcctcccccagtttctttccatgtwctgacctgtctctttctgtcttcccccatgcccgtgtgtcctgctctgacccttgtcggcatgtctgtgtgtgtcccctgtcctccctgccctgggccct

SEQ ID NO: 29095 - DNA, 201 bp, Homo sapiens
tcaggaggccaagccgcagactgcacctgccttgagaccaggagccccatctcatctcacctcctagccggctattgaccctttgccctctgtccccagcwcttggggtcacccccacggtccggatcgagtcatcgtcttcgcaagtggccgaggggcagaccctggacctgaactgcctcgttgctggtcaggcccatg

SEQ ID NO: 29096 - DNA, 201 bp, Homo sapiens
gtaggcactcaactcctgcgcctccctccccacaccgagaatccatgctaccactcagggcccaatgtgggctcccagctcccctctgctgcattcttctycctgctggtacacctgggtctctgcctcccaggcccctttagtccctcggtgtccctgtccccacaggtgtcagtgaatggcaaacggctggacctcacc

SEQ ID NO: 29097 - DNA, 201 bp, Homo sapiens
acctggtcctgactgtgacctcccagagcctggacttggggctctgcctgaaggttttccatttccatgtgtaggtctccacgaggctgcaggatgcctgsgagctgggtggggcttgggagagggagtgtcaggtgggccccaggcacacatggcacgtcccgtcctggaatggcctatgctaatgtgtccctggagctg

SEQ ID NO: 29098 - DNA, 201 bp, Homo sapiens
tgagagcagcagctacgtgtgcgtctgcccagctggcttcaccgggagccgctgtgagcactcgcaggccctgcactgccatccaggtacgcaccccgacygccagtcgctgtcgccccagggcctgcctcttccctttgctgcctccccatatccaccaccatctcaaccactggggcacttccacaccccccactctca

SEQ ID NO: 29099 - DNA, 201 bp, Homo sapiens
attagactttcacccctaagggttcatataaatggaatcgtatagtttgtagtcttgtgtgtctggcttctttcagatccacacctatcaatcagtggttygatcctccttattcctgagtaggtggaggaggtggtatttaagttgattttggaggatgcattggagttcgcctgagaaacaaagagaggaagggcattc

SEQ ID NO: 29100 - DNA, 201 bp, Homo sapiens
ccaaggccagggccctcagtgctagtgcatttgcagctggatggcagcctgccacctgacagccgcctggagaacaacatgctgatgctgccctcagtccraccccaggacgcaggtacctacgtctgcaccgccactaaccgccagggcaaggtcaaagcctttgcccacctgcaggtgccaggtaagacaccaccccta

SEQ ID NO: 29101 - DNA, 201 bp, Homo sapiens
actggggaaggggagcattcatacctcctcagcctcctccaagggtcactgtcaactcaggtgatactaggctgaggaaatgcattgcaaagtggcatgcmgtgtggctgagaggctttgcaagagtgactcccagtgatctcatatctgcttcattgcatacccctggtcacagaggtgatatagcacagtggtagctgc

SEQ ID NO: 29102 - DNA, 201 bp, Homo sapiens
gtgggcctgaggcacagatgggaggtgggcccctggagccgtgggccaaggccagggccctcagtgctagtgcatttgcagctggatggcagcctgccacytgacagccgcctggagaacaacatgctgatgctgccctcagtccgaccccaggacgcaggtacctacgtctgcaccgccactaaccgccagggcaaggtc

SEQ ID NO: 29103 - DNA, 201 bp, Homo sapiens
accccaagccctgtgacttgcctccaaacttccttacctatactgcccctagtgtgcacttctcaggtccccaaagggctgcacaattttttgcccaggcrtgttgaagaggtctcaggctgtggagtgaaatggatctggccctgaaccctgactctgcccgaccaggagcaaacagccgcttttcccctctgagccata

SEQ ID NO: 29104 - DNA, 201 bp, Homo sapiens
agtaaaacaaggacaacagatgcagggcagacacaaacactgtgtgttctttaaaggcaattcctttttaccccaagccctgtgacttgcctccaaacttycttacctatactgcccctagtgtgcacttctcaggtccccaaagggctgcacaattttttgcccaggcatgttgaagaggtctcaggctgtggagtgaaa

SEQ ID NO: 29105 - DNA, 201 bp, Homo sapiens
ggctgggatgcagagaacaggctggagtggcttcagagaacaggagtgaccggtgaccatcttatccctcagctgccggcagcacccagcccatccgcatygagccctcctcctcgcaagtggcggaagggcagaccctggatctgaactgcgtggtgcccgggcagtcccatgcccaggtcacgtggcacaagcgtgggg

SEQ ID NO: 29106 - DNA, 201 bp, Homo sapiens
ccgccccggccagagacaaccatcatgcgacagccaccagtcacccacgctcctcagcccctgcttcccggttccgtcaggcccctgccctgtgggccccrggaggccgcatgccgcaatgggcactgcatccccagagactacctctgcgacggacaggaggactgcgaggacggcagcgatgagctagactgtggtgcg

SEQ ID NO: 29107 - DNA, 201 bp, Homo sapiens
gactctgagcaggcttggtgggtgctgaccccacgtctactcgtcagggggccccggcggccagctccctgcgaaggcacaaatccacggcggcatcctgygcctgccagctgtcgagcccacggatcaggcccagtacttgtgccgagcccacagcagcgctgggcagcaggtggccagggctgtgctccacgtgcatgg

SEQ ID NO: 29108 - DNA, 201 bp, Homo sapiens
agatgccccattggctattctggcttgtcctgcgagagctgtgatgcccacttcactcgggtgcctggtgggccctacctgggcacctgctctggttgcarttgcaatggccatgccagctcctgtgaccctgtgtatggccactgcctggtgagtagtgccagcagacacttgaacactaaaataggagaagggacaatg

SEQ ID NO: 29109 - DNA, 201 bp, Homo sapiens
tttgtgcaagtcatttcacatccctgagcctctgtttcctcatgtgaaggatgaaggtatcacctacctctcaaggtccttaggggagttaaatgaggtgrtgtcgaatggaaagcagaacagtgcgtgaaacactccataaatagaagcagcaattatttcaatcaagtcgctgtatttcaagtctaaatttattggtga

SEQ ID NO: 29110 - DNA, 201 bp, Homo sapiens
catcaaggtacccatggccctaggctcctcagccccaagagccatcccagtgggaggggaggcaggggcctgtccctgccctagtgggatgctgtccttgygcatggggctggatgtgagaaagagtgtatctgcaccaacaagctcttgtctcctccccaccaggctccgagctccacttccccagcgtccagccctcgg

SEQ ID NO: 29111 - DNA, 201 bp, Homo sapiens
ctatgaaggagatgttattcctcctgtttcagagacgagggaactgaggcccagaaaggaaaatctaaatttgtccagaatcagatgggcagatagtgaawaggcgaggatttcaaacaaactcggtgtctgtgacagtcttgccagaacctgtgatgacagaagcaggagaaactgaggcacagagagactaggaaactg

SEQ ID NO: 29112 - DNA, 201 bp, Homo sapiens
tacaggaagttcgagatcaagatcaccttccggcccgactcagccgatggtgagcaggagggttaatttgcggggtgggctggcctgggttgagggacctygtggagtaactgccatcatggcaggagccctggctgcccctcagtcctgccccaatccctcagccctccctctccagaagcccccagacctctgggcctc

SEQ ID NO: 29113 - DNA, 201 bp, Homo sapiens
tcagagtcctcagacctggtggtactcaggcaagggccagcggaaagatgcgtgggttcagtggctacggctaccccatttctaacatttcaaattctcartagccacgtgtggcttgcagccactgacttggcctgtgcagataaaaagcatttccatcatcacaggaagtttacgaattttgtgagggttaagtgagtt

SEQ ID NO: 29114 - DNA, 201 bp, Homo sapiens; identical to SEQ ID NO: 5257

SEQ ID NO: 29115 - DNA, 201 bp, Homo sapiens
ctaggaaagggacgagggatgcaggcaacagtgttccctggggagaaggaactttcaggtcagagtcctcagacctggtggtactcaggcaagggccagcrgaaagatgcgtgggttcagtggctacggctaccccatttctaacatttcaaattctcaatagccacgtgtggcttgcagccactgacttggcctgtgcag

SEQ ID NO: 29116 - DNA, 201 bp, Homo sapiens
tggggagacaggtgcccacccagcagttactaagctggaggccatggcagtgtgggtgagcagcagagccctgcctgtgtgtcagtggttgtcattcctcygcacagggccccctacagtgtccgtgctccccgagggccccgtgtgggtgaaagtgggaaaggctgtcaccctggagtgtgtcagtgccggggagccccg

SEQ ID NO: 29117 - DNA, 201 bp, Homo sapiens
agaccgatagcagcctcaacaggctgagcaggaaggcctgagccagctggtgaccccagcgtccctccactccctctccctctccttccccatccgcacgyccagacccatggctcccacctgcggttgcaccaaatgtctgtggctgactcgggcgagtatgtgtgccgggccaacaacaacatcgatgccctggaggcc

SEQ ID NO: 29118 - DNA, 201 bp, Homo sapiens
gtggggagacaggtgcccacccagcagttactaagctggaggccatggcagtgtgggtgagcagcagagccctgcctgtgtgtcagtggttgtcattcctycgcacagggccccctacagtgtccgtgctccccgagggccccgtgtgggtgaaagtgggaaaggctgtcaccctggagtgtgtcagtgccggggagcccc

SEQ ID NO: 29119 - DNA, 201 bp, Homo sapiens
tgtcacgtcagtaacggtgcaggctcccgggagacctcgctcatcgtcaccatccagggcagcggttcctcccacggtgagagcagagagggcagggggtmcagacaagtggcgcagagggtggcagagaggtccccggtgccatcactgttatctcactctggctgcgtggtccacacccgtctgtccccagtgcccagc

SEQ ID NO: 29120 - DNA, 201 bp, Homo sapiens
agctgtgcccctgctacggagaccctgctgccggccagtgcgtccagtccctgcctgcacctgcccttccctgaaatgtctaccacccgctcccacacccscttcatccagggcccttctgagaggcagtggttaaatcctggccttactgcctgctcagtgtcacttggtgtgagatacacttcactttcagggcctcag

SEQ ID NO: 29121 - DNA, 201 bp, Homo sapiens
cacagaaagtactctaagctgttaatattttactataatgccattagctattgttgttaccatattttgtagaatttaggataccactgattgcgagatcygctatgattttatgtacctctaagaaaaagcttctatttgtaaggttattcattgtagatgcatcttgattttggagacatcgaaatgtgtgtctagaat

SEQ ID NO: 29122 - DNA, 201 bp, Homo sapiens
gggaggtggaggttacagtaggccaagaccgtgcccctgcactccagcctgggcaacagagcaagactcagtctcagaaaaaaaaaacaacccagagatayagcatccagacaagggaggtgttggccctcctctccaccctcatcagactaatcctggagagtgccaaatgaagaagcatggcctgcagagggcaactct

SEQ ID NO: 29123 - DNA, 201 bp, Homo sapiens
cttaggctcacagaaagtactctaagctgttaatattttactataatgccattagctattgttgttaccatattttgtagaatttaggataccactgattkcgagatccgctatgattttatgtacctctaagaaaaagcttctatttgtaaggttattcattgtagatgcatcttgattttggagacatcgaaatgtgtg

SEQ ID NO: 29124 - DNA, 201 bp, Homo sapiens
gccgaggtctgacccctagacccctcctctccagctgcccgtctggctccaacacatgcctgaagtgctgggttcctctgggaggaagccgggctccctcrccgccggagacgggctggagggcaggaaacctgggttctatttctgaccttggagctgctaatggccctccttgggacctgaggcacatgctgcacagtc

SEQ ID NO: 29125 - DNA, 201 bp, Homo sapiens
tggcgcccagagatgccagccccactggtggtgcctttgacatgggtcttgtccatgtgagcaagatagcgcttctgtgcctctgagcgtggctgggtgaygctgtggttgtgacagtgatgtgccagccataactggcatggggaatgcaggtggagtgaggggtgggggccgggtaatgtgatgagtggttcgatgaca

SEQ ID NO: 29126 - DNA, 201 bp, Homo sapiens
ctcctgtggttttctcctccgttcttagtcctttcctaggcagccttgtctgcctctttatcctcacccaggccaggagaggaggatccagcctgcattcrttgtccctaatgacacaacttggacctggagttccatgtgaccctcgttctcaccaggagggcctggacatagcccacctctgggattgggtgcctccca

SEQ ID NO: 29127 - DNA, 201 bp, Homo sapiens
aggccaggctggtctcgaacttctggcctcaagtgatctgtacctgctctccgtatctgtacctctccctccttctctccattctgtgccccactcctgtrgttttctcctccgttcttagtcctttcctaggcagccttgtctgcctctttatcctcacccaggccaggagaggaggatccagcctgcattcattgtccc

SEQ ID NO: 29128 - DNA, 201 bp, Homo sapiens
ctcctacctcagcctcccgagtagttgggactataggcatgcaccaccgcgctgggctaatttttgtatttttagtagagatggggtttcaccctgtaggmcaggctggtctcgaacttctggcctcaagtgatctgtacctgctctccgtatctgtacctctccctccttctctccattctgtgccccactcctgtggtt

SEQ ID NO: 29129 - DNA, 201 bp, Homo sapiens
ctcccgagtagttgggactataggcatgcaccaccgcgctgggctaatttttgtatttttagtagagatggggtttcaccctgtaggccaggctggtctcraacttctggcctcaagtgatctgtacctgctctccgtatctgtacctctccctccttctctccattctgtgccccactcctgtggttttctcctccgttc

SEQ ID NO: 29130 - DNA, 201 bp, Homo sapiens
gagttcacctctgcgccgtctctcagcaggcaggcacctgccacctgcatggccatatcgtggttaggcacgtggcttttgcagtcccatagacattggtytgaaccccagctctgccgcttgccagccagacaccatttgataaacctcaacttcatggtggctgaggggattggagatcgtgcctggcacataataagt

SEQ ID NO: 29131 - DNA, 201 bp, Homo sapiens
tgtgtcccaagggcacacggctaatgtgtggcagaaactaatttgaacctgggtctgattgactccaaagcctagcatgtcctaaccactgggcagtgcakcctcacgtttgggccacactctccgggggttaaaacccagttcatgcccttgagggggcccaccagagacagggagccaattcagaaacacagattactc

SEQ ID NO: 29132 - DNA, 201 bp, Homo sapiens
agtgcatttgcagctggatggcagcctgccacctgacagccgcctggagaacaacatgctgatgctgccctcagtccgaccccaggacgcaggtacctacrtctgcaccgccactaaccgccagggcaaggtcaaagcctttgcccacctgcaggtgccaggtaagacaccacccctaagaattggcagtgccctgcccac

SEQ ID NO: 29133 - DNA, 201 bp, Homo sapiens
gagcaaacgctcaatgttggaaggtgggcctgaggcacagatgggaggtgggcccctggagccgtgggccaaggccagggccctcagtgctagtgcatttrcagctggatggcagcctgccacctgacagccgcctggagaacaacatgctgatgctgccctcagtccgaccccaggacgcaggtacctacgtctgcaccg

SEQ ID NO: 29134 - DNA, 201 bp, Homo sapiens
tccccaggatgtggcacaggcttggccaagagcaaacgctcaatgttggaaggtgggcctgaggcacagatgggaggtgggcccctggagccgtgggccarggccagggccctcagtgctagtgcatttgcagctggatggcagcctgccacctgacagccgcctggagaacaacatgctgatgctgccctcagtccgacc

SEQ ID NO: 29135 - DNA, 201 bp, Homo sapiens
acacctgttactcaaggctcttgacttcctcctgccggagaaaccatcataataaacatgccctccacaatgcggactgtcaaaggggtcgcctccaacakgatgcgcctacatatctgtgcatggcagtcccagggtgtgggtaccagaggcctgggcatctgaaggctcccagctcaccctccccgctctcaccccacc

SEQ ID NO: 29136 - DNA, 201 bp, Homo sapiens
ccctccttccgcccaccccagcaatctgtggcctctggaggcccagcctcaactcacatcctgctcctccagggctgccagcatcacacggagggccctcrgtgtgagcagtgccagccaggatactacggggacgcccagcgggggacaccacaggactgccagctgtgcccctgctacggagaccctgctgccggccag

SEQ ID NO: 29137 - DNA, 201 bp, Homo sapiens
gctcttgacttcctcctgccggagaaaccatcataataaacatgccctccacaatgcggactgtcaaaggggtcgcctccaacaggatgcgcctacatatytgtgcatggcagtcccagggtgtgggtaccagaggcctgggcatctgaaggctcccagctcaccctccccgctctcaccccaccttggccaggtccacgg

SEQ ID NO: 29138 - DNA, 201 bp, Homo sapiens
cccagtcaccatcaggtatgcagctggcaggaaatggtgggagagccgctggatgtgggggccctggctagctttgccaagagggagacctaggagccccygtggggtgcagtacccccctgtgtcagaggttagaccctggccccaggccttcaacagttccagactggcacctgactctgttcctctgtcctgtcccct

SEQ ID NO: 29139 - DNA, 201 bp, Homo sapiens
tacctcacagaattatcttaaagattaaaatatatgcaaaatcctcagagcttaggctcacagaaagtactctaagctgttaatattttactataatgccrttagctattgttgttaccatattttgtagaatttaggataccactgattgcgagatccgctatgattttatgtacctctaagaaaaagcttctatttgta

SEQ ID NO: 29140 - DNA, 201 bp, Homo sapiens
ttaaaaaaataataataataatgcacctcagagtcaccctgccctgtcgtccagggaaaagtgagacagggatgggagggcgtccataaaggctgtgtcaycaagcagattgccaccgtgagcagttgttgcttagtacaaccgaggaagcttttaaagggagccggtgtaaaacacgcacctcaaagtcaccctgccctg

SEQ ID NO: 29141 - DNA, 201 bp, Homo sapiens
aggtacattcagagaagtgagacagggaggttgaggggtgaggataagaagcaatctgctggagccgagggtggagctggagtactgcagggttatcaagygtgatatgcattctcaaactgtgtggagtacatcaccatttgtgtcctatattacttaatcctcatgatacccttcaaagtgggtattacttttacttcc

SEQ ID NO: 29142 - DNA, 201 bp, Homo sapiens
tgagtattcatattgcctctattttgttccaacaatttcaagtacctcttaagaatacacatagcaggctgggcgtggtggctcacacctgtaatcccaayactttgggagactggggcaggcgaacacctgaggtcaggagttcgagaccagcctggccaacatggtgaaaccctgtctctactaaaataacaaaaatta

SEQ ID NO: 29143 - DNA, 201 bp, Homo sapiens
gccttttctctgggcttccttgaccttgtgtctagatgctggcctagtttttggtacttcactcagtcattcaagaagcattaattatttactgtgtgctkcgtcgtgtacaggccgagtgggccctggcctcccagagctccctgtccatcccattatcattcctgtcaccatcagtatcattattattatcatcatgag

SEQ ID NO: 29144 - DNA, 201 bp, Homo sapiens
atcccgggatatccccgcctagctcaggaggaacaagagggcagtgggtacaagggccagagtgccaggtatcagcacttgtgagcagacagtgcagagcrggtggctggctgggcccgtggggaggtgaagcctcacggacgtcctttctgtccctctctgctcccttctgccgctcttcggctcctggtcccccaggtg

SEQ ID NO: 29145 - DNA, 201 bp, Homo sapiens
gcgtggcctccaatgcctacggtgtggcccagagtgtggtgaacctcagtgtgcacggtgaggggacgttgaccctgtggggctctgccctgtttccagcmctgattctcagctcagagcctccaagtttaaatcctccttccaccattgactctgtcttgggcattctccctctctgagcctcagtttccacctcagtgc

SEQ ID NO: 29146 - DNA, 201 bp, Homo sapiens
gcccacacctgtaattccagcactttggaaggctgaggcgggaggaccacttgagctcaggagtttgagaccagcctgggcaatgtgacgaaaccccgtcyctacaaaaagtacaaaaaattagctgggcgtgttggtgcatgcctgtagtcccagctatttagggaggctgaggtgggaggatcgctggtacccaggatg

SEQ ID NO: 29147 - DNA, 201 bp, Homo sapiens
tccaggcctcaatggaacgggaagggaaagaagccatgtcccaaatggcctctggtcctagtatctgggccccaggggaagggctgagggcatcagggtgscatctcagctcactgacctctcccctgtgccccagccccaggtggagccccacccatccgcatcgagccctcctcctcccgagtggcagaagggcagacc

SEQ ID NO: 29148 - DNA, 201 bp, Homo sapiens
tgttcatgacttttagctttcatgcagttattctacaaacagatctgggagaggccgggaaatataaagacaagtgagacacagtttcagtgtcattcacrtgcccgctccgacttcactcatccacactgctggctctgtgcttgtgttggacacagtaattctcatgataggtcatgtgtgttgagctctcactatgtg

SEQ ID NO: 29149 - DNA, 201 bp, Homo sapiens
ctggaagtggccagggaggctggcctcaggctgctgggggtgcaggagacccactgagtcccctgcctgcctccttccatccgtctacccaggcccaggtrgaaggcctcacttgcagccactgccggccccaccacttccacctgagtgccagcaacccagacggctgcctgccctgcttctgtatgggcatcacccagc

SEQ ID NO: 29150 - DNA, 201 bp, Homo sapiens
aacagagcaagactctgtcttaaaaaaataataataataatgcacctcagagtcaccctgccctgtcgtccagggaaaagtgagacagggatgggagggcrtccataaaggctgtgtcaccaagcagattgccaccgtgagcagttgttgcttagtacaaccgaggaagcttttaaagggagccggtgtaaaacacgcacc

SEQ ID NO: 29151 - DNA, 201 bp, Homo sapiens
gcaggtgcgcccctggctactatggcaaccccagccagggccagccatgccagagtgagtaggattggggaggtcattggggtcgggttacccagagtccytagggcggagctaggacagaagcctttactcccctttggctttgcctgtccgagcctgtttcttcatctgtaaaatggggataggagaaggccccaccac

SEQ ID NO: 29152 - DNA, 201 bp, Homo sapiens
ctcacctgtggtctgggcagacacgtctcccggggctcactggggaaggggagcattcatacctcctcagcctcctccaagggtcactgtcaactcaggtgatactaggctgaggaaatgcattgcaaagtggcatgcagtgtggctgagaggctttgcaagagtgactcccagtgatctcatatctgcttcattgcatac

SEQ ID NO: 29153 - DNA, 201 bp, Homo sapiens
gaagggacagagaccagggggcagaactggcagaaggaaacactttctggcactcggcgagaactgccgctctgattccagacttcacctcccgccacccrcacggtcccaggaccaaggagccggctcaggtggagtggttcctgtccctctccacggcttgcgagcataggctttggactatgctcatctgtgcatgag

SEQ ID NO: 29154 - DNA, 201 bp, Homo sapiens
ctgggattacaggcatgagccaccatgcccggccaagtgttaactattagtgttactctggggggtgagattttctatggcagagggtcccaccaaccctrttcccaaatctgacaacggctgtgccgactcactgatctctgttcccccagcccctggcagctccatgcccatcagaattgagtcatcctcctcacacgt

SEQ ID NO: 29155 - DNA, 201 bp, Homo sapiens
ggccacatgactcctcaggcgtcccctcccacctcctcttcctctctccaactcatctctgccctcatctctctcacttcctcactcccctctgcaaggcrtggcccatgccctggtcctcccatcagggttgctgagctgagggcatcaagtccaggcccccagatgcctgaaaagctggatctggccttgaaaccctgg

SEQ ID NO: 29156 - DNA, 201 bp, Homo sapiens
ctgcagggagggccgcagaggttccatccaagtcgacggtgaggagctggtcagcggccggtccccaggtcccaacgtggcagtcaacgccaagggcagcrtctacatcggtaagtctggggctccttctcagggcaggggcaggaacggcactcccttagggctagagctcgcccagccttcctcgcctcctgggctgct

SEQ ID NO: 29157 - DNA, 201 bp, Homo sapiens
actgacttggcctgtgcagataaaaagcatttccatcatcacaggaagtttacgaattttgtgagggttaagtgagttagtgcatgtaatgtgcttagagygtgcctggcatgccagaagtgctttataagtgttaactattattatcatttttttttttttgagagggagtctcgctctgtcacccaggctggagtgcag

SEQ ID NO: 29158 - DNA, 201 bp, Homo sapiens; identical to SEQ ID NO: 5201

SEQ ID NO: 29159 - DNA, 201 bp, Homo sapiens
tctcagtgtccccaggatgtggcacaggcttggccaagagcaaacgctcaatgttggaaggtgggcctgaggcacagatgggaggtgggcccctggagccrtgggccaaggccagggccctcagtgctagtgcatttgcagctggatggcagcctgccacctgacagccgcctggagaacaacatgctgatgctgccctca

SEQ ID NO: 29160 - DNA, 201 bp, Homo sapiens
tctcacctcccggcaggcggagcccctgacgtggccacgctgaccgggggcagattctcctcaggcatcacaggctgtgtcaagaacctggtgctgcactyggcccgacccggcgccccgcccccacagcccctggacctgcagcaccgcgcccaggccggggccaacacacgcccctgcccctcgtaggcacctgcctgc

SEQ ID NO: 29161 - DNA, 201 bp, Homo sapiens
cctttttaccccaagccctgtgacttgcctccaaacttccttacctatactgcccctagtgtgcacttctcaggtccccaaagggctgcacaattttttgmccaggcatgttgaagaggtctcaggctgtggagtgaaatggatctggccctgaaccctgactctgcccgaccaggagcaaacagccgcttttcccctctg

SEQ ID NO: 29162 - DNA, 201 bp, Homo sapiens
gccggcagcccctccggtgagtctgcctaggaaagggacgagggatgcaggcaacagtgttccctggggagaaggaactttcaggtcagagtcctcagacytggtggtactcaggcaagggccagcggaaagatgcgtgggttcagtggctacggctaccccatttctaacatttcaaattctcaatagccacgtgtggct

SEQ ID NO: 29163 - DNA, 201 bp, Homo sapiens
gcgtccctgctcttctctgcccagtttccccgtaacatgggcgagtcaggctcttcttttcttccagtgcatgaggccattgaattcaatatggggccctyagcccagccctggggttctgcttcccttcatccaaaattcatcagaggctttttctctctgcaggtgcgcccctggctactatggcaaccccagccaggg

SEQ ID NO: 29164 - DNA, 201 bp, Homo sapiens
tcaccatccagggcagcggttcctcccacggtgagagcagagagggcagggggtacagacaagtggcgcagagggtggcagagaggtccccggtgccatcrctgttatctcactctggctgcgtggtccacacccgtctgtccccagtgcccagcgtctccccaccgatcaggatcgagtcgtcttcccccacggtggtgg

SEQ ID NO: 29165 - DNA, 201 bp, Homo sapiens
cagagtcttcccacaaaacccctgcttctttctgaaactcctgggttcctacctgccccaattcactggctgtgcggtccagggcgcgtccctgctcttcyctgcccagtttccccgtaacatgggcgagtcaggctcttcttttcttccagtgcatgaggccattgaattcaatatggggccctcagcccagccctgggg

SEQ ID NO: 29166 - DNA, 201 bp, Homo sapiens
gccccagccaggccagagtcttcccacaaaacccctgcttctttctgaaactcctgggttcctacctgccccaattcactggctgtgcggtccagggcgcrtccctgctcttctctgcccagtttccccgtaacatgggcgagtcaggctcttcttttcttccagtgcatgaggccattgaattcaatatggggccctcag

SEQ ID NO: 29167 - DNA, 201 bp, Homo sapiens
gagggtggggggatgcgcacagggggtgtccctggaatcctcaggcagggcccagcgctcccaacccagaggaatcagggatgcctctcgctcttaacctygcacaggccccagaagacagtcagctcccctcctcgggagactcaacctctagcccagaattcaagaccctcagacacacatcctagcctgcggttcacc

SEQ ID NO: 29168 - DNA, 201 bp, Homo sapiens
gtggaacagtgctcctgcccacccgggtaccgtgggccgtcctgccaggtgagtcctgggccccacgccagcccagccagccccctccatggtgcttcccrctccttctccatgagccctccacacctccccagccctggccatccagtgcccctacctgaatgggccgtgttcggaagtccctcccactgccatctttct

SEQ ID NO: 29169 - DNA, 201 bp, Homo sapiens
aagactcagtctcagaaaaaaaaaacaacccagagatacagcatccagacaagggaggtgttggccctcctctccaccctcatcagactaatcctggagartgccaaatgaagaagcatggcctgcagagggcaactctagggggaagagcccttggggtgggaccttatttcttaggaatagtggcgagagctgggattg

SEQ ID NO: 29170 - DNA, 201 bp, Homo sapiens
gtcaagatcattaaaaacaaggaaatcctgagaaactgccacagccaaggggagcctaaagaggcatgatgactattaatgaatgtaacatgaggccgggygcggaggctcacgcctgtaatcccagcactttgggaggccaaggcgggtggatcacttgaggtcaggagtttgagaccagcctgtccaacatggagaaat

SEQ ID NO: 29171 - DNA, 201 bp, Homo sapiens
gaggcaggaggatctgttgagcctaggaggttgaggctgcagtgagctatgatcacaccattgcactccagcctggacaacagagtgagaccccatccctraaaacaaaacaaaacttagttacttcccaaagttgtcccccagtatatttacaatgctaatggccgtggccaccatttggtgagcaggcagttggccctg

SEQ ID NO: 29172 - DNA, 201 bp, Homo sapiens
caactgtttactgagcactgactgcctttatttccagcctccgggtcagtcttcacagcaattcctatgaaggagatgttattcctcctgtttcagagacsagggaactgaggcccagaaaggaaaatctaaatttgtccagaatcagatgggcagatagtgaaaaggcgaggatttcaaacaaactcggtgtctgtgaca

SEQ ID NO: 29173 - DNA, 201 bp, Homo sapiens
tctccagcggctctgtggcctcctacgtcacctctccccagggattccagttccgacgcctgggcacaggtgagcctatcctggtgtctgggatcgcctcytccagactcgtggggtcccctttcagtgtctctgccataggctcccaacttgggcttgcacaccactagaaacagggagctcactactcctgagtctgcc

SEQ ID NO: 29174 - DNA, 201 bp, Homo sapiens
ctgccatacctcctgccatctgcttcctgcagatcgtgggctcccggctgcggatccctcaggtgactccggcagactcgggcgagtacgtgtgtcacgtmagtaacggtgcaggctcccgggagacctcgctcatcgtcaccatccagggcagcggttcctcccacggtgagagcagagagggcagggggtacagacaag

SEQ ID NO: 29175 - DNA, 201 bp, Homo sapiens
tgaggaggcaaggcagggaggcccccagagtccaggggcagcggcagcagtgcccaagatgtggaggagctgcccacacctactgccatacctcctgccayctgcttcctgcagatcgtgggctcccggctgcggatccctcaggtgactccggcagactcgggcgagtacgtgtgtcacgtcagtaacggtgcaggctcc

SEQ ID NO: 29176 - DNA, 201 bp, Homo sapiens
tggatgggtcctagaccagtgctgagaatacagaaataaggctccctgacctcagggagatccacttctgcaccaaatctcactgaaaagctgctccgggycatgtcctgtgcctgacactgaagattccagatggaatgagacagttgcctgctctcaggcagctcgcaggctgtgggagccccagcaggatactgtgtc

SEQ ID NO: 29177 - DNA, 201 bp, Homo sapiens; identical to SEQ ID NO: 5219

SEQ ID NO: 29178 - DNA, 201 bp, Homo sapiens
cagccaaggggagcctaaagaggcatgatgactattaatgaatgtaacatgaggccgggtgcggaggctcacgcctgtaatcccagcactttgggaggccraggcgggtggatcacttgaggtcaggagtttgagaccagcctgtccaacatggagaaatcccgtctctactaaaaatacaaaaattagctgagcgtggtg

SEQ ID NO: 29179 - DNA, 201 bp, Homo sapiens
agggccagcaggtggggagggcaaaagcagggcacaccagcccccaatgggaagaggggggactctcagcacctcactctgtgctcattcagtcattcaamaaacattgagtatccttgctggatgggtcctagaccagtgctgagaatacagaaataaggctccctgacctcagggagatccacttctgcaccaaatctc

SEQ ID NO: 29180 - DNA, 201 bp, Homo sapiens; identical to SEQ ID NO: 5220

SEQ ID NO: 29181 - DNA, 201 bp, Homo sapiens
ccaggctccccacaccatcacctggtataagcgtggaggcagcttacccagccggcaccaggtacagggccagcaggtggggagggcaaaagcagggcacrccagcccccaatgggaagaggggggactctcagcacctcactctgtgctcattcagtcattcaacaaacattgagtatccttgctggatgggtcctagac

SEQ ID NO: 29182 - DNA, 201 bp, Homo sapiens
gacagggacagtgatccagagctgatggccaggccttgggggtcagagtgaggggccaaatgggctcatgctgcctacctcatctcccctgtagcatgtcracaaacactggtccccacttttctctggtgccaagtctcagtcgtccctggcatgggtgaggtgggacgctagacccagtcctgacactggggcggtaga

SEQ ID NO: 29183 - DNA, 201 bp, Homo sapiens
gcgggggcagcctcccggcccggcaccaggtaggaggcaggagctcaggaagcctgaaggaccctgtagctgcagtacaagagcataggcttgaccgggcrcagtggctcacgcctgtaatcccggcactttgggaggccaaggcaggaagatcacgaggtcaggagtttgagaccagcctgaccaacataatgaaacccc

SEQ ID NO: 29184 - DNA, 201 bp, Homo sapiens
ccaccacttagcttgtgacctcggacaagttacttaacctctctgtgctatagtttcagggcctataaaatggtaacaatggtacgtaccagccgggcacrgtggcttacgcctgtaatcccagcactttgggaggccgaggtgggcgaatcgcctgaggtcgggagttcgagaccagcctggccagtatggtgaaacccc

SEQ ID NO: 29185 - DNA, 201 bp, Homo sapiens
tattgggggagggctagaggctcccctgagatcaggaagccctggaccccattgcacagatgtatagtgcagtggttagaaaccagaatctaggactgacyaacctgggtgtgaattctggctccaccacttagcttgtgacctcggacaagttacttaacctctctgtgctatagtttcagggcctataaaatggtaaca

SEQ ID NO: 29186 - DNA, 201 bp, Homo sapiens
caagaatgtgggacggggccatggacagtgggttgcaggatcctggcccctaggctgaggggctggcacttcctagatcggggggacagcggtggggcatytgctggcctccgggaagcccccctcacacctctgcccacggctgcccaggttcgtggctcccgcctgtacatcttccaggcctcacctgccgatgcggga

SEQ ID NO: 29187 - DNA, 201 bp, Homo sapiens
gcagcggttcctcccacggtgagagcagagagggcagggggtacagacaagtggcgcagagggtggcagagaggtccccggtgccatcactgttatctcamtctggctgcgtggtccacacccgtctgtccccagtgcccagcgtctccccaccgatcaggatcgagtcgtcttcccccacggtggtggaagggcagacct

SEQ ID NO: 29188 - DNA, 201 bp, Homo sapiens
gctctctccctgccacctccatcccagcagggtccacgcccaccgtgcaggtcacgcctcagctagagaccaagagcattggggccagcgttgagttccaytgtgctgtgcccagcgaccggggtacccagctccgttggttcaaggaagggggtcagctgcctccgggtcacagcgtgcaggatggggtgctccggtgag

SEQ ID NO: 29189 - DNA, 201 bp, Homo sapiens
caggccctcccggctctctccctgccacctccatcccagcagggtccacgcccaccgtgcaggtcacgcctcagctagagaccaagagcattggggccagygttgagttccactgtgctgtgcccagcgaccggggtacccagctccgttggttcaaggaagggggtcagctgcctccgggtcacagcgtgcaggatgggg

SEQ ID NO: 29190 - DNA, 201 bp, Homo sapiens
gtctcgctgaccctcctctcctgcctgtctccatccccagggagctggatggctgggtttttgtggagctggatgtgggctcggaagggaatgcggatggkgctcagattcaggagatgctgctcagggtcatctccagcggctctgtggcctcctacgtcacctctccccagggattccagttccgacgcctgggcacag

SEQ ID NO: 29191 - DNA, 201 bp, Homo sapiens
gagcctcatggaggagctgagaacacaggtgtctcgctgaccctcctctcctgcctgtctccatccccagggagctggatggctgggtttttgtggagctsgatgtgggctcggaagggaatgcggatggggctcagattcaggagatgctgctcagggtcatctccagcggctctgtggcctcctacgtcacctctcccc

SEQ ID NO: 29192 - DNA, 201 bp, Homo sapiens
caggggctaggccagccactgcccctgcccaggacacagccaggcccaccctgggcccacagatctaaacacagtgggctggaaccctggcgggcgttctyccccatggggtgttgacgggcagagatgggtgcagcagccctgcagggaccaggccctgcattccagaggccacttgtgtccaccccagcacaggccaat

SEQ ID NO: 29193 - DNA, 201 bp, Homo sapiens
tctgtggaatcgggcattcaggcaggcagcagggcatgcagagcacagatcgagcctgacgctaggcttgggagagaaccttgccttaaggtgggtcatcrgctgggaagcaagggttcctagcttagggaggcaaggctaggctcttggagggaggagagtcagcccccaccctggtcagactggcccagcactgggatg

SEQ ID NO: 29194 - DNA, 201 bp, Homo sapiens
ggtgtagcagtgggcacacaggtgtcagcctcgagggaggcctctgggggccatccccccaactctgcctgaatggtccaactgcctaaggccactagatrccaggctggggctctcaaaatgatcctccttcgattttccagtttatttccgagccctggtgaatttcactcgctccatcgagtacagccctcagctgga

SEQ ID NO: 29195 - DNA, 201 bp, Homo sapiens
acaaaacacatgaatagaatttatgtctaaaggagatagatgctagtgagaaaaattacgcatgttggtgggggcagggctgccgcttttcttttcttttytttttttttttttttttttgagacggagtctcgctctgtcgcccaggctggagtgcagtggcaggatctcggctcactgcaagctccgccttccgggttc

SEQ ID NO: 29196 - DNA, 201 bp, Homo sapiens
accggagctggctgcagggccctgcccaggccgactccacctgtcagagtaaccaccgccttcccgtcacactttgctttggccacatgactcctcaggcrtcccctcccacctcctcttcctctctccaactcatctctgccctcatctctctcacttcctcactcccctctgcaaggcgtggcccatgccctggtcctc

SEQ ID NO: 29197 - DNA, 201 bp, Homo sapiens
cccagggctcacagtgagcagagttaaagcacctgccccagggggcgcaacatgaagcactgtccttggacacatcactttacctctctgagcctcagtgktctcagctgtacagtgggttatataagactgaatgaggtccaggcacggtggctcatgcctgtaatcccagcactttgggaggctgaggcgggcagatca

SEQ ID NO: 29198 - DNA, 201 bp, Homo sapiens
gtgagatccaagggacccctcttgctgacagggcagaaggcccacaccggagctggctgcagggccctgcccaggccgactccacctgtcagagtaaccaycgccttcccgtcacactttgctttggccacatgactcctcaggcgtcccctcccacctcctcttcctctctccaactcatctctgccctcatctctctca

SEQ ID NO: 29199 - DNA, 201 bp, Homo sapiens
ccacacgggagcacctgctgatggcactggcaggcatcgacaccctcctgatccgagcatcctacgcccagcagcccgctgagagcaggtgtctggagccrgggcaggaggaccagcatgggcttggggaggggctccatctaagcggtgcagtacagcacagccacttacagactgtgtgacccttttgtgcctcacttt

SEQ ID NO: 29200 - DNA, 201 bp, Homo sapiens
aggatggggtgctccggtgagtggggccgggggcaggactggacttgggcagcatagcccagggctcacagtgagcagagttaaagcacctgccccagggkgcgcaacatgaagcactgtccttggacacatcactttacctctctgagcctcagtgttctcagctgtacagtgggttatataagactgaatgaggtccag

SEQ ID NO: 29201 - DNA, 201 bp, Homo sapiens
agagaggagggggatatgaccaccctgccccatctgcaggagcctgaagatccagctcaagtgccatcctgccagtggcccccagactgtggggttgggaygcctggcctctgtgtcctagaagggaccctcctgtggtctttgtcttgatttttcttaataaacggtgctatccccgccaggggcctcctgagtctttga

SEQ ID NO: 29202 - DNA, 201 bp, Homo sapiens
acccctagacccctcctctccagctgcccgtctggctccaacacatgcctgaagtgctgggttcctctgggaggaagccgggctccctcaccgccggagaygggctggagggcaggaaacctgggttctatttctgaccttggagctgctaatggccctccttgggacctgaggcacatgctgcacagtcccaggccactg

SEQ ID NO: 29203 - DNA, 201 bp, Homo sapiens
ccaccccatttgcacacagacccacggctcgctgctgcggctgcaccaggtgaccccggccgactcaggcgagtatgtgtgccatgtggtgggcacctccrgccccctagaggcctcagtcctggtcaccatcgaagcctctgtcatccctggtgagtgactcccagtgacatggaaagctggaggaggcagagaggcctc

SEQ ID NO: 29204 - DNA, 201 bp, Homo sapiens
agttgggcttggggacattccttgtcctggggactttgccctgataactgtcccctcgctgctctgacagacccatggctcccagctgcggctccacctcrtctcccctgccgactcaggcgagtatgtgtgtcgtgcagccagcggcccaggccctgagcaagaagcctccttcacagtcaccgtcccgcccagtgaggg

SEQ ID NO: 29205 - DNA, 201 bp, Homo sapiens
cccggcccatccgcatcgagccctcctcctcacacgtggcggaagggcagaccctggatctgaactgcgtggtgcccgggcaggcccacgcccaggtcacrtggcacaagcgtgggggcagcctccctgcccggcaccaggtatggcagccccccgggaccaccttgctggaggggctggatgggactgttccagccccct

SEQ ID NO: 29206 - DNA, 201 bp, Homo sapiens
taggagctcccaaggaagatgcctgtggcttcttcagtgggaccaggacaggggggcattccaggcaggctttgacccttcagcgcctgctcagagagagraggaggttgagtggacgggagggaggttaaggctggtccagcttacctgggctccctatgagtgactgtttcagaatttgtcaggaagcagcagaatgtc

SEQ ID NO: 29207 - DNA, 201 bp, Homo sapiens
gctgacgccggcttctacctctgcgtggccaccagccctgcaggcactgcccaggcccggatccaagtggttgtcctttcaggtacggactctctgggaayggaggggtggggagggcaagccagggctcccctggggcctgctgacccctactctggccccagcctcagatgccagcccaccgccggtcaagattgagtc

SEQ ID NO: 29208 - DNA, 201 bp, Homo sapiens
tgggggccgggagtgtgctcagcccagggcgtgttctcacaggactctgtctgcagggggcggtgggcccagagtccaagtgagcccagagaggacccagrtccacgcaggccgcaccgtcaggctgtactgcagggctgcaggcgtgcctagcgccaccatcacctggaggaaggaagggggcagcctcccaccacaggt

SEQ ID NO: 29209 - DNA, 201 bp, Homo sapiens
agcggagccagagcgtgcgccccggagctgacgtcaccttcatctgcacagccaaaagcaaggtgtgcaggtcagggagtggggatggaggaagtctgtcytctggggtctctgagccccacccatgaccccctttcgccttgccctgcagtccccagcctataccctggtgtggacccgcctgcacaacgggaaactgcc

SEQ ID NO: 29210 - DNA, 201 bp, Homo sapiens
gggctttcagggcagcctccctgctgggaagtcacataagggcagagaaatagcccttggaggtcatgctttgacaagagcggttttcagtggagagaagrgatagaaaccagattggaaggaggcgacacatgggtgggaaggcagcgagtgtggacaactcctgcaagagtcttggctctgaagggaggccaggaagtg

SEQ ID NO: 29211 - DNA, 201 bp, Homo sapiens
tgggtcacggggagggacgacaagacagggacaggaacgggaacagccccagggctgggactgcaggaagtggtgacatccctcctctgggacccctctayccaactgggcccctagcccttcttacaaaccccctatccactctctcctgccccggcctgccccacggagcaggttcgatgcaggctcaggcatggccac

SEQ ID NO: 29212 - DNA, 201 bp, Homo sapiens
cctcactctgtgctcattcagtcattcaacaaacattgagtatccttgctggatgggtcctagaccagtgctgagaatacagaaataaggctccctgacckcagggagatccacttctgcaccaaatctcactgaaaagctgctccgggccatgtcctgtgcctgacactgaagattccagatggaatgagacagttgcct

SEQ ID NO: 29213 - DNA, 201 bp, Homo sapiens
catgggtgaggtgggacgctagacccagtcctgacactggggcggtagataggaagggagaaggtggttttccctggaagagtttccatcgagttccagcwggctgggctgggagtggcaccagggaagggaacaggagcttggcgtgagccgcagtgcccagctctgagcctgcctcctccctcctgaccctcccaggtg

SEQ ID NO: 29214 - DNA, 201 bp, Homo sapiens
cagctctgagcctgcctcctccctcctgaccctcccaggtgcatggctcgaggctacgcctgctccaggtgaccccagctgattcaggggagtacgtgtgycgtgtggtcggcagctcaggtacccaggaagcctcagtccttgtcaccatccagcagcgccttagtggctcccactgtgagtgtctcgggggtcatgcaa

SEQ ID NO: 29215 - DNA, 201 bp, Homo sapiens
gcccggggcatggtgtttggcattcctgacggtgtccttgagctcgtcccacaacgaggtactgccggagggcaggtgtcaccgggtgtgggggcggagcygggctgcccaccacagccggctgcagcccccgcccatgccgcccagcaggcccctgccctgacggccacttctacctggagcacagcgccgcctgcctgc

SEQ ID NO: 29216 - DNA, 201 bp, Homo sapiens
gcctgtaaggcaggatttggggggtggtaactgtaggagcagcccacaaagcccactgcccccgcccacgttgccacccccaacccaggaattctggcgcyggcccgatgggcagccggccacacgcgagcacctcctgatggcactggccgacctggatgagctcctgatccgggccacgttctcctccgtgccgctggc

SEQ ID NO: 29217 - DNA, 201 bp, Homo sapiens
gaactgagaaatgtcctgtttcccaggcaaccatgcaccctggcctcttggtttgggcagggaggggggtgggggagtgtggcacaggtgcaaaaaggccrccagatgctccatccctcacctatatggtccaacactcacaccccaaggtcagcctgtgacctctgggcttgcctctttgcaggtggcggcctacggtgg

SEQ ID NO: 29218 - DNA, 201 bp, Homo sapiens
ctccacccactttgcccctggggacttccaaggctttgccctggtgaacccacagcgaaacagccgcctgacaggagaattcactgtggaacccgtgcccragggtgcccagctctcttttggcaactttgcccaactcggccatgagtccttctactggcagctgccggagacataccagggagacaaggtgggccccag

SEQ ID NO: 29219 - DNA, 201 bp, Homo sapiens
aagggcaggggggctcctgtgccactgcagctggtgccaactggtcctgagcctctgggcctggagagtgaggcaggcaagggtcccagaggaaggcagartagctggaccccacccgagggtccaggatccccactgcctcagctgagctgtggctgctgcaggtgtgacagtgaccaccccctcgctgtcgggtgctgg

SEQ ID NO: 29220 - DNA, 201 bp, Homo sapiens
gatcacccagggcccttcctcaccatggccaccctctgcgggtccctgaggtagcccagtgacttctgtcatcttccactcgactccacaggcagccccgygcccaccatccactggtccaagctgcgttccccactgccctggcagcaccggctggaaggtgacacactcatcataccccgggtagcccagcaggactcg

SEQ ID NO: 29221 - DNA, 201 bp, Homo sapiens
tacggggagaccgtgttgctagcatcccccagtgatggccgaggaacccaactggggtccccatagagggacaggatcacccagggcccttcctcaccatrgccaccctctgcgggtccctgaggtagcccagtgacttctgtcatcttccactcgactccacaggcagccccgcgcccaccatccactggtccaagctgc

SEQ ID NO: 29222 - DNA, 201 bp, Homo sapiens
ccaagccagagctggggctgacatcagcgtccccactgagtccccacataaccagcctccttgctttctcccagatttcatcagctaaaccatcagatgcrggcacttatgtgtgccttgctcagaatgcactaggcacagcacagaagcaggtggaggtgatcgtggacacgggcgccatggccccaggggcccctcagg

SEQ ID NO: 29223 - DNA, 201 bp, Homo sapiens
accagcctgggcaacatggtgaaaccccgtctctactaaaatacaaaaaaaaaaaaaaaattagccaggcacggtggcgcacctgtagtctcagctactcrggaggctgaggcaggagaatcgcttgaacccgggaggtggacgttgcagtgagctgagatcgtgccactgcactccagcctgggaacagagcgagactcc

SEQ ID NO: 29224 - DNA, 201 bp, Homo sapiens
gtggctcacgcctgtaatcctagcaccttgggaggccgaggcaggcagattgcctgagctcaggagtttgagaccagcctgggcaacatggtgaaaccccrtctctactaaaatacaaaaaaaaaaaaaaaattagccaggcacggtggcgcacctgtagtctcagctactcgggaggctgaggcaggagaatcgcttgaa

SEQ ID NO: 29225 - DNA, 201 bp, Homo sapiens
tgccactgcactccaacctgtgcgacagagtaagaccctgtctcaaaaaataaatatataaataagtaaataaatagataccaaggcagggtagaggaaayagggaagaccaagccagagctggggctgacatcagcgtccccactgagtccccacataaccagcctccttgctttctcccagatttcatcagctaaacca

SEQ ID NO: 29226 - DNA, 201 bp, Homo sapiens
gagaggattgcttgagcccaggaggcagaggttgcaatgagccagatggtgccactgcactccaacctgtgcgacagagtaagaccctgtctcaaaaaatraatatataaataagtaaataaatagataccaaggcagggtagaggaaatagggaagaccaagccagagctggggctgacatcagcgtccccactgagtcc

SEQ ID NO: 29227 - DNA, 201 bp, Homo sapiens; identical to SEQ ID NO: 5272

SEQ ID NO: 29228 - DNA, 201 bp, Homo sapiens
acaaggagcaggtgaggagccatctgcttctgccaaatgccaagcggaatctatccacagaggagccagtcctgggtatcagccccacattctctctcctygtggagacgacatctttaccgccccggccagagacaaccatcatgcgacagccaccagtcacccacgctcctcagcccctgcttcccggttccgtcaggc

SEQ ID NO: 29229 - DNA, 201 bp, Homo sapiens
ctcggctcttcaagccccagggaggcatgggaggataaatgcagggatcagggcaagtcccctcttcctgtgcatttcgtctctgtgtcacttgaggccartccctagccctctctgagccatgggctcctcatctggaatacagaaggctgtagggcattccccatctgctcagggccctgtttgtggtggagagggcag

SEQ ID NO: 29230 - DNA, 201 bp, Homo sapiens
gctctgagcctgcctcctccctcctgaccctcccaggtgcatggctcgaggctacgcctgctccaggtgaccccagctgattcaggggagtacgtgtgccrtgtggtcggcagctcaggtacccaggaagcctcagtccttgtcaccatccagcagcgccttagtggctcccactgtgagtgtctcgggggtcatgcaaat

SEQ ID NO: 29231 - DNA, 201 bp, Homo sapiens
tcctgaccctcccaggtgcatggctcgaggctacgcctgctccaggtgaccccagctgattcaggggagtacgtgtgccgtgtggtcggcagctcaggtayccaggaagcctcagtccttgtcaccatccagcagcgccttagtggctcccactgtgagtgtctcgggggtcatgcaaatggtggagggctgggggacccc

SEQ ID NO: 29232 - DNA, 201 bp, Homo sapiens
cactgccctggcagcaccggctggaaggtgacacactcatcataccccgggtagcccagcaggactcgggccagtacatctgcaatgccactagccctgcygggcacgctgaggccaccatcatcctgcacgtggagagtaaggcctcatcccttctttgtctgcaccaaatggagatctgagccccccgactaggctcca

SEQ ID NO: 29233 - DNA, 201 bp, Homo sapiens
tgggaggccccccactcttgcaacggcaggatcaggaggccaagccgcagactgcacctgccttgagaccaggagccccatctcatctcacctcctagccrgctattgaccctttgccctctgtccccagcacttggggtcacccccacggtccggatcgagtcatcgtcttcgcaagtggccgaggggcagaccctggac

SEQ ID NO: 29234 - DNA, 201 bp, Homo sapiens
gtggcgtgatctcagctcactacaacctccacctcccaggttgaagcgattctcctgcctcagcctcccgagtagctgggactatgcgcgcctgccaccayacccggctaattttttgtatttttagtagagacggggtttcactgtgttagccaggatggtctcgatctcctgacctcgtgatccgcccgccttggcctc

SEQ ID NO: 29235 - DNA, 201 bp, Homo sapiens
cacctcctaaccacccacctgcctgtttcaccagctcctccccggcctcctgtttctgacctggctgcacacatgcctggcccaccatgacccctccctcrgggggcacccccacagtcacggtaccccacactgctactcggctgaggaactgcccctcggccaggcccccccacacctgctggctcgaggtgccaagtg

SEQ ID NO: 29236 - DNA, 201 bp, Homo sapiens
gcaggacccagggccagggaaaggtgttttcacaaagcacagaccatagagcaggtgaacagggaaacctctgctcttccgtgcagtgaaggactccacgsgccaagttaacagaccctcaccagaaagcatgaaggcatccccagtgtttaaaggttacaaaggctaaatagctaaaatatatgtggacttcctgcaact

SEQ ID NO: 29237 - DNA, 201 bp, Homo sapiens
agcaggtgaacagggaaacctctgctcttccgtgcagtgaaggactccacgcgccaagttaacagaccctcaccagaaagcatgaaggcatccccagtgtytaaaggttacaaaggctaaatagctaaaatatatgtggacttcctgcaacttaagaaaaagacaatcaggccgggcgcggtggctcacgcctgtaatccc

SEQ ID NO: 29238 - DNA, 201 bp, Homo sapiens
gagcccaggtctcctggctcccagctgggtgccctcagtccgtctacttcctgtagggagtgcggggcaggcagggtgagtctcacggggcagctctgggragagctgtctgaactgacccaccgacttcttggccgctgactcgaagcaggcggtcactttcctgggcacaggacaggctgcagggccccgtcctccagc

SEQ ID NO: 29239 - DNA, 201 bp, Homo sapiens
gttgaatcagcaaggtgctgacggatacgcaagcagaaaccctcttataggaggttcaaggctgggcgcagtggctcactcctgtaatcccagcactttgkgaggccaaggcgagcagatcacttgaggtcaggagcctcagaccagcctggccgatatggcaaaaccctgtctgtactaaaaatacaaaaattagccagg

SEQ ID NO: 29240 - DNA, 201 bp, Homo sapiens
tgcagttcttttttttttttttgaggagtctcgctctggcccaggctggagtgcaatggtgcgatctcggctcactgcaagctccgcctcccgggttcacrccattctcctgcctcagcctcctgagtagctgggactacaggcgcccgccaccacgcccggctaattttttgtatttttagtagagacggggtttcaccg

SEQ ID NO: 29241 - DNA, 201 bp, Homo sapiens
cagcatcagtgtgggggcaaacaaggccacatccgccaccagcttcaccccagcttctacggaaaagaggcgcagggtagaggctcaccacgtggctccgrccctgttcccttttcacttaacgccagcggcctcctctggaatccaagccccttagggaggcgttaggtgtggagggcctgcagggcctgcaggagctgt

SEQ ID NO: 29242 - DNA, 201 bp, Homo sapiens
gtagggagtgcggggcaggcagggtgagtctcacggggcagctctggggagagctgtctgaactgacccaccgacttcttggccgctgactcgaagcaggmggtcactttcctgggcacaggacaggctgcagggccccgtcctccagccctcccaccctgaggtctctgctcccactccagctgccacgcaccctccaga

SEQ ID NO: 29243 - DNA, 201 bp, Homo sapiens
tgttgcccaggctggagtgcagtgtggtatgacttcagctcactgccacccccaccttctgagttcaagcgatcctcccagctcagcttcccagtacaggygtgcaccaccacacccaactcatatttgtatttttagtggaggcggggtttcgccatgttggccaggttggtctcgaactcctgagctcaagtgatcctc

SEQ ID NO: 29244 - DNA, 201 bp, Homo sapiens
tcattcaacacatttattgagtttcttttctttcttgaaaaagggtctcgctctgttgcccaggctggagtgcagtgtggtatgacttcagctcactgccwcccccaccttctgagttcaagcgatcctcccagctcagcttcccagtacaggcgtgcaccaccacacccaactcatatttgtatttttagtggaggcggg

SEQ ID NO: 29245 - DNA, 201 bp, Homo sapiens
tagagggggtgcgggacggggactcacaggagatgcaggacggcccgaacatagtaattcctggtaaagggcccgaacagcttcaccacggcggtcatgtrcttctgtcccctgggggagggaggaaggcgagacggcgcggctgggcctctcccactcgggactcctttgctgccctgctgaccaccccagggcacccag

SEQ ID NO: 29246 - DNA, 201 bp, Homo sapiens
caacattcaatgcgacattctcccgttcagccctggtccaggccagccatggacccaattctggggtgtccttccagaaaggtctacgcagccgcgagcartgcatgcaggtgggactgagctgtagcacgggggggtcacaggtgtccctgctctgcccacacagtgtctcccctgaggacacccctgggaacaggaacc

SEQ ID NO: 29247 - DNA, 201 bp, Homo sapiens
tgaacagggaaacctctgctcttccgtgcagtgaaggactccacgcgccaagttaacagaccctcaccagaaagcatgaaggcatccccagtgtttaaagkttacaaaggctaaatagctaaaatatatgtggacttcctgcaacttaagaaaaagacaatcaggccgggcgcggtggctcacgcctgtaatcccagcact

SEQ ID NO: 29248 - DNA, 201 bp, Homo sapiens
cggccttggtttacccacaagcaccaaagggttggttccggagcctccaagtgagaaaccaagctccacccaaccctgtgagccctgcctgggccccgcarcccccggagagaccccagagcaggaggagactcaccagcgctccatggtggagcccttcttcctcttcccccgggggtactccagcaggcacacaaacac

SEQ ID NO: 29249 - DNA, 201 bp, Homo sapiens
acacgtgtgctccccagagggcaccccctatttatgtgtatttattgttatttatatgcctcccccaacactacccttggggtctgggcattccccgtgtytggaggacagccccccactgttctcctcatctccagcctcagtagttgggggtagaaggagctcagcacctcttccagcccttaaagctgcagaaaaggt

SEQ ID NO: 29250 - DNA, 201 bp, Homo sapiens
gcctcccactgtcctaggtggccagggtcccctggggaaattctgggcccgtcacctgagctcctgcagaagtggggctgggtgatgaagtggaagggagkctcctagaggcctccggaccctgctctgtgctcttggagggccctggggagacgtggattaccaccacatgtgagcccgactgcaccccaagcccgtgtg

SEQ ID NO: 29251 - DNA, 201 bp, Homo sapiens
gggttggttccggagcctccaagtgagaaaccaagctccacccaaccctgtgagccctgcctgggccccgcaacccccggagagaccccagagcaggaggrgactcaccagcgctccatggtggagcccttcttcctcttcccccgggggtactccagcaggcacacaaacacgcccgccacactgaagccatgtggttaa

SEQ ID NO: 29252 - DNA, 201 bp, Homo sapiens
cggctccaagccctcctgagccctagagggggtgcgggacggggactcacaggagatgcaggacggcccgaacatagtaattcctggtaaagggcccgaasagcttcaccacggcggtcatgtacttctgtcccctgggggagggaggaaggcgagacggcgcggctgggcctctcccactcgggactcctttgctgccct

SEQ ID NO: 29253 - DNA, 201 bp, Homo sapiens
gccctgactgcccggagagctctctgggccttggcggttctcacctgtcaagtgggcgtggccacctgagctccctccctccggccctcctgacctggackgctgagctgctgcttgcggctggccgtgccctgcctcccactgtcctaggtggccagggtcccctggggaaattctgggcccgtcacctgagctcctgca

SEQ ID NO: 29254 - DNA, 201 bp, Homo sapiens
ctccacttccatacgcggaaggcgtacacagaaagtgctgcacctttcccacgcacacacactagaagacgcacagcaaggggagggcagttgcctctgckggcaggagggacttggctctatggacaaaaggatttaaataagcaaagtctgagggctctgtccacccagagacccccgcagtgagaggtggcctgcagc

SEQ ID NO: 29255 - DNA, 201 bp, Homo sapiens
ggcagcccggccggtgggacagtggggagggtcggctccaagccctcctgagccctagagggggtgcgggacggggactcacaggagatgcaggacggccygaacatagtaattcctggtaaagggcccgaacagcttcaccacggcggtcatgtacttctgtcccctgggggagggaggaaggcgagacggcgcggctgg

SEQ ID NO: 29256 - DNA, 201 bp, Homo sapiens
ggctcctgtccaggcagcccggccggtgggacagtggggagggtcggctccaagccctcctgagccctagagggggtgcgggacggggactcacaggagaygcaggacggcccgaacatagtaattcctggtaaagggcccgaacagcttcaccacggcggtcatgtacttctgtcccctgggggagggaggaaggcgaga

SEQ ID NO: 29257 - DNA, 201 bp, Homo sapiens
cctgagccctagagggggtgcgggacggggactcacaggagatgcaggacggcccgaacatagtaattcctggtaaagggcccgaacagcttcaccacggyggtcatgtacttctgtcccctgggggagggaggaaggcgagacggcgcggctgggcctctcccactcgggactcctttgctgccctgctgaccaccccag

SEQ ID NO: 29258 - DNA, 201 bp, Homo sapiens
aggcaagtctctgaggatgaactgcagggctgtcggctcaaggcagggcccccagccttcgtggttcggatcaacatccaaggccaagcgccctccctgawggtgaactagccacgcttcgggacccaggctctgttggagattttagttaaggggccccggggggagcagccccagtcgtggaaagggggcccaggcctg

SEQ ID NO: 29259 - DNA, 201 bp, Homo sapiens
gcagcccggccggtgggacagtggggagggtcggctccaagccctcctgagccctagagggggtgcgggacggggactcacaggagatgcaggacggcccraacatagtaattcctggtaaagggcccgaacagcttcaccacggcggtcatgtacttctgtcccctgggggagggaggaaggcgagacggcgcggctggg

SEQ ID NO: 29260 - DNA, 201 bp, Homo sapiens
tgtagtctgtgagtgagtccaggacagaggctctgggggaggggctgcagttcttttttttttttttgaggagtctcgctctggcccaggctggagtgcartggtgcgatctcggctcactgcaagctccgcctcccgggttcacgccattctcctgcctcagcctcctgagtagctgggactacaggcgcccgccaccac

SEQ ID NO: 29261 - DNA, 201 bp, Homo sapiens
aagctgagcttgtagtgagccgagatcgcaccactgtactccccgcctgggcgacagagtcagactccgcctcaaaaaaacaacaaaaaaaaaaacaacacagaaacccaacagagacctgaagacgtgcctgcctcccccatctccgggacctctcccacctgggtgaagggggcacgtgagcctcacctgatcttgacc

SEQ ID NO: 29262 - DNA, 201 bp, Homo sapiens
gaagctgagcttgtagtgagccgagatcgcaccactgtactccccgcctgggcgacagagtcagactccgcctcaaaaaaacaacaaaaaaaaaaacaacmcagaaacccaacagagacctgaagacgtgcctgcctcccccatctccgggacctctcccacctgggtgaagggggcacgtgagcctcacctgatcttgac

SEQ ID NO: 29263 - DNA, 201 bp, Homo sapiens
gggaatccgcccgccttggcctcccagagtgttgggattacaggcatgagccacggcgcctggtccttcctactattttatttctttttttttttttttttggagacagagtcttgccctgtcacccaggctggagttccgtggcgtgatctcagctcactacaacctccacctcccaggttgaagcgattctcctgcctc

SEQ ID NO: 29264 - DNA, 201 bp, Homo sapiens
tggtgaagagcagagcctgtggcgcacgggctggcggagggggtgctggacatgcccgggctctgggtcccaggagtggccaaggacagcccgacctgcargccccagtgggctctgggacccccaaatggacccccttgtcaccatgagtctttgtttgatgcactgaaagctaacaggccgagtgtggtttctgcatct

SEQ ID NO: 29265 - DNA, 201 bp, Homo sapiens; identical to SEQ ID NO: 5436

SEQ ID NO: 29266 - DNA, 201 bp, Homo sapiens
ggctagcctctctgggcttcagtttccccatctatagagggagggctgtactccatctttccgctgggaacaaggaaagctgaggtggaagtgaggtgccycctgccctgggcacctcctaaccacccacctgcctgtttcaccagctcctccccggcctcctgtttctgacctggctgcacacatgcctggcccaccatg

SEQ ID NO: 29267 - DNA, 201 bp, Homo sapiens
ggacacagaagggcactcagaaaggggaacggagccccaggtctgggggccaaggccacaaagtctcaggacaaggcagactgcagacccaggggacgtgygcggaccggggcttgtttcggtcctgggtgttctcagccttgatgtggacactagcggctctggtgcacttgctcggaggaagcagccacgtgtgggtgt

SEQ ID NO: 29268 - DNA, 201 bp, Homo sapiens
cagaaaccctcttataggaggttcaaggctgggcgcagtggctcactcctgtaatcccagcactttgggaggccaaggcgagcagatcacttgaggtcagsagcctcagaccagcctggccgatatggcaaaaccctgtctgtactaaaaatacaaaaattagccaggcatggtggggggtgcctgtaatcccagctactc

SEQ ID NO: 29269 - DNA, 201 bp, Homo sapiens
gaggggggtaacaggacagcgcctcccggggcctccttgcatgtctgtgtcctgatgcacagcaggcgggggctgcggggaccagagaaggaagaagcgcmccagctgggcacttcccgaggaggaagtggtgccggaatttcccccaggtgtggcctcaggtataagagcggctgctgccaggtgcatggccaggtgcac

SEQ ID NO: 29270 - DNA, 201 bp, Homo sapiens
ccaggtctgggggccaaggccacaaagtctcaggacaaggcagactgcagacccaggggacgtgcgcggaccggggcttgtttcggtcctgggtgttctcrgccttgatgtggacactagcggctctggtgcacttgctcggaggaagcagccacgtgtgggtgtcctggcctcagccggcagtaaccagcagacacacag

SEQ ID NO: 29271 - DNA, 201 bp, Homo sapiens
ccaaggccacaaagtctcaggacaaggcagactgcagacccaggggacgtgcgcggaccggggcttgtttcggtcctgggtgttctcagccttgatgtggmcactagcggctctggtgcacttgctcggaggaagcagccacgtgtgggtgtcctggcctcagccggcagtaaccagcagacacacagcacggaaccctcc

SEQ ID NO: 29272 - DNA, 201 bp, Homo sapiens
acggatacgcaagcagaaaccctcttataggaggttcaaggctgggcgcagtggctcactcctgtaatcccagcactttgggaggccaaggcgagcagatsacttgaggtcaggagcctcagaccagcctggccgatatggcaaaaccctgtctgtactaaaaatacaaaaattagccaggcatggtggggggtgcctgta

SEQ ID NO: 29273 - DNA, 201 bp, Homo sapiens
cagcagacggagaagaactgtatagggtgcaaaagcgccccgccaccatcaggtccagatgaaaacctacaagttgaatcagcaaggtgctgacggatacrcaagcagaaaccctcttataggaggttcaaggctgggcgcagtggctcactcctgtaatcccagcactttgggaggccaaggcgagcagatcacttgagg

SEQ ID NO: 29274 - DNA, 201 bp, Homo sapiens
ccaccagcagcagacggagaagaactgtatagggtgcaaaagcgccccgccaccatcaggtccagatgaaaacctacaagttgaatcagcaaggtgctgasggatacgcaagcagaaaccctcttataggaggttcaaggctgggcgcagtggctcactcctgtaatcccagcactttgggaggccaaggcgagcagatca

SEQ ID NO: 29275 - DNA, 201 bp, Homo sapiens
acgtgagcctcacctgatcttgaccatctcagctaaaacactgaaccacccttggcacccaccagcagcagacggagaagaactgtatagggtgcaaaagygccccgccaccatcaggtccagatgaaaacctacaagttgaatcagcaaggtgctgacggatacgcaagcagaaaccctcttataggaggttcaaggctg

SEQ ID NO: 29276 - DNA, 201 bp, Homo sapiens
gcgggcgcctgtagtcccagctacccggcaggctgaggcaggagaatggcgtgaacccaggaagctgagcttgtagtgagccgagatcgcaccactgtacyccccgcctgggcgacagagtcagactccgcctcaaaaaaacaacaaaaaaaaaaacaacacagaaacccaacagagacctgaagacgtgcctgcctcccc

SEQ ID NO: 29277 - DNA, 201 bp, Homo sapiens
gagctcctcggatttggagtggatccttacaaatcctgcacactagacagcagacacaggccctgccagagccagggacccgaatttttgtttggaaaaayactgaggtaagtgggggtggctcctgtccaggcagcccggccggtgggacagtggggagggtcggctccaagccctcctgagccctagagggggtgcggg

SEQ ID NO: 29278 - DNA, 201 bp, Homo sapiens
acacagaagggcactcagaaaggggaacggagccccaggtctgggggccaaggccacaaagtctcaggacaaggcagactgcagacccaggggacgtgcgyggaccggggcttgtttcggtcctgggtgttctcagccttgatgtggacactagcggctctggtgcacttgctcggaggaagcagccacgtgtgggtgtcc

SEQ ID NO: 29279 - DNA, 201 bp, Homo sapiens
cacagcacctccctgagcctccgcatctttgtctgtaaagtggggaccccagtacccctcccagggctgtggtgcgggttaatgaggaaatgcaaggaaaygacccgacacactagacacgccaaaaatggcagcagcaaccgctgcgtccccgccgtgctgtgagcacacgcccaggctcacacttgctcccagccttgg

SEQ ID NO: 29280 - DNA, 201 bp, Homo sapiens
ccctccagctcgggtgacagcaagaccctgtctcaaaaaaaaaaaaaaagtttgagaatgtcagacaaggcagcaccctgtgtaggtgctcaggttgggcrgagtctctctcgggggaggggggtaacaggacagcgcctcccggggcctccttgcatgtctgtgtcctgatgcacagcaggcgggggctgcggggaccag

SEQ ID NO: 29281 - DNA, 201 bp, Homo sapiens
ggtcaccgggatggggttgacctggggacctcccgggggtccccccgccgccgccgcagcctcctcctcgctgggcttcttgcgggcctcggccgggggcygcggcggggggttgctgggcggctgcttgatggtgcctccgatctgcggccgctcccggggcttgggctcgatgggcgtccactgctcgccacgcacagc

SEQ ID NO: 29282 - DNA, 201 bp, Homo sapiens
cgggatggggttgacctggggacctcccgggggtccccccgccgccgccgcagcctcctcctcgctgggcttcttgcgggcctcggccgggggccgcggckgggggttgctgggcggctgcttgatggtgcctccgatctgcggccgctcccggggcttgggctcgatgggcgtccactgctcgccacgcacagccgcctg

SEQ ID NO: 29283 - DNA, 201 bp, Homo sapiens
ttcaagggccatgcgtgtccgagggtgtcagggcaggggctggggatgggggtggccggggccgacctcagagggcgccactcaccagtaggtagatgcckctcgcaatggccaggcaggcggtcccaaggatggtggccagcaggaagccggcgggcaccgagagcctgggggacagcgggtgagaggcagggacacaga

SEQ ID NO: 29284 - DNA, 201 bp, Homo sapiens
cacacggccagctcgtgctgtgaaactggcaagcgtgggagaaagcctagtgcatggtgggagagatggggccacatggctggtggtgggttgtctgctgrggagcagctgagcccggcagggtgaacggtgcagaggctgatgcctgacccagcaattcctctctgggtttagcacaaggaattcctcccgaggtctcca

SEQ ID NO: 29285 - DNA, 201 bp, Homo sapiens
taggcaccaaagtaccactgggtgaagcgcccagctgtggccacgatgcccccggtgatgaggactgcggggagaagtgggtcaggcactgtggggctccygtcccgggggcctgggccaccccccttctctacctactgtgggccaccaggccacccagagctgccccctacccatccccacagcacagtgacagggtcg

SEQ ID NO: 29286 - DNA, 201 bp, Homo sapiens
gccctcctgacctggacggctgagctgctgcttgcggctggccgtgccctgcctcccactgtcctaggtggccagggtcccctggggaaattctgggcccktcacctgagctcctgcagaagtggggctgggtgatgaagtggaagggaggctcctagaggcctccggaccctgctctgtgctcttggagggccctgggga

SEQ ID NO: 29287 - DNA, 201 bp, Homo sapiens
tgggggtgcagatcatgtctgccctggggccatcagaagcttgtggctgtcactggaggtagctgagcctgtgggttctgagcctgcggattctgagccgsaggcactggggtgaggctttgggtttcaatggcagcatcaggatggtttcaggggatgagggcagagcgggaggcggcaggtggcctgggtggggatggc

SEQ ID NO: 29288 - DNA, 201 bp, Homo sapiens
cggcggggggttgctgggcggctgcttgatggtgcctccgatctgcggccgctcccggggcttgggctcgatgggcgtccactgctcgccacgcacagccrcctgcggggcactgaagggttgagccgcgccccagcgcccgccctccctccctccctccctccccggaggcccaccccgctaggggccctgggacaggct

SEQ ID NO: 29289 - DNA, 201 bp, Homo sapiens
ggctccccacacctggggcctttgccttccacaccgagttcatccacgtccccgtcggctgcacctgcgtgctgccccgttcagtgtgaccgccgaggccrtggggcccctagactggacacgtgtgctccccagagggcaccccctatttatgtgtatttattgttatttatatgcctcccccaacactacccttggggt

SEQ ID NO: 29290 - DNA, 201 bp, Homo sapiens
gctcccgcgacggctcggggctccccacacctggggcctttgccttccacaccgagttcatccacgtccccgtcggctgcacctgcgtgctgccccgttcrgtgtgaccgccgaggccgtggggcccctagactggacacgtgtgctccccagagggcaccccctatttatgtgtatttattgttatttatatgcctcccc

SEQ ID NO: 29291 - DNA, 201 bp, Homo sapiens
cccgggttcacgccattctcctgcctcagcctcctgagtagctgggactacaggcgcccgccaccacgcccggctaattttttgtatttttagtagagackgggtttcaccgtgttagccaggatggtctcgatctcctgacctcatgatctgcccgcctcggcctcccaaagtgctgggattacaggcgtgagccaccgc

SEQ ID NO: 29292 - DNA, 201 bp, Homo sapiens
gagggtcagggaggcctcgaagacctgaaggggaggaggaaggagccaggcagccatgcagggaacagctccaggcagcaggaagagcccatgcaaaggcyctgagaagacacatgctgcgtgtgtccaagggtcagagagtggcctgcgtggctgatgccaggtgagagggggaccgcaggggcagggcagggcgctggg

SEQ ID NO: 29293 - DNA, 201 bp, Homo sapiens
aaggccacaaagtctcaggacaaggcagactgcagacccaggggacgtgcgcggaccggggcttgtttcggtcctgggtgttctcagccttgatgtggacrctagcggctctggtgcacttgctcggaggaagcagccacgtgtgggtgtcctggcctcagccggcagtaaccagcagacacacagcacggaaccctccac

SEQ ID NO: 29294 - DNA, 201 bp, Homo sapiens
cagactgcagacccaggggacgtgcgcggaccggggcttgtttcggtcctgggtgttctcagccttgatgtggacactagcggctctggtgcacttgctcrgaggaagcagccacgtgtgggtgtcctggcctcagccggcagtaaccagcagacacacagcacggaaccctccaccctaccaggaagcccaggcaagacc

SEQ ID NO: 29295 - DNA, 201 bp, Homo sapiens
ttttttgtatttttagtagagacggggtttcactgtgttagccaggatggtctcgatctcctgacctcgtgatccgcccgccttggcctcccaaagtgctrggattacaggtgtagccaccttgccctgccagccattctgtttttgtctccacatggtcttgttggaagatttcctatccttggtttgagcccagctaca

SEQ ID NO: 29296 - DNA, 201 bp, Homo sapiens
attttttgtatttttagtagagacggggtttcactgtgttagccaggatggtctcgatctcctgacctcgtgatccgcccgccttggcctcccaaagtgcyaggattacaggtgtagccaccttgccctgccagccattctgtttttgtctccacatggtcttgttggaagatttcctatccttggtttgagcccagctac

SEQ ID NO: 29297 - DNA, 201 bp, Homo sapiens
ccctggagataccggtgaggacctggggattccgctgtggcgtggggctgcccctcccctggcggggccctgactgcccggagagctctctgggccttggyggttctcacctgtcaagtgggcgtggccacctgagctccctccctccggccctcctgacctggacggctgagctgctgcttgcggctggccgtgccctgc

SEQ ID NO: 29298 - DNA, 201 bp, Homo sapiens
cggatgaggaccgctatccacagaagctggccttcgccgagtgcctgtgcagaggctgtatcgatgcacggacgggccgcgagacagctgcgctcaactcygtgcggctgctccagagcctgctggtgctgcgccgccggccctgctcccgcgacggctcggggctccccacacctggggcctttgccttccacaccgagt

SEQ ID NO: 29299 - DNA, 201 bp, Homo sapiens
ttctcacctgtcaagtgggcgtggccacctgagctccctccctccggccctcctgacctggacggctgagctgctgcttgcggctggccgtgccctgcctsccactgtcctaggtggccagggtcccctggggaaattctgggcccgtcacctgagctcctgcagaagtggggctgggtgatgaagtggaagggaggctcc

SEQ ID NO: 29300 - DNA, 201 bp, Homo sapiens
gttgctgggagagcaggtggacaagcagcaggcaagggcttctccggcctcaggggagtgggtgccttggcgagagcccaaaggtgggggacgtggctgaygccgggcaaagctttgggggcaccgggctggggtggtggtgaggacctgtgggcaggtgtgtgtgcagccagccacagcctccgcacaagtgaggggaag

SEQ ID NO: 29301 - DNA, 201 bp, Homo sapiens
gcctcgggaaccatcgctaccccagccccgcccaccggccccaggcagaggctcacgcgctcccggcttcgctgcatttattgcaggtgggtgcacctggygggagggcaggtccggggcgaggtcacacgacctcgtcggtcaccgggatggggttgacctggggacctcccgggggtccccccgccgccgccgcagcct

SEQ ID NO: 29302 - DNA, 201 bp, Homo sapiens
tcctccagccctcccaccctgaggtctctgctcccactccagctgccacgcaccctccagacaacagggagggcgctcagagccccaggggagtggtggcrgcgggcccctcctcctcaccctcagcccccaggcccttcccaggcactcctcccccggtgcaggtccttcctggagctgctgcagtggtgcctctgccct

SEQ ID NO: 29303 - DNA, 201 bp, Homo sapiens
gaagcccaggcaagaccccccagcagtgcatgctgaccccagaccctggcgacggatcggagctcctcggatttggagtggatccttacaaatcctgcacrctagacagcagacacaggccctgccagagccagggacccgaatttttgtttggaaaaacactgaggtaagtgggggtggctcctgtccaggcagcccggc

SEQ ID NO: 29304 - DNA, 201 bp, Homo sapiens
cccacaagcaccaaagggttggttccggagcctccaagtgagaaaccaagctccacccaaccctgtgagccctgcctgggccccgcaacccccggagagamcccagagcaggaggagactcaccagcgctccatggtggagcccttcttcctcttcccccgggggtactccagcaggcacacaaacacgcccgccacactg

SEQ ID NO: 29305 - DNA, 201 bp, Homo sapiens
aagctccacccaaccctgtgagccctgcctgggccccgcaacccccggagagaccccagagcaggaggagactcaccagcgctccatggtggagcccttcktcctcttcccccgggggtactccagcaggcacacaaacacgcccgccacactgaagccatgtggttaaggaacagcccagctcagcctgaggggccacag

SEQ ID NO: 29306 - DNA, 201 bp, Homo sapiens
tgcacctggcgggagggcaggtccggggcgaggtcacacgacctcgtcggtcaccgggatggggttgacctggggacctcccgggggtccccccgccgccrccgcagcctcctcctcgctgggcttcttgcgggcctcggccgggggccgcggcggggggttgctgggcggctgcttgatggtgcctccgatctgcggccg

SEQ ID NO: 29307 - DNA, 201 bp, Homo sapiens
ggcaggaaacggggtgcctgcccaggcctcgggaaccatcgctaccccagccccgcccaccggccccaggcagaggctcacgcgctcccggcttcgctgcrtttattgcaggtgggtgcacctggcgggagggcaggtccggggcgaggtcacacgacctcgtcggtcaccgggatggggttgacctggggacctcccggg

SEQ ID NO: 29308 - DNA, 201 bp, Homo sapiens
ctccccagctctgccctgggcgttccccgcccaccccagcctcaggtggaaggatacatggagtaggcaccaaagtaccactgggtgaagcgcccagctgyggccacgatgcccccggtgatgaggactgcggggagaagtgggtcaggcactgtggggctcctgtcccgggggcctgggccaccccccttctctacctac

SEQ ID NO: 29309 - DNA, 201 bp, Homo sapiens
ctcagcctcccgagtagctgggactatgcgcgcctgccaccatacccggctaattttttgtatttttagtagagacggggtttcactgtgttagccaggayggtctcgatctcctgacctcgtgatccgcccgccttggcctcccaaagtgctaggattacaggtgtagccaccttgccctgccagccattctgtttttgt

SEQ ID NO: 29310 - DNA, 201 bp, Homo sapiens; identical to SEQ ID NO: 5437

SEQ ID NO: 29311 - DNA, 201 bp, Homo sapiens
acaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcg

SEQ ID NO: 29312 - DNA, 201 bp, Homo sapiens
ttacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatct

SEQ ID NO: 29313 - DNA, 201 bp, Homo sapiens
gattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgat

SEQ ID NO: 29314 - DNA, 201 bp, Homo sapiens
agtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagt

SEQ ID NO: 29315 - DNA, 201 bp, Homo sapiens
aagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcag

SEQ ID NO: 29316 - DNA, 201 bp, Homo sapiens
aaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgca

SEQ ID NO: 29317 - DNA, 201 bp, Homo sapiens
ccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtg

SEQ ID NO: 29318 - DNA, 201 bp, Homo sapiens; identical to SEQ ID NO: 8408

SEQ ID NO: 29319 - DNA, 201 bp, Homo sapiens
tcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggag

SEQ ID NO: 29320 - DNA, 201 bp, Homo sapiens; identical to SEQ ID NO: 8409

SEQ ID NO: 29321 - DNA, 201 bp, Homo sapiens
cctcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctgg

SEQ ID NO: 29322 - DNA, 201 bp, Homo sapiens; identical to SEQ ID NO: 8410

SEQ ID NO: 29323 - DNA, 201 bp, Homo sapiens; identical to SEQ ID NO: 8412

SEQ ID NO: 29324 - DNA, 201 bp, Homo sapiens; identical to SEQ ID NO: 8413

SEQ ID NO: 29325 - DNA, 201 bp, Homo sapiens; identical to SEQ ID NO: 8415

SEQ ID NO: 29326 - DNA, 201 bp, Homo sapiens; identical to SEQ ID NO: 8414

SEQ ID NO: 29327 - DNA, 201 bp, Homo sapiens
caacaaagagggtcgaatggcaggaatgggcctaattaaggggtcctggagcactgaaggtgaaggggtgggagggctggaccctggtgagaactggagcyacaggagaggccaccccggctgagctgaggtctctgaagggtaagaaccccatcagagcagagggagccccggagccaacaccctgacctctctctcctc

SEQ ID NO: 29328 - DNA, 201 bp, Homo sapiens; identical to SEQ ID NO: 8417

SEQ ID NO: 29329 - DNA, 201 bp, Homo sapiens; identical to SEQ ID NO: 8418

SEQ ID NO: 29330 - DNA, 201 bp, Homo sapiens
gtcagggagatgcggccacaggacgcaggcctgggctgccgggagggacgtatcagtcctcccgcccccggcagccccttcctggggtgcatgatacttgstgtccagccacacagggcatggcctgaggagccgctcacctggttccccacatcctcctacagggacagagcctggagcccagagaggccgactgcccag

SEQ ID NO: 29331 - DNA, 201 bp, Homo sapiens; identical to SEQ ID NO: 8423

SEQ ID NO: 29332 - DNA, 201 bp, Homo sapiens
tcggaaggaaggtatgctggagcaggagggctgatccattcacccaggatcccctcaggaggcagagcctcgctctgctgtgaccccaagttctcaagacyctgtccagagccctcgtcctgagcactcagcagcatcggctcagggaagccacggcgggtatgagaaggggtgctcagtggggcctactttacagaagac

SEQ ID NO: 29333 - DNA, 201 bp, Homo sapiens; identical to SEQ ID NO: 8424

SEQ ID NO: 29334 - DNA, 201 bp, Homo sapiens; identical to SEQ ID NO: 8425

SEQ ID NO: 29335 - DNA, 201 bp, Homo sapiens
tgctccaggcccttgccagcagctgcacagctgggcctggggacctgggtgtgggtctgttgaaccttggcccaccctggggctgtggtcggcctggacgygtaggtgtggaggtgcatatttattatggcaattttctgacaggtaacagagtgtggggctctcttctgaatggggctcgtggaggccgtgggtcaaaag

SEQ ID NO: 29336 - DNA, 201 bp, Homo sapiens
gaggatcatgaggtcaggagatcaagaccgtcctggccaacatggtgaaaccccatctctactaaaaaaaatacaaaaatttgccgggtgtggcggcacgygcctgtagttccagctactcaggaggctgaggtatgagaattacttgaacccagtaggcagaggctaccgtgagccaagatcatgccactgcactccagc

SEQ ID NO: 29337 - DNA, 201 bp, Homo sapiens
cctgttgtccaggttggtcctgaactcctgacttcaagtgatctgcctgcctcagcctcccaaagtgctgggattataggcatgagccaccacacccagcytgaatcatttttgtaatttaaaaatttaacgcaaaaagaataaaacttagcaataacaaaaatgcacaaaagatggaaagaaatccacccctgacctttg

SEQ ID NO: 29338 - DNA, 201 bp, Homo sapiens
ccagcagctgcacagctgggcctggggacctgggtgtgggtctgttgaaccttggcccaccctggggctgtggtcggcctggacgtgtaggtgtggaggtrcatatttattatggcaattttctgacaggtaacagagtgtggggctctcttctgaatggggctcgtggaggccgtgggtcaaaagccctaattttgtagt

SEQ ID NO: 29339 - DNA, 201 bp, Homo sapiens
gcacccaccaccacacctggctgattttggtatttttagtagagacggggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgta

SEQ ID NO: 29340 - DNA, 201 bp, Homo sapiens
tcgtggaggccgtgggtcaaaagccctaattttgtagtgagggctaaaaggcttcacaagggaaagggcctggctggggctatgggccggtgccgaccccycctctcccactttgtttgcagttctgggaagtcatcagtgatgagcatggcatcgaccccagcggcaactacgtgggcgactcggacttgcagctggagc

SEQ ID NO: 29341 - DNA, 201 bp, Homo sapiens
ccagactaggcgatagagtgagatcctgtctcacagtaataatagtatctgattctttttaacaatgaaagcaacagagaaggaaattttctcgggggcgkgggcggcaagagcgtgttcctttgctctgctgcccttgtggaatcaatgggaagttccttggccgttctcggcctccactcccgcagctgatagggggtg

SEQ ID NO: 29342 - DNA, 201 bp, Homo sapiens
ttctcggcctccactcccgcagctgatagggggtgcaacgcggctgcttccctgtctggggtcctcgggcggtgcctggctgggcaggaaggcccgtgcastctgggcagagggaagtcggggtgactcgaggccgggagcaaagccgggtcccgggcggtcacgcggcagcgcggacgactcaccgcggtcacccctgcg

SEQ ID NO: 29343 - DNA, 201 bp, Homo sapiens
tcctgagtagcagggactacgggcgcccgccaccatgcccggctaattttttgtatttttagtagagatggggtttcaccatgttagccaggatggtctcsatctcctgacctcaggatccgcccaccttggcctcccaaagtgctgggattacaggcgtgagccaccgtcactgattcttaagtgtgccagacccatgtc

SEQ ID NO: 29344 - DNA, 201 bp, Homo sapiens
gctcctcacaatgttgggaggggccagctgcaagctctgacatctcactcttggggttgtcctccgcacggctgcctggccgacccctcgcatggtggggmggaggctggaaccacgtcttacatggcaccggttctttttttctttgtgacagagtctcgctctgtcgcctaggctggagtgcagtggcgcaatctcagc

SEQ ID NO: 29345 - DNA, 201 bp, Homo sapiens
tcaggcaagagctgggatctagaagtcaggtgcacatgcagacatcccctgaggctccacgggtagcagagggagcccttgtcccctggaccgtgtccttsgctgccttgtgctctgcttctgaacactggagctcttagtttgcccgctactttttattccttttgagttgtttgttttttcttaatatatttcttttta

SEQ ID NO: 29346 - DNA, 201 bp, Homo sapiens
gggtttctccttctatggctgggatgggcccagagctgtggtcccacaaggcacttgtcaggcaagagctgggatctagaagtcaggtgcacatgcagacwtcccctgaggctccacgggtagcagagggagcccttgtcccctggaccgtgtccttggctgccttgtgctctgcttctgaacactggagctcttagtttg

SEQ ID NO: 29347 - DNA, 201 bp, Homo sapiens
ttctaaggtggtggcactgtaatatctggcccaggaggaggtcagtgccgtgccggcgagtcctttgctcccttccttctctgaccagtaaacgcatctccagtcgctcccccgaggcccccctgcacgcagtctccgacctcagagagtgagtcagatagaagccgctgcccaccctcccccaccctggccgggttcttg

SEQ ID NO: 29348 - DNA, 201 bp, Homo sapiens; identical to SEQ ID NO: 8439

SEQ ID NO: 29349 - DNA, 201 bp, Homo sapiens
aggaggaggtcagtgccgtgccggcgagtcctttgctcccttccttctctgaccagtaaacgcatctccagtcgctcccccgaggcccccctgcacgcagwctccgacctcagagagtgagtcagatagaagccgctgcccaccctcccccaccctggccgggttcttgcctggcttgtgcgtccttgtgacaattcctga

SEQ ID NO: 29350 - DNA, 201 bp, Homo sapiens
cccaagctggtcttgaactcctgacctcatgatccgcctgcctcagcctcccaaagtgctgagattataggggtgagccactgtgcccggcaataataatwtttttttttttgagacagagttttgctcttgttgcccaggctggagtgcaatggtgcaatctcggctcacggcaacctccgcctctcatgttcaagctat

SEQ ID NO: 29351 - DNA, 201 bp, Homo sapiens
tgatctcggctcactgcaacctccgcctcctgggttcaagcaattctgcctcagcctcccaagtagctgggattataggcgtgcgccaccacgcctggctratttttgtatttttagtagagatggagtttcaccatattacccaagctggtcttgaactcctgacctcatgatccgcctgcctcagcctcccaaagtgct

SEQ ID NO: 29352 - DNA, 201 bp, Homo sapiens
tcacacctgtaatcccagcacttcaggaggccaaggcagacaggtcatgaggtcaggaaatggagaccatcctggctaacaaggtgaaaccccgtaactamtaaaaatacaaaaaaattagctgggcgtggtggcgggcgcctttagtcccaactactcgggaggctgaggcagaagaatcacttgaacccaggaggtgga

SEQ ID NO: 29353 - DNA, 201 bp, Homo sapiens
gctggagtgcagtggtgtgatctcggctcactgcaacctccgcctcctgggttcaagcaattctgcctcagcctcccaagtagctgggattataggcgtgygccaccacgcctggctgatttttgtatttttagtagagatggagtttcaccatattacccaagctggtcttgaactcctgacctcatgatccgcctgcct

SEQ ID NO: 29354 - DNA, 201 bp, Homo sapiens
cagcctgcgcgacagagtgaaactgtctcaaaataaataaatacataaaattatatgtatatatatatatatatatatttttttttttttgagactgtatytctgtttcccaggctggagtgcagtggtgtgatctcggctcactgcaacctccgcctcctgggttcaagcaattctgcctcagcctcccaagtagctggg

SEQ ID NO: 29355 - DNA, 201 bp, Homo sapiens; identical to SEQ ID NO: 8450

SEQ ID NO: 29356 - DNA, 201 bp, Homo sapiens
ctggggcggggccgtggatgccacgttcccatgcctgtgtcctggggcggggccgtggatgccacgttcccatgtctgtgtcctggggcggggccgtggaygcgccacagaaacaggagggcctcgcttcacttctgccttcccgaccgcagcacatccagctggtagatgccaactcgcatccagcccccagctgccagg

SEQ ID NO: 29357 - DNA, 201 bp, Homo sapiens; identical to SEQ ID NO: 8452

SEQ ID NO: 29358 - DNA, 201 bp, Homo sapiens
cgtggaggccgtgggtcaaaagccctaattttgtagtgagggctaaaaggcttcacaagggaaagggcctggctggggctatgggccggtgccgacccccsctctcccactttgtttgcagttctgggaagtcatcagtgatgagcatggcatcgaccccagcggcaactacgtgggcgactcggacttgcagctggagcg

SEQ ID NO: 29359 - DNA, 201 bp, Homo sapiens; identical to SEQ ID NO: 8405

SEQ ID NO: 29360 - DNA, 201 bp, Homo sapiens
gcctcgtcctccccacctaggccacgtgtgagctgctcctgtctctgtcttattgcagctccaggcctgacgttttacggttttgttttttactggtttgkgtttatattttcggggatacttaataaatctattgctgtcagatacccttgcttggtgccagagatgtccttttattctggaaagttgtgtccagtaggt

SEQ ID NO: 29361 - DNA, 201 bp, Homo sapiens
gccctcctgcagtatttatggcctcgtcctccccacctaggccacgtgtgagctgctcctgtctctgtcttattgcagctccaggcctgacgttttacggktttgttttttactggtttgtgtttatattttcggggatacttaataaatctattgctgtcagatacccttgcttggtgccagagatgtccttttattctg

SEQ ID NO: 29362 - DNA, 201 bp, Homo sapiens; identical to SEQ ID NO: 5447

SEQ ID NO: 29363 - DNA, 201 bp, Homo sapiens
aaaaatttaacgcaaaaagaataaaacttagcaataacaaaaatgcacaaaagatggaaagaaatccacccctgacctttgtggagagatgacctctgatracagtctcagggtgaacgggcacctctgataacagtctcagggtgaacgggcatcccgagacactgttagcagaggtggtccatgtccatgctgtccgcg

SEQ ID NO: 29364 - DNA, 201 bp, Homo sapiens
gagtgcagtggagtgatctcggctcactgcaacctccacctcctgggttcaagcaattctcctgccttagcctcctgagtagctgggattacaggcacccrtcaccacactggctaattttttttttttttttttgaggcggagtctctatctgttgcccaggctggagcacggtggcacaatctcggttcactgcaagct

SEQ ID NO: 29365 - DNA, 201 bp, Homo sapiens
gctcgccaccacgcctggctaatttttgtatttttagtagagacagggttttgccatgttggccaggctggtcttgaactcctgacctcagatgatccacygcctcagcctcccaaagtactgggattacaggcgtgagccaccgtgcctggcacaagcagttttctccccttccttccttccttccttccttccttcctt

SEQ ID NO: 29366 - DNA, 201 bp, Homo sapiens; identical to SEQ ID NO: 8427

SEQ ID NO: 29367 - DNA, 201 bp, Homo sapiens
ctggaaccataaatttggggtgtcccagtgctttggggagcaaggtccccgactcaagtggactgccagcaactaaattaatgggggatcctcaaagagastgttagggaggcaagcagtaggtgggaagcttggacaagccccaaatgcctcagggacctttctgtattttttttttgagacaggctcttactctgtcgc

SEQ ID NO: 29368 - DNA, 201 bp, Homo sapiens
gcaagaccctatctaaaaaaaaaaaaggaacaatatattttattactttatctcaaattataattttattaattttaactacaaaagcaattaatatattstcctggttaaaaaaaaccttaaatattgcagataaacctggtgcccatctagccacctctctctatccaagtgggaacaaatttctttttctatccttct

SEQ ID NO: 29369 - DNA, 201 bp, Homo sapiens
agacagaggtgggaggatcacctgggggaggtgggcagaggttaaagtgagctgaggtcatgcccctgcattctagcctgggcaatagagcaagaccctayctaaaaaaaaaaaaggaacaatatattttattactttatctcaaattataattttattaattttaactacaaaagcaattaatatattctcctggttaaa

SEQ ID NO: 29370 - DNA, 201 bp, Homo sapiens
gggagacagaggtgggaggatcacctgggggaggtgggcagaggttaaagtgagctgaggtcatgcccctgcattctagcctgggcaatagagcaagaccytatctaaaaaaaaaaaaggaacaatatattttattactttatctcaaattataattttattaattttaactacaaaagcaattaatatattctcctggtt

SEQ ID NO: 29371 - DNA, 201 bp, Homo sapiens; identical to SEQ ID NO: 8436

SEQ ID NO: 29372 - DNA, 201 bp, Homo sapiens
tgggcaacatggcaagactccgtgcctacaaaaaataaaaaacaaaaaaaattagctggacatggaggcacgccggcctgtggtcccagctacttgggagrcagaggtgggaggatcacctgggggaggtgggcagaggttaaagtgagctgaggtcatgcccctgcattctagcctgggcaatagagcaagaccctatct

SEQ ID NO: 29373 - DNA, 201 bp, Homo sapiens
ggctcacacctgtaatcccagcactttgggaggccgaggtgggtggatcacctgaggtcagcacttcagggccagcctgggcaacatggcaagactccgtscctacaaaaaataaaaaacaaaaaaaattagctggacatggaggcacgccggcctgtggtcccagctacttgggagacagaggtgggaggatcacctggg

SEQ ID NO: 29374 - DNA, 201 bp, Homo sapiens
tttataaaattatattttattgtttattaaatatgtaacataggccaggtgcggtggctcacacctgtaatcccagcactttgggaggccgaggtgggtgratcacctgaggtcagcacttcagggccagcctgggcaacatggcaagactccgtgcctacaaaaaataaaaaacaaaaaaaattagctggacatggaggc

SEQ ID NO: 29375 - DNA, 201 bp, Homo sapiens
atttagtttataaaattatattttattgtttattaaatatgtaacataggccaggtgcggtggctcacacctgtaatcccagcactttgggaggccgaggygggtggatcacctgaggtcagcacttcagggccagcctgggcaacatggcaagactccgtgcctacaaaaaataaaaaacaaaaaaaattagctggacat

SEQ ID NO: 29376 - DNA, 201 bp, Homo sapiens
cgcctggccacaattttccttttttcttattttcttttagatggagtttggctcttgttgcccaggctggagtgcagtggcgcgatctcggctcattgcamcctccacttcctgggttcaagctattctcctgcctcagcctcctgagtagctgggattacaggcgcccgccaccacacctggcttattttgtacttttac

SEQ ID NO: 29377 - DNA, 201 bp, Homo sapiens
cacgcctggccacaattttccttttttcttattttcttttagatggagtttggctcttgttgcccaggctggagtgcagtggcgcgatctcggctcattgmaacctccacttcctgggttcaagctattctcctgcctcagcctcctgagtagctgggattacaggcgcccgccaccacacctggcttattttgtactttt

SEQ ID NO: 29378 - DNA, 201 bp, Homo sapiens
ggtggctgtttgggctcctggcactgccagtcggaaggaaggtatgctggagcaggagggctgatccattcacccaggatcccctcaggaggcagagcctygctctgctgtgaccccaagttctcaagaccctgtccagagccctcgtcctgagcactcagcagcatcggctcagggaagccacggcgggtatgagaaggg

SEQ ID NO: 29379 - DNA, 201 bp, Homo sapiens
aataaacttcgtttttcttctgttttcatagaaatacctcttattaaaaatctgttcaccttcctcatatacataagtttagcccatctgcaacctcctgytatgggaaatagctgtttaacggaactgatcttgtctcaggaccaggaaatcactacaaagatatgtgacagtgtatctaaatttgttctttcctgtcta

SEQ ID NO: 29380 - DNA, 201 bp, Homo sapiens
gagaccggtagtggccccgaatgtctggctgcgctgttatttactggatacagagcaaaaggggcagggtaaagagtgtgagtcatctccaatgacaggtraggtcacgtgggtcacgtgtccactggacagggggcccttccctgcctggcagccaaggcagagagagagagggagagagagagacagcttacaccatta

SEQ ID NO: 29381 - DNA, 201 bp, Homo sapiens; identical to SEQ ID NO: 8404

SEQ ID NO: 29382 - DNA, 201 bp, Homo sapiens
gccagccacgtggctgacatgtaaattgcaactttggctccgggtggaggcgcctctgagggtgggaggcccagtagtggggagactctaatcacccaagragacagctgtgcctgccaaggagagcctgggggaggggagacctgggggacagtggcctcaaatcaaaccaggactcccggagcagcctctgacagctgc

SEQ ID NO: 29383 - DNA, 201 bp, Homo sapiens
ggacagggaggaaccccaggcagctagaccccagcagcagccacacgagcacactgtggggcagggaggggcatctcttgagaacaaaagatccatttctmgactttccaaactggagagcttcttgagagaaaagagagagacaggtacaggtccacgccacccacacacagccctgtgcacacagaccggacacaggcg

SEQ ID NO: 29384 - DNA, 201 bp, Homo sapiens; identical to SEQ ID NO: 8407

SEQ ID NO: 29385 - DNA, 201 bp, Homo sapiens
gtgcaatggtgcaatctcggctcacggcaacctccgcctctcatgttcaagctattatcctgactcagctgggattacaggcacccaccaccacacctggstgattttggtatttttagtagagacggggtttctccatgtcggccaggctggtctcgaactcctgacctcaggtgatccacccgccttgggctcccaaag

SEQ ID NO: 29386 - DNA, 201 bp, Homo sapiens
ccacacccagctaatttttttgtatttttagtagagacgggagttcaccatgttggtcaggctggtctcaaactcctgacctcgtgatctgcctgcctcgrcctcccaaagtgctgggattgcaggtgtgagccactgtgcctggccacattactgattctttttgttttgtttttcagagtcaagaaaaccttttttctt

SEQ ID NO: 29387 - DNA, 201 bp, Homo sapiens
agaaggtggaggttgcagtgagccaagaatgcaccactacactccagcctgcgcgacagagtgaaactgtctcaaaataaataaatacataaaattatatrtatatatatatatatatatatttttttttttttgagactgtatctctgtttcccaggctggagtgcagtggtgtgatctcggctcactgcaacctccgcc

SEQ ID NO: 29388 - DNA, 201 bp, Homo sapiens
tgaagagaccacctccatttcctctgcagagactgagcactcagtcagcccccttcctgggacaggctcaatggaggctgcagggccatcagccgactccwacgcaggctcagtcagcagccccctggccagccccacccctgactgccggcctcagaactgggagctgcttcctggcagggcccgcctctgctgggagac

SEQ ID NO: 29389 - DNA, 201 bp, Homo sapiens
gaaacctcatctctacaaaaaatacaaaaaatagccaggtgtggtagtgggtgccgtagtcccagctagttgggaggctgaggcataagtattgcttgaayccagaaggtggaggttgcagtgagccaagaatgcaccactacactccagcctgcgcgacagagtgaaactgtctcaaaataaataaatacataaaattat

SEQ ID NO: 29390 - DNA, 201 bp, Homo sapiens
gccattctcctgcctcagcctcctgagtagcagggactacgggcgcccgccaccatgcccggctaattttttgtatttttagtagagatggggtttcaccrtgttagccaggatggtctccatctcctgacctcaggatccgcccaccttggcctcccaaagtgctgggattacaggcgtgagccaccgtcactgattctt

SEQ ID NO: 29391 - DNA, 201 bp, Homo sapiens
tgctgcttatgtggctggttcaggtctgtcatccgtcaacctgcatatttatcactggtgcattttcatgtatgttgtacctcaattaaaacattttaggsccgggcgcggtggctcacgcctgtaatcccagcactgtgggaggcggaggcgggaggatcatgaggtcaggagatcaagaccgtcctggccaacatggtg

SEQ ID NO: 29392 - DNA, 201 bp, Homo sapiens
cccaggttctgcccagtggtaccctgagagcggccccttcttcttgaatcacccttcaacctggcaatgggcgcagaagaagacaggccgtgtgcactgcrggccccagcttcagatgcgagggctgcaggccccagaggccgccatctcgagttctggccctgacacccccaacatggatggggccggggatgtgtctcc

SEQ ID NO: 29393 - DNA, 201 bp, Homo sapiens; identical to SEQ ID NO: 8411

SEQ ID NO: 29394 - DNA, 201 bp, Homo sapiens
agtaggttttagctggtgtttggttacatgaatgagttctttagtggtgttttctgagattttggtccatccattacctgagcagtatacactgtatccartatgtagcctttatccctaaccctctcccaccctttcccctgagttcccaaactccttcatatcattattattattgttattattattattgaaacagtg

SEQ ID NO: 29395 - DNA, 201 bp, Homo sapiens
tgagtgcctgccccagcctccctatcccagccctggactgaccaggtctcagcgtctgactgaccaggtctcagcacctggactcaccagctctcagcatmtctgtcctcccatgggttaggttggctgagatgccagcaggcgtaactggatgtcaggcatccagacgcacagaacagacaataaatcacagtcacaaaa

SEQ ID NO: 29396 - DNA, 201 bp, Homo sapiens
ttggccaggctggtctcgaactcctgacctcgtgacccacccgcctctgcctcccaaagtgcagggattatgggggtgagccaccgtgcccagctatgagyggttttgtttctatttatttattattattctatgagacagagtctcactctgtcgcccacgctggagtacagtggtgcaatcttggcttactgcaacctc

SEQ ID NO: 29397 - DNA, 201 bp, Homo sapiens
atggagtttcactatgttggccaggctggtctcgaactcctgacctcgtgacccacccgcctctgcctcccaaagtgcagggattatgggggtgagccacygtgcccagctatgagtggttttgtttctatttatttattattattctatgagacagagtctcactctgtcgcccacgctggagtacagtggtgcaatctt

SEQ ID NO: 29398 - DNA, 201 bp, Homo sapiens; identical to SEQ ID NO: 8420

SEQ ID NO: 29399 - DNA, 201 bp, Homo sapiens; identical to SEQ ID NO: 8421

SEQ ID NO: 29400 - DNA, 201 bp, Homo sapiens; identical to SEQ ID NO: 8428

SEQ ID NO: 29401 - DNA, 201 bp, Homo sapiens; identical to SEQ ID NO: 8435

SEQ ID NO: 29402 - DNA, 201 bp, Homo sapiens; identical to SEQ ID NO: 8440

SEQ ID NO: 29403 - DNA, 201 bp, Homo sapiens
ccctttcccctgagttcccaaactccttcatatcattattattattgttattattattattgaaacagtgtctccctctgtcacccaggctggagtgcagwggcacgatctcacctcattgcaacctccacctcctgagttcaagcagttctcctgcctcagtctcctgggtagctgggattacaggcacacaccaccaca

SEQ ID NO: 29404 - DNA, 201 bp, Homo sapiens
ttagtggtgttttctgagattttggtccatccattacctgagcagtatacactgtatccaatatgtagcctttatccctaaccctctcccaccctttcccytgagttcccaaactccttcatatcattattattattgttattattattattgaaacagtgtctccctctgtcacccaggctggagtgcagtggcacgatc

SEQ ID NO: 29405 - DNA, 201 bp, Homo sapiens
tagctggtgtttggttacatgaatgagttctttagtggtgttttctgagattttggtccatccattacctgagcagtatacactgtatccaatatgtagcytttatccctaaccctctcccaccctttcccctgagttcccaaactccttcatatcattattattattgttattattattattgaaacagtgtctccctct

SEQ ID NO: 29406 - DNA, 201 bp, Homo sapiens; identical to SEQ ID NO: 8403

SEQ ID NO: 29407 - DNA, 201 bp, Homo sapiens
cgactttccaaactggagagcttcttgagagaaaagagagagacaggtacaggtccacgccacccacacacagccctgtgcacacagaccggacacaggcrtccacaggcaagttcgcagctgctcattttgtgaagtgaatgctgatttgggggccgggtggggttcgtctgtacatcgtgcactgtcagacccttcctg

SEQ ID NO: 29408 - DNA, 201 bp, Homo sapiens
ccagcagcagccacacgagcacactgtggggcagggaggggcatctcttgagaacaaaagatccatttctcgactttccaaactggagagcttcttgagasaaaagagagagacaggtacaggtccacgccacccacacacagccctgtgcacacagaccggacacaggcgtccacaggcaagttcgcagctgctcatttt

SEQ ID NO: 29409 - DNA, 201 bp, Homo sapiens
cccagccggcggagaagtccctgggagtgagtacctggggatgaactatgctgcctggtgctggggagcagtggcgcccctgggccatccctctgctgaarcctgggcgtctcgctgaagagaccacctccatttcctctgcagagactgagcactcagtcagcccccttcctgggacaggctcaatggaggctgcagggc

SEQ ID NO: 29410 - DNA, 201 bp, Homo sapiens
attcacccaggatcccctcaggaggcagagcctcgctctgctgtgaccccaagttctcaagaccctgtccagagccctcgtcctgagcactcagcagcatsggctcagggaagccacggcgggtatgagaaggggtgctcagtggggcctactttacagaagacagaacaggcatggggctgccacggctgcccttgggat

SEQ ID NO: 29411 - DNA, 201 bp, Homo sapiens; identical to SEQ ID NO: 8406

SEQ ID NO: 29412 - DNA, 201 bp, Homo sapiens
tgagcatggcatcgaccccagcggcaactacgtgggcgactcggacttgcagctggagcggatcagcgtctactacaacgaggcctcttgtgagtgcctgycccagcctccctatcccagccctggactgaccaggtctcagcgtctgactgaccaggtctcagcacctggactcaccagctctcagcatctctgtcctcc

SEQ ID NO: 29413 - DNA, 201 bp, Homo sapiens; identical to SEQ ID NO: 8416

SEQ ID NO: 29414 - DNA, 201 bp, Homo sapiens; identical to SEQ ID NO: 8419

SEQ ID NO: 29415 - DNA, 201 bp, Homo sapiens; identical to SEQ ID NO: 8422

SEQ ID NO: 29416 - DNA, 201 bp, Homo sapiens
ccccatcagagcagagggagccccggagccaacaccctgacctctctctcctccgtcccccggcctccaggcaccctgacttctctctcctccgccctccrgcctcttgctgagctcagctggaagtcaggggacgtccaggtcagcctccaggcagagaggagggccaggaggcgtgagaggtgggtctggggccagtgg

SEQ ID NO: 29417 - DNA, 201 bp, Homo sapiens
ccaccccggctgagctgaggtctctgaagggtaagaaccccatcagagcagagggagccccggagccaacaccctgacctctctctcctccgtcccccggyctccaggcaccctgacttctctctcctccgccctccagcctcttgctgagctcagctggaagtcaggggacgtccaggtcagcctccaggcagagaggag

SEQ ID NO: 29418 - DNA, 201 bp, Homo sapiens; identical to SEQ ID NO: 5444

SEQ ID NO: 29419 - DNA, 201 bp, Homo sapiens; identical to SEQ ID NO: 5443

SEQ ID NO: 29420 - DNA, 201 bp, Homo sapiens
ggccaccccggctgagctgaggtctctgaagggtaagaaccccatcagagcagagggagccccggagccaacaccctgacctctctctcctccgtcccccrgcctccaggcaccctgacttctctctcctccgccctccagcctcttgctgagctcagctggaagtcaggggacgtccaggtcagcctccaggcagagagg

SEQ ID NO: 29421 - DNA, 201 bp, Homo sapiens
ctaggctggagtgcagtggcgcaatctcagctcactgcaagctccgcctcccgggttcacgccattctcctgcctcagcctcctgagtagcagggactacrggcgcccgccaccatgcccggctaattttttgtatttttagtagagatggggtttcaccatgttagccaggatggtctccatctcctgacctcaggatcc

SEQ ID NO: 29422 - DNA, 201 bp, Homo sapiens
ggtggcacaatctcggttcactgcaagctccgcctcccaggttcacgccattctcctgagtcagcctcccaagtagctgggactacaggtgcccgccaccrcgcctggctaattttttgtatttttagtagagacagggtttcactgtgccagccaggatggtctcgatctcctgacctcatgatccgcccacctcggcct

SEQ ID NO: 29423 - DNA, 201 bp, Homo sapiens
tctcagtgggttcagggcctgggccagcctttacctacctcccccacccaaaaccggcaaaagctcagagcaccttgtctgccaaaagacagggagctggsatggtgcgggttggtctctaaaccggcgtggggaaaaaagaccctccgtacaaagccgcagggtggggctgtcgcaagggcggaaccgagagggtagctg

SEQ ID NO: 29424 - DNA, 201 bp, Homo sapiens
ccctttacgagaggcatcttttttttttttttgagatggtgtctcactctgtcgcccaggctggagtgcaatggcatgatctcagctcactgcaagctccrcctcctgggttcaagtgattctcctgcttcagcctcccgagtagctgggactacaggcacccgccaccattcccggctaattttttgtatctttagtaga

SEQ ID NO: 29425 - DNA, 201 bp, Homo sapiens; identical to SEQ ID NO: 8429

SEQ ID NO: 29426 - DNA, 201 bp, Homo sapiens; identical to SEQ ID NO: 8430

SEQ ID NO: 29427 - DNA, 201 bp, Homo sapiens; identical to SEQ ID NO: 8431

SEQ ID NO: 29428 - DNA, 201 bp, Homo sapiens; identical to SEQ ID NO: 8432

SEQ ID NO: 29429 - DNA, 201 bp, Homo sapiens; identical to SEQ ID NO: 8433

SEQ ID NO: 29430 - DNA, 201 bp, Homo sapiens
aaaaggggcagggtaaagagtgtgagtcatctccaatgacaggtgaggtcacgtgggtcacgtgtccactggacagggggcccttccctgcctggcagccraggcagagagagagagggagagagagagacagcttacaccattatttctgcatatcaagagacttttatactttcactaatttgctactgctatctggaa

SEQ ID NO: 29431 - DNA, 201 bp, Homo sapiens; identical to SEQ ID NO: 8434

SEQ ID NO: 29432 - DNA, 201 bp, Homo sapiens
cgaatgtctggctgcgctgttatttactggatacagagcaaaaggggcagggtaaagagtgtgagtcatctccaatgacaggtgaggtcacgtgggtcacrtgtccactggacagggggcccttccctgcctggcagccaaggcagagagagagagggagagagagagacagcttacaccattatttctgcatatcaagag

SEQ ID NO: 29433 - DNA, 201 bp, Homo sapiens; identical to SEQ ID NO: 8437

SEQ ID NO: 29434 - DNA, 201 bp, Homo sapiens
gctggagtgcaatggcatgatctcagctcactgcaagctccacctcctgggttcaagtgattctcctgcttcagcctcccgagtagctgggactacaggcrcccgccaccattcccggctaattttttgtatctttagtagagacggggtttcaccatgttagccaggatggtctcgatctcctgacttcgtgatccaccc

SEQ ID NO: 29435 - DNA, 201 bp, Homo sapiens
acgcggagaccggtagtggccccgaatgtctggctgcgctgttatttactggatacagagcaaaaggggcagggtaaagagtgtgagtcatctccaatgayaggtgaggtcacgtgggtcacgtgtccactggacagggggcccttccctgcctggcagccaaggcagagagagagagggagagagagagacagcttacac

SEQ ID NO: 29436 - DNA, 201 bp, Homo sapiens; identical to SEQ ID NO: 8438

SEQ ID NO: 29437 - DNA, 201 bp, Homo sapiens
cccgtggggagaccccggaaacgggaagcccgggagaaggaacgggaagtacctcattccagacctcaagatgcagccctcccgacttggaaataaccccrcactcgttccctggcctcccacagagcggcttgcaccccagacttttctcccacctgtctgtaggctgaaagttggggcaggtggtccctcctgcggtgg

SEQ ID NO: 29438 - DNA, 201 bp, Homo sapiens
ctgggagtaggcaggtggggaaggggtcgggggtggagggtctgtgttcagccagtcctgggaaatgcttgatgtgaggcttctgaagatggcagtgaggsagaggcccagccggcggagaagtccctgggagtgagtacctggggatgaactatgctgcctggtgctggggagcagtggcgcccctgggccatccctctg

SEQ ID NO: 29439 - DNA, 201 bp, Homo sapiens
ggacaggcaagaagagctcatcctctcccaggctggcggctgagagaggcctgcgctgggggccggaatgtgtctcaaggcacagcccgtggggagacccyggaaacgggaagcccgggagaaggaacgggaagtacctcattccagacctcaagatgcagccctcccgacttggaaataaccccacactcgttccctggc

SEQ ID NO: 29440 - DNA, 201 bp, Homo sapiens
agcaggtgcagcagggccccagtcccctccactcttgacgctgtcctagctgcagaagaggcgggttcccagccttccctgtgaccacatgtgacctcagscgggacacatccctttgctggccctggccctgagtccctccagccatgatgagccgtgaatgggaccatccctgtccactctgagatgcctggaaggggg

SEQ ID NO: 29441 - DNA, 201 bp, Homo sapiens
caggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcga

SEQ ID NO: 29442 - DNA, 201 bp, Homo sapiens; identical to SEQ ID NO: 8441

SEQ ID NO: 29443 - DNA, 201 bp, Homo sapiens; identical to SEQ ID NO: 8442

SEQ ID NO: 29444 - DNA, 201 bp, Homo sapiens; identical to SEQ ID NO: 8443

SEQ ID NO: 29445 - DNA, 201 bp, Homo sapiens; identical to SEQ ID NO: 8446

SEQ ID NO: 29446 - DNA, 201 bp, Homo sapiens; identical to SEQ ID NO: 8444

SEQ ID NO: 29447 - DNA, 201 bp, Homo sapiens; identical to SEQ ID NO: 8445

SEQ ID NO: 29448 - DNA, 201 bp, Homo sapiens; identical to SEQ ID NO: 8447

SEQ ID NO: 29449 - DNA, 201 bp, Homo sapiens; identical to SEQ ID NO: 8448

SEQ ID NO: 29450 - DNA, 201 bp, Homo sapiens; identical to SEQ ID NO: 5442

SEQ ID NO: 29451 - DNA, 201 bp, Homo sapiens; identical to SEQ ID NO: 8449

SEQ ID NO: 29452 - DNA, 201 bp, Homo sapiens; identical to SEQ ID NO: 5445

SEQ ID NO: 29453 - DNA, 201 bp, Homo sapiens; identical to SEQ ID NO: 8451

SEQ ID NO: 29454 - DNA, 201 bp, Homo sapiens; identical to SEQ ID NO: 8453

SEQ ID NO: 29455 - DNA, 201 bp, Homo sapiens; identical to SEQ ID NO: 8454

SEQ ID NO: 29456 - DNA, 201 bp, Homo sapiens
agtgtggggctctcttctgaatggggctcgtggaggccgtgggtcaaaagccctaattttgtagtgagggctaaaaggcttcacaagggaaagggcctggytggggctatgggccggtgccgaccccccctctcccactttgtttgcagttctgggaagtcatcagtgatgagcatggcatcgaccccagcggcaactacg

SEQ ID NO: 29457 - DNA, 201 bp, Homo sapiens; identical to SEQ ID NO: 5439

SEQ ID NO: 29458 - DNA, 201 bp, Homo sapiens
acccctcttctccctgtacaggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcacgggctccggcatgggcacgttgctcatca

SEQ ID NO: 29459 - DNA, 201 bp, Homo sapiens; identical to SEQ ID NO: 8455

SEQ ID NO: 29460 - DNA, 201 bp, Homo sapiens
taagaaccccatcagagcagagggagccccggagccaacaccctgacctctctctcctccgtcccccggcctccaggcaccctgacttctctctcctccgycctccagcctcttgctgagctcagctggaagtcaggggacgtccaggtcagcctccaggcagagaggagggccaggaggcgtgagaggtgggtctggggc

SEQ ID NO: 29461 - DNA, 201 bp, Homo sapiens
gaactatgctgcctggtgctggggagcagtggcgcccctgggccatccctctgctgaaacctgggcgtctcgctgaagagaccacctccatttcctctgcwgagactgagcactcagtcagcccccttcctgggacaggctcaatggaggctgcagggccatcagccgactcctacgcaggctcagtcagcagccccctgg

SEQ ID NO: 29462 - DNA, 201 bp, Homo sapiens
aggtctctgaagggtaagaaccccatcagagcagagggagccccggagccaacaccctgacctctctctcctccgtcccccggcctccaggcaccctgacytctctctcctccgccctccagcctcttgctgagctcagctggaagtcaggggacgtccaggtcagcctccaggcagagaggagggccaggaggcgtgaga

SEQ ID NO: 29463 - DNA, 201 bp, Homo sapiens
gaagagaccacctccatttcctctgcagagactgagcactcagtcagcccccttcctgggacaggctcaatggaggctgcagggccatcagccgactcctwcgcaggctcagtcagcagccccctggccagccccacccctgactgccggcctcagaactgggagctgcttcctggcagggcccgcctctgctgggagacc

SEQ ID NO: 29464 - DNA, 201 bp, Homo sapiens
aggccaccccggctgagctgaggtctctgaagggtaagaaccccatcagagcagagggagccccggagccaacaccctgacctctctctcctccgtccccyggcctccaggcaccctgacttctctctcctccgccctccagcctcttgctgagctcagctggaagtcaggggacgtccaggtcagcctccaggcagagag

SEQ ID NO: 29465 - DNA, 201 bp, Homo sapiens
aaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaa

SEQ ID NO: 29466 - DNA, 201 bp, Homo sapiens
gcctcggcctcccaaagtgctgggattacaggtgtgagccaccgcacctggccagtggagttccttcttaagtacatgtattgacatctttaaaaagggcragaggatttacaggaaactatcaggtcagtaatggcaggggccgtccacagtgggtggctgagtccccctatttttctgctggtgtgcggggaggtcatt

SEQ ID NO: 29467 - DNA, 201 bp, Homo sapiens
aggtgtgagccaccgcacctggccagtggagttccttcttaagtacatgtattgacatctttaaaaagggcgagaggatttacaggaaactatcaggtcartaatggcaggggccgtccacagtgggtggctgagtccccctatttttctgctggtgtgcggggaggtcatttcctgccacccatgtttccccaccctgaa

SEQ ID NO: 29468 - DNA, 201 bp, Homo sapiens
tggtctcatttctgattttaaaatggctctggctgtgatgtggagaagaggcagggtgagcctcatctgcagcaactgctaactgcccacatccccccagmcttctcaaaaatttgccactcccctgctcaaagaccctcaaaagctgcccactgcttagaggacaggcctttgacctgaggtcctcacttgggcttcagg

SEQ ID NO: 29469 - DNA, 201 bp, Homo sapiens
cctggtctcatttctgattttaaaatggctctggctgtgatgtggagaagaggcagggtgagcctcatctgcagcaactgctaactgcccacatccccccrgacttctcaaaaatttgccactcccctgctcaaagaccctcaaaagctgcccactgcttagaggacaggcctttgacctgaggtcctcacttgggcttca

SEQ ID NO: 29470 - DNA, 201 bp, Homo sapiens
taatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtga

SEQ ID NO: 29471 - DNA, 201 bp, Homo sapiens; identical to SEQ ID NO: 5484

SEQ ID NO: 29472 - DNA, 201 bp, Homo sapiens
ctcagatatttctttatagcaatgcaaaaatggactaacacacttgagttctgtctttttcttatggcatattttaatctaggccagacacagtggctcaygcctgtaatcccagcactttggaggccaaggcgggtggatcacttgaggtcaggagtttaagaccagcctggccaacatggggaaaccctgtctctacta

SEQ ID NO: 29473 - DNA, 201 bp, Homo sapiens
ccccggacaaagttccagggttttggggactgcatttcaagggtcagcaaccacagtccttaaacacgtggattttggagtgacaatgcctaggttatggytctgtgaccaccagcaagtgctctagcctttttgtgcctcagtcttctcatcagtaaaatgggaatgttaatggcacctacctcatagggtcgttgggag

SEQ ID NO: 29474 - DNA, 201 bp, Homo sapiens
agtccccctatttttctgctggtgtgcggggaggtcatttcctgccacccatgtttccccaccctgaatccaccttcctcacattcccattggagggacamtctctggacatatgggacctggggtcccacagggctgcattccaatgcctgctgtgccactcgccagctgtgtgatgttgggcatatcccataacctctt

SEQ ID NO: 29475 - DNA, 201 bp, Homo sapiens
cctgccacccatgtttccccaccctgaatccaccttcctcacattcccattggagggacactctctggacatatgggacctggggtcccacagggctgcawtccaatgcctgctgtgccactcgccagctgtgtgatgttgggcatatcccataacctctttgtgcctcagtttcctcatctgtaacacaggagtgacaag

SEQ ID NO: 29476 - DNA, 201 bp, Homo sapiens
tgggacaacaggcgcttgccaccacacctggctaattttcttattttaatttaattttattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgt

SEQ ID NO: 29477 - DNA, 201 bp, Homo sapiens
tcctgggctaaagagatcctcccatttcaacttccagagcagctgggacaacaggcgcttgccaccacacctggctaattttcttattttaatttaatttwattttattttttgggacagagtggagtctcaaaaaccaagctagagtgcagtggtgcgatctcgactcactgcaatctctgcctcccgggttcaagcgat

SEQ ID NO: 29478 - DNA, 201 bp, Homo sapiens
cagcccgctcctctcctgcttaagagccttcactggctccccactgccctagagacagagtttgagtctactgccatggcttggcagacggtgttgtcccyggcctgccaaccttccagctgccatcccagccagtccttctcccccttgctccagccaagggccccgcttgtagggtgggaagtgggccgtgccctccct

SEQ ID NO: 29479 - DNA, 201 bp, Homo sapiens
ctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagc

SEQ ID NO: 29480 - DNA, 201 bp, Homo sapiens
acaatcttgcctaacagtaacctccgcctcccgggttcaagcaattcttctgcctcagcctccagagtagctgggattacaggcgcatgccactatgcccrgctaattttttgtatttttggtagagatggggtttcaccatgttggtcaggctggtctcgaactcctgacctcatgatctgcctgcctcagcctcccaaa

SEQ ID NO: 29481 - DNA, 201 bp, Homo sapiens
tccaaaagctctttataataaaatataattttaaataaaaatagttatctgtttagggccaagcaatatgctaagtgccgtccagccactgtgtcatttaygtctccaaacagctctagttgggaggctcaatgattatcccaattttacagataaggaaacaggtccagagaggttgaggattagcctagaaccacacag

SEQ ID NO: 29482 - DNA, 201 bp, Homo sapiens
cacaatcttgcctaacagtaacctccgcctcccgggttcaagcaattcttctgcctcagcctccagagtagctgggattacaggcgcatgccactatgccyggctaattttttgtatttttggtagagatggggtttcaccatgttggtcaggctggtctcgaactcctgacctcatgatctgcctgcctcagcctcccaa

SEQ ID NO: 29483 - DNA, 201 bp, Homo sapiens
tgaaacagataacaatgtatgggaccctcattcattatttcagcaaatatttgctgagttcctcctacatggctagccctgtgctagacactggggaatcrgcgatgaacaaagcagatagaaatccccactcttgtggagctgacattctggagggagagacaaaaagcaaacatataaagaaagaaagaaatcacatgg

SEQ ID NO: 29484 - DNA, 201 bp, Homo sapiens
ttttgagacggagtctcactctgtcacccaggctggagtatagtggcacaatcttgcctaacagtaacctccgcctcccgggttcaagcaattcttctgcytcagcctccagagtagctgggattacaggcgcatgccactatgcccggctaattttttgtatttttggtagagatggggtttcaccatgttggtcaggct

SEQ ID NO: 29485 - DNA, 201 bp, Homo sapiens
tcctactggggagactgaaaatacatatcaatcacaaacaggtggttttccatagtgacccactctctgaatgcactagaccagggtggaggccagagatsttctggggtgctttttgcaagggggaccaggataaggctctccaaggagggaaaatttgaggggggccctgactggggagaatgagctggccagggataa

SEQ ID NO: 29486 - DNA, 201 bp, Homo sapiens
tcggcctcccgtgtagctgggactacaggtgtgcgccaccacactcggctaatttttgtatttttagtagagacagggtttcactatgttggccaggctgktctcaaactcctgacctcgtgatccgcccacctcagcctcccaaactttctgttttcttttcttttcttttttttttatgacagggtcttgctggagtgc

SEQ ID NO: 29487 - DNA, 201 bp, Homo sapiens
atacgtatttactgagcagctactacacaccttgagagtagagctgagaacatatcgacaaggaccccacttttttcttttttttttttttttttttttttgagacggagtctcactctgtcacccaggctggagtatagtggcacaatcttgcctaacagtaacctccgcctcccgggttcaagcaattcttctgcctca

SEQ ID NO: 29488 - DNA, 201 bp, Homo sapiens
tttgaataagatcccaggagagagacccaagcgggaagtgaaggatgggcacttgaaatgttgcagggaatataacccagcgcgtgctgttttcttttttyctttttcttttttttttttttctctttttgcaacagggtctcactgtgtcgcccagcctagagtgcagtggtgccatctcggctcaccacaacctccacc

SEQ ID NO: 29489 - DNA, 201 bp, Homo sapiens
gtcctctcagtcaataatacgtatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaag

SEQ ID NO: 29490 - DNA, 201 bp, Homo sapiens
cctgagctcaagcgatcctccctcctcagcctcctaaagtgctgggattacaggcgtgagccaccgcacccggcttccatatcctttctaattggtcatgrcttgggataatggtgttgcttttaattatcatcatccataaagactttttcttactcaacagatctgagcttgtatttggtgcccaggacatgtgctggg

SEQ ID NO: 29491 - DNA, 201 bp, Homo sapiens
cgcacccggcttccatatcctttctaattggtcatggcttgggataatggtgttgcttttaattatcatcatccataaagactttttcttactcaacagayctgagcttgtatttggtgcccaggacatgtgctgggttcccgaaatcccaaagacacagaccctaccctcagggatttctcattctagcaacatagactg

SEQ ID NO: 29492 - DNA, 201 bp, Homo sapiens
ttcccgaaatcccaaagacacagaccctaccctcagggatttctcattctagcaacatagactgatcaattactgattataacgttagaaggcatgtctgmagtagacagccatcaggacatggtgatttcaggctgggctttgaagaatgaataggagtttttcaagtgtcgaaactgaaccctgaccaacctttgcttt

SEQ ID NO: 29493 - DNA, 201 bp, Homo sapiens
ggctgaagtgcagtggcgcggttacggctcactgcagcctccaattcctgggctaaagagatcctcccatttcaacttccagagcagctgggacaacaggygcttgccaccacacctggctaattttcttattttaatttaattttattttattttttgggacagagtggagtctcaaaaaccaagctagagtgcagtggt

SEQ ID NO: 29494 - DNA, 201 bp, Homo sapiens
actggggactcggcagtgaatgggacagaccctggctgtcaggatgacagacaatttaaaaagggacagatgtcccacgctggcttgtcctttgcaccccyggcacttcgtgaggagcagcggccagttcttgtatatagactggcccttggtgtacatttgtctgacgtttccaaatgatgtatgcatccttggcaggaa

SEQ ID NO: 29495 - DNA, 201 bp, Homo sapiens
tgatgttgggcatatcccataacctctttgtgcctcagtttcctcatctgtaacacaggagtgacaagagcacccgcccacagggctatgacagtacaagktgtgtgatacagatgagctcccctgtttggcccacatgtgtcctaaaagccatgtgccctttctcttgagtgccccaggccacagagatccccatctgcc

SEQ ID NO: 29496 - DNA, 201 bp, Homo sapiens
ggtcagtgcggataactatacactggacctgtgggctgggcagcagctgctgtggaagggctccttcaagcccagcgagcatggtgagcagggcggagtgyggcaggggtggctgggtgtgttcccacagctgcctgggctgagggtggggtgggcaggggaggaggtggggtcatagcaacagcaggaggaagccgcctg

SEQ ID NO: 29497 - DNA, 201 bp, Homo sapiens
gcagcagctgctgtggaagggctccttcaagcccagcgagcatggtgagcagggcggagtgcggcaggggtggctgggtgtgttcccacagctgcctgggytgagggtggggtgggcaggggaggaggtggggtcatagcaacagcaggaggaagccgcctgtattttcccaaatctgatgggattcctgcccctgcctgg

SEQ ID NO: 29498 - DNA, 201 bp, Homo sapiens
cctcccacctttgaaacggagctggtcgcagtagaccaccaagcccccttcagcccagctgtttccacccctgaacttaagtgcccaggaaggcgtattgrgatgaggtgtgcttgctggaaggcatgcctgctgctgattgaaaaccgaactgggaacattccttccattctgtgtccactggtcagctgctgcggcttt

SEQ ID NO: 29499 - DNA, 201 bp, Homo sapiens
tttatatctctcaggtctggtttcccctttggcactgggccaggtatggggaaagagcaggaatggggcagttggctcacacagcagaggctcagaaagcrgggggcatggggggaaggagtgcacagatgctagagagtggggcaagttttgtttggtcaataaatctccttctcatgccccaggcctgtgcaagaccta

SEQ ID NO: 29500 - DNA, 201 bp, Homo sapiens
cttgacggttctaataagagtcctaaggctgctgctcagtggcctggcttcgatgctgtgccagcctctgaaccaatcactggctgtgggtggagagaggrtgctggtggagggccctgcttgtccagggaggagtcacatacctgcctctagggctgcaggtgggctcagctccatccaaaccagatgaactgaaaataa

SEQ ID NO: 29501 - DNA, 201 bp, Homo sapiens
tggcttcgatgctgtgccagcctctgaaccaatcactggctgtgggtggagagagggtgctggtggagggccctgcttgtccagggaggagtcacataccygcctctagggctgcaggtgggctcagctccatccaaaccagatgaactgaaaataaggcaggagtggcttccccaggggaaactggggaagaggaagcag

SEQ ID NO: 29502 - DNA, 201 bp, Homo sapiens
tgctgatatagttgggatgtcatcctctctaaatctcttgttgaaatgtgatccccagtgttggaggtgggtcctggtgggagatgttgggtcatggggaygggtccctcatggtttggttctgtccttgccatagtgagtgagttctcacaagatctggttgtttagaagtgtgcggcacctccctcctctctcttgccc

SEQ ID NO: 29503 - DNA, 201 bp, Homo sapiens
cccagctactcaggaggctgaggcaggagaatcacttgaacccacgcggaggttgcagtgagctgatatcgtgccactgcactccagactggtgacaaagytaggctccatctcaaaaaaaaaaaaaaaaaagattgttgaatttattattgctgaatttttttttttttgagacagaactttgctctattgcccgggctg

SEQ ID NO: 29504 - DNA, 201 bp, Homo sapiens
aaaatgattattgaggccaggtgcggtagctcatgcctgtaatcccagcactatgggaggctgaggcaggcggatcaggaggtcaagagatcgagaccatsctggccaacatggtgaaatcccgtttctactaaaaatacaaaaattagccaggtgtgatggcgtgctcctgtagtcccagctactcaggaggctgaggca

SEQ ID NO: 29505 - DNA, 201 bp, Homo sapiens
tgtatacttgtcggcaaatagccactatcctgaacactcccctccttttttttaatatacaggatctcactctgtggcccaggctggtgtgcagtggtgcratcatagctcactgcaccttcaaactcctgagctcaagtgatcctcccatcttagcctcccgagtagctgatactacagatgtgcattaccacgcctggc

SEQ ID NO: 29506 - DNA, 201 bp, Homo sapiens
tgcctcagcctcctgagtagctgggattacaggtgcccgccaccacacccagctaatttttgtatttttagtagagacagagtttcaccatgttggccagrctggtcttgaactcctcacctcaagtgatccacccacttcggcctcccaaagtgctgggattacaggcatgagccaccatgcccagccccatctctcttt

SEQ ID NO: 29507 - DNA, 201 bp, Homo sapiens
acatgcccagctaattttccttttttttaattcttgtagagatgtttgagacggcttgggctctgttgcccaggctgttctcaaactcctgagctcaagcratcctccctcctcagcctcctaaagtgctgggattacaggcgtgagccaccgcacccggcttccatatcctttctaattggtcatggcttgggataatgg

SEQ ID NO: 29508 - DNA, 201 bp, Homo sapiens
ttcttctgcctcagcctcctgagtagctgggattacaggtgcccgccaccacacccagctaatttttgtatttttagtagagacagagtttcaccatgttrgccaggctggtcttgaactcctcacctcaagtgatccacccacttcggcctcccaaagtgctgggattacaggcatgagccaccatgcccagccccatct

SEQ ID NO: 29509 - DNA, 201 bp, Homo sapiens
caaagatgtgattcaaagtggggatcatcggggccatcttaggtttgtctgcagtgatcactgtgccatctctctctctctcttttttttttttttttttygagacgaagtcgtcactctgtcacccaggctggagtgcagtggcatgatctcagcttaccacaatctctgcctcccaggttcaaatgattcttctgcctc

SEQ ID NO: 29510 - DNA, 201 bp, Homo sapiens
acaagttgtcaagtttgtgtgagataaaggtgcacttggttcgttcttgtctaatggcccccgcacccatgggtatttcttcagcttccacagtcatcccracactagctgggaagctccagcagccctggtcctggccccagctctgtgggcgctggccctcaactttgcctgcactgtgcttttgtgctattccccttg

SEQ ID NO: 29511 - DNA, 201 bp, Homo sapiens
acaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcct

SEQ ID NO: 29512 - DNA, 201 bp, Homo sapiens
gcagaggcccagtccctggagccaggagcctgggaggcaagccctggggctggatagcaaatcccaggagctagagacctggcttctcacctggctctgcmctaggcaagtccctttgcttcctggccccccacccctcacatcagagaaggggagttatctctgcatgccgctcctcctctgtaaaggtagggctgtggg

SEQ ID NO: 29513 - DNA, 201 bp, Homo sapiens
agtgctctagcctttttgtgcctcagtcttctcatcagtaaaatgggaatgttaatggcacctacctcatagggtcgttgggagaaccaaattgattaatmtattgtaagtacttagaacagggccaggcacaaaataagtactgcatatacagttaactatggacaaaagcttgggacctggttcatgtttaaaaatgat

SEQ ID NO: 29514 - DNA, 201 bp, Homo sapiens; identical to SEQ ID NO: 5477

SEQ ID NO: 29515 - DNA, 201 bp, Homo sapiens; identical to SEQ ID NO: 5479

SEQ ID NO: 29516 - DNA, 201 bp, Homo sapiens
aacttaagtgcccaggaaggcgtattgagatgaggtgtgcttgctggaaggcatgcctgctgctgattgaaaaccgaactgggaacattccttccattctrtgtccactggtcagctgctgcggctttggatggtcttgaccgtggaaggctgaccttcttctggtacccggagtccctgcaggaatcccccttgagcttg

SEQ ID NO: 29517 - DNA, 201 bp, Homo sapiens
gcccaggaaggcgtattgagatgaggtgtgcttgctggaaggcatgcctgctgctgattgaaaaccgaactgggaacattccttccattctgtgtccactsgtcagctgctgcggctttggatggtcttgaccgtggaaggctgaccttcttctggtacccggagtccctgcaggaatcccccttgagcttgctgggctgt

SEQ ID NO: 29518 - DNA, 201 bp, Homo sapiens
gtggagggggagttttggcttgggcattgaaggatgcataggagttttctagatggggaaagaagggaacggtagaccaggcagagggaactgcatgatawaaggtttatgggtgtgaaaattcatggaatgtttgaggattatggggttgggggatgtgggaatatgtgtagcgataaagcaccaaacaaagccaaaagt

SEQ ID NO: 29519 - DNA, 201 bp, Homo sapiens
gctgattgaaaaccgaactgggaacattccttccattctgtgtccactggtcagctgctgcggctttggatggtcttgaccgtggaaggctgaccttcttytggtacccggagtccctgcaggaatcccccttgagcttgctgggctgtggtgacaggagtttaaaacatgcgttgtattccagtgatgcatgatatgaca

SEQ ID NO: 29520 - DNA, 201 bp, Homo sapiens
ccaggcagagggaactgcatgataaaaggtttatgggtgtgaaaattcatggaatgtttgaggattatggggttgggggatgtgggaatatgtgtagcgawaaagcaccaaacaaagccaaaagtttagttagagccctgaatgcctgcctcataatggtttccatattttatatgcctactatgtgccaggcacattgct

SEQ ID NO: 29521 - DNA, 201 bp, Homo sapiens
caccgtgcccagctaatttttgtatatttagtagagatggggtttcactgcgttggccaggctggtctcaaactcctgacctcagatgatccactcgcctyggcctcccaaagtgctgggattacaggtgtgagccaccgcacctggccagtggagttccttcttaagtacatgtattgacatctttaaaaagggcgagag

SEQ ID NO: 29522 - DNA, 201 bp, Homo sapiens
agcagccgggactacaggcacctgccaccgtgcccagctaatttttgtatatttagtagagatggggtttcactgcgttggccaggctggtctcaaactcytgacctcagatgatccactcgcctcggcctcccaaagtgctgggattacaggtgtgagccaccgcacctggccagtggagttccttcttaagtacatgta

SEQ ID NO: 29523 - DNA, 201 bp, Homo sapiens
ctctgtcacccagggtggaacacagtggcgtgatcttggctcactgcaacctccgcctcctgggttctagcgattctcctgcctcagcctcctgagcagcygggactacaggcacctgccaccgtgcccagctaatttttgtatatttagtagagatggggtttcactgcgttggccaggctggtctcaaactcctgacct

SEQ ID NO: 29524 - DNA, 201 bp, Homo sapiens
gctacttgggaggctgaggtaggagaatggcttgaacccaggagaaggaggttgcagtgagcttagatcatgctactgccctccagcctgggcgacagagygagattacgtctcaaaaaaataaaaataaataaaaataaaaagattttttaaaaggctgaagtttgggttactttggctcatacactttgccttcactgt

SEQ ID NO: 29525 - DNA, 201 bp, Homo sapiens
ggaatgcagcccagtaagtctcagcctcattttacccagcccctcttcaaagctccagtttaaataaacctctgacaaaagggtgagttattcaacagatwaccagcatgagtaactgatgcttacctgccggggatctctggaagaccatgcatggcacatgcccagttatgcctgcaaaggagagggagctggggtatt

SEQ ID NO: 29526 - DNA, 201 bp, Homo sapiens
gaggccgggtgtggtggttcatgcctataatcccagcactttgggaggccgagcccagcggatcaccggaggtcaggagttcgagaccagcctggacaacrtggtaaaaccccgtctctactaaaaatacaaaaaattagtctggcatggtggcaggcgcctgtaatcccagctacttgggaggctgaggtaggagaatgg

SEQ ID NO: 29527 - DNA, 201 bp, Homo sapiens
tgtggccaaaggtgtgaaggatgcagctgtaaaagctgaagtttgaggccgggtgtggtggttcatgcctataatcccagcactttgggaggccgagcccrgcggatcaccggaggtcaggagttcgagaccagcctggacaacatggtaaaaccccgtctctactaaaaatacaaaaaattagtctggcatggtggcagg

SEQ ID NO: 29528 - DNA, 201 bp, Homo sapiens
atgaatcaaaataaagaaaaatactcagtaaatcatcataaagtacagagatgtggccaaaggtgtgaaggatgcagctgtaaaagctgaagtttgaggcygggtgtggtggttcatgcctataatcccagcactttgggaggccgagcccagcggatcaccggaggtcaggagttcgagaccagcctggacaacatggta

SEQ ID NO: 29529 - DNA, 201 bp, Homo sapiens
gtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggct

SEQ ID NO: 29530 - DNA, 201 bp, Homo sapiens
ggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggc

SEQ ID NO: 29531 - DNA, 201 bp, Homo sapiens
attggggatgaccaaccaggcctccctgctcacagccaggggaattcatcctgtcgttcttccattcagcaaatattcatggagcacctgctgtgtgccargcaccgtgctaggctctggggagatggctgtgagcgggatcgacactggccttgtgtgagctggccttgcagtaggggatatgagcaccaaacacataag

SEQ ID NO: 29532 - DNA, 201 bp, Homo sapiens
gctagtgtttgcccagcagggagaggtggaaaattggggatgaccaaccaggcctccctgctcacagccaggggaattcatcctgtcgttcttccattcarcaaatattcatggagcacctgctgtgtgccaggcaccgtgctaggctctggggagatggctgtgagcgggatcgacactggccttgtgtgagctggcctt

SEQ ID NO: 29533 - DNA, 201 bp, Homo sapiens
attttttgtatttttagtagcgacagggtctcgccatgttgtccgggctggtctggatctcctggcttcaagtgatccccctggctcagcctcccaaggtrctgggattacaggcttgagccaccgcatccagcccagatctgagatttgcacccagtatttgaactcccaagcctgtgctctttttcctcccatggacat

SEQ ID NO: 29534 - DNA, 201 bp, Homo sapiens
gggtctcgccatgttgtccgggctggtctggatctcctggcttcaagtgatccccctggctcagcctcccaaggtgctgggattacaggcttgagccaccrcatccagcccagatctgagatttgcacccagtatttgaactcccaagcctgtgctctttttcctcccatggacatttctctcagagatggtctcccaaac

SEQ ID NO: 29535 - DNA, 201 bp, Homo sapiens
tgacaggagtttaaaacatgcgttgtattccagtgatgcatgatatgacatgcatcacaggaataaaaacctgaggtctcatggatatgattgcttcaaargagaccaagttttaaaacagatgaatcaaaataaagaaaaatactcagtaaatcatcataaagtacagagatgtggccaaaggtgtgaaggatgcagctg

SEQ ID NO: 29536 - DNA, 201 bp, Homo sapiens
ttaaaaaacagacaaaccgcaagtagttctttggaagctcagatttctcttttgtttcttagtaaaacatttcccagttcccagctcccttccagggtgtragatttcttcggtaacttacatctagctgttgcttcttgtttgctcatgtttagaaagaaagacaaaagagagtgagaattttctctcccttccccagtc

SEQ ID NO: 29537 - DNA, 201 bp, Homo sapiens
tgcacttgtaaggccgggcactgtggtggctcgcggctgtaatcccagccctttgggaggccgaggtgggcagatcacttgaggtcaggagttcgagaccrgcctggccaacatggtgaagctccatctctactaaaaatacaacaattaactgggtgtagtggcgcacacctgtaatcccagctactagggaggctgagg

SEQ ID NO: 29538 - DNA, 201 bp, Homo sapiens
cagaaccccagacttcaccactaggcagcatatccagtgagaacagatctgaggcttgccatcaaaattgcacttgtaaggccgggcactgtggtggctcrcggctgtaatcccagccctttgggaggccgaggtgggcagatcacttgaggtcaggagttcgagaccggcctggccaacatggtgaagctccatctctac

SEQ ID NO: 29539 - DNA, 201 bp, Homo sapiens
gcatgtctgaagtagacagccatcaggacatggtgatttcaggctgggctttgaagaatgaataggagtttttcaagtgtcgaaactgaaccctgaccaamctttgcttttgcagacactggaagaattgtcttaccaagctcttgccctgttttctggagcacaacatgaaaagggatgaagatcctcacaaggctgcca

SEQ ID NO: 29540 - DNA, 201 bp, Homo sapiens
caaccagagcagccgtgcctgttgttaaaatcttgacctaattgtatacttgtcggcaaatagccactatcctgaacactcccctccttttttttaatatmcaggatctcactctgtggcccaggctggtgtgcagtggtgcgatcatagctcactgcaccttcaaactcctgagctcaagtgatcctcccatcttagcct

SEQ ID NO: 29541 - DNA, 201 bp, Homo sapiens
tgttggccaagctggtctcgaactcctgaactcaggtgatccacccgcctcagcgtcccaaagtgctgggattacaggcatgagccactgagcccggcctyctcctttatcttaattgaaataattcagaaatggaaagtcaaatactgcatgttctcacttataagtaagagttaaataatgtgtacacatgggcattat

SEQ ID NO: 29542 - DNA, 201 bp, Homo sapiens
cctgagtttcactggtgtgtcaggtacatggtgataccccttgggagtgctgttatagttaacaaccagagcagccgtgcctgttgttaaaatcttgaccyaattgtatacttgtcggcaaatagccactatcctgaacactcccctccttttttttaatatacaggatctcactctgtggcccaggctggtgtgcagtgg

SEQ ID NO: 29543 - DNA, 201 bp, Homo sapiens
cacccggctaatttttcgtatttttagtagagaccggttttcatcatgttggccaagctggtctcgaactcctgaactcaggtgatccacccgcctcagcstcccaaagtgctgggattacaggcatgagccactgagcccggcctcctcctttatcttaattgaaataattcagaaatggaaagtcaaatactgcatgtt

SEQ ID NO: 29544 - DNA, 201 bp, Homo sapiens
tatgttatttaatattttcatatttctagatctgccttcaggcatggctggatccagcttctaggaacctgtccagctctgcgccctgctttattctgtaytggcttcgtttttaggcaggctcttccctcatgtagtggcagatatgcctactagttgctccaggcctacatcccaaagccacagtgggaaaagggtttt

SEQ ID NO: 29545 - DNA, 201 bp, Homo sapiens
ccacacccggctaatttttcgtatttttagtagagaccggttttcatcatgttggccaagctggtctcgaactcctgaactcaggtgatccacccgcctcrgcgtcccaaagtgctgggattacaggcatgagccactgagcccggcctcctcctttatcttaattgaaataattcagaaatggaaagtcaaatactgcat

SEQ ID NO: 29546 - DNA, 201 bp, Homo sapiens
aagcgattctcctgtctcagcctcccgagtagttgggattaatggtgcctgccaccacacccggctaatttttcgtatttttagtagagaccggttttcaycatgttggccaagctggtctcgaactcctgaactcaggtgatccacccgcctcagcgtcccaaagtgctgggattacaggcatgagccactgagcccggc

SEQ ID NO: 29547 - DNA, 201 bp, Homo sapiens
tgtttgtttgtttgtttgttttctttgagacagagtttcgctcttgttgcccaggctggagtgcagtggcacaatctcggctcactgcaacctctgcctcscgggttcaagcgattctcctgtctcagcctcccgagtagttgggattaatggtgcctgccaccacacccggctaatttttcgtatttttagtagagaccg

SEQ ID NO: 29548 - DNA, 201 bp, Homo sapiens
atccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctgc

SEQ ID NO: 29549 - DNA, 201 bp, Homo sapiens
aatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctg

SEQ ID NO: 29550 - DNA, 201 bp, Homo sapiens
aaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctct

SEQ ID NO: 29551 - DNA, 201 bp, Homo sapiens; identical to SEQ ID NO: 5480

SEQ ID NO: 29552 - DNA, 201 bp, Homo sapiens; identical to SEQ ID NO: 5481

SEQ ID NO: 29553 - DNA, 201 bp, Homo sapiens; identical to SEQ ID NO: 5482

SEQ ID NO: 29554 - DNA, 201 bp, Homo sapiens
ccccaccctcagctccctctgtaataggaaaatctctgaactctctgtagttgctccagcaatcttttggaactttgcttctttcttgtgaaaaaacctcyccttggctcactttgcaccaggtttccccaaatgtgcttccaaccacaagcagaaatggagctgccagtaaccaggaagaaactgccgggggctgaggaa

SEQ ID NO: 29555 - DNA, 201 bp, Homo sapiens
gttgggagtctggacatagcttagccaggttctctgctttagagtctcgtgaggctataatcaaggtgtgggatggggctgcagtttcatctgaggctcarttggggaagggtcacttctaagctcatacaatattggtgacattcagtccctggcaggctgttgaactgagagcctcagtttcgtgctggctgttggttg

SEQ ID NO: 29556 - DNA, 201 bp, Homo sapiens
ccaaacatacctccagacactgctgtgagtgctgtgtctctgttaactcctggaattcacccatccagaggaaccaggatgcaagaggttaagaaacttgycgtctgggtttgggttccccatacaaggattcaaatagttgatttaggaagtaatcccgggaaaccctgctaaggtagtggggaactgaggcagggaagg

SEQ ID NO: 29557 - DNA, 201 bp, Homo sapiens
atttttttttgtatttttggtagagacaggtttcaccatgttggccaggctggttgtgaactcctaaagtgctgggattacagatgtgagccaccacgccyggccccagtacacactttttggagggtatttgacgttatgtaccaggagtgctggggaaaagtacacacttgactccgtgagattctgcttcttagcatt

SEQ ID NO: 29558 - DNA, 201 bp, Homo sapiens
caaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctc

SEQ ID NO: 29559 - DNA, 201 bp, Homo sapiens
tgtggtggtgggcacctgtaatcccagctactcgggaggctgaggcagaagaatcgcttgaacccgggaggtggaggttgcagtgagctgagattgcaccrctgcactccagccttggagacagagcgagactctgtctcggaaaaacaaacaaacaagcaaacaaacaaacaaataaatggccagggcaggggagggttg

SEQ ID NO: 29560 - DNA, 201 bp, Homo sapiens
catggtgaaaccccgtctctactaaaaatacaaaaattagccaggtgtggtggtgggcacctgtaatcccagctactcgggaggctgaggcagaagaatcrcttgaacccgggaggtggaggttgcagtgagctgagattgcaccgctgcactccagccttggagacagagcgagactctgtctcggaaaaacaaacaaac

SEQ ID NO: 29561 - DNA, 201 bp, Homo sapiens
tggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttg

SEQ ID NO: 29562 - DNA, 201 bp, Homo sapiens
cattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactcg

SEQ ID NO: 29563 - DNA, 201 bp, Homo sapiens
ccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactc

SEQ ID NO: 29564 - DNA, 201 bp, Homo sapiens
gccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcact

SEQ ID NO: 29565 - DNA, 201 bp, Homo sapiens
ggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcc

SEQ ID NO: 29566 - DNA, 201 bp, Homo sapiens
ccagccccatctctctttaaaaaacaaacaaacaaacaaaaaacataaaaagaagcagagaacacatacacatctgcatcttcccttgtttacttaacaayagatcttggaagtcacttctcagtagaggctaggttgggcagagcattggattctaggccagtgagtttggacttgaccatggagacactaggaagccca

SEQ ID NO: 29567 - DNA, 201 bp, Homo sapiens
acaaaaaacataaaaagaagcagagaacacatacacatctgcatcttcccttgtttacttaacaatagatcttggaagtcacttctcagtagaggctaggytgggcagagcattggattctaggccagtgagtttggacttgaccatggagacactaggaagcccatgaaggacagagagagatgcctcgaccctgccagt

SEQ ID NO: 29568 - DNA, 201 bp, Homo sapiens
accctatttgaaatacttacgtatattaacccatttccttatcaccacaaccctgcgggaagggagataggcacttttattatcttcattttgcagatgasgacattgaggtccagagaggttatgtcacttacttaaggtcacacagccaggaagtggtagtagggactcttacccttgttttacagatgagattgaatt

SEQ ID NO: 29569 - DNA, 201 bp, Homo sapiens
cagccttcccagtagctggggctacaggcatgtgccacctctaataacttttctttaatttacaatagtattagtttgttctcatgctgctctaaggacaygcccaagactgggtaatttataaaggaaagaggtttgactcacagttctgcagggctggggaggcttcaggaaacatattatcatggcggaaagggaagc

SEQ ID NO: 29570 - DNA, 201 bp, Homo sapiens
tctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggat

SEQ ID NO: 29571 - DNA, 201 bp, Homo sapiens
cttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 29572 - DNA, 201 bp, Homo sapiens
gcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 29573 - DNA, 201 bp, Homo sapiens
actccctcagccctgcctttacacagaatttgtgggggatgaggggagggggaaaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaaga

SEQ ID NO: 29574 - DNA, 201 bp, Homo sapiens
ctgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgt

SEQ ID NO: 29575 - DNA, 201 bp, Homo sapiens
aacaaggggtggattattatgcctcccttttagaccatatagggtaacttcctgatgttgccatggcatttgtaaactgtcatggcgctgttgggagtgtrgcagtgaggacaaccagaggtcactcttgttgccatcttggttttggtgggttagagccatcttctttactgcaacctgttttatcagcaaggtctttat

SEQ ID NO: 29576 - DNA, 201 bp, Homo sapiens
tcatgcaagaaagaattcagagcgagtccatagagtcagtgaaagcaagttaatgaggaaagtaaaggaataaaagaatggctactccgtagacagagcasccctgagggttgctggctgcctatttttatggttattgattaattatattccaaacaaggggtggattattatgcctcccttttagaccatatagggtaa

SEQ ID NO: 29577 - DNA, 201 bp, Homo sapiens
tgccaccacgccaggctaattttgtatttttaatagagatggggtttcttcatgttggtcaggctggtctggaactcctaatatcagatgatccacccacytcagcctcccaaagtgctgggattacaggcgtgagccactgcacccagcctagttggctgacttttacctgggacagtgcaggtgcctgagccatgtgcc

SEQ ID NO: 29578 - DNA, 201 bp, Homo sapiens
tacagatgagattgaattatctcacgaaaactcagaaaggttaaacaacttgcctaagtaacatacagctaattagtcgaggagcctgacgcatgttgctstagcctggtcacagttacagaggtggcaagcaatggcctgaacaggacgaacaaccaaatacccaggctggtggctcttaaacatggtggggtcagctaa

SEQ ID NO: 29579 - DNA, 201 bp, Homo sapiens
cttgcctaagtaacatacagctaattagtcgaggagcctgacgcatgttgctctagcctggtcacagttacagaggtggcaagcaatggcctgaacaggaygaacaaccaaatacccaggctggtggctcttaaacatggtggggtcagctaacgacagcaaccagggtgggcactggtgcccctcgcccccggctggtgc

SEQ ID NO: 29580 - DNA, 201 bp, Homo sapiens
caatcctgccattagatacacctgccgtggtgtatctgccaggtaggcaggctaggctgcagtaacacacaagcccacaatttccatggcttaacactatrggaatatatttcttgctcacgtaacaagctaacgtgaatgttgctggtttgtaggtggtttccctccctgtagaaatctggggagtgaggttctttccat

SEQ ID NO: 29581 - DNA, 201 bp, Homo sapiens
ggaagggctccttcaagcccagcgagcatggtgagcagggcggagtgcggcaggggtggctgggtgtgttcccacagctgcctgggctgagggtggggtgrgcaggggaggaggtggggtcatagcaacagcaggaggaagccgcctgtattttcccaaatctgatgggattcctgcccctgcctgggcctcagtcctccc

SEQ ID NO: 29582 - DNA, 201 bp, Homo sapiens
gtgccaccacgccaggctaattttgtatttttaatagagatggggtttcttcatgttggtcaggctggtctggaactcctaatatcagatgatccacccayctcagcctcccaaagtgctgggattacaggcgtgagccactgcacccagcctagttggctgacttttacctgggacagtgcaggtgcctgagccatgtgc

SEQ ID NO: 29583 - DNA, 201 bp, Homo sapiens; identical to SEQ ID NO: 5493

SEQ ID NO: 29584 - DNA, 201 bp, Homo sapiens
gattacaggcatgtgccaccacgccaggctaattttgtatttttaatagagatggggtttcttcatgttggtcaggctggtctggaactcctaatatcagrtgatccacccacctcagcctcccaaagtgctgggattacaggcgtgagccactgcacccagcctagttggctgacttttacctgggacagtgcaggtgcc

SEQ ID NO: 29585 - DNA, 201 bp, Homo sapiens
aattttcttgcctcagcctcccaagtagctgggattacaggcatgtgccaccacgccaggctaattttgtatttttaatagagatggggtttcttcatgtyggtcaggctggtctggaactcctaatatcagatgatccacccacctcagcctcccaaagtgctgggattacaggcgtgagccactgcacccagcctagtt

SEQ ID NO: 29586 - DNA, 201 bp, Homo sapiens
gacagttggctttttttttttttttctttttctgagacggagttttgctcttattgcccaggagtgcaatggcgtgatcttggctcactgcaacctctgcytcctgggttcaagcaattttcttgcctcagcctcccaagtagctgggattacaggcatgtgccaccacgccaggctaattttgtatttttaatagagatg

SEQ ID NO: 29587 - DNA, 201 bp, Homo sapiens
gtctgacagttggctttttttttttttttctttttctgagacggagttttgctcttattgcccaggagtgcaatggcgtgatcttggctcactgcaacctstgcctcctgggttcaagcaattttcttgcctcagcctcccaagtagctgggattacaggcatgtgccaccacgccaggctaattttgtatttttaataga

SEQ ID NO: 29588 - DNA, 201 bp, Homo sapiens
ccgtccccgtagcctccctccgtgtctgacagttggctttttttttttttttctttttctgagacggagttttgctcttattgcccaggagtgcaatggcrtgatcttggctcactgcaacctctgcctcctgggttcaagcaattttcttgcctcagcctcccaagtagctgggattacaggcatgtgccaccacgccag

SEQ ID NO: 29589 - DNA, 201 bp, Homo sapiens
cttgctcacgtaacaagctaacgtgaatgttgctggtttgtaggtggtttccctccctgtagaaatctggggagtgaggttctttccatcttgtggtgccrtcattctccaggacaaagattcttacctacttttgtgtcctggtttcctttggcagcctggtgaagcctatggacctcatttcagaatatttttaaatac

SEQ ID NO: 29590 - DNA, 201 bp, Homo sapiens
acggtgtttcaccatattggccaggctggtctcgaacttctgacctcaggtgatacacctgccttggcctcccaaagtgctgggattacaggcgtgagccrccatgcctggcctcatataagcatttctgtctccatttatcatccatctttccctcttgaaggtcagtttcaccaaggcaggcatctttgtctcgttcac

SEQ ID NO: 29591 - DNA, 201 bp, Homo sapiens
taacaagctaacgtgaatgttgctggtttgtaggtggtttccctccctgtagaaatctggggagtgaggttctttccatcttgtggtgccatcattctccmggacaaagattcttacctacttttgtgtcctggtttcctttggcagcctggtgaagcctatggacctcatttcagaatatttttaaatacataaaatccc

SEQ ID NO: 29592 - DNA, 201 bp, Homo sapiens
agtagagacggtgtttcaccatattggccaggctggtctcgaacttctgacctcaggtgatacacctgccttggcctcccaaagtgctgggattacaggcrtgagccgccatgcctggcctcatataagcatttctgtctccatttatcatccatctttccctcttgaaggtcagtttcaccaaggcaggcatctttgtct

SEQ ID NO: 29593 - DNA, 201 bp, Homo sapiens
ctacttttgtgtcctggtttcctttggcagcctggtgaagcctatggacctcatttcagaatatttttaaatacataaaatcccagcctgggcaatatagwgaaacccccatctgtacaaaaattagccaggcatggtggcatgcacctgtagtcccaggtactgggaaggctgaggtgggaggatcacttgagcccagga

SEQ ID NO: 29594 - DNA, 201 bp, Homo sapiens
tttagtagagacggtgtttcaccatattggccaggctggtctcgaacttctgacctcaggtgatacacctgccttggcctcccaaagtgctgggattacargcgtgagccgccatgcctggcctcatataagcatttctgtctccatttatcatccatctttccctcttgaaggtcagtttcaccaaggcaggcatctttg

SEQ ID NO: 29595 - DNA, 201 bp, Homo sapiens
gaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcat

SEQ ID NO: 29596 - DNA, 201 bp, Homo sapiens
cacagctaggaaatcctggagccaggatttgaacccgggtctgacctaagagctcccagccgccgtgatatatcagcttatgtcatcctgacacctacgcrgatgtcggctcgaatccactttgcctgagcattgtctcagagaaatctaatttaaaaattaggcagcaaatagaaaatatatttgactgctagagatgca

SEQ ID NO: 29597 - DNA, 201 bp, Homo sapiens
agttgggaggctcaatgattatcccaattttacagataaggaaacaggtccagagaggttgaggattagcctagaaccacacagctaggaaatcctggagycaggatttgaacccgggtctgacctaagagctcccagccgccgtgatatatcagcttatgtcatcctgacacctacgcagatgtcggctcgaatccactt

SEQ ID NO: 29598 - DNA, 201 bp, Homo sapiens
agtaagtctcagcctcattttacccagcccctcttcaaagctccagtttaaataaacctctgacaaaagggtgagttattcaacagattaccagcatgagyaactgatgcttacctgccggggatctctggaagaccatgcatggcacatgcccagttatgcctgcaaaggagagggagctggggtatttgtccaccagct

SEQ ID NO: 29599 - DNA, 201 bp, Homo sapiens
gctgtttccaatggctctgcttaactgagacctgagagtgattgctccatctgtggtggcatatgggctgaaactgcctagcagcatgtcagaagtggggygttcgcaggacatccttgtccaggttggcagttgagcttggcaggtgaccgctgagaccccttccaactccaccacttcaggaatctctttttttttttt

SEQ ID NO: 29600 - DNA, 201 bp, Homo sapiens
aattattcgagcatggtggtgtgtgcctgtagtcacaactacttgggaggctaaggcaggaggatcacttgagcccaggagttcaaggctgcactgagccrtgacggtgcgactgcattctagccacagaatgagaccctgtctctaaagcaaaaaagagaaggagaataagtgaggtacttgagcaagtgggtgaggatg

SEQ ID NO: 29601 - DNA, 201 bp, Homo sapiens
taatttcaaagtagataagcataaataatactttatgatactgaaattgtgatgtgatatgagaatagctgtgagttttgttttgctggggacaggatcastgatgctgtcattactggggtctcttccctccattctttttttaaaattgtattttattttatttttaaaattttaaaataaatagagacagggtatcac

SEQ ID NO: 29602 - DNA, 201 bp, Homo sapiens
gccaagtgatatctcttcccttctgctgtcttcccttctgccatccttcacatggtggcattgtatccttagacttgccacccatgccctcaggttggccrttgcacactgtcttacataaagcaggaaggaaaggaaaggctgctacgagagagtgtaccttgtgcatctcttttttaatcaggaagcaaacatctttct

SEQ ID NO: 29603 - DNA, 201 bp, Homo sapiens; identical to SEQ ID NO: 5485

SEQ ID NO: 29604 - DNA, 201 bp, Homo sapiens; identical to SEQ ID NO: 5486

SEQ ID NO: 29605 - DNA, 201 bp, Homo sapiens
attggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggcgggggaggct

SEQ ID NO: 29606 - DNA, 201 bp, Homo sapiens
ctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctg

SEQ ID NO: 29607 - DNA, 201 bp, Homo sapiens
aaggctctccaaggagggaaaatttgaggggggccctgactggggagaatgagctggccagggataagcaagatggagtcatcccacatccccttacaacrctgggtgcctgggcaactgggggcatttgggggcatgtggtaggagccagaggaatttgcgacgattgccctgatggagtcaggagacctgggtttgaat

SEQ ID NO: 29608 - DNA, 201 bp, Homo sapiens
ctaaaaccggcatcctactggggagactgaaaatacatatcaatcacaaacaggtggttttccatagtgacccactctctgaatgcactagaccagggtgsaggccagagatcttctggggtgctttttgcaagggggaccaggataaggctctccaaggagggaaaatttgaggggggccctgactggggagaatgagct

SEQ ID NO: 29609 - DNA, 201 bp, Homo sapiens
tcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttcttttttttttttttttttttttttgagac

SEQ ID NO: 29610 - DNA, 201 bp, Homo sapiens
cagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggc

SEQ ID NO: 29611 - DNA, 201 bp, Homo sapiens
aaaagcaaacatataaagaaagaaagaaatcacatggatctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaa

SEQ ID NO: 29612 - DNA, 201 bp, Homo sapiens
tgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagca

SEQ ID NO: 29613 - DNA, 201 bp, Homo sapiens
atatctcttcccttctgctgtcttcccttctgccatccttcacatggtggcattgtatccttagacttgccacccatgccctcaggttggccgttgcacaytgtcttacataaagcaggaaggaaaggaaaggctgctacgagagagtgtaccttgtgcatctcttttttaatcaggaagcaaacatctttctagaagctt

SEQ ID NO: 29614 - DNA, 201 bp, Homo sapiens
atctcttcccttctgctgtcttcccttctgccatccttcacatggtggcattgtatccttagacttgccacccatgccctcaggttggccgttgcacactrtcttacataaagcaggaaggaaaggaaaggctgctacgagagagtgtaccttgtgcatctcttttttaatcaggaagcaaacatctttctagaagcttcc

SEQ ID NO: 29615 - DNA, 201 bp, Homo sapiens
tgtaccttgtgcatctcttttttaatcaggaagcaaacatctttctagaagcttccctagcaaaattccccttacatctcattggccaagactgttacatrttacatggttactgttattacttgctcattgcaaggaagactgggaactcaaatgcctggaaaaaggaacaggataatcgtgattggctcaagccttagg

SEQ ID NO: 29616 - DNA, 201 bp, Homo sapiens; identical to SEQ ID NO: 5501

SEQ ID NO: 29617 - DNA, 201 bp, Homo sapiens
gcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcagggggcaacggtagggagggtgtcggggaaaactttt

SEQ ID NO: 29618 - DNA, 201 bp, Homo sapiens
tccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaat

SEQ ID NO: 29619 - DNA, 201 bp, Homo sapiens
tcgtgaaaactcaatgaaagaagattcttcaacgtggtaggtgcagtggcagctggcagtaccctgaccctgccaccgcacagccctctcagcattgctcrtcctgcactgtggatatcagttgagccacgtgtctcctgccctgggctgtgagctccataggcagggtctccatggctgtatctccagaacccagcacag

SEQ ID NO: 29620 - DNA, 201 bp, Homo sapiens
ttgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccgttgcacactgtcttacataaagcaggaaggaaaggaaaggct

SEQ ID NO: 29621 - DNA, 201 bp, Homo sapiens
cacttcctctcaaattctattggtgaaaatggtcacatgactacacatagccacaaaggaggctgggaactttctcacttggaacctacatcccagaaacractcttttcagtgaggtatcccacaggtctttcgcagtagaaatattgattatctcacataaaatgaagtcttacaaatggacctactgggttttgtaca

SEQ ID NO: 29622 - DNA, 201 bp, Homo sapiens
ggaagtgggccgcatcacttcctctcaaattctattggtgaaaatggtcacatgactacacatagccacaaaggaggctgggaactttctcacttggaacstacatcccagaaacaactcttttcagtgaggtatcccacaggtctttcgcagtagaaatattgattatctcacataaaatgaagtcttacaaatggacct

SEQ ID NO: 29623 - DNA, 201 bp, Homo sapiens
ctatgttgcccaggctgcttttgacctcctgggctccagtgatcttcccatcttggcttcccaaagtgctgggattacaagtgggagccagtgttcctggycccttcctccattcttaatggaaggagatgctaggtgtgagaggttagggaaagtaaagatgtaatttctttcccatccaagttctcagacccctgaatt

SEQ ID NO: 29624 - DNA, 201 bp, Homo sapiens
tattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctgg

SEQ ID NO: 29625 - DNA, 201 bp, Homo sapiens
tgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaa

SEQ ID NO: 29626 - DNA, 201 bp, Homo sapiens
cctgccgtggtgtatctgccaggtaggcaggctaggctgcagtaacacacaagcccacaatttccatggcttaacactataggaatatatttcttgctcaygtaacaagctaacgtgaatgttgctggtttgtaggtggtttccctccctgtagaaatctggggagtgaggttctttccatcttgtggtgccatcattctc

SEQ ID NO: 29627 - DNA, 201 bp, Homo sapiens
taaggaggctgtttccaatggctctgcttaactgagacctgagagtgattgctccatctgtggtggcatatgggctgaaactgcctagcagcatgtcagargtggggtgttcgcaggacatccttgtccaggttggcagttgagcttggcaggtgaccgctgagaccccttccaactccaccacttcaggaatctcttttt

SEQ ID NO: 29628 - DNA, 201 bp, Homo sapiens
aagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtt

SEQ ID NO: 29629 - DNA, 201 bp, Homo sapiens
ccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagag

SEQ ID NO: 29630 - DNA, 201 bp, Homo sapiens
atagaaggtgctcaataaatatgtgtttatttattgaaaccatgggcagaggctaattcagaagcggtctgaggaccttacctcccagtgatgatgcaccrtggccccaggcaggccaggaagagagaagggttgtgtttctccgtaggtcccccagcttcccaggccatcccaggccattccctggtcatttgccctcag

SEQ ID NO: 29631 - DNA, 201 bp, Homo sapiens
gggcatggctccctgacaagggagagaggaaaaagctgttgagtgaagaagactgcttcagtttccccatctgtataatgggaggagtaagggctgtcgtraaaactcaatgaaagaagattcttcaacgtggtaggtgcagtggcagctggcagtaccctgaccctgccaccgcacagccctctcagcattgctcatcct

SEQ ID NO: 29632 - DNA, 201 bp, Homo sapiens
acatgaagaagtgtggttcagaacacctgggctgttaaggaccttcactggcttctggaatggcaaatagacagtcaggagggttgcaggggagacagagrcagaagccgaatgaggtcattagcagaccagaggctttcccgcccttccccttggcaatcccagcctggggtgggcttctctggggttggtttcctgttt

SEQ ID NO: 29633 - DNA, 201 bp, Homo sapiens
aagattcttcaacgtggtaggtgcagtggcagctggcagtaccctgaccctgccaccgcacagccctctcagcattgctcatcctgcactgtggatatcarttgagccacgtgtctcctgccctgggctgtgagctccataggcagggtctccatggctgtatctccagaacccagcacagaaccaggtgcttgggaaagt

SEQ ID NO: 29634 - DNA, 201 bp, Homo sapiens
atgaggatgcggaggcacagagaagataagggacttgtcctgtgtcacacagcaaggagccatccggctcctaagttggtgcatttgacttctgtgcttcyggaaagaaagagcagcaagtttaagatctggaggtggcactgagctttggaggagcagggggcaatgaggtggccggtgtgacgaggactcaatgtgcaa

SEQ ID NO: 29635 - DNA, 201 bp, Homo sapiens
ctgggcttttatatcataggatgcctctaatggcaatcctgccattagatacacctgccgtggtgtatctgccaggtaggcaggctaggctgcagtaacamacaagcccacaatttccatggcttaacactataggaatatatttcttgctcacgtaacaagctaacgtgaatgttgctggtttgtaggtggtttccctcc

SEQ ID NO: 29636 - DNA, 201 bp, Homo sapiens
ccattcttcccctgtggccagacacttcccctggctgagtctctgggcttttatatcataggatgcctctaatggcaatcctgccattagatacacctgcygtggtgtatctgccaggtaggcaggctaggctgcagtaacacacaagcccacaatttccatggcttaacactataggaatatatttcttgctcacgtaac

SEQ ID NO: 29637 - DNA, 201 bp, Homo sapiens
tagagggttgtccaaggaaggccacatccagaagcatctcccaggacagttgttgtgtagctcaccctctggactttgtgggtctgggtgttgtttcatgwttatagagagagctctgtgaacgtggaggacctgttgtcggcagagacacaaatggccagggcatggctgggcagccgcagtggctcaggcctgtaatcc

SEQ ID NO: 29638 - DNA, 201 bp, Homo sapiens
aggaggccgaggcaggaggatcgcttgagcccaggagttcgaggtcagcttgggcaacatagggagaccttgtctctacaaataataaaatattagccagrtgtggcagtgcacgcctgtagccccagctactcaggaggccgaggtgggaggatcccttgaactcaggaggtcaaggctgcagtgaactgtgatcgcgcc

SEQ ID NO: 29639 - DNA, 201 bp, Homo sapiens
tttcatctgaggctcaattggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagt

SEQ ID NO: 29640 - DNA, 201 bp, Homo sapiens
ggcacaggccaccacgccaggctaattttttgtatttttagtagcgacagggtctcgccatgttgtccgggctggtctggatctcctggcttcaagtgatmcccctggctcagcctcccaaggtgctgggattacaggcttgagccaccgcatccagcccagatctgagatttgcacccagtatttgaactcccaagcctg

SEQ ID NO: 29641 - DNA, 201 bp, Homo sapiens
ttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtct

SEQ ID NO: 29642 - DNA, 201 bp, Homo sapiens
gtgacggacccaccagaaccccagacttcaccactaggcagcatatccagtgagaacagatctgaggcttgccatcaaaattgcacttgtaaggccgggcrctgtggtggctcgcggctgtaatcccagccctttgggaggccgaggtgggcagatcacttgaggtcaggagttcgagaccggcctggccaacatggtgaa

SEQ ID NO: 29643 - DNA, 201 bp, Homo sapiens
gtttccacccctgaacttaagtgcccaggaaggcgtattgagatgaggtgtgcttgctggaaggcatgcctgctgctgattgaaaaccgaactgggaacaktccttccattctgtgtccactggtcagctgctgcggctttggatggtcttgaccgtggaaggctgaccttcttctggtacccggagtccctgcaggaatc

SEQ ID NO: 29644 - DNA, 201 bp, Homo sapiens; identical to SEQ ID NO: 5498

SEQ ID NO: 29645 - DNA, 201 bp, Homo sapiens
gtgtaacaaatgaccccgaaatgtagagggttacaacaactttatttagcttatgcttctgcaggctggcatttggggctgggctcagcagtgagggtggygggggaggctgggctgggctgggctgggcagatctgaattgagctgacccgtccccgtagcctccctccgtgtctgacagttggcttttttttttttttt

SEQ ID NO: 29646 - DNA, 201 bp, Homo sapiens
gtggaggggtggtcggcggtcagatcgtggagggtctcggacgagggtcctgaccctgggtctccagtcctgggaagtggagcccaggctgtaccatggckgacctcagctcatggcttcccctcccacttccagcctacagggagcccttcgagcagcacctcctgctgggcgtcagcgtttcctgcattgtcatcctgg

SEQ ID NO: 29647 - DNA, 201 bp, Homo sapiens
cagcctacagggagcccttcgagcagcacctcctgctgggcgtcagcgtttcctgcattgtcatcctggccgtctgcctgttgtgctatgtcagcatcacsaagtgagtcctgggcccagtgctgccgagcagtccctctggagtgcagggtggcagggacttgcccctctagtctgcccctttgcagtcctctcagtcaa

SEQ ID NO: 29648 - DNA, 201 bp, Homo sapiens
aaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatc

SEQ ID NO: 29649 - DNA, 201 bp, Homo sapiens
ctggagttgcaggcagtggagttctgtcctaagcagtgggcacctaaacccgatggcataaaagctgggcgggtgtccacctgcatctgccacagcactgyaggcaccaactgtggctcatactgagtgggataaattccagaaagaaacattaggaacttactatagaattttggggctagagctactcattcattcccc

SEQ ID NO: 29650 - DNA, 201 bp, Homo sapiens
cctggagttgcaggcagtggagttctgtcctaagcagtgggcacctaaacccgatggcataaaagctgggcgggtgtccacctgcatctgccacagcactrcaggcaccaactgtggctcatactgagtgggataaattccagaaagaaacattaggaacttactatagaattttggggctagagctactcattcattccc

SEQ ID NO: 29651 - DNA, 201 bp, Homo sapiens
gaggtgggaggatcccttgaactcaggaggtcaaggctgcagtgaactgtgatcgcgccactccactccagcctgcgtgagaaagtgagaccctgtcaaamaaaaagagaaggtgatggggaaagaacacagaacagcataagagggggttggggaagctgggtggagtgggggggattgcagttgaaagtagggaagtca

SEQ ID NO: 29652 - DNA, 201 bp, Homo sapiens
ttaatattttcatatttctagatctgccttcaggcatggctggatccagcttctaggaacctgtccagctctgcgccctgctttattctgtactggcttcrtttttaggcaggctcttccctcatgtagtggcagatatgcctactagttgctccaggcctacatcccaaagccacagtgggaaaagggttttttttcttg

SEQ ID NO: 29653 - DNA, 201 bp, Homo sapiens
tgagaaagtgagaccctgtcaaaaaaaaagagaaggtgatggggaaagaacacagaacagcataagagggggttggggaagctgggtggagtgggggggaytgcagttgaaagtagggaagtcagggaaggcctcattgagctgacttggaggaagcgggaaccgtgcagatgtctggggaaggctcattcttggcagaga

SEQ ID NO: 29654 - DNA, 201 bp, Homo sapiens
gtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggag

SEQ ID NO: 29655 - DNA, 201 bp, Homo sapiens
atggaggcgcctgagtggtctcatgctcaggtggtttagcaaactcagtgtacatcctgccaattccagtcctgccatggccactgacaagctaggagggygctgaaaggagaaggaccccgatgtctcctccagcccatccatctcctctctcccattggccaaacccaaccggaaactaaaggccaagggtacccggtg

SEQ ID NO: 29656 - DNA, 201 bp, Homo sapiens
tgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttg

SEQ ID NO: 29657 - DNA, 201 bp, Homo sapiens
gcaagtccctttgcttcctggccccccacccctcacatcagagaaggggagttatctctgcatgccgctcctcctctgtaaaggtagggctgtgggccacrtctgtgtttcccagtttgggggacacaagtgatcgtaggtggcacattgacagctcacttgaataaccctattattgaagagaataatactgactcaaga

SEQ ID NO: 29658 - DNA, 201 bp, Homo sapiens
gtacatcctgccaattccagtcctgccatggccactgacaagctaggagggcgctgaaaggagaaggaccccgatgtctcctccagcccatccatctcctstctcccattggccaaacccaaccggaaactaaaggccaagggtacccggtgatgaagactgtggtatcagcctcctgagcacagagagggcagaaagggg

SEQ ID NO: 29659 - DNA, 201 bp, Homo sapiens
aaacatacctccagacactgctgtgagtgctgtgtctctgttaactcctggaattcacccatccagaggaaccaggatgcaagaggttaagaaacttgccrtctgggtttgggttccccatacaaggattcaaatagttgatttaggaagtaatcccgggaaaccctgctaaggtagtggggaactgaggcagggaaggac

SEQ ID NO: 29660 - DNA, 201 bp, Homo sapiens
gcaaaacaccgaaaaaacaaaaaacccagcaagtgtttgagctcccaccacgagggaggcctgacgtcactggatcctcccggcagccgatgaggctgcakgggacttgcccacgatgtgctgttaccgagtggcatagccaggcttcaaaccagagtcctagctaaccgccctgtatataccatgggctcatcatcttcc

SEQ ID NO: 29661 - DNA, 201 bp, Homo sapiens; identical to SEQ ID NO: 5487

SEQ ID NO: 29662 - DNA, 201 bp, Homo sapiens; identical to SEQ ID NO: 5488

SEQ ID NO: 29663 - DNA, 201 bp, Homo sapiens; identical to SEQ ID NO: 5489

SEQ ID NO: 29664 - DNA, 201 bp, Homo sapiens; identical to SEQ ID NO: 5490

SEQ ID NO: 29665 - DNA, 201 bp, Homo sapiens
ggctctgccctaggcaagtccctttgcttcctggccccccacccctcacatcagagaaggggagttatctctgcatgccgctcctcctctgtaaaggtagrgctgtgggccacatctgtgtttcccagtttgggggacacaagtgatcgtaggtggcacattgacagctcacttgaataaccctattattgaagagaataa

SEQ ID NO: 29666 - DNA, 201 bp, Homo sapiens
aggcaagccctggggctggatagcaaatcccaggagctagagacctggcttctcacctggctctgccctaggcaagtccctttgcttcctggccccccacycctcacatcagagaaggggagttatctctgcatgccgctcctcctctgtaaaggtagggctgtgggccacatctgtgtttcccagtttgggggacacaag

SEQ ID NO: 29667 - DNA, 201 bp, Homo sapiens
atgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcc

SEQ ID NO: 29668 - DNA, 201 bp, Homo sapiens
catcctgccaattccagtcctgccatggccactgacaagctaggagggcgctgaaaggagaaggaccccgatgtctcctccagcccatccatctcctctcwcccattggccaaacccaaccggaaactaaaggccaagggtacccggtgatgaagactgtggtatcagcctcctgagcacagagagggcagaaaggggtgg

SEQ ID NO: 29669 - DNA, 201 bp, Homo sapiens
cgaccaaaaatctgggtggtggctgtggtttgtaggccggggctgggctgggtgatgggggagtcactgcatagatcctcacatagaggccgcttctcccrcagtgaaacccagggccccaggaaacctgacagttcacaccaatgtctccgacactctgctgctgacctggagcaacccgtatccccctgacaattacct

SEQ ID NO: 29670 - DNA, 201 bp, Homo sapiens
gccactgacaagctaggagggcgctgaaaggagaaggaccccgatgtctcctccagcccatccatctcctctctcccattggccaaacccaaccggaaacyaaaggccaagggtacccggtgatgaagactgtggtatcagcctcctgagcacagagagggcagaaaggggtggagacaaagaggggcgcagatagtgggc

SEQ ID NO: 29671 - DNA, 201 bp, Homo sapiens
  misc_feature (1)...(201): n = A,T,C or G, or insertion/deletion polymorphism (see Tables 1-2)
gcggttcctggaggcatgtcccggacacagctgtggggcccagccagcctacaggtgaccagcctaacccagcccctgtgtctgcagagcccacacgtgtntccctgagaacaacggaggcgcggggtgcgtgtgccacctgctcatggatgacgtggtcagtgcggataactatacactggacctgtgggctgggcagca

SEQ ID NO: 29672 - DNA, 201 bp, Homo sapiens
ggccggggctgggctgggtgatgggggagtcactgcatagatcctcacatagaggccgcttctcccgcagtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 29673 - DNA, 201 bp, Homo sapiens
tcacctgtcaataattcagagatcaacaccttttccttttgtttttcaggattaagaaagaatggtgggatcagattcccaacccagcccgcagccgcctsgtggctataataatccaggatgctcaggtaggagtaggcgtggatgaggacatgtgggactgtgtacatgaagaagtgtggttcagaacacctgggctgt

SEQ ID NO: 29674 - DNA, 201 bp, Homo sapiens
gcactttgggagcccagcgcaggcagatcacttgagccctgggctattgaggctgcagtgagctgggattgtgccactgcactccagcctgggcaacagartgggaccctgtctcaaaaaagaagaaaaaaagggtaattaataaacactaaagttctatgtagaattttagcaacattattgttattataatcttctttg

SEQ ID NO: 29675 - DNA, 201 bp, Homo sapiens
agaatgaataggagtttttcaagtgtcgaaactgaaccctgaccaacctttgcttttgcagacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 29676 - DNA, 201 bp, Homo sapiens
tgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcactgtggtggctcgcggctgtaatcccagccctttgg

SEQ ID NO: 29677 - DNA, 201 bp, Homo sapiens
ttaaaaagggcgagaggatttacaggaaactatcaggtcagtaatggcaggggccgtccacagtgggtggctgagtccccctatttttctgctggtgtgcrgggaggtcatttcctgccacccatgtttccccaccctgaatccaccttcctcacattcccattggagggacactctctggacatatgggacctggggtcc

SEQ ID NO: 29678 - DNA, 201 bp, Homo sapiens
ctagctcgagggcagaggcttggtgtgatggaatggcactccttaaactgctacatattttccctttaatttggccaagaacaagttgtcaagtttgtgtragataaaggtgcacttggttcgttcttgtctaatggcccccgcacccatgggtatttcttcagcttccacagtcatcccgacactagctgggaagctcca

SEQ ID NO: 29679 - DNA, 201 bp, Homo sapiens
atggtttgctgctgtttatatggtgttagaggggaggtcccatctccagggacatgttatgtaagatacagtggagcgcatggtgggagtgttggtccacrtggcacatggatacggctggaatactggactagaccagcagttctcacactttttggtctcaggaccctttttcacacttaaaaatgagtgaggacccaa

SEQ ID NO: 29680 - DNA, 201 bp, Homo sapiens
ctgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgagg

SEQ ID NO: 29681 - DNA, 201 bp, Homo sapiens
aacattatccttaatattacactgaatatgtctgtggattttgtgggaggtgagggtataaaacataattagaggaaataatgacattctaaatttaattygactttattacaaaaagggcagaatggagcaacagtaatccaggacaaaaaattgtcccaatcccatcattcaacccacttgtgtttgtatctgtttgtg

SEQ ID NO: 29682 - DNA, 201 bp, Homo sapiens; identical to SEQ ID NO: 5502

SEQ ID NO: 29683 - DNA, 201 bp, Homo sapiens; identical to SEQ ID NO: 5503

SEQ ID NO: 29684 - DNA, 201 bp, Homo sapiens
ggatgggaggagattcagagcactcctctgtggccacttttgccatcgaccacagtccctgtaaatattaggacaatgtaattaattcccaggaatctgargctcagaaagcgtaagtgacctgttggacttctgatctgtgtgatgtcgaggcttgtaccccttcctgagcattgccgtactccaggccgggctgcaagg

SEQ ID NO: 29685 - DNA, 201 bp, Homo sapiens; identical to SEQ ID NO: 5504

SEQ ID NO: 29686 - DNA, 201 bp, Homo sapiens
aactcctgacctcatgatctgcctgcctcagcctcccaaagtgctgggattacaggtgtgagccactgcacccaaccaggactccacatttctaaaaccgscatcctactggggagactgaaaatacatatcaatcacaaacaggtggttttccatagtgacccactctctgaatgcactagaccagggtggaggccagag

SEQ ID NO: 29687 - DNA, 201 bp, Homo sapiens; identical to SEQ ID NO: 5472

SEQ ID NO: 29688 - DNA, 201 bp, Homo sapiens; identical to SEQ ID NO: 5471

SEQ ID NO: 29689 - DNA, 201 bp, Homo sapiens; identical to SEQ ID NO: 5475

SEQ ID NO: 29690 - DNA, 201 bp, Homo sapiens; identical to SEQ ID NO: 5474

SEQ ID NO: 29691 - DNA, 201 bp, Homo sapiens
gctctcagctcagcccgctcctctcctgcttaagagccttcactggctccccactgccctagagacagagtttgagtctactgccatggcttggcagacgrtgttgtccctggcctgccaaccttccagctgccatcccagccagtccttctcccccttgctccagccaagggccccgcttgtagggtgggaagtgggccg

SEQ ID NO: 29692 - DNA, 201 bp, Homo sapiens; identical to SEQ ID NO: 5476

SEQ ID NO: 29693 - DNA, 201 bp, Homo sapiens; identical to SEQ ID NO: 5478

SEQ ID NO: 29694 - DNA, 201 bp, Homo sapiens
gcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtg

SEQ ID NO: 29695 - DNA, 201 bp, Homo sapiens
attaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaat

SEQ ID NO: 29696 - DNA, 201 bp, Homo sapiens; identical to SEQ ID NO: 5483

SEQ ID NO: 29697 - DNA, 201 bp, Homo sapiens
gtattatgatgaaaagagttttacctggtgggcccagaccacactttgagaaccactggactagacccttgattgaggagtacggtgttgagagtggagtyctctgtgatggtggatggaccaggacacatggcataggagtcaggtggttccctgggctactccatggtgcacaggatgcttcgttacactggtgcccag

SEQ ID NO: 29698 - DNA, 201 bp, Homo sapiens
acagtcatcccgacactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtctt

SEQ ID NO: 29699 - DNA, 201 bp, Homo sapiens
ttaaactgctacatattttccctttaatttggccaagaacaagttgtcaagtttgtgtgagataaaggtgcacttggttcgttcttgtctaatggcccccrcacccatgggtatttcttcagcttccacagtcatcccgacactagctgggaagctccagcagccctggtcctggccccagctctgtgggcgctggccctc

SEQ ID NO: 29700 - DNA, 201 bp, Homo sapiens
cttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggcgctgaaaggagaaggaccccgatgtctcctcca

SEQ ID NO: 29701 - DNA, 201 bp, Homo sapiens
cagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctc

SEQ ID NO: 29702 - DNA, 201 bp, Homo sapiens
gtgagtgggcatgctttgacgtttttctgtgacctctggggaacagggtgggtgaccagcagaggcccagtccctggagccaggagcctgggaggcaagcyctggggctggatagcaaatcccaggagctagagacctggcttctcacctggctctgccctaggcaagtccctttgcttcctggccccccacccctcacat

SEQ ID NO: 29703 - DNA, 201 bp, Homo sapiens
ataagagggggttggggaagctgggtggagtgggggggattgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtg

SEQ ID NO: 29704 - DNA, 201 bp, Homo sapiens
acgtttttctgtgacctctggggaacagggtgggtgaccagcagaggcccagtccctggagccaggagcctgggaggcaagccctggggctggatagcaawtcccaggagctagagacctggcttctcacctggctctgccctaggcaagtccctttgcttcctggccccccacccctcacatcagagaaggggagttatc

SEQ ID NO: 29705 - DNA, 201 bp, Homo sapiens
gtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacac

SEQ ID NO: 29706 - DNA, 201 bp, Homo sapiens
ggaggcaagccctggggctggatagcaaatcccaggagctagagacctggcttctcacctggctctgccctaggcaagtccctttgcttcctggccccccrcccctcacatcagagaaggggagttatctctgcatgccgctcctcctctgtaaaggtagggctgtgggccacatctgtgtttcccagtttgggggacaca

SEQ ID NO: 29707 - DNA, 201 bp, Homo sapiens
aaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatct

SEQ ID NO: 29708 - DNA, 201 bp, Homo sapiens
aggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctctagcctggtcacagttacagaggtg

SEQ ID NO: 29709 - DNA, 201 bp, Homo sapiens
tctgccttctcttccctgcattcggtaattgccctgtgacattagccttcaagggacggcaggaggaggggtgttctggaaacgtggactgctggccaagmcccctgagtttcactggtgtgtcaggtacatggtgataccccttgggagtgctgttatagttaacaaccagagcagccgtgcctgttgttaaaatcttga

SEQ ID NO: 29710 - DNA, 201 bp, Homo sapiens
tatcaatcacaaacaggtggttttccatagtgacccactctctgaatgcactagaccagggtggaggccagagatcttctggggtgctttttgcaaggggsaccaggataaggctctccaaggagggaaaatttgaggggggccctgactggggagaatgagctggccagggataagcaagatggagtcatcccacatccc

SEQ ID NO: 29711 - DNA, 201 bp, Homo sapiens; identical to SEQ ID NO: 5491

SEQ ID NO: 29712 - DNA, 201 bp, Homo sapiens
aaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaata

SEQ ID NO: 29713 - DNA, 201 bp, Homo sapiens
gaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtgg

SEQ ID NO: 29714 - DNA, 201 bp, Homo sapiens
ctttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggc

SEQ ID NO: 29715 - DNA, 201 bp, Homo sapiens
attaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttcta

SEQ ID NO: 29716 - DNA, 201 bp, Homo sapiens
gccttaacctcctgggctcaagtgatcctcctgcctcagccttcccagtagctggggctacaggcatgtgccacctctaataacttttctttaatttacartagtattagtttgttctcatgctgctctaaggacatgcccaagactgggtaatttataaaggaaagaggtttgactcacagttctgcagggctggggagg

SEQ ID NO: 29717 - DNA, 201 bp, Homo sapiens
catggtctcggctcgctgcaacctccgcctcctgggttcaagcaattctcccacctcggcctcccgtgtagctgggactacaggtgtgcgccaccacactyggctaatttttgtatttttagtagagacagggtttcactatgttggccaggctggtctcaaactcctgacctcgtgatccgcccacctcagcctcccaaa

SEQ ID NO: 29718 - DNA, 201 bp, Homo sapiens
gtgctctagcctttttgtgcctcagtcttctcatcagtaaaatgggaatgttaatggcacctacctcatagggtcgttgggagaaccaaattgattaatayattgtaagtacttagaacagggccaggcacaaaataagtactgcatatacagttaactatggacaaaagcttgggacctggttcatgtttaaaaatgatt

SEQ ID NO: 29719 - DNA, 201 bp, Homo sapiens
gagtttggacttgaccatggagacactaggaagcccatgaaggacagagagagatgcctcgaccctgccagtcctttagaaagatcacccagtgctttttrtataccaaaccctatttgaaatacttacgtatattaacccatttccttatcaccacaaccctgcgggaagggagataggcacttttattatcttcatttt

SEQ ID NO: 29720 - DNA, 201 bp, Homo sapiens
tggtgccatcattctccaggacaaagattcttacctacttttgtgtcctggtttcctttggcagcctggtgaagcctatggacctcatttcagaatatttwtaaatacataaaatcccagcctgggcaatatagtgaaacccccatctgtacaaaaattagccaggcatggtggcatgcacctgtagtcccaggtactggg

SEQ ID NO: 29721 - DNA, 201 bp, Homo sapiens
aaacgtggactgctggccaagccccctgagtttcactggtgtgtcaggtacatggtgataccccttgggagtgctgttatagttaacaaccagagcagccktgcctgttgttaaaatcttgacctaattgtatacttgtcggcaaatagccactatcctgaacactcccctccttttttttaatatacaggatctcactct

SEQ ID NO: 29722 - DNA, 201 bp, Homo sapiens; identical to SEQ ID NO: 5499

SEQ ID NO: 29723 - DNA, 201 bp, Homo sapiens
tttatttttaaaattttaaaataaatagagacagggtatcactatgttgcccaggctgcttttgacctcctgggctccagtgatcttcccatcttggcttyccaaagtgctgggattacaagtgggagccagtgttcctggccccttcctccattcttaatggaaggagatgctaggtgtgagaggttagggaaagtaaag

SEQ ID NO: 29724 - DNA, 201 bp, Homo sapiens
cctgagctcaagtgatcctcccatcttagcctcccgagtagctgatactacagatgtgcattaccacgcctggctattttaaaaggtttttgcctgtaatbccagctactcaggaggctgaggcatgagaatcacttgaacccgggaggcagaggttgcagtgagcgcagattgtgccactgcactccagcctgggcgaca

SEQ ID NO: 29725 - DNA, 201 bp, Homo sapiens
ttctctagcctcagccttctaagtagctgggactacagtcatacaccaacatgcccagctaattttccttttttttaattcttgtagagatgtttgagacrgcttgggctctgttgcccaggctgttctcaaactcctgagctcaagcgatcctccctcctcagcctcctaaagtgctgggattacaggcgtgagccaccg

SEQ ID NO: 29726 - DNA, 201 bp, Homo sapiens
aatgcactagaccagggtggaggccagagatcttctggggtgctttttgcaagggggaccaggataaggctctccaaggagggaaaatttgaggggggccytgactggggagaatgagctggccagggataagcaagatggagtcatcccacatccccttacaacactgggtgcctgggcaactgggggcatttgggggca

SEQ ID NO: 29727 - DNA, 201 bp, Homo sapiens
ggggggccctgactggggagaatgagctggccagggataagcaagatggagtcatcccacatccccttacaacactgggtgcctgggcaactgggggcatytgggggcatgtggtaggagccagaggaatttgcgacgattgccctgatggagtcaggagacctgggtttgaatcctggccttggagcttggtagctggcg

SEQ ID NO: 29728 - DNA, 201 bp, Homo sapiens
tttgggggcatgtggtaggagccagaggaatttgcgacgattgccctgatggagtcaggagacctgggtttgaatcctggccttggagcttggtagctggyggccgacaagttgctgaaacccctgagcctggggttcctgctttgcagagtgacagtgatggtgagaacatatttcatcagccagaagaggccaaatcac

SEQ ID NO: 29729 - DNA, 201 bp, Homo sapiens; identical to SEQ ID NO: 5505

SEQ ID NO: 29730 - DNA, 201 bp, Homo sapiens
taaaaaatggaaaaagcagaggagccagggacccggcatccctctggcacgggaatgggaagacagcagaagaatctgtgggggcagtttccggaacaccrgtctcaggtcatctgctgaggagtggggaagcccagctgtttaggtctggggaacatcaggtgccccacagtggctgtggcctctgccatagtgtagttc

SEQ ID NO: 29731 - DNA, 201 bp, Homo sapiens
gtaatgacatagttcagtctctgaaatcagaggcagtcacctggtagcatatttgttaatgaccctgactgtagaaagagcagtacactcacagaggtctrtttaaactataaccattttaagaaagacagagcctaattacatcagaatcctttgtattgcttaataggaaataacaaatagaaggctgtctgagctcta

SEQ ID NO: 29732 - DNA, 201 bp, Homo sapiens
gctcaggactgggagactagggagttgctatcaggtcctgagtttgccactaacttgcagtagaaacttagcggaaaaaaaaaaaaaagagtgtttctgcrtgggcctatttcctcatctgtgaagggaggtagctgctgtagagtattccaaggtctctgctagctctaacgtcacagatatgtgtatctagatgtttct

SEQ ID NO: 29733 - DNA, 201 bp, Homo sapiens
atcagataatgctttttatcaaaattccccaaggtgattcaaatgcctattaaagtttatggagcgctggcagaatgcagaaagctcaggactgggagackagggagttgctatcaggtcctgagtttgccactaacttgcagtagaaacttagcggaaaaaaaaaaaaaagagtgtttctgcgtgggcctatttcctcat

SEQ ID NO: 29734 - DNA, 201 bp, Homo sapiens
caaggacaaaaaaatcaaagctgaaacgagagcagcacaatccattggtgacgttcatctttttccagaggaatataccattctgttaggacttgggggaraaaagatcttttaggaggtgcagggaaaacattcagaattaagacatactgacccaccaccacagaaacagcaattaattaaaatagcacacaaaatgat

SEQ ID NO: 29735 - DNA, 201 bp, Homo sapiens
aaccccaaaaggtctgtaactggattctctaagccttgagaagttcagaccaaagcttcagaccagggaaaatattttggaaagatcagtctttccaagaktgagctcctttccaagaagctggacaggaaacccaataaatgtggatctgaaaaaacaaaatccaagagagaagcaaaatgggctgggggtgtgcaataa

SEQ ID NO: 29736 - DNA, 201 bp, Homo sapiens
aggttgggatgcagagaaaaacaggcaggagggtgtcaatctatagcatcctgaaccccaaaaggtctgtaactggattctctaagccttgagaagttcasaccaaagcttcagaccagggaaaatattttggaaagatcagtctttccaagattgagctcctttccaagaagctggacaggaaacccaataaatgtggat

SEQ ID NO: 29737 - DNA, 201 bp, Homo sapiens; identical to SEQ ID NO: 5506

SEQ ID NO: 29738 - DNA, 201 bp, Homo sapiens
ttgcttaataggaaataacaaatagaaggctgtctgagctctagcgtgtgggaggaagtctgtttgatttattcaaaggtacacagtcaaagatctatcawctccttcctagagatatctaggatataggacattcctttaaaaaaagtcataatcagaatttcctatctacaaatgtactttttcaccccacgatgctac

SEQ ID NO: 29739 - DNA, 201 bp, Homo sapiens
ggcctcttcaccaccagcacaagataaggcaaaggaccatttgtcagagacaccaagaaaggggaatttccatttggatggtcaatagtgtccagttctgycaaggacaagactaagctttgagaaaaagccatggatttggtgattggataactggtaacctttagaaaagtttagttgacagacagagaccgaagtgag

SEQ ID NO: 29740 - DNA, 201 bp, Homo sapiens
atgcctgccccaccctttctgccctcaggtggagagtgtgactgcaggatccccactcaccaaccagttctatctggctgctccccgaggtgtctgctacrgggctgaccatgacctgggccgcctgcacccttgtgtgatggccttgaaggcccagagccccatcaccaacctctgacaggtatactcactgccccatgt

SEQ ID NO: 29741 - DNA, 201 bp, Homo sapiens
gatctcacatgcctgccccaccctttctgccctcaggtggagagtgtgactgcaggatccccactcaccaaccagttctatctggctgctccccgaggtgyctgctacagggctgaccatgacctgggccgcctgcacccttgtgtgatggccttgaaggcccagagccccatcaccaacctctgacaggtatactcactg

SEQ ID NO: 29742 - DNA, 201 bp, Homo sapiens; identical to SEQ ID NO: 5511

SEQ ID NO: 29743 - DNA, 201 bp, Homo sapiens
aaataaatgtattaaatccattgctttaacattttgaaatttattttggtttctgttcaacaaaaccaaaccacattgggatggcatttacagaagctcaraaaaacattatgcactgaaaaatacttctcattagaccacaacaagctttaaaaaaataaaattaagtaattatagttaagttacaaaaagctgaaagta

SEQ ID NO: 29744 - DNA, 201 bp, Homo sapiens
gtgggacccctcatttgagtcacatccatatggcatggagaaagaaaacctctctgccagaaggaactgaactctggaagtcctaaggaaggtcaccatgmtcagcagataggaaagcattgccaagggctgtccctcaagagcttagttttcttagggagaccagaaagacatcagatcctgactgccctgttttgctca

SEQ ID NO: 29745 - DNA, 201 bp, Homo sapiens
tgcagccggctcggcctcccctctctcagaccgggggagctgagggggtgaggtagagacggcccaggggcagagcaggggggtcgggcttggtgcacagrcagactctgcctttgctacttcctgcctctctctctgtgaccctgacctcccttctcccctgtcccaggacctctgggaactgacactgtcctggccagg

SEQ ID NO: 29746 - DNA, 201 bp, Homo sapiens
actgtactccagcctgggcagcaatgcgagactccctctcaaagaaaacaaaaacaaaaacatttttttttttacttcttaaacttttttgtttaaaacaataaaaatatagcaaatacataaaccagtaacatagtcatttcgttcattaaaaagtactataggccaggcgcggtggttcacgcctgtaatcccaacaca

SEQ ID NO: 29747 - DNA, 201 bp, Homo sapiens
ccaactttcctacagagcccgggccccagggagggtggtcagcagcgcagcctgcccaggctgggatctccctttggtcacagccgtgtttccatataccyctccactcaccctcagaggaggaacggatggaagccaccagcataaataaagggaacacagaagaacaatgtcaccaaagtgcaggtgcaaagcccaaag

SEQ ID NO: 29748 - DNA, 201 bp, Homo sapiens
cactgtactccagcctgggcagcaatgcgagactccctctcaaagaaaacaaaaacaaaaacatttttttttttacttcttaaacttttttgtttaaaacwataaaaatatagcaaatacataaaccagtaacatagtcatttcgttcattaaaaagtactataggccaggcgcggtggttcacgcctgtaatcccaacac

SEQ ID NO: 29749 - DNA, 201 bp, Homo sapiens
tgcaatgccacagtcaaggaccaactttcctacagagcccgggccccagggagggtggtcagcagcgcagcctgcccaggctgggatctccctttggtcayagccgtgtttccatatacctctccactcaccctcagaggaggaacggatggaagccaccagcataaataaagggaacacagaagaacaatgtcaccaaag

SEQ ID NO: 29750 - DNA, 201 bp, Homo sapiens
tgacctcaaaaccccaactctactaaaaatataaaaattagccggacacggtggcgggcgcctgtaatcccagctactagggaggttgaggcaggagaatytcttgaacccgggaggcggaggttgcagtgagctgagatcatgccactgtactccagcctgggcagcaatgcgagactccctctcaaagaaaacaaaaac

SEQ ID NO: 29751 - DNA, 201 bp, Homo sapiens
ctcacccaggcagcccagctagagccatctgtccctcttgccctccatctgtgttcctgtgtctcttcctcctgaacacaacctgagggcctcacaaatayttagttacatgaacgaagcaggccgggcacggtgactcacgccttcaatcccagcactttgggaggacgaggcaggcagatcacttgaggtcaggagttt

SEQ ID NO: 29752 - DNA, 201 bp, Homo sapiens
ttctgtgtgatagacttctttgtatgactggcagtgcagtgggtggctccaccaatgccagcctctccttcccctgccccatgtggttgggtctgcagcckgctcggcctcccctctctcagaccgggggagctgagggggtgaggtagagacggcccaggggcagagcaggggggtcgggcttggtgcacaggcagactc

SEQ ID NO: 29753 - DNA, 201 bp, Homo sapiens
aatactgcacataattctgtgtgatagacttctttgtatgactggcagtgcagtgggtggctccaccaatgccagcctctccttcccctgccccatgtggytgggtctgcagccggctcggcctcccctctctcagaccgggggagctgagggggtgaggtagagacggcccaggggcagagcaggggggtcgggcttggt

SEQ ID NO: 29754 - DNA, 201 bp, Homo sapiens; identical to SEQ ID NO: 5507

SEQ ID NO: 29755 - DNA, 201 bp, Homo sapiens; identical to SEQ ID NO: 5508

SEQ ID NO: 29756 - DNA, 201 bp, Homo sapiens; identical to SEQ ID NO: 5509

SEQ ID NO: 29757 - DNA, 201 bp, Homo sapiens; identical to SEQ ID NO: 5510

SEQ ID NO: 29758 - DNA, 201 bp, Homo sapiens
agataaaagatggcatagctgtatagggcatttcccaggcatggagcttgcaggactggcagctgctctgggtgcgtcagtgagtggtgagtaaccatgaygctgtacacttaggcaacactaggtttataaagaaatattcttctttcttcaagaataaattaaccttagtttaacttttttactttatcaacttaaaca

SEQ ID NO: 29759 - DNA, 201 bp, Homo sapiens
taaaaatacaaaaagtaactgggcgtggtggtgggcgcctgtaatcccagctactcaggtggctgaggcaggagaattgcttgaacccaggaggcagaggwtgcggtgagccgagatcgcaccgttgcactccagcctgggcaacaagatcaaaattctgtcttgggaaaaaaaaaacaaaaaacaagataaaagatggca

SEQ ID NO: 29760 - DNA, 201 bp, Homo sapiens
tcttatttccctcatctcccaagttatttgtatttccctgagatcagctcagaaacaactctctttaggctctctacaatgcggtagagcatgattagaaragataaaccttcaaacaatagtgttgtccaagacactaccctcacttatcccaggggaacccacggaatttcttcatttgtattaactcctgacatggca

SEQ ID NO: 29761 - DNA, 201 bp, Homo sapiens
gattggctgtactcaggaactccagcctacggtgcttaagccaggctgatgtggggagttggaggcctatgtgcttccaggctcgtgtttccagggagcayagtctagcactttaccacacaaagtgtggatccagtggcatttggtttcacctgggaacttcctaagaatgtagacacaggccaggcacggtggcttatg

SEQ ID NO: 29762 - DNA, 201 bp, Homo sapiens
ttttttcttagaggcaaggtctcactctgtcacccgggctggagtgcaatggcgtgatcatggctcactgaagcctcgacctcccacagtcaagccatccycccacttcagcctcctgagtagctgggaccacacacgtccaccaccacatctggctaatttttttattatatgtagagacgaggtcttgctatgttggcc

SEQ ID NO: 29763 - DNA, 201 bp, Homo sapiens
ttttcttcatttcttttgatttagaaacaaatcagcagggaggacaaggttctcaaggacaaaaaaatcaaagctgaaacgagagcagcacaatccattgrtgacgttcatctttttccagaggaatataccattctgttaggacttgggggaaaaaagatcttttaggaggtgcagggaaaacattcagaattaagacat

SEQ ID NO: 29764 - DNA, 201 bp, Homo sapiens
tatttctgccctttccttgagacaggggaattgggccccaagacatgagccccagggaaggacagggcacccaaccccggagtcagtgaatgggaaagagyggaagagggaggggagccaggatctcacatgcctgccccaccctttctgccctcaggtggagagtgtgactgcaggatccccactcaccaaccagttcta

SEQ ID NO: 29765 - DNA, 201 bp, Homo sapiens
aaagcagccccctacctctgccagcccagacccgccactaaattctagaggagggtgtctctcaggtcacagtacttttttcttcatttcttttgatttaraaacaaatcagcagggaggacaaggttctcaaggacaaaaaaatcaaagctgaaacgagagcagcacaatccattggtgacgttcatctttttccagagg

SEQ ID NO: 29766 - DNA, 201 bp, Homo sapiens
gagtgtgactgcaggatccccactcaccaaccagttctatctggctgctccccgaggtgtctgctacagggctgaccatgacctgggccgcctgcaccctygtgtgatggccttgaaggcccagagccccatcaccaacctctgacaggtatactcactgccccatgttgtcaggacctgagaccctgggcccctgtcgcc

SEQ ID NO: 29767 - DNA, 201 bp, Homo sapiens
ttgaccttcctgcaggtgctgagccagctcatgggggctgaggaccagggctgggctttacctgcctctgaaggggcttggagcagaggcaggggaggtgraagaataggaacctggggcagtgtccttcccaggcaggaggacacagaagagcaggcccctgccaacatcaagttgaaacagctgtaaaagtggcctggg

SEQ ID NO: 29768 - DNA, 201 bp, Homo sapiens
gttctgatgtcacactaagaatcatgcatgttcactcactccgtgactgcataaaagttcatcctgaaatcaggctggtaatgagctgctgttcatgtgtrgtcttcatggggggaacccagtcatgtgctccacacttcaagacacgaaggggaagatgggaggcagtaagcttgaccttcctgcaggtgctgagccagc

SEQ ID NO: 29769 - DNA, 201 bp, Homo sapiens
cctaggtctgcagagagaaacagtgcagagtgcaatgccacagtcaaggaccaactttcctacagagcccgggccccagggagggtggtcagcagcgcagsctgcccaggctgggatctccctttggtcacagccgtgtttccatatacctctccactcaccctcagaggaggaacggatggaagccaccagcataaataa

SEQ ID NO: 29770 - DNA, 201 bp, Homo sapiens
gtctcaagctacataaaataatcagaaaatcaagaagatctcatgctagacaggttagacttgcacccaaaaaagcatctttttttttaacctgctgtttwggtttgctgctgaagtctttgaagagaattatgtattcaaagtagctctttgcccattggcatttccccatcttctatgtcttctgtagggcacatcccc

SEQ ID NO: 29771 - DNA, 201 bp, Homo sapiens
ggttctcaaggacaaaaaaatcaaagctgaaacgagagcagcacaatccattggtgacgttcatctttttccagaggaatataccattctgttaggacttrggggaaaaaagatcttttaggaggtgcagggaaaacattcagaattaagacatactgacccaccaccacagaaacagcaattaattaaaatagcacacaa

SEQ ID NO: 29772 - DNA, 201 bp, Homo sapiens
cctcctgagtagctgggaccacacacgtccaccaccacatctggctaatttttttattatatgtagagacgaggtcttgctatgttggccaggctggtctyggactcctgggctcaagcgatcctcctgcctcggcctcccaaagtgctgggattagaggcaggagccactgcaccgggccaggaatgcacatttttacta

SEQ ID NO: 29773 - DNA, 201 bp, Homo sapiens
tttagatctttttccttccaggacaaaagcaatgatctgaggaaaggaaaaagaaaatgattaacaggtggctctgtaatgacatagttcagtctctgaamtcagaggcagtcacctggtagcatatttgttaatgaccctgactgtagaaagagcagtacactcacagaggtctatttaaactataaccattttaagaaa

SEQ ID NO: 29774 - DNA, 201 bp, Homo sapiens
agccccagctcatctcaaagcctgtcttcctgagcaaacaggaggcacaggtgtgcatactgcacccagaggccctcgagagcagcggctgagccacaatratcttcacatccccagcacctcacagtgccaggcccaataaacgtcaccatagttcacgtagacaggcacagactaacatgacgaaagggaaatgctgga

SEQ ID NO: 29775 - DNA, 201 bp, Homo sapiens
aaggtggggatgtcagccccagctcatctcaaagcctgtcttcctgagcaaacaggaggcacaggtgtgcatactgcacccagaggccctcgagagcagcrgctgagccacaatgatcttcacatccccagcacctcacagtgccaggcccaataaacgtcaccatagttcacgtagacaggcacagactaacatgacgaa

SEQ ID NO: 29776 - DNA, 201 bp, Homo sapiens
tttgctagattggaaacttgtaaaacaacagtttgacaaaggaagatgattctggcaagaaaaagtttctgtgaagatggcacttcttagcatagtcctcrcccttattattaaaagatgcatttccactttgacagtgatttccccacccgagagcctggttgggcagccctgagccccttagccagtatctttcccatc

SEQ ID NO: 29777 - DNA, 201 bp, Homo sapiens
caatgccttttcagtctttacctagactctccagagaatcactccagaatagaaattagagtataggtaggcagtccaacctctgcatttaaaaaaaaaawttttgagatgggagtctctctctgtcacccaggctggagtgcagtggcatgatcttggctcactgcagcctccgcctcctgggttcaagggattctcctg

SEQ ID NO: 29778 - DNA, 201 bp, Homo sapiens
gtccccactgatgcccgagacggtgcccctgtgtgtgtgagccctcgacccacataacagagaggtgtcctgatgccctctgtcctctccaggtggatctmggatccggcttccaacatgtggcagctctgggcctccctctgctgcctgctggtgttggccaatgcccggagcaggccctctttccatcccctgtcggat

SEQ ID NO: 29779 - DNA, 201 bp, Homo sapiens
ttgcagtgagccaagacagtgccagtgcactccagcctcggtgacagcgcaaggctccgtctcaataattaaaaaaaaaaaaaaaaaaaaaaggccgggcrcagtggctcaagcctgtaatcccagcactttgggaggctgaggcgggcagatcacctgaggtcaggagttttgagatcagccttggcaacacggtgaaac

SEQ ID NO: 29780 - DNA, 201 bp, Homo sapiens
gcagggattggggagggagttgtgggatcagagcttgtaatgaagaccttcctttatccagagttatgtttaccgaggacctgaagctgcctgcaagcttygatgcacgggaacaatggccacagtgtcccaccatcaaagagatcagagaccagggctcctgtggctcctgctgggtaaggccctgctggctggcgggga

SEQ ID NO: 29781 - DNA, 201 bp, Homo sapiens
gccagatccaaatgcaggtctcctgactccaagtgcagggctcattttatcgtccggttgcagcacgctggcggccccttgagccccaacctggataccayaggggaggagcagagaagccaggaacaccacagccctgggccaaggtgcggggctgaaagaacttcccagcgctcagcctgggactagtggaatgggctg

SEQ ID NO: 29782 - DNA, 201 bp, Homo sapiens
agctctgaaaatctgaggaacattgtaggaaaggtttgttaagcatctcttaagtgccatgatgagcataacagccggccgtggtggctcacgcctgtaakcccagcactttgggaggccaaggtgggaggatgacaaggtcaggagttcaagaccagcctggccaacatgctgaaacctcacctctactaaaaatacaaa

SEQ ID NO: 29783 - DNA, 201 bp, Homo sapiens
caacgttctacagagccggggtggagcgtgctttctcataagtgctctgcaggtttggagagagaggatatgaggagcacccttttctgttttttttaacmcaaagattagcttggaaaaggggcagaggggtgcactggaactcaggtctgcctaagcagcacagcagaccaaggtctagagatgacatctgctcgcagc

SEQ ID NO: 29784 - DNA, 201 bp, Homo sapiens
cagatgctagatcaaataagctctgaaaatctgaggaacattgtaggaaaggtttgttaagcatctcttaagtgccatgatgagcataacagccggccgtsgtggctcacgcctgtaatcccagcactttgggaggccaaggtgggaggatgacaaggtcaggagttcaagaccagcctggccaacatgctgaaacctcac

SEQ ID NO: 29785 - DNA, 201 bp, Homo sapiens
ggggagcagtgggtgctgggtgtggggcgttgcaggcaggctggggtgggcgacccaggtggaagtgaattgcacttggcttcctggtgggcctctgtcayccccttcccaggcgctgagaaagccagcaggctggcaaagaaaaggaccctagcgcaggccccacactcctcctcctaacggacgagagaccccccaaac

SEQ ID NO: 29786 - DNA, 201 bp, Homo sapiens; identical to SEQ ID NO: 5521

SEQ ID NO: 29787 - DNA, 201 bp, Homo sapiens
tggccaactttctgcgcaagatcccacgcaattcctgggaccccagaagacaggtcctgttgaagaacaggaatctggcactgggtgggctggggaggaasccgcacggtgttaaatccataaacaggaagagaaaccagacagcgaaaccaagaggcgaatgggcgattggatgccggtggggagaaggccgggggcgca

SEQ ID NO: 29788 - DNA, 201 bp, Homo sapiens; identical to SEQ ID NO: 5523

SEQ ID NO: 29789 - DNA, 201 bp, Homo sapiens; identical to SEQ ID NO: 5525

SEQ ID NO: 29790 - DNA, 201 bp, Homo sapiens
aaagtgaaactccgcctccaggaaaaaaaaaaaaaaaaaccacacacacacatacaaactaatactacacattttgcagatttcagaaatgaaccgagttyccaggcagaggttcacggtggtgcttctcttgctttaaaagctgagttgggcagatgttgaggcaggagagtggggcaagtggctcatgacgcctctaat

SEQ ID NO: 29791 - DNA, 201 bp, Homo sapiens
gctggagtgcagtggtgggatattggctcactgcaacctctgcctcctgggttcaagcaattctcctgcctcagtctccccagtagctaagactacaggcrtgtgccaccacgcccagctaatttttgtatttttagtagagatggggttttgccatgttggacagcctggtctcaaacgcctcacctgttgatctgcctt

SEQ ID NO: 29792 - DNA, 201 bp, Homo sapiens
cttctccgtgggggctgtaggttgactccgctttctcccgggtcccatcagggtgcagaccgtactccatccctccctgtgagcaccacgtcaacggctcycggcccccatgcacgggggagggagatacccccaagtgtagcaagatctgtgagcctggctacagcccgacctacaaacaggacaagcactacggtaagg

SEQ ID NO: 29793 - DNA, 201 bp, Homo sapiens
agcttcgatgcacgggaacaatggccacagtgtcccaccatcaaagagatcagagaccagggctcctgtggctcctgctgggtaaggccctgctggctggyggggaagcgctggagagaaagtgggagcaacactggagagtcttgggggattcggggtggggacaactctgacaaggcaagttatagaaactttctgagt

SEQ ID NO: 29794 - DNA, 201 bp, Homo sapiens
tggactgttgaaaaatggccctgaccctgagtcatgtcggctctggaccacgcctccctcctttgtcccataccccacgtgtgtgcatgagtgtgtgtgcwtgtgtatgaatatatggttgtgtgcacgtggaggtgtgtgggggagtaagtgagcttcggaagtgttcaaaaccagctagcccctgtgacgcccgccgtg

SEQ ID NO: 29795 - DNA, 201 bp, Homo sapiens
tcccaggtcggtctgtgcacactgactccaggaatgggaagccagccctcactgtggcccacagaacattgtcctggactgttgaaaaatggccctgaccytgagtcatgtcggctctggaccacgcctccctcctttgtcccataccccacgtgtgtgcatgagtgtgtgtgcttgtgtatgaatatatggttgtgtgca

SEQ ID NO: 29796 - DNA, 201 bp, Homo sapiens
cctgctggtgttggccaatgcccggagcaggccctctttccatcccctgtcggatgagctggtcaactatgtcaacaaacggaataccacgtggcaggtargctgtggggctgcgtcctatgtatgtcccctcccaggtcggtctgtgcacactgactccaggaatgggaagccagccctcactgtggcccacagaacatt

SEQ ID NO: 29797 - DNA, 201 bp, Homo sapiens
ctctctctgggctctggccgcctggcccccggggacccacacgaggtcatggcgtgctgcgggcagtggggcggggatcccatagacacctcagctccttagagttctccgcctgggccaggacgagcatgggggtccccactgatgcccgagacggtgcccctgtgtgtgtgagccctcgacccacataacagagaggtg

SEQ ID NO: 29798 - DNA, 201 bp, Homo sapiens
ttctctgttctacccaccgcacagccttaaaccctggacctacggccaggctgtgagctcctcctaagtgccaggcagtcaggagttcccttttgctgtgrgggcagactctgagcagcttcagagccaacgcctgcaacagttcccacagcatcgcgccagatcctgtgatgggaagggtgaccgggcagggggcttgcc

SEQ ID NO: 29799 - DNA, 201 bp, Homo sapiens
tggactcggtctcgtccagcacagccccttggctctctctctgggctctggccgcctggcccccggggacccacacgaggtcatggcgtgctgcgggcagkggggcggggatcccatagacacctcagctccttagagttctccgcctgggccaggacgagcatgggggtccccactgatgcccgagacggtgcccctgtg

SEQ ID NO: 29800 - DNA, 201 bp, Homo sapiens
agccaacgcctgcaacagttcccacagcatcgcgccagatcctgtgatgggaagggtgaccgggcagggggcttgcccgtggaggtgtgccccacggctcyagaagccttgtggtgttgaggactgtgctagtgggcccacagcaggagtggccagggatgagtgacttaaggtcttttaaggatgagtctgactatattg

SEQ ID NO: 29801 - DNA, 201 bp, Homo sapiens
gaaggccctggactcggtctcgtccagcacagccccttggctctctctctgggctctggccgcctggcccccggggacccacacgaggtcatggcgtgctkcgggcagtggggcggggatcccatagacacctcagctccttagagttctccgcctgggccaggacgagcatgggggtccccactgatgcccgagacggtg

SEQ ID NO: 29802 - DNA, 201 bp, Homo sapiens
actttctggccagatggattgtttgagcaattaaccatcatggctttatttgcctttataaactgggggttgagacagaggggctgctgagaggtgctagycaggtgtacaggcctctggcaggacctgcctggcgtccatgctgcaggcacgaggcttgccttgccccaggtctgcctcgcccagctggggcttctccgt

SEQ ID NO: 29803 - DNA, 201 bp, Homo sapiens
tgctaggattataggcgtgagccactgtgcccggctgccactctttttaaagaaagcagtaatttgccctcttttattgtgcttcagccatactgaagtgrtccacagaccaggagcacggccgtcacctgagagcctgttagaaatgctcatcagagtgtcagagggccagacctctgaaccagcatttgcatctcccaa

SEQ ID NO: 29804 - DNA, 201 bp, Homo sapiens
gggattacaggtgtgagtcactgtgcccagccatgtgtttagacttttaactaatctcttttttagtttcaagccttatcgtccgcctctgtagaccactsctgtgcctgtttcctgatccttccaagggccattgtattccctgtctgctgcccctcttttggattcttctgcacatttttttgttcatgcattcattca

SEQ ID NO: 29805 - DNA, 201 bp, Homo sapiens
gtgtcagtgagctgtcttaattttgtcatttaattgtggtaaaatacacgtaacagaaatgtaataatcttagcaatcttcttttgttttctttttctttytttttttttttttttttttttggagatggagtcttgctctgtcacccaggctggagtgcagtggtgggatattggctcactgcaacctctgcctcctggg

SEQ ID NO: 29806 - DNA, 201 bp, Homo sapiens
atggtgaaaccctgtctttactaaaaatacaaaaattagccgggtgtggtggtgcatgcctgtaatcccacctactcaggaggctgaggcacgagaatcgmttgaactcaggaggcagaggttgcagtgggcagagatctcgccactgcactccagcctggatgacacagtgaaattctgtccactcccaccctcccgtcc

SEQ ID NO: 29807 - DNA, 201 bp, Homo sapiens
catttagtcagtggcagagccagatccaaatgcaggtctcctgactccaagtgcagggctcattttatcgtccggttgcagcacgctggcggccccttgagccccaacctggataccataggggaggagcagagaagccaggaacaccacagccctgggccaaggtgcggggctgaaagaacttcccagcgctcagcctgg

SEQ ID NO: 29808 - DNA, 201 bp, Homo sapiens
actcctgacctcgtgatccgcctgcctcagcctcccaaagtgctgggattacatgcgtgagccattgtgtccggcctttttttttttttttttttttttttgagacagagtctcgctctgttgcccaggctggagtgcagtggtgtgacctcagcttactgcaacctccgcttcctggattcaagtgattctcctgcctca

SEQ ID NO: 29809 - DNA, 201 bp, Homo sapiens
ttctggtggcctctatgaatcccatgtaggtaagtgtgtccccttggccactttctggccagatggattgtttgagcaattaaccatcatggctttatttrcctttataaactgggggttgagacagaggggctgctgagaggtgctagccaggtgtacaggcctctggcaggacctgcctggcgtccatgctgcaggcac

SEQ ID NO: 29810 - DNA, 201 bp, Homo sapiens
tactcgtgcaaaaatttaaaaaattgcaacctctggcataaatgggttgagtgacacttttcctgtttttattgttggtcagtgatggcatatttgctggktttttttgttttttttttgaaacggagtctcactgtgtcgccaggctggagtgcagtggtgtaatctcggctcactgtaacctccgcctcccgggttcaa

SEQ ID NO: 29811 - DNA, 201 bp, Homo sapiens
gacacactccctctatcgctcaggctggagtgcagtggtgcgatctcggttcactgccacctccgcctctcatgttgaagcaattctcctgtctcagcctscctcccaagtagctgggattgccagtgcccatcaccacacctggcttttttttttttttttgtatttttagtagagacgggctttcaccatgttagccag

SEQ ID NO: 29812 - DNA, 201 bp, Homo sapiens
aattagctgggcatggtggcacatgcctgtaatcccagctacttgggaggctgaggcaggagaatcgcttgaacccgggaggcggaggttgcagtgagccragacagtgccagtgcactccagcctcggtgacagcgcaaggctccgtctcaataattaaaaaaaaaaaaaaaaaaaaaaggccgggcgcagtggctcaag

SEQ ID NO: 29813 - DNA, 201 bp, Homo sapiens
tagccaggataatcttgatctcctgacctcgtgatccgcccgcctcggcctcccaaagtgctgggattacaggcgtgagccactgcacccggctactgccytcttactgtcgccacagcctggataaaatacgattcttctgagccttttttttttttttaatacagagtttcactcttgttgcctaggctggagtgcaat

SEQ ID NO: 29814 - DNA, 201 bp, Homo sapiens
ccaccgcagcgtaagtgaccttggcggggacggtgctacccggccgccgagacgggttcctctgcgccctcagtcgggcccaggcgcggccccgcggcgtmcctgggggccggcggggagccgggaccctcgggactgtccctgacgggcgggctggggtgggagtccgcgcgctccgaagcgtcggcgagaaaagcagaa

SEQ ID NO: 29815 - DNA, 201 bp, Homo sapiens; identical to SEQ ID NO: 5547

SEQ ID NO: 29816 - DNA, 201 bp, Homo sapiens
agtgcaatggcgtgatctcggctcactacaacctctgactccctggttcaagggatcctcctgcctcagcgctcgagtagctgggattacaggcccgcaaygccacacccagctaatttttgtatttttagtagagacggggtttcaccatgttggccaggctggtcttgaacttccaacgtcgtgatccgcctgccttgg

SEQ ID NO: 29817 - DNA, 201 bp, Homo sapiens
ttttctgttgctcttggttggattgggaagtgaattgaagggaggtcacgtttcaggggtgccttgggatgtctgtcagtgattttcttttctttcttaawttctttttctttcttttttttttttttttgagacacactccctctatcgctcaggctggagtgcagtggtgcgatctcggttcactgccacctccgcctc

SEQ ID NO: 29818 - DNA, 201 bp, Homo sapiens
gagccaacgcctgcaacagttcccacagcatcgcgccagatcctgtgatgggaagggtgaccgggcagggggcttgcccgtggaggtgtgccccacggctycagaagccttgtggtgttgaggactgtgctagtgggcccacagcaggagtggccagggatgagtgacttaaggtcttttaaggatgagtctgactatatt

SEQ ID NO: 29819 - DNA, 201 bp, Homo sapiens
ccatgtggatttcacggaatcatacaatactgagtcctttggacctggctgattttatttagtaaacgttttcaaggtttatcgatgttgtagcatgtgtsactacttcattcctttttacgactgaataaaactccatttggtggatttatgacagtttgtttattcgtgcaatggtttttaatggatggacatttgagt

SEQ ID NO: 29820 - DNA, 201 bp, Homo sapiens
aattttcttaaatctggtaatgagttgtggttgtgtagagtaacataccgtcctttcgagatatggactgaaacattgagagggaggagttacaggtatgycgattcttcttttctctctctcctttttttttttgaggtggagtctgactctctcacccaggctggagtgcagtggcaagatctcagctcactgcaacct

SEQ ID NO: 29821 - DNA, 201 bp, Homo sapiens
ggtgcttctcttgctttaaaagctgagttgggcagatgttgaggcaggagagtggggcaagtggctcatgacgcctctaatcccagcactttgggaggccraggtgggcaaatcacttgaacccgggagttcaagaccagtctggccaacatagcaagaccccatttctaccaaagaaaataaaagctgagtttgagcccc

SEQ ID NO: 29822 - DNA, 201 bp, Homo sapiens
agcctcatctccgcagccggaagcagagcccttggctgactggaaaaaccagagaggccccgggagtgggtggatggccagcccagccccacctctcagcstcaacctccaccagcccacaccgagcttgtttgtctgtgtcctgtcgaaactaggactcctggattgtaacttttcttacatttccctgtcccctgggtc

SEQ ID NO: 29823 - DNA, 201 bp, Homo sapiens
gggatcaaattccactctgtgtttagacatttttttctttctttttttttttgagacagagtttcactctgtcacccaggctggaatgccgtggcacaatytcagctcactgcaaccttacctcccaggttcaagcaatgttcctgcctcagcctccggagtagctgggattagaggcatgcaccaccatgcctggctaat

SEQ ID NO: 29824 - DNA, 201 bp, Homo sapiens
tgaaccgagttcccaggcagaggttcacggtggtgcttctcttgctttaaaagctgagttgggcagatgttgaggcaggagagtggggcaagtggctcatsacgcctctaatcccagcactttgggaggccgaggtgggcaaatcacttgaacccgggagttcaagaccagtctggccaacatagcaagaccccatttcta

SEQ ID NO: 29825 - DNA, 201 bp, Homo sapiens
acaaaacaattctgtgttgcatgtggtactttttgtgtgtgaggagtccagtgtgaagattcagacttcaggcagccacttgtacaagcactgtcctgttkcctctctggcctcacctaggtaacgctgattcctccacggaggatgtgcttctgagtggtccgttgggtgctgtgctgatgagcatcacccagcatttta

SEQ ID NO: 29826 - DNA, 201 bp, Homo sapiens
caaactaatactacacattttgcagatttcagaaatgaaccgagttcccaggcagaggttcacggtggtgcttctcttgctttaaaagctgagttgggcaratgttgaggcaggagagtggggcaagtggctcatgacgcctctaatcccagcactttgggaggccgaggtgggcaaatcacttgaacccgggagttcaag

SEQ ID NO: 29827 - DNA, 201 bp, Homo sapiens
ggccaaaatggtgaaaccctgtctttactaaaaatatgaaaattagctgggcatgatggcacatgcctgtaatcccgctgctcgggaagctgaggtaggaraatagcttgaacccaggaggcagaggttgcagtgagccgagatcatgccattgcactccagcctgggggacagagtaagactccgtctcaaaaaaacaaa

SEQ ID NO: 29828 - DNA, 201 bp, Homo sapiens
ctactaaaaagacaaaacttagctgggcctggtggcaggcacctataatcccagctactatagaggctgaggcaggagaattgcttgaacccaggaggcgyaggttgcagtgagctgagattgcgccactgcattccagcctgggcaacaaaagtgaaactccgcctccaggaaaaaaaaaaaaaaaaaccacacacacac

SEQ ID NO: 29829 - DNA, 201 bp, Homo sapiens
cagggtttcaccaccttagtcaggctggtctctaactcctgacctcaggtgatccaaccgcctcggctacaggcatgcgccaccgtgccccaccaactaaytgcttttttaatggttgcttcatattctatttaaccacttaccgtaatttaacagttactctgttattggatacttgattcatttccaggacatgcagat

SEQ ID NO: 29830 - DNA, 201 bp, Homo sapiens; identical to SEQ ID NO: 5607

SEQ ID NO: 29831 - DNA, 201 bp, Homo sapiens
caaaactgaaataataggaacatactcacttttttttttttcttaaaagtaagggtatgttgtgaaaaaaagtctccccaccgtagtgaccgactgccgtrcatcttccttggcattttgcatgtagtggcaggagtgttcctacatgtgtagattgctgagagggtcagatgcttatggtcctcagtcacccacagcttg

SEQ ID NO: 29832 - DNA, 201 bp, Homo sapiens
cctcccgtcccacccaaaaaaaaaatcaaaaggtgcattgagcaacagaatttccttttgttttatgaaattaccaaggacacctgtctgcagccttcttyggcatgtcttgtgctcatttccttgttaggggagtgtggcccagccaaagtggcctttgcagggattggggagggagttgtgggatcagagcttgtaatg

SEQ ID NO: 29833 - DNA, 201 bp, Homo sapiens
agaccaaggtctagagatgacatctgctcgcagctgttcttccaccagcccgcatcctggaaaggggtcttgtggcacacaagagttcacatccttccctsgtgaaataaggactttgtgttcatcatctcttgtaagaagcagagcagaaagcacagaattaagaaataaaagggaagtgggtgcctatataaagggaag

SEQ ID NO: 29834 - DNA, 201 bp, Homo sapiens
cctgccaccatgcctggctatttttttgtatttttagtagaaacggggtttcaccgtgttatccaggatggtctcgatctcctgacctcgtgattcgcccrcctcagcctcccaaagtactgggattacaggcgtgagccagcatgcccggcccagagctaggcctttctgtggctggccttcgcgtcagcctcaactacc

SEQ ID NO: 29835 - DNA, 201 bp, Homo sapiens
attctgccctaagagcccggagggccgggctgtctcatgaccctctgacgtgctgacctggactctggcagaatgtgcacacacacagtcacacagcttcstggcttgcgcaagtcccaggagggcggtgccagccacaggcttttcccattcgagggttggaagcgtatcatcaaaccacatcagagtgctgggggccac

SEQ ID NO: 29836 - DNA, 201 bp, Homo sapiens
gtcactatcctgcccaggctggtcttaatctcctgggttcagtcaatcttcccaccttggcctcccgaagtgtcagaattatagatgtgagccactgtgcycagcccagaactgatgttttctaaatgctgggtgctgagaaggatgtgtggctggcagtcttgactgtgttatctgtctttaccaggccagtaacttctt

SEQ ID NO: 29837 - DNA, 201 bp, Homo sapiens
acccacttatgcctagtgttccattattagaacgctaagcatgtgggagtttttacatcatactgctcaaggtcatcgccaaggtctgatgtttttactcrtgcaaaaatttaaaaaattgcaacctctggcataaatgggttgagtgacacttttcctgtttttattgttggtcagtgatggcatatttgctggtttttt

SEQ ID NO: 29838 - DNA, 201 bp, Homo sapiens
ctcccgagtagctgggattacaggcacctgccaccacacctggcctaatgtttatatttttagtagagatagagtttcaccatgttggccaggctggtctkgaactcctgacttcaagtgatccacctgccttggcctcccaaagtgctaggattataggcgtgagccactgtgcccggctgccactctttttaaagaaag

SEQ ID NO: 29839 - DNA, 201 bp, Homo sapiens
tggctcacacctgtaatcctagcactttgagaggcggagacagcaggatcatttgagctcaagagcttgagatcagcctgggcaacatgggaaaacaccgyctctacaaaaaatacaaaattaggctgggccctgtggctcacgcctgtaatcccagcactttggggggccgaggcaggtggatcacgaggtcaggagttc

SEQ ID NO: 29840 - DNA, 201 bp, Homo sapiens
atgtaagcgatctggttcccacctcagcctcccgagtagtaagtagctgggaccacaggcggtgcccaggttttttttttttttttttttttttttcgttkgtagagacagggtctcactgttgccaggactgctctgaaactcctggtttcaagtgatccccttgcctcctcccacttaggccttccaaatgctgggatt

SEQ ID NO: 29841 - DNA, 201 bp, Homo sapiens; identical to SEQ ID NO: 5514

SEQ ID NO: 29842 - DNA, 201 bp, Homo sapiens
gtgatgggaagggtgaccgggcagggggcttgcccgtggaggtgtgccccacggctccagaagccttgtggtgttgaggactgtgctagtgggcccacagyaggagtggccagggatgagtgacttaaggtcttttaaggatgagtctgactatattggttgacccttgtcacactttaaaagcaccttactttttattcc

SEQ ID NO: 29843 - DNA, 201 bp, Homo sapiens
atgctgctgcacacctctgttccagtctcataccactccttctctctggaatgcgcctcccacgtcccttcaactggctcctacctaggcccccaagtctsaacttcaggattatgccttctagaaaacctgtctgcagctccaggttcagccaggagccaccctattgtacatacctttacctttccacttacgtggaaa

SEQ ID NO: 29844 - DNA, 201 bp, Homo sapiens; identical to SEQ ID NO: 5517

SEQ ID NO: 29845 - DNA, 201 bp, Homo sapiens
ccagagaaaccccacaccctttagctgtcacctacctaacctcccatgtggatttcacggaatcatacaatactgagtcctttggacctggctgattttayttagtaaacgttttcaaggtttatcgatgttgtagcatgtgtcactacttcattcctttttacgactgaataaaactccatttggtggatttatgacagt

SEQ ID NO: 29846 - DNA, 201 bp, Homo sapiens
gtgtttagacatttttttctttctttttttttttgagacagagtttcactctgtcacccaggctggaatgccgtggcacaatctcagctcactgcaacctyacctcccaggttcaagcaatgttcctgcctcagcctccggagtagctgggattagaggcatgcaccaccatgcctggctaatttttgtatttttagtaga

SEQ ID NO: 29847 - DNA, 201 bp, Homo sapiens
ccaaagtgttgggattacaggtgtgagtcactgtgcccagccatgtgtttagacttttaactaatctcttttttagtttcaagccttatcgtccgcctctrtagaccactcctgtgcctgtttcctgatccttccaagggccattgtattccctgtctgctgcccctcttttggattcttctgcacatttttttgttcatg

SEQ ID NO: 29848 - DNA, 201 bp, Homo sapiens
attgtttgattaatgacagggtcttgctttgtctcccaggctggtgtgcagtggtgcgaccacggctcacggcagcctcagccacccagatgtaagcgatytggttcccacctcagcctcccgagtagtaagtagctgggaccacaggcggtgcccaggttttttttttttttttttttttttttcgtttgtagagacagg

SEQ ID NO: 29849 - DNA, 201 bp, Homo sapiens
gtgttaagtgcccagtgtgtttatctactgagggacagttatgttatttcgtgttcactattatcccatgctacaataaatatcctgtgtctcccagatasttagaagagtttctgcagggcacatgtgggagagtttgtttctgggtcatgaggtgtgttcatcttccatcttgctagatgctggcaaagggttctccag

SEQ ID NO: 29850 - DNA, 201 bp, Homo sapiens; identical to SEQ ID NO: 5529

SEQ ID NO: 29851 - DNA, 201 bp, Homo sapiens
agccaggagtttaagaccagcctggccaacatggtgaaaccctgtctttactaaaaatacaaaaattagccgggtgtggtggtgcatgcctgtaatcccasctactcaggaggctgaggcacgagaatcgcttgaactcaggaggcagaggttgcagtgggcagagatctcgccactgcactccagcctggatgacacagt

SEQ ID NO: 29852 - DNA, 201 bp, Homo sapiens; identical to SEQ ID NO: 5532

SEQ ID NO: 29853 - DNA, 201 bp, Homo sapiens
ccttaatttaatcataagccaagaatctactaaacacagttccattaggggcaaagacgtaacacatcagaggccacagcaaggctgtgattcatactcaraaaggaaaggtctctgggtcacaacagagcatagttgaggtcagcacactcccacccagtgcagggctgctccagcattgaggtgtgtctggcaggttga

SEQ ID NO: 29854 - DNA, 201 bp, Homo sapiens
ctcctgtgacttagccgcacctcctctcctttgactttcattccacctccttccaggatcgcaaggtccctatttgtcctggaaacggcttcaaggtagtytagggtgccgtttgccgggggaggaaggtgctctggttgatagagtcgcctggccgcacactctttttggcacataacaacgttctacagagccggggtg

SEQ ID NO: 29855 - DNA, 201 bp, Homo sapiens
tactttttgtgtgtgaggagtccagtgtgaagattcagacttcaggcagccacttgtacaagcactgtcctgttgcctctctggcctcacctaggtaacgstgattcctccacggaggatgtgcttctgagtggtccgttgggtgctgtgctgatgagcatcacccagcattttacgacacatgtgctgccccagagggct

SEQ ID NO: 29856 - DNA, 201 bp, Homo sapiens
gtttgcagtgagccatgatcgtgccactgcactccagcctgggcaacagagtgagatcctgtcttaaaacaaacaaaaaaaacaaacttgttttcatttaractcttcctggcgttggggacctattggaataggtttagtgtgaactgagagctagaagtgttagaggagagagggagggaacagagcccgctggagcga

SEQ ID NO: 29857 - DNA, 201 bp, Homo sapiens
ctaagaattctttcactttttttgtctatcagccaggagctagcaacttggcttatttggaaattttaagtgtacatatcctgtctccttaaatcctttamagatttaaagtgcagtctacctgagggctctgtgaccatgtaagaaagctttttctttctttttttttctctgagacagagtgttgctctgtcgcccagg

SEQ ID NO: 29858 - DNA, 201 bp, Homo sapiens
ccgcctctcatgttgaagcaattctcctgtctcagcctccctcccaagtagctgggattgccagtgcccatcaccacacctggcttttttttttttttttrtatttttagtagagacgggctttcaccatgttagccaggctggttttcgaactcctgatctcaagtgatccgcctcagcctcccaaagtggtaggattac

SEQ ID NO: 29859 - DNA, 201 bp, Homo sapiens
cccgagcggaagggggcggggggtgtgcggggccgggaagcggggagcgcgggcggcggaaggtggcgggagggggtgggggctgggaagcaccgtgcgcrggcggcgggagggcccgggcggggctgcgcggtggtcacgtggggcggggccgggagggtacttagggccggggctggcccaggctacggcggctgcagg

SEQ ID NO: 29860 - DNA, 201 bp, Homo sapiens
ccctggcacagctctcctgggtgttggctcaggacagccctgtttccaactggttaggcggtgaggggtggtggccctttggttccaggttgaaactgccyatgtggtgctgatttagcagactggggaggctctttttgtaggcaggttcttttctttccccagctgctggacctgggagttggaagagaagttgcaccc

SEQ ID NO: 29861 - DNA, 201 bp, Homo sapiens
cctcggactgagaaccaagaatgaggagtgagccatgttgagggctggagagggtctctgattgtcagcaaatgggagcagatcaggggagacacccactytgcccgtgtgtcactctgggctgttccccagtgccccccaacccttgggcccttgaattgggtagggcctctggttttccctgggttgggcttcgtgtgt

SEQ ID NO: 29862 - DNA, 201 bp, Homo sapiens
aaaccccaagtaaatgtgcactttgtccgtcctctcggagcaggtctccgggtactcctgtgccaaaccgatttccgcccccaaggtccttctcctcttakaaatcctgacgcagctcctaggttccttcgcagtgacagccactcttttctatttgtacgtagctgtagtgttttgtgggtacgttctctgaacaacaaa

SEQ ID NO: 29863 - DNA, 201 bp, Homo sapiens
ggggccggcggggagccgggaccctcgggactgtccctgacgggcgggctggggtgggagtccgcgcgctccgaagcgtcggcgagaaaagcagaaaacarctccgcccgccagccctctgccctccgctcccctccccgggctgtgcgccggaccccggccctcggagcggggacgcggccaggaccgccgagggaggcg

SEQ ID NO: 29864 - DNA, 201 bp, Homo sapiens
attacaggcacctgccaccacacctggcctaatgtttatatttttagtagagatagagtttcaccatgttggccaggctggtcttgaactcctgacttcamgtgatccacctgccttggcctcccaaagtgctaggattataggcgtgagccactgtgcccggctgccactctttttaaagaaagcagtaatttgccctct

SEQ ID NO: 29865 - DNA, 201 bp, Homo sapiens
ctggagtgcagtggcacgatctcagctcacgggttcacgccattctcctgcctccgcctcccgagtagctgggactacaggcgcccgccaccacgcccggstaattttttgtatttttactagagacggggtttcaccgtgttagccaggataatcttgatctcctgacctcgtgatccgcccgcctcggcctcccaaagt

SEQ ID NO: 29866 - DNA, 201 bp, Homo sapiens
cggggtgggggccttgggaccacctttaggggctttttccccatcccctggccccaattcgcagcgtttcgccacccagggcccgcagggctccaagcccytcttccccagcccgcgcgctcaggcccccgcccgcccccggcggtggccccggaccccgagcggaagggggcggggggtgtgcggggccgggaagcgggg

SEQ ID NO: 29867 - DNA, 201 bp, Homo sapiens
atgtggatttcacggaatcatacaatactgagtcctttggacctggctgattttatttagtaaacgttttcaaggtttatcgatgttgtagcatgtgtcamtacttcattcctttttacgactgaataaaactccatttggtggatttatgacagtttgtttattcgtgcaatggtttttaatggatggacatttgagttg

SEQ ID NO: 29868 - DNA, 201 bp, Homo sapiens
gaaacaactcaaattcaatgattaagccaccatccacgatgggctgcagaagagtagactttatgagtacctgtagcattaatggcttctagaaagtaccraatgccctagtacaccaattctcaactcgagggtccacaggcctccttgctgcactgagcacctcagtgagagcacatcacaagctctgctgcactggag

SEQ ID NO: 29869 - DNA, 201 bp, Homo sapiens
ccaccagaaacagaaatggtgggaagtggtggcctctggaggcaaagctttgggggctgtggacatctgctgagaccctggctgcagacatggcttccctyccgagggagttcatgtgaaagtcgaggcccccaccggtattagaggagcagccatctcttttgctcgcagttaaacaagtgctctcgcagtaggataagc

SEQ ID NO: 29870 - DNA, 201 bp, Homo sapiens; identical to SEQ ID NO: 5543

SEQ ID NO: 29871 - DNA, 201 bp, Homo sapiens
caaatgggagcagatcaggggagacacccactttgcccgtgtgtcactctgggctgttccccagtgccccccaacccttgggcccttgaattgggtagggyctctggttttccctgggttgggcttcgtgtgtgggcagcgtgcccatccaccgccatcccgggagacccttcagtcagtgggtgactctcttccaggccg

SEQ ID NO: 29872 - DNA, 201 bp, Homo sapiens
ggcgtccatgctgcaggcacgaggcttgccttgccccaggtctgcctcgcccagctggggcttctccgtgggggctgtaggttgactccgctttctcccgsgtcccatcagggtgcagaccgtactccatccctccctgtgagcaccacgtcaacggctcccggcccccatgcacgggggagggagatacccccaagtgta

SEQ ID NO: 29873 - DNA, 201 bp, Homo sapiens
gtgtgtgggcagcgtgcccatccaccgccatcccgggagacccttcagtcagtgggtgactctcttccaggccgggcacaacttctacaacgtggacatgrgctacttgaagaggctatgtggtaccttcctgggtgggcccaagccaccccagaggtgagtgcctgctcctctgcaccgctgtaatgtgagtggcaggcg

SEQ ID NO: 29874 - DNA, 201 bp, Homo sapiens
caaactggaagggaccaaagccctccttttacaagggagtggcgtgtcctggagtcttgaggtatcctggcctcttccggggcctcgtgctcattgctccsttctcccatttctgagcttccagccccagccctgtccttagttcttcaggggagccttccttgagctcccctggcagggcaagtccccttagatgcagtc

SEQ ID NO: 29875 - DNA, 201 bp, Homo sapiens; identical to SEQ ID NO: 5604

SEQ ID NO: 29876 - DNA, 201 bp, Homo sapiens
cgtgctgatggctgatggcaatagagggtgggggtcgggaggggagcctgggtgccaggatggttcatgttgaccaatagggctggattgggcaggcaggkgaggggctggggaagagggctgtgtggggccttccatataggctcactcctctgtggaccagcctggcacctgactgtctttgtccaggtgttgtgccaa

SEQ ID NO: 29877 - DNA, 201 bp, Homo sapiens; identical to SEQ ID NO: 5605

SEQ ID NO: 29878 - DNA, 201 bp, Homo sapiens; identical to SEQ ID NO: 5606

SEQ ID NO: 29879 - DNA, 201 bp, Homo sapiens
gctggcggggaagcgctggagagaaagtgggagcaacactggagagtcttgggggattcggggtggggacaactctgacaaggcaagttatagaaactttytgagtcccagtttccatcagtacaaaaatcacaatccctctggccatgaatgatggcgaggattaggtggagtggcgggcagagcatccagcagattgca

SEQ ID NO: 29880 - DNA, 201 bp, Homo sapiens
acaagcagcacagtgatcatcacccacaaggacaggttgctgggatgaggcaccctttcctttcatgtttaggttcttctcacctgcatttcactttcctwaaggtcccagccacacagcgttcttttagggattaaagtagtaggaaaaaaataaagagaacacaacatccatccttaaagaaaaaaagtaaatccactt

SEQ ID NO: 29881 - DNA, 201 bp, Homo sapiens
cagctatggacaaatttgggatcagtgttctccagtctgaacatagtcttctgttacctgggagagagtggtcaggtactgccagctcagggcagccaaargcatgacaaacgacaggtagatgggggagtagtggcttcgggaaatcagctgacagttgggaagattctgcgtccggatggtggagatgatctgccttgt

SEQ ID NO: 29882 - DNA, 201 bp, Homo sapiens
gtggatctaggatccggcttccaacatgtggcagctctgggcctccctctgctgcctgctggtgttggccaatgcccggagcaggccctctttccatcccstgtcggatgagctggtcaactatgtcaacaaacggaataccacgtggcaggtaggctgtggggctgcgtcctatgtatgtcccctcccaggtcggtctgt

SEQ ID NO: 29883 - DNA, 201 bp, Homo sapiens
ttggggactggggtgggaagatcacttgagcctgggaggtggaggttgcagtgatccgagatcatgccactgcactccagcctggatgacagaacaagacsctgtctcaaaaaacaaacaaaaacaaaagaacaactgtctactgttgtttcgcccatgcgatgctgctgcacacctctgttccagtctcataccactcct

SEQ ID NO: 29884 - DNA, 201 bp, Homo sapiens
aaacaaaaacaaaagaacaactgtctactgttgtttcgcccatgcgatgctgctgcacacctctgttccagtctcataccactccttctctctggaatgcrcctcccacgtcccttcaactggctcctacctaggcccccaagtctcaacttcaggattatgccttctagaaaacctgtctgcagctccaggttcagccag

SEQ ID NO: 29885 - DNA, 201 bp, Homo sapiens
aaatccactttatggtggacttcagctatggacaaatttgggatcagtgttctccagtctgaacatagtcttctgttacctgggagagagtggtcaggtaytgccagctcagggcagccaaaagcatgacaaacgacaggtagatgggggagtagtggcttcgggaaatcagctgacagttgggaagattctgcgtccgga

SEQ ID NO: 29886 - DNA, 201 bp, Homo sapiens
actgatgcccgagacggtgcccctgtgtgtgtgagccctcgacccacataacagagaggtgtcctgatgccctctgtcctctccaggtggatctaggatcyggcttccaacatgtggcagctctgggcctccctctgctgcctgctggtgttggccaatgcccggagcaggccctctttccatcccctgtcggatgagctg

SEQ ID NO: 29887 - DNA, 201 bp, Homo sapiens
gctgctgagaggtgctagccaggtgtacaggcctctggcaggacctgcctggcgtccatgctgcaggcacgaggcttgccttgccccaggtctgcctcgcscagctggggcttctccgtgggggctgtaggttgactccgctttctcccgggtcccatcagggtgcagaccgtactccatccctccctgtgagcaccacgt

SEQ ID NO: 29888 - DNA, 201 bp, Homo sapiens
gtttggaatcccagcacttcaggaggctgaggcatgtagactgcttaagctcaggcgtttaagaccagcctggacaacacagtaaaaccctgtttctacaraatgtacaaaaattagccgggcatcgtggcatgcacctgtggtcccccagctacttggggactggggtgggaagatcacttgagcctgggaggtggaggt

SEQ ID NO: 29889 - DNA, 201 bp, Homo sapiens
ccagcccttgcccacctccctctctatagtctagtaacagttgccgggccaggcacagtggctcatgtttggaatcccagcacttcaggaggctgaggcaygtagactgcttaagctcaggcgtttaagaccagcctggacaacacagtaaaaccctgtttctacaaaatgtacaaaaattagccgggcatcgtggcatgc

SEQ ID NO: 29890 - DNA, 201 bp, Homo sapiens
aaaaaagcctgagctctgtaatgtgtagcgcaaggccacccatggtccagacctactgcacctgtctagtgtcaccagcccttgcccacctccctctctayagtctagtaacagttgccgggccaggcacagtggctcatgtttggaatcccagcacttcaggaggctgaggcatgtagactgcttaagctcaggcgttta

SEQ ID NO: 29891 - DNA, 201 bp, Homo sapiens
tctgcgtccggatggtggagatgatctgccttgttttgctagaagatgggtctgagtcggggattctatgataaatctgttaaagacacaggaaaaaatgrtaagtgctatgtgctttacattttccatggctacttacaacaaccctccactggcaggtattttatacccattttaccaatgaggaaagggaggctcaga

SEQ ID NO: 29892 - DNA, 201 bp, Homo sapiens
ctggggaagagggctgtgtggggccttccatataggctcactcctctgtggaccagcctggcacctgactgtctttgtccaggtgttgtgccaacacacasaattccagaggcctctcccagagcctctgggctagttccttcccatccattggagtccagctcatacatgttctctgtgggaacgcccccctccctggtg

SEQ ID NO: 29893 - DNA, 201 bp, Homo sapiens
attatcattctagccaggatcatactaagtaggatctcatgacagtcacatatgcagcgacttcacctaaaccgtggcactgaatgctctgccatgagccrcaagcagcacagtgatcatcacccacaaggacaggttgctgggatgaggcaccctttcctttcatgtttaggttcttctcacctgcatttcactttccta

SEQ ID NO: 29894 - DNA, 201 bp, Homo sapiens
ttcccatcagctagcattagctgccaccagtcctcccttctcctccctcacctcttcagggtgtacctggagcagctattaaaactctttaagccgtgtarcgcttttgacaaacccttacttacatggaatcccagtataaagaacagatgaatcagtcatctagcattaaatgttttatcaattagaatgtattagaaa

SEQ ID NO: 29895 - DNA, 201 bp, Homo sapiens
ataaatatttctatctactccattcaacccaattaaagaaaacaaaatgatgagaaaaataggagccgaacagaaagaaaattcacatcattttctactaktacgaacattcaaatggtgcttcaaattaaatacttttaattatcattctagccaggatcatactaagtaggatctcatgacagtcacatatgcagcgac

SEQ ID NO: 29896 - DNA, 201 bp, Homo sapiens
cccatcagctagcattagctgccaccagtcctcccttctcctccctcacctcttcagggtgtacctggagcagctattaaaactctttaagccgtgtaacrcttttgacaaacccttacttacatggaatcccagtataaagaacagatgaatcagtcatctagcattaaatgttttatcaattagaatgtattagaaatt

SEQ ID NO: 29897 - DNA, 201 bp, Homo sapiens
cttggctcaccacaacctctgcctcaacctcttgagctcaagggatcctcctgcctcagccccaacaccctccgagtagctgagaccacaggtgtgagccrccatgcccagcatcccctattatatctggcaaccttagtagagaagatacttagaaggaaaacaagctttcaaagagcttcagaatggaatgagagcgaa

SEQ ID NO: 29898 - DNA, 201 bp, Homo sapiens
cgccatgcccagcatcccctattatatctggcaaccttagtagagaagatacttagaaggaaaacaagctttcaaagagcttcagaatggaatgagagcgratacctttctacaactcagtgagtagaaaaaagcacatagctttatagatagaaaaaatctgagatcacccaaaccacacagctcaggaagtggtcccac

SEQ ID NO: 29899 - DNA, 201 bp, Homo sapiens
aagttcccatatgcagatataaagctcttgctcccaagcattctaattgtttatggtcctagattcacatgggtcagaggctcctctgaggaaaacaaaayattgcaccattaggtcggatccaaatagactgtatgccagagatgctataaaattatattagaagtggggagtagagggtagtgttgccagagttaccaa

SEQ ID NO: 29900 - DNA, 201 bp, Homo sapiens
gcacatagctttatagatagaaaaaatctgagatcacccaaaccacacagctcaggaagtggtcccacaggtaatgaccaagtcaggaaagaagatttccrcaggccccactcagaccaaatctctttccagcaggttgttctgtcttaacgtgaactttggcagaattaaatcttagatttcaacacacagatttttaac

SEQ ID NO: 29901 - DNA, 201 bp, Homo sapiens
gtataaagaacagatgaatcagtcatctagcattaaatgttttatcaattagaatgtattagaaattctatttttaaagccaacaagcacattttgtaggmatctatttcaatatttactcaacaactttgagtgtgttgggccttcaaaaatatatttaattccccagtattgtgggaccccccctggagcctcctggtg

SEQ ID NO: 29902 - DNA, 201 bp, Homo sapiens
ctagcattaaatgttttatcaattagaatgtattagaaattctatttttaaagccaacaagcacattttgtaggaatctatttcaatatttactcaacaamtttgagtgtgttgggccttcaaaaatatatttaattccccagtattgtgggaccccccctggagcctcctggtggagcagcaggttccctctggaagctg

SEQ ID NO: 29903 - DNA, 201 bp, Homo sapiens
ctatttcaatatttactcaacaactttgagtgtgttgggccttcaaaaatatatttaattccccagtattgtgggaccccccctggagcctcctggtggarcagcaggttccctctggaagctgtttctccttcccggagcatgaccagctgagtgtggggggtgctgtggggcgtgggacagtggcccggtctcggtctc

SEQ ID NO: 29904 - DNA, 201 bp, Homo sapiens; identical to SEQ ID NO: 5536

SEQ ID NO: 29905 - DNA, 201 bp, Homo sapiens; identical to SEQ ID NO: 5538

SEQ ID NO: 29906 - DNA, 201 bp, Homo sapiens; identical to SEQ ID NO: 5539

SEQ ID NO: 29907 - DNA, 201 bp, Homo sapiens
cttgctgcagctgggggtgggtccacgagtggcctcgggcacttgggtagcacacagtggtctggagagctggtggtgcttctctcagaggttttcattasaggctgtcttttcagctgtaatggtggctatcctgctgaagcttggaacttctggacaagaaaaggcctggtttctggtggcctctatgaatcccatgta

SEQ ID NO: 29908 - DNA, 201 bp, Homo sapiens
gttggccaggctggtcttgaacttccaacgtcgtgatccgcctgccttggcctcccaaagtgctgggattacaggcgtgagccactgcgcctggcctattkctttttttcttttcttttcttttgagatggaatcttgcccgggttggagtgcaatggcgtgattttggctcaccgcaacctccacctcccgggctcaagc

SEQ ID NO: 29909 - DNA, 201 bp, Homo sapiens
tgggggtccccactgatgcccgagacggtgcccctgtgtgtgtgagccctcgacccacataacagagaggtgtcctgatgccctctgtcctctccaggtgratctaggatccggcttccaacatgtggcagctctgggcctccctctgctgcctgctggtgttggccaatgcccggagcaggccctctttccatcccctgt

SEQ ID NO: 29910 - DNA, 201 bp, Homo sapiens
ggtttagtgctgagagaccctgggccccagcttctcagtggaggggactttgaggacttcctgggactgctgcgagtcagaagtgtttcggggagactccragagtctggcaggcagggcctggcaaggctgctgcttcctgggaggtgcctgaaccaaggctggcccggcagagctgtctgaggggtggcatcccagcaa

SEQ ID NO: 29911 - DNA, 201 bp, Homo sapiens
gtcggcggaggacctgctcacctgctgtggcagcatgtgtggggacgggtgagtcaggctgtgcttccacagcgggtttagtgctgagagaccctgggccscagcttctcagtggaggggactttgaggacttcctgggactgctgcgagtcagaagtgtttcggggagactccgagagtctggcaggcagggcctggcaa

SEQ ID NO: 29912 - DNA, 201 bp, Homo sapiens
caagccttatcgtccgcctctgtagaccactcctgtgcctgtttcctgatccttccaagggccattgtattccctgtctgctgcccctcttttggattctyctgcacatttttttgttcatgcattcattcatttattgtttgattaatgacagggtcttgctttgtctcccaggctggtgtgcagtggtgcgaccacggc

SEQ ID NO: 29913 - DNA, 201 bp, Homo sapiens; identical to SEQ ID NO: 5666

SEQ ID NO: 29914 - DNA, 201 bp, Homo sapiens; identical to SEQ ID NO: 5668

SEQ ID NO: 29915 - DNA, 201 bp, Homo sapiens; identical to SEQ ID NO: 5669

SEQ ID NO: 29916 - DNA, 201 bp, Homo sapiens; identical to SEQ ID NO: 5544

SEQ ID NO: 29917 - DNA, 201 bp, Homo sapiens
ctcaaatgaaccaattaactgaagtctccctgggcccaaactaattttggtgtcagtggtcacagcaagaaagtgtgcttacaacaatgcaaatccaacgytgcagctcgaaacaactcaaattcaatgattaagccaccatccacgatgggctgcagaagagtagactttatgagtacctgtagcattaatggcttctag

SEQ ID NO: 29918 - DNA, 201 bp, Homo sapiens; identical to SEQ ID NO: 5545

SEQ ID NO: 29919 - DNA, 201 bp, Homo sapiens
atctcaaaaatgtccacctttactggagaccaatcttctaaaaggtcaaaagcaatcctgctgtttctctctgaaagctaaactcctttaaatgagaatasgagaatacccagaattttattcccagcctttgtgtggaaaaggcagtttgcattcttaggaaacatctaactgttacctaaaccataaatatttctatct

SEQ ID NO: 29920 - DNA, 201 bp, Homo sapiens; identical to SEQ ID NO: 5548

SEQ ID NO: 29921 - DNA, 201 bp, Homo sapiens; identical to SEQ ID NO: 5550

SEQ ID NO: 29922 - DNA, 201 bp, Homo sapiens
ttctagccaggatcatactaagtaggatctcatgacagtcacatatgcagcgacttcacctaaaccgtggcactgaatgctctgccatgagccacaagcakcacagtgatcatcacccacaaggacaggttgctgggatgaggcaccctttcctttcatgtttaggttcttctcacctgcatttcactttcctaaaggtcc

SEQ ID NO: 29923 - DNA, 201 bp, Homo sapiens; identical to SEQ ID NO: 5549

SEQ ID NO: 29924 - DNA, 201 bp, Homo sapiens; identical to SEQ ID NO: 5552

SEQ ID NO: 29925 - DNA, 201 bp, Homo sapiens; identical to SEQ ID NO: 5551

SEQ ID NO: 29926 - DNA, 201 bp, Homo sapiens; identical to SEQ ID NO: 5553

SEQ ID NO: 29927 - DNA, 201 bp, Homo sapiens
gctgcgggcagtggggcggggatcccatagacacctcagctccttagagttctccgcctgggccaggacgagcatgggggtccccactgatgcccgagacrgtgcccctgtgtgtgtgagccctcgacccacataacagagaggtgtcctgatgccctctgtcctctccaggtggatctaggatccggcttccaacatgtg

SEQ ID NO: 29928 - DNA, 201 bp, Homo sapiens; identical to SEQ ID NO: 5555

SEQ ID NO: 29929 - DNA, 201 bp, Homo sapiens; identical to SEQ ID NO: 5557

SEQ ID NO: 29930 - DNA, 201 bp, Homo sapiens; identical to SEQ ID NO: 5558

SEQ ID NO: 29931 - DNA, 201 bp, Homo sapiens
cctcaagtgatccacccacctcggcctcccaaagggctgggattacaggcgtgagccactccacccagccaagacttttcaatacaagcatccataaagtraaatatatagtgatgagataattctattagaagtcatccttctgcctgcccatgttgctttactgcttgtcttagccttcctcctaaaagcagaacctga

SEQ ID NO: 29932 - DNA, 201 bp, Homo sapiens
ctggcaaggctgctgcttcctgggaggtgcctgaaccaaggctggcccggcagagctgtctgaggggtggcatcccagcaaaacagtcagtttcagaaaawgtggtggaatgtctggcccctggtctggtttgtgtcatcgcatgttcctttttcctgcttggggaaccagtttggggcgtttccttatgtgtagttagcg

SEQ ID NO: 29933 - DNA, 201 bp, Homo sapiens
aaattcaatgattaagccaccatccacgatgggctgcagaagagtagactttatgagtacctgtagcattaatggcttctagaaagtaccgaatgccctartacaccaattctcaactcgagggtccacaggcctccttgctgcactgagcacctcagtgagagcacatcacaagctctgctgcactggagtagagaggaa

SEQ ID NO: 29934 - DNA, 201 bp, Homo sapiens
tttcgaactcctgatctcaagtgatccgcctcagcctcccaaagtggtaggattacaggcatgagccaccgcgcggtggaggggtaattttcttaaatctrgtaatgagttgtggttgtgtagagtaacataccgtcctttcgagatatggactgaaacattgagagggaggagttacaggtatgccgattcttcttttct

SEQ ID NO: 29935 - DNA, 201 bp, Homo sapiens
ggagcctcctggtggagcagcaggttccctctggaagctgtttctccttcccggagcatgaccagctgagtgtggggggtgctgtggggcgtgggacagtsgcccggtctcggtctcagccagttcttcccttttcaggagtgtaccaacacgtcaccggagagatgatgggtggccatgccatccgcatcctgggctggg

SEQ ID NO: 29936 - DNA, 201 bp, Homo sapiens
ggaggaagaagaaggagcccagaggcacggctcatacctccctgctggaaggaggggtaaagggcacgaaagtcctttgagaagagaggaaggagaaatakaaatgaataagacagcaccctacaccaaccaacttagagtttagataggaatggagacatatttctgaaaatactggaaacaatcacagccaaataagaa

SEQ ID NO: 29937 - DNA, 201 bp, Homo sapiens
tcggctttctctgttctacccaccgcacagccttaaaccctggacctacggccaggctgtgagctcctcctaagtgccaggcagtcaggagttcccttttrctgtgagggcagactctgagcagcttcagagccaacgcctgcaacagttcccacagcatcgcgccagatcctgtgatgggaagggtgaccgggcaggggg

SEQ ID NO: 29938 - DNA, 201 bp, Homo sapiens
gatcaggcgtggtagctcatgcctgtaatccccgcactttgggaggccaaaggcgggagaattgcttgaggttaggagtttgagaccagcctgggcaatayagcaagatcccatctctacaaaaaataaatattagctgggcatggtggcatgcacctgtagccccagctaattgggaggcgtaggcaagaggattgtttg

SEQ ID NO: 29939 - DNA, 201 bp, Homo sapiens
ccaggatggtctcgatctcctgacctcgtgattcgcccacctcagcctcccaaagtactgggattacaggcgtgagccagcatgcccggcccagagctagkcctttctgtggctggccttcgcgtcagcctcaactaccctggtgtaatctcgcctgcggttgaattagggaaccgccgtgttctgcaagctggagaggca

SEQ ID NO: 29940 - DNA, 201 bp, Homo sapiens
tattacgaacattcaaatggtgcttcaaattaaatacttttaattatcattctagccaggatcatactaagtaggatctcatgacagtcacatatgcagcracttcacctaaaccgtggcactgaatgctctgccatgagccacaagcagcacagtgatcatcacccacaaggacaggttgctgggatgaggcaccctttc

SEQ ID NO: 29941 - DNA, 201 bp, Homo sapiens
taatacacctcagatcaccacattgatcataactttgtcacctcagttcaatagtttctcctggattcttgtccaagtgagatgacaggtggacgtaacartgccttttcagtctttacctagactctccagagaatcactccagaatagaaattagagtataggtaggcagtccaacctctgcatttaaaaaaaaaaatt

SEQ ID NO: 29942 - DNA, 201 bp, Homo sapiens
ctcacacctgtaatcctagcactttgagaggcggagacagcaggatcatttgagctcaagagcttgagatcagcctgggcaacatgggaaaacaccgtctytacaaaaaatacaaaattaggctgggccctgtggctcacgcctgtaatcccagcactttggggggccgaggcaggtggatcacgaggtcaggagttcgag

SEQ ID NO: 29943 - DNA, 201 bp, Homo sapiens
aactgtttcatatcactcacttgggaaagtgtctcaagctgttctacaaatccatgcaaaggccgtttaaaaatagcagcgaaggccctggactcggtctygtccagcacagccccttggctctctctctgggctctggccgcctggcccccggggacccacacgaggtcatggcgtgctgcgggcagtggggcggggatc

SEQ ID NO: 29944 - DNA, 201 bp, Homo sapiens
gcaaaatgctgggattacaggcgtgagccaccgtgcccagcaactattttcaagtgtacagttctgtagcattaagtacattcacagtgttgctcagccaycaccaccatctgtcccccgaactctttttcagctcgcaagacagaaactctgtccccattaacaccaatattgtagcccctggtaagccccactctactt

SEQ ID NO: 29945 - DNA, 201 bp, Homo sapiens
ccagcctgggcaacaaaagtgaaactccgcctccaggaaaaaaaaaaaaaaaaaccacacacacacatacaaactaatactacacattttgcagatttcaraaatgaaccgagttcccaggcagaggttcacggtggtgcttctcttgctttaaaagctgagttgggcagatgttgaggcaggagagtggggcaagtggct

SEQ ID NO: 29946 - DNA, 201 bp, Homo sapiens; identical to SEQ ID NO: 5522

SEQ ID NO: 29947 - DNA, 201 bp, Homo sapiens
agcgtggaggtgtcggcggaggacctgctcacctgctgtggcagcatgtgtggggacgggtgagtcaggctgtgcttccacagcgggtttagtgctgagasaccctgggccccagcttctcagtggaggggactttgaggacttcctgggactgctgcgagtcagaagtgtttcggggagactccgagagtctggcaggca

SEQ ID NO: 29948 - DNA, 201 bp, Homo sapiens; identical to SEQ ID NO: 5524

SEQ ID NO: 29949 - DNA, 201 bp, Homo sapiens; identical to SEQ ID NO: 5526

SEQ ID NO: 29950 - DNA, 201 bp, Homo sapiens
gcccggacatggcagcctcacccggtggggctcgttcctgcaggccttcggggctgtggaagccatctctgaccggatctgcatccacaccaatgcgcacrtcagcgtggaggtgtcggcggaggacctgctcacctgctgtggcagcatgtgtggggacgggtgagtcaggctgtgcttccacagcgggtttagtgctga

SEQ ID NO: 29951 - DNA, 201 bp, Homo sapiens; identical to SEQ ID NO: 5528

SEQ ID NO: 29952 - DNA, 201 bp, Homo sapiens; identical to SEQ ID NO: 5533

SEQ ID NO: 29953 - DNA, 201 bp, Homo sapiens
atcctgtgatgggaagggtgaccgggcagggggcttgcccgtggaggtgtgccccacggctccagaagccttgtggtgttgaggactgtgctagtgggccmacagcaggagtggccagggatgagtgacttaaggtcttttaaggatgagtctgactatattggttgacccttgtcacactttaaaagcaccttacttttt

SEQ ID NO: 29954 - DNA, 201 bp, Homo sapiens; identical to SEQ ID NO: 5534

SEQ ID NO: 29955 - DNA, 201 bp, Homo sapiens
gccaagaacagtgaattgtgagccacaccccgtggccatctcggctttctctgttctacccaccgcacagccttaaaccctggacctacggccaggctgtsagctcctcctaagtgccaggcagtcaggagttcccttttgctgtgagggcagactctgagcagcttcagagccaacgcctgcaacagttcccacagcatc

SEQ ID NO: 29956 - DNA, 201 bp, Homo sapiens; identical to SEQ ID NO: 5535

SEQ ID NO: 29957 - DNA, 201 bp, Homo sapiens
caacaaaagtgaaactccgcctccaggaaaaaaaaaaaaaaaaaccacacacacacatacaaactaatactacacattttgcagatttcagaaatgaaccsagttcccaggcagaggttcacggtggtgcttctcttgctttaaaagctgagttgggcagatgttgaggcaggagagtggggcaagtggctcatgacgcct

SEQ ID NO: 29958 - DNA, 201 bp, Homo sapiens
cagctagcattagctgccaccagtcctcccttctcctccctcacctcttcagggtgtacctggagcagctattaaaactctttaagccgtgtaacgctttygacaaacccttacttacatggaatcccagtataaagaacagatgaatcagtcatctagcattaaatgttttatcaattagaatgtattagaaattctatt

SEQ ID NO: 29959 - DNA, 201 bp, Homo sapiens
ggctgccactctttttaaagaaagcagtaatttgccctcttttattgtgcttcagccatactgaagtggtccacagaccaggagcacggccgtcacctgaragcctgttagaaatgctcatcagagtgtcagagggccagacctctgaaccagcatttgcatctcccaagaccccaggtagtttcccaggtacattcaagc

SEQ ID NO: 29960 - DNA, 201 bp, Homo sapiens
agcctggcacctgactgtctttgtccaggtgttgtgccaacacacagaattccagaggcctctcccagagcctctgggctagttccttcccatccattggmgtccagctcatacatgttctctgtgggaacgcccccctccctggtggctggccacgcctgccctcgccttcctggctttgcattgctttaccagcatgtt

SEQ ID NO: 29961 - DNA, 201 bp, Homo sapiens
ccagcctggcacctgactgtctttgtccaggtgttgtgccaacacacagaattccagaggcctctcccagagcctctgggctagttccttcccatccattrgagtccagctcatacatgttctctgtgggaacgcccccctccctggtggctggccacgcctgccctcgccttcctggctttgcattgctttaccagcatg

SEQ ID NO: 29962 - DNA, 201 bp, Homo sapiens
atggtgcttcaaattaaatacttttaattatcattctagccaggatcatactaagtaggatctcatgacagtcacatatgcagcgacttcacctaaaccgkggcactgaatgctctgccatgagccacaagcagcacagtgatcatcacccacaaggacaggttgctgggatgaggcaccctttcctttcatgtttaggtt

SEQ ID NO: 29963 - DNA, 201 bp, Homo sapiens
agatcaaataagctctgaaaatctgaggaacattgtaggaaaggtttgttaagcatctcttaagtgccatgatgagcataacagccggccgtggtggctcrcgcctgtaatcccagcactttgggaggccaaggtgggaggatgacaaggtcaggagttcaagaccagcctggccaacatgctgaaacctcacctctacta

SEQ ID NO: 29964 - DNA, 201 bp, Homo sapiens
tgatcataactttgtcacctcagttcaatagtttctcctggattcttgtccaagtgagatgacaggtggacgtaacaatgccttttcagtctttacctagmctctccagagaatcactccagaatagaaattagagtataggtaggcagtccaacctctgcatttaaaaaaaaaaattttgagatgggagtctctctctgt

SEQ ID NO: 29965 - DNA, 201 bp, Homo sapiens
ggctcacacctgtaatcctagcactttgagaggcggagacagcaggatcatttgagctcaagagcttgagatcagcctgggcaacatgggaaaacaccgtytctacaaaaaatacaaaattaggctgggccctgtggctcacgcctgtaatcccagcactttggggggccgaggcaggtggatcacgaggtcaggagttcg

SEQ ID NO: 29966 - DNA, 201 bp, Homo sapiens
aaaagctttcagaactttccagaatattgactaaattgtcttgtttacaaccaacaacgacaacaaaaaataactgctgagggccttcgtagtgtctgctrtttcaagtgtacagtagtcattttgtctgcaggatgtggggttgctgtggctgaccttgtacaatattccactcataggtgtcttcaggcctatggagag

SEQ ID NO: 29967 - DNA, 201 bp, Homo sapiens
agaaaaataggagccgaacagaaagaaaattcacatcattttctactattacgaacattcaaatggtgcttcaaattaaatacttttaattatcattctarccaggatcatactaagtaggatctcatgacagtcacatatgcagcgacttcacctaaaccgtggcactgaatgctctgccatgagccacaagcagcacag

SEQ ID NO: 29968 - DNA, 201 bp, Homo sapiens; identical to SEQ ID NO: 5541

SEQ ID NO: 29969 - DNA, 201 bp, Homo sapiens; identical to SEQ ID NO: 5542

SEQ ID NO: 29970 - DNA, 201 bp, Homo sapiens
gcctgctagtgaagtggcgagggggccctgtgggactccagggaatggccacggcaggttgtcctccaggagttgagagccactggacatggcagctgccwgtgttctcagccaccacagtaaccaaagaaatcttggttttaaaattcaagttgccatggaaacgctcccatcctcgacttggcttattatttaaaataa

SEQ ID NO: 29971 - DNA, 201 bp, Homo sapiens
aggaaaaaaaaaaaaaaaaaccacacacacacatacaaactaatactacacattttgcagatttcagaaatgaaccgagttcccaggcagaggttcacggkggtgcttctcttgctttaaaagctgagttgggcagatgttgaggcaggagagtggggcaagtggctcatgacgcctctaatcccagcactttgggaggcc

SEQ ID NO: 29972 - DNA, 201 bp, Homo sapiens
ccttgagctcccctggcagggcaagtccccttagatgcagtcttcccctggaggccaccagaaatcagtgactggctgaccgtggcgtgccacgaggcackgtcactgccctccccaaccccgagctcggttcattttccaggatacaattcctacagcgtctccaatagcgagaaggacatcatggccgagatctacaaa

SEQ ID NO: 29973 - DNA, 201 bp, Homo sapiens
aactcagcctcagcccttccaaactggaagggaccaaagccctccttttacaagggagtggcgtgtcctggagtcttgaggtatcctggcctcttccgggrcctcgtgctcattgctcccttctcccatttctgagcttccagccccagccctgtccttagttcttcaggggagccttccttgagctcccctggcagggca

SEQ ID NO: 29974 - DNA, 201 bp, Homo sapiens
aagatctgtgagcctggctacagcccgacctacaaacaggacaagcactacggtaaggggcctggggcctggccacggcgcacgtggaggctggggagctrctgcatccctcctcacgctgcagcgaagaggtcagggctgaggagccttggggtcccggaactctaggatagaggagggggagtgatgccctcttgccag

SEQ ID NO: 29975 - DNA, 201 bp, Homo sapiens
atggattgtttgagcaattaaccatcatggctttatttgcctttataaactgggggttgagacagaggggctgctgagaggtgctagccaggtgtacaggmctctggcaggacctgcctggcgtccatgctgcaggcacgaggcttgccttgccccaggtctgcctcgcccagctggggcttctccgtgggggctgtaggt

SEQ ID NO: 29976 - DNA, 201 bp, Homo sapiens
ggccagatggattgtttgagcaattaaccatcatggctttatttgcctttataaactgggggttgagacagaggggctgctgagaggtgctagccaggtgyacaggcctctggcaggacctgcctggcgtccatgctgcaggcacgaggcttgccttgccccaggtctgcctcgcccagctggggcttctccgtgggggct

SEQ ID NO: 29977 - DNA, 201 bp, Homo sapiens
ggcctggggcctggccacggcgcacgtggaggctggggagctgctgcatccctcctcacgctgcagcgaagaggtcagggctgaggagccttggggtcccrgaactctaggatagaggagggggagtgatgccctcttgccaggagaagcagcacactctccactttctgcctgttccaccctgaactcagcctcagccct

SEQ ID NO: 29978 - DNA, 201 bp, Homo sapiens
tcagttgagaatcagtgttctacccggaagggcactcgtagcctggtctggtatggacatgaacaggagagcctcctgtcttctcccggatctttgtgggyaggggtggggctggcggttattccctgcaagctgtgcttatctagggagcgtcccttggagggtttggggtctgggaggtctgctcgcaccacttgctgc

SEQ ID NO: 29979 - DNA, 201 bp, Homo sapiens
gggagatacccccaagtgtagcaagatctgtgagcctggctacagcccgacctacaaacaggacaagcactacggtaaggggcctggggcctggccacggygcacgtggaggctggggagctgctgcatccctcctcacgctgcagcgaagaggtcagggctgaggagccttggggtcccggaactctaggatagaggagg

SEQ ID NO: 29980 - DNA, 201 bp, Homo sapiens
aaaacagtcagtttcagaaaatgtggtggaatgtctggcccctggtctggtttgtgtcatcgcatgttcctttttcctgcttggggaaccagtttggggcrtttccttatgtgtagttagcggggatggctccaccttaacaacaaggtggtggcacagaactttctgctccagctgcctgcagcctcgccttggttccgc

SEQ ID NO: 29981 - DNA, 201 bp, Homo sapiens
tcctgcaggccttcggggctgtggaagccatctctgaccggatctgcatccacaccaatgcgcacgtcagcgtggaggtgtcggcggaggacctgctcacvtgctgtggcagcatgtgtggggacgggtgagtcaggctgtgcttccacagcgggtttagtgctgagagaccctgggccccagcttctcagtggaggggac

SEQ ID NO: 29982 - DNA, 201 bp, Homo sapiens
gcctctaatcccagcactttgggaggccgaggtgggcaaatcacttgaacccgggagttcaagaccagtctggccaacatagcaagaccccatttctaccraagaaaataaaagctgagtttgagccccaggagcgtcccctggtgttgagagatcagttgcctacaaggtctgaggtgcccctgtggccctttgagggga

SEQ ID NO: 29983 - DNA, 201 bp, Homo sapiens
agtggggcaagtggctcatgacgcctctaatcccagcactttgggaggccgaggtgggcaaatcacttgaacccgggagttcaagaccagtctggccaacrtagcaagaccccatttctaccaaagaaaataaaagctgagtttgagccccaggagcgtcccctggtgttgagagatcagttgcctacaaggtctgaggtg

SEQ ID NO: 29984 - DNA, 201 bp, Homo sapiens
tgatcgcgccactgcattctagcccgggcgacagagggaaatccagtcaccagacacagtacctgatagtctactagggaagaccagttagaaacatcccrattggccaggcacagtggctcacgcctgtaatcccaacacttagggaggctgaggtgggcggatcacgaggtcagtagatcgagaccatcctggctaaca

SEQ ID NO: 29985 - DNA, 201 bp, Homo sapiens
agacacagtacctgatagtctactagggaagaccagttagaaacatcccaattggccaggcacagtggctcacgcctgtaatcccaacacttagggaggcygaggtgggcggatcacgaggtcagtagatcgagaccatcctggctaacacggtgaaaatacaaaaaattagctgggtgtggtagcgggtgcctgtagtcc

SEQ ID NO: 29986 - DNA, 201 bp, Homo sapiens
taatcccaacacttagggaggctgaggtgggcggatcacgaggtcagtagatcgagaccatcctggctaacacggtgaaaatacaaaaaattagctgggtrtggtagcgggtgcctgtagtcccagctatttgggaggctgaggcaggagaattgcttgaacccaggaggcggaggttgcagtgagctgagatcttgccac

SEQ ID NO: 29987 - DNA, 201 bp, Homo sapiens
caccattgacagcaggggatgggaggtgaattcttcaccattatggaagaaaactgcttagcaagcataacgtattaactgtgagtcagcagtgtcaactscatttcaaagaacagctctatttagggcagagtggcggtgatgatgctgaacaggaggtgtgcagacatgtgagggatagatttgcacatgtgattagct

SEQ ID NO: 29988 - DNA, 201 bp, Homo sapiens
ctgccttcttccaaatacccaccattgacagcaggggatgggaggtgaattcttcaccattatggaagaaaactgcttagcaagcataacgtattaactgygagtcagcagtgtcaactgcatttcaaagaacagctctatttagggcagagtggcggtgatgatgctgaacaggaggtgtgcagacatgtgagggataga

SEQ ID NO: 29989 - DNA, 201 bp, Homo sapiens
actaagacactgcatatagaattctccacaaatggacttcttctctcagcacttctctttggatcttctaattctatcatgtttcttaattctgcctccatttttttttttttttttttttttttgagatggagtctcactctgtcacccaggccaaagtgcagtggtgtgatcttggctcactgcaacctctgcctcctg

SEQ ID NO: 29990 - DNA, 201 bp, Homo sapiens
agcctgcagctctgccttcttccaaatacccaccattgacagcaggggatgggaggtgaattcttcaccattatggaagaaaactgcttagcaagcataaygtattaactgtgagtcagcagtgtcaactgcatttcaaagaacagctctatttagggcagagtggcggtgatgatgctgaacaggaggtgtgcagacatg

SEQ ID NO: 29991 - DNA, 201 bp, Homo sapiens
ctagaactccatgctgagattctgactcagtaggtctgggtggggcccaggaacctgtgtttaaagttgcaggtcatccccaggccacagttttggatcckctgctttgactatgtggagtgctgtggagacccaggctctgggcacaaacttgtcctggtatcttcattttctcccatggcctcagcctgcagctctgcc

SEQ ID NO: 29992 - DNA, 201 bp, Homo sapiens
gtgtacacaagactcccttaggagatcttgtttaaaatgtggctcctagaactccatgctgagattctgactcagtaggtctgggtggggcccaggaaccygtgtttaaagttgcaggtcatccccaggccacagttttggatccgctgctttgactatgtggagtgctgtggagacccaggctctgggcacaaacttgtc

SEQ ID NO: 29993 - DNA, 201 bp, Homo sapiens
agtgatcaactcatacattcatgtctatagaatcttgcttctttggacagaagcaacttaatgtttttatgtagaaaactgggccgggcacagtgactcayacctgtaatccctgtgttttgggaggctgaggccagaggattccttgagcccaggagttcaagaccagcctgggcaacatagcaagaccccatctgtaca

SEQ ID NO: 29994 - DNA, 201 bp, Homo sapiens
gtaaactaattcagtcccctgtgtactaagaacttaaaaagtagttctcataagtgtacacaagactcccttaggagatcttgtttaaaatgtggctcctrgaactccatgctgagattctgactcagtaggtctgggtggggcccaggaacctgtgtttaaagttgcaggtcatccccaggccacagttttggatccgct

SEQ ID NO: 29995 - DNA, 201 bp, Homo sapiens
ctccttagtagctgggactacaggtgtacaccaccgtgcccggctaatttcttgtatttttagtagagataggatttcgccatgttggccaggctggtctygaactccagaccccaggtgatctacctgccttggcctcccaaagtgctgagattacaggcatgagccaccatgcctggccagaaaggagctcaaaagagg

SEQ ID NO: 29996 - DNA, 201 bp, Homo sapiens
atactttatttttttgagatggagtctcgctcttttgcctaggctggagtgtagtggtgtgatctctctgctcactgcaacctccacctctagggttcaarcgattctcctgcatcagcctccttagtagctgggactacaggtgtacaccaccgtgcccggctaatttcttgtatttttagtagagataggatttcgcca

SEQ ID NO: 29997 - DNA, 201 bp, Homo sapiens
ttcttttcagataaatactttatttttttgagatggagtctcgctcttttgcctaggctggagtgtagtggtgtgatctctctgctcactgcaacctccayctctagggttcaaacgattctcctgcatcagcctccttagtagctgggactacaggtgtacaccaccgtgcccggctaatttcttgtatttttagtagag

SEQ ID NO: 29998 - DNA, 201 bp, Homo sapiens
gtgtatgaagtgatgatgttatgggatatgtttcatatgtttttctgttcttttcagataaatactttatttttttgagatggagtctcgctcttttgccyaggctggagtgtagtggtgtgatctctctgctcactgcaacctccacctctagggttcaaacgattctcctgcatcagcctccttagtagctgggactac

SEQ ID NO: 29999 - DNA, 201 bp, Homo sapiens
caccctgcccctcatcagtgtttgcaaagcataaggtgacctgggcttctctcctctacctcaagtctccatcttacctaaaagacttgggtgttggcaawggctttgctgctgaaccatgtcaggggtcagcggggggtggtggcaatgggtcctcttaatgagccagtggccaaggctcagtgagtgagtaatcagagg

SEQ ID NO: 30000 - DNA, 201 bp, Homo sapiens
tgtttttcttctgaaagcaaagctaataatttttagggaatgatgagacagtagatggtagcttggtagctttttgtatgtatgtatgcatgtatgtatgyatgtatgtatgtatgtatgtatgcatgtatgtatgtatgtatgtatgtatgtatttttagacagagtctctctctgtcgcccaggctggagtgcagtggt

SEQ ID NO: 30001 - DNA, 201 bp, Homo sapiens
ttccttaataacgtctaacattcaatccatgttcacttcttttttttttttttgagactgaattttgctcttgttgcccaggctggagtgcagtggcacartctcggctcgctgcaacctccacctctggggttcaagcgattctcttgcctcatcctcccgagtagctgggattacaggcacctgccaccacgccccgct

SEQ ID NO: 30002 - DNA, 201 bp, Homo sapiens
ggtgaagatggcattaagcagtggaggattcttcctatttccctccccccaaccgccccaacacacacatgcttacatacgattctagcctgggtccttgaaagccctttgttcaacccaagattgccctgttcccagggatttgtccagctccaggcctgggagctcagacttgtctggggagtgactgggtcacgtgga

SEQ ID NO: 30003 - DNA, 201 bp, Homo sapiens
agtgcgcgattatggctcactgcaacctcaacctcctgggctcaaggggtcctccctcctacctcagcctcctgagtagctgtgaccacaggcatgcaccrccaggcccagctaattttttatttttattttttgtagagatggggtcttgctgtgttgtgtaggctagtctcaaattactgagcacagacaatcctcttg

SEQ ID NO: 30004 - DNA, 201 bp, Homo sapiens
ggggccagaagtccatgttcaaaggggaaaagggggtcacgaggatcaatcttttctcctgctttaaagaaatgtttttgctactgcatgccctgatagtygccacaccagcagccgcctacctgggcagcaatgaccagctcacgtctcttgcttctttgcagatgattcctgccagatttgccggggtgctgcttgctc

SEQ ID NO: 30005 - DNA, 201 bp, Homo sapiens
gtgtgtgtgtgtgtgtatgaagtgatgatgttatgggatatgtttcatatgtttttctgttcttttcagataaatactttatttttttgagatggagtctygctcttttgcctaggctggagtgtagtggtgtgatctctctgctcactgcaacctccacctctagggttcaaacgattctcctgcatcagcctccttagt

SEQ ID NO: 30006 - DNA, 201 bp, Homo sapiens
ctcctctttccccaggattactgcggcagtaaccctgggacctttcggatcctagtggggaataagggatgcagccacccctcagtgaaatgcaagaaacrggtcaccatcctggtggagggaggagagattgagctgtttgacggggaggtaagtgcagcctcatctccaccctcatgtcccgctttgtgcttctgccac

SEQ ID NO: 30007 - DNA, 201 bp, Homo sapiens
tttttattaaaaccatctcattagctaaacaactatgccgctgctttcgcggcagcggctccagagtggcctggtctctcctgcagctgtcccccgtctaygccgggaagacctgcggcctgtgtgggaattacaatggcaaccagggcgacgacttccttaccccctctgggctggcggagccccgggtggaggacttcg

SEQ ID NO: 30008 - DNA, 201 bp, Homo sapiens
ggggatatgcgcccctttagagctttcccagagattctatatggaagtttcccagcctcagcagcaaaagagagggcgacaccagctttgcagaacaactrcccagcccatttcaaatctgaacatccaggaaaaaattaattcagtgcagcaaggaccagacagctggtcagcatctgctgctcccagcccttccctgcc

SEQ ID NO: 30009 - DNA, 201 bp, Homo sapiens
gtgagtgtcgctaagtgacactaagagagtctctaagtgtcgcccccactctcctaaccctggccgagctgacctccgagacaagccaaggggatgggagragacctggttttagagtggggcatgggagtgatggctggcttggtgggggtgaatgaaaacgcctttggggagcatcaaactctgagaaaggagagagaa

SEQ ID NO: 30010 - DNA, 201 bp, Homo sapiens
ccttcccttctttgcctcagtttcccccttttagggacagccactaggcttccctgtctcctgctgggccccatgctgggcctatgaagtccacactccaygctacaggtcctcaacttccttgggcttcctggagggttgggaggcacccagagtattctgtgttccttcattgcctccatggcccagatgggcccctca

SEQ ID NO: 30011 - DNA, 201 bp, Homo sapiens
tctccttcccctgggtgtgttatgtacgctttgtccccgtggggctggcggtccaggcagcaaggctccagccagcagaaatcacatcctctgtgtgctgyttccctgccctgctggctgccctgcagggcccagctctgccttaggcatagcagtgtggaaaagatccttgcacaggcttcatttagtcagaactgtcac

SEQ ID NO: 30012 - DNA, 201 bp, Homo sapiens
atttatttatggttcatatataccttatacacgttgcctgagggtaagtttatacaacattttaaatatgtatttaatgtgtatttagtatttttaatgtwtgtgcatgaaacaaagttttgtgtacattgaaccatcagaaagtaaaggtgtcaccctctcagccacccatgtggtgtcatgttggtgctcaaagttttg

SEQ ID NO: 30013 - DNA, 201 bp, Homo sapiens
tggaaaggtgtccctgcttccatcagggcaaggagtatgcccctggagaaacagtgaagattggctgcaacacttggtgaggctcagtgaggggctgcgcyggggacccaggccctgcgggtggagtgagggtgcacgcggccacaggaccttccgcacttgcctccagccccctgtgggaacctggttactctctgcctt

SEQ ID NO: 30014 - DNA, 201 bp, Homo sapiens
atcctttccttgggatggctaggtgtaagaatatgtgcatttcaaggcctctggacatgattttttgaagtacctttgcaaaaatgtccaggttacagtgycccagcagggcacgagagggcagagggcagtcagtgtctttagttgacagggaggagccatgtagatgggaacccatgtttgccaagccctggcctgggc

SEQ ID NO: 30015 - DNA, 201 bp, Homo sapiens
ctacttcaaccccctacctgccgcatgaatgctctccacaaactgtgtctgggtagacaggttatgctgtgaccttgactgtaagagttaaatcttggccrggcgcgggggctcagcctgtaatcccggcactttgggaggccgaggcgggcggatcacgaggtcaggaggtcgagaccatcctggctaacacagtgaagc

SEQ ID NO: 30016 - DNA, 201 bp, Homo sapiens
gttaaaaattaacagcataagtatttctcacttcatttaagattcttccaaaggaccattgtaatagcaccataggatactggcgcctggtgattcctcartggatttagtcattttcctattaagtgtttccaatttttttttgcaatgataaataattctccatcaatctttgtccataattctatttccctcagagaa

SEQ ID NO: 30017 - DNA, 201 bp, Homo sapiens
gagactgggcaggagggggcctgtggcttggaccagcccccagactctagttctgatcgatttctacttatgcccaatatttggccctcacctccagagtrttaagtacatattaattttattcaatatagtgttcattttctttaattataaacataatacatgctcattgaagaacacttggaaaaaaattttaaaact

SEQ ID NO: 30018 - DNA, 201 bp, Homo sapiens
catggagagtgaaccgggatacgggagactgggcaggagggggcctgtggcttggaccagcccccagactctagttctgatcgatttctacttatgcccartatttggccctcacctccagagtgttaagtacatattaattttattcaatatagtgttcattttctttaattataaacataatacatgctcattgaagaa

SEQ ID NO: 30019 - DNA, 201 bp, Homo sapiens
aagtgtggaggcgagagctggagggaggccagctggggcagaggcggtgcaagaggaggtgcagctaggggccccccggtctccttcccctgggtgtgttrtgtacgctttgtccccgtggggctggcggtccaggcagcaaggctccagccagcagaaatcacatcctctgtgtgctgtttccctgccctgctggctgcc

SEQ ID NO: 30020 - DNA, 201 bp, Homo sapiens
aagcaaattaaatgggaaaaccataggaatttcctgaagatcactacatggcaagactgggattcggccctaggcttctctgatttggagaccacctttgwaatgctgtgacgtttcacccaggggaaggcgttcaacttgccaccccaacgctgccaacaaacagaaaaatggcaacaacaacaaaaactagttctttct

SEQ ID NO: 30021 - DNA, 201 bp, Homo sapiens
ttctttttctttttcttttttttttcgagacagagtctcactctgtcgcccagtctagagtgcagtggtatgatgttggctccctgcaacctctgcctccygggctcaagtgattctcctgcctcagcctcaccagtagctgggattacaggcgcccaccactacacccggctagtttttgtatttttagtagagacaggg

SEQ ID NO: 30022 - DNA, 201 bp, Homo sapiens
cccaccattgtgaagctcccatcttcctctgctttcttgcagggcaaatgtgccagcaaagccatgtactccattgacatcaacgatgtgcaggaccagtrctcctgctgctctccgacacggacggagcccatgcaggtggccctgcactgcaccaatggctctgttgtgtaccatgaggttctcaatgccatggagtgc

SEQ ID NO: 30023 - DNA, 201 bp, Homo sapiens; identical to SEQ ID NO: 5833

SEQ ID NO: 30024 - DNA, 201 bp, Homo sapiens; identical to SEQ ID NO: 5834

SEQ ID NO: 30025 - DNA, 201 bp, Homo sapiens
gactcttctggggctggtagttcttagttcttttattttctcagccccaacagaccggaggaatacaacatgctcacgaaagtagtttcccgaggggtgasgacggggaagtagagcataccccatggagagtgaaccgggatacgggagactgggcaggagggggcctgtggcttggaccagcccccagactctagttct

SEQ ID NO: 30026 - DNA, 201 bp, Homo sapiens
ccatttcctcccaaatacatctgcctgccaccaccctgtcctctccccacctctgcctgagtcctgtcctgctgggttccaggtgacctccgcatccagcrtacagtgacggcctccgtgcgcctcagctacggggaggacctgcagatggactgggatggccgcgggaggctgctggtgaaggtaggtgccctcacgggg

SEQ ID NO: 30027 - DNA, 201 bp, Homo sapiens
actgggtcacgtggagctggaactgttcagaccaggagcttctcgccctgcagggagctctggagccaaggtgccacagtccttcacctgggggtgacccrggcctctttgagaacccccaaggctaggccacaccaggacaggcacccagggctgccccttggagtcgggacagaagcgtgtctgcatgttgagctcaga

SEQ ID NO: 30028 - DNA, 201 bp, Homo sapiens
cgctgtgtgcacccgctccgtcaccgtccggctgcctggcctgcacaacagccttgtgaaactgaagcatggggcaggagttgccatggatggccaggacrtccagctccccctcctgaaaggtatgcttcgtcctgctccatcaggcctggggctggcacagcccatcccttagcaccctccttctcaaccctggccact

SEQ ID NO: 30029 - DNA, 201 bp, Homo sapiens
tggaggattcttcctatttccctccccccaaccgccccaacacacacatgcttacatacgattctagcctgggtccttgaaagccctttgttcaacccaasattgccctgttcccagggatttgtccagctccaggcctgggagctcagacttgtctggggagtgactgggtcacgtggagctggaactgttcagaccagg

SEQ ID NO: 30030 - DNA, 201 bp, Homo sapiens
aagcagtggaggattcttcctatttccctccccccaaccgccccaacacacacatgcttacatacgattctagcctgggtccttgaaagccctttgttcarcccaagattgccctgttcccagggatttgtccagctccaggcctgggagctcagacttgtctggggagtgactgggtcacgtggagctggaactgttcag

SEQ ID NO: 30031 - DNA, 201 bp, Homo sapiens
gagatgcgggaacacctcctgaggttgggtgaagatggcattaagcagtggaggattcttcctatttccctccccccaaccgccccaacacacacatgctyacatacgattctagcctgggtccttgaaagccctttgttcaacccaagattgccctgttcccagggatttgtccagctccaggcctgggagctcagactt

SEQ ID NO: 30032 - DNA, 201 bp, Homo sapiens
caacctgcatcttatgccctgcactgtcatcctgacccatcagctgggcttccagagatgcgggaacacctcctgaggttgggtgaagatggcattaagcrgtggaggattcttcctatttccctccccccaaccgccccaacacacacatgcttacatacgattctagcctgggtccttgaaagccctttgttcaaccca

SEQ ID NO: 30033 - DNA, 201 bp, Homo sapiens
gagtggggtcaacctgcatcttatgccctgcactgtcatcctgacccatcagctgggcttccagagatgcgggaacacctcctgaggttgggtgaagatgrcattaagcagtggaggattcttcctatttccctccccccaaccgccccaacacacacatgcttacatacgattctagcctgggtccttgaaagccctttg

SEQ ID NO: 30034 - DNA, 201 bp, Homo sapiens
ccctttgatgttccttttcaggcccagtgtgccctgctggtatggagtataggcagtgtgtgtccccttgcgccaggacctgccagagcctgcacatcaawgaaatgtgtcaggagcgatgcgtggatggctgcagctgccctggtaatgaacttcccactttatttacagatcagagaccttgccagcacccttggcttt

SEQ ID NO: 30035 - DNA, 201 bp, Homo sapiens
ccctgggccgtgaacgcatggtgggttgtcccatgggttgaatatcatggcgagaggtaaaaacatgcagcatgcagaccaagaggcctgggagcccccarcccggcctgcccaagggtgaggggcaacatgtgctgctgaggtaaggggagcctggctctgtttcctggagtccgtccctgcacttctgtcccacatggt

SEQ ID NO: 30036 - DNA, 201 bp, Homo sapiens
tgttctgtgtatcgctcagaaacaaaagcctaccaattcaaatatgatagccatcctaagacgcaatccaacttcagagatgttacactgtgggaaaaagrtgtatttagagtcattaacatacagaatggagagatgtttctaggtaaaacgtagggtcgttgatactcgtgagtgagcagaagtaggaaatgatgacaa

SEQ ID NO: 30037 - DNA, 201 bp, Homo sapiens
attaataacctcctcttgctaacacgagtcggcagagagcagccacgtggtttgcagtgggtgctcagaaggaggaggaggtggcggctgcagtcatggcrttgttatctcacacctgagctgggactggagtgttctgtccgctggaggagggctgggcttccatagacccacacctgggtgacaggagggtctccctgg

SEQ ID NO: 30038 - DNA, 201 bp, Homo sapiens
tgcttctaggtcttgcttcatctcagcctccacctgccacgtcctatctctgacctgcaaggctgctgcaggttccgtgggttctttcatcagagtcaggmcagtcgtgatttttctcaagtcgagctcctccaaaatgcttttctgtgcctatttatgggattctcacctaaagcagcccctgccgatagaactttctgc

SEQ ID NO: 30039 - DNA, 201 bp, Homo sapiens
tacatctgggcacttaagcacagggctgtgagttcggagctaaaaattggcccggagtgacctgaaagctgtctactctgtactgtttgtgcctaacctgmaattttgctgttttcttagggtaaaattatgaaaattccaggcacctgctgtgacacatgtgagtgcgttactaatatcttgtcccttgaaacccatcag

SEQ ID NO: 30040 - DNA, 201 bp, Homo sapiens
ctgctctctcaagtctctctttcttgagtcattgataggctaaggaatgaggacttatttcaagtgctttagtgaggtccaagaatccagggggcagtccytggtttggcccaattctctgcatgtcctcgtgtaagttactttcctactctgcctctcagtcttccctctctgaggtaaacagagctccacggaaccccc

SEQ ID NO: 30041 - DNA, 201 bp, Homo sapiens
acacgtgtctttccccgttttgatgagaactgctctctcaagtctctctttcttgagtcattgataggctaaggaatgaggacttatttcaagtgctttastgaggtccaagaatccagggggcagtccctggtttggcccaattctctgcatgtcctcgtgtaagttactttcctactctgcctctcagtcttccctctc

SEQ ID NO: 30042 - DNA, 201 bp, Homo sapiens
caccctttgatgaacacaagtgtctggctgagggagtgagtactcattctgctttcctctttactgtctcaatctctaagaacaagattcttctgaatagygtgcatcccagctccggcataatttctcagtgtctgaggcacatctctggcctagttgaagaatcagtgagattacgaaatcaaagcctacggagagata

SEQ ID NO: 30043 - DNA, 201 bp, Homo sapiens
cttcagtgttctccaggcagatgaaggggaggtggtgggtgcttcagtgggtgaggtggggtcagggtggctgtggaggtacctctaatactgaaacatgscttcaaagatttattatttttggtctcattttattttgcaaacatagcccagtgcagagtaagtacttgacaaatgttccctaccctcggaatacaaagg

SEQ ID NO: 30044 - DNA, 201 bp, Homo sapiens
ggggactgggcttaggttccatgtcatattcttaccttcattctgcaaaaatattttgagcattcgtaatccactgtataagaatttagagataagagacwcagcccatacccttaagtaaggagctcacagttgaatgggagatgaatatgagcaaaaagaatacaaaccaaaggtgatgagtgttttggtagagggatg

SEQ ID NO: 30045 - DNA, 201 bp, Homo sapiens
ttgggctgcccagagcaagcccttgacatacttaaaacagcactcgcttgagtcccagctcttcatcactgactagctctgtgatgataggcaagttaccmcagggtctgccgcctggccagccccgagccccgcagcctgtgtggacaggttcctctgttatttactctaggagggctggggctctccttctctcccata

SEQ ID NO: 30046 - DNA, 201 bp, Homo sapiens
tgtgttccttcattgcctccatggcccagatgggcccctcaaacccaaggtgcccaacttgtcatctctgccatgactgctcctagtgtctgtcgggaccrgaagtggaactgcacagaccatgtgtgtgatgccacgtgctccacgatcggcatggcccactacctcaccttcgacgggctcaaatacctgttccccggg

SEQ ID NO: 30047 - DNA, 201 bp, Homo sapiens
tgaataactcccagcccgtgagcttggccctcacacatttctgacttaatcttctgagtctaaagctccctggcaccctatagcatagctgaatacttacragccctggctgggcgcagtgctcagtgtggccttgtcctatcctcagcctgcaggaaggaggagtgcaaaagagtgtccccaccctcctgccccccgcac

SEQ ID NO: 30048 - DNA, 201 bp, Homo sapiens
ctgtgttccttcattgcctccatggcccagatgggcccctcaaacccaaggtgcccaacttgtcatctctgccatgactgctcctagtgtctgtcgggacyggaagtggaactgcacagaccatgtgtgtgatgccacgtgctccacgatcggcatggcccactacctcaccttcgacgggctcaaatacctgttccccgg

SEQ ID NO: 30049 - DNA, 201 bp, Homo sapiens
atctccagatggcgcaggccatcaccacatgggtctgcagtcctggaggctttgcctgttgtggccacagccttgtctcctgtctacacagcccagagctkcgaggagaggaatctccgggagaacgggtatgagtgtgagtggcgctataacagctgtgcacctgcctgtcaagtcacgtgtcagcaccctgagccactg

SEQ ID NO: 30050 - DNA, 201 bp, Homo sapiens
ctgaagcagcaggtgacgaagaggctctttttgtggctctacttgattcaaaataatccgcattttctcgttccgtttagggcctcgtctcactcaggtgwcagtgctgcagtatggaagcatcaccaccattgacgtgccatggaacgtggtcccggagaaagcccatttgctgagccttgtggacgtcatgcagcggga

SEQ ID NO: 30051 - DNA, 201 bp, Homo sapiens
accaagaatactcgtgcttgctgcagtgtgtctgggacattccacagaatcagcgcatgctgttgctgatgggaactggtcccgtctggccccagcaatcwcctggggagtgtttaaaaaaaaaaaaatcttgctgatccccatcccaaactactgcattcagatctcctagggtgagacccagaaatctctataaagccc

SEQ ID NO: 30052 - DNA, 201 bp, Homo sapiens
tcccaccattgtgaagctcccatcttcctctgctttcttgcagggcaaatgtgccagcaaagccatgtactccattgacatcaacgatgtgcaggaccagwgctcctgctgctctccgacacggacggagcccatgcaggtggccctgcactgcaccaatggctctgttgtgtaccatgaggttctcaatgccatggagtg

SEQ ID NO: 30053 - DNA, 201 bp, Homo sapiens
tgctgaaggataccaggtgtgggcacagccacaggcacctccgtcttgggtttatgaagaagcagctggggctgagatgaggaggcctccgaatctaatctttatttctgcccatcctcctgtatgtcatcaaggggagggaatgtttccttgacttcccctcatcattggatcttattcccaaacaaatttatagttttt

SEQ ID NO: 30054 - DNA, 201 bp, Homo sapiens
gcccttcatcctcctggatttcttgctttgtcttcctccaggtgaatgtgaagaggcccatgaaggatgagactcactttgaggtggtggagtctggccgrtacatcattctgctgctgggcaaagccctctccgtggtctgggaccgccacctgagcatctccgtggtcctgaagcagacataccaggtcagtggctttc

SEQ ID NO: 30055 - DNA, 201 bp, Homo sapiens
caggtcagtggctttcttgcttcatcttgttggggacttggcctttggagtgttttctgctccctgatcgtaggtctctaaggacttgctttatgaatccrggtgctcctgtgttgggtgcatatatatttaggatagttagctcttcttgttgaattgatccctttaccattatgtaatggccttcttttgatctttgtt

SEQ ID NO: 30056 - DNA, 201 bp, Homo sapiens
attttatttatttgtttgtttgtttgtttgaggcagattctcactctggagtgactggcgctatctctggataggctagagtgcagtggcactattttggytcactgcaaccttggcctcctgggttcaagcacttttcctgcctcagcctccgagtagctgggattacaggcgtgcgccaccacactcggctaatttttg

SEQ ID NO: 30057 - DNA, 201 bp, Homo sapiens
gggcagtgggagaagttgaactgcttgtgatagcattgatagagcttcagcggggcctcagctgatccttcaaggagctctggaaggtggagtggcccctrttggtcactggatgtgggctgccctgggtaaggaggtggaactcccttgggctgagggccattcctgaggaatgactcagtggtgagcccttggcagcca

SEQ ID NO: 30058 - DNA, 201 bp, Homo sapiens
tgcatatgattgacgtatatgcatataattttctatttcaaaaaaagacattgatggccctgccgtgtcactagcaagccatgggcccaacaagtctcttycccacaatgaaacttgttttcctcatctgtaatgtgagtcgtgaggtcttggccagcccttaacattccatgactccggtgctgtgcctgaaacaggcat

SEQ ID NO: 30059 - DNA, 201 bp, Homo sapiens
gtgatcgcgccactgcattctagcccgggcgacagagggaaatccagtcaccagacacagtacctgatagtctactagggaagaccagttagaaacatccyaattggccaggcacagtggctcacgcctgtaatcccaacacttagggaggctgaggtgggcggatcacgaggtcagtagatcgagaccatcctggctaac

SEQ ID NO: 30060 - DNA, 201 bp, Homo sapiens
tcatcccatgggagccactgttttgccttccataatcctggtgcagattatatcctagcgggaatgttactatagatagtttgggctgatgagccctgtgragaggggatgtaagagcagaatctttggggaagggagggaatgagtcatgccagtatctaggggagagagtttaggcagacggaacaagcacgtgccgag

SEQ ID NO: 30061 - DNA, 201 bp, Homo sapiens
atgttactatagatagtttgggctgatgagccctgtgaagaggggatgtaagagcagaatctttggggaagggagggaatgagtcatgccagtatctaggsgagagagtttaggcagacggaacaagcacgtgccgaggccttaaggtggtaggtgtctgcagccgttgtacaaggaggtcagtgtggctacagaggaggg

SEQ ID NO: 30062 - DNA, 201 bp, Homo sapiens
ggggatgtaagagcagaatctttggggaagggagggaatgagtcatgccagtatctaggggagagagtttaggcagacggaacaagcacgtgccgaggccytaaggtggtaggtgtctgcagccgttgtacaaggaggtcagtgtggctacagaggagggacttgggggtaatggtagttcacgagggcagggaggggcag

SEQ ID NO: 30063 - DNA, 201 bp, Homo sapiens
agtatctaggggagagagtttaggcagacggaacaagcacgtgccgaggccttaaggtggtaggtgtctgcagccgttgtacaaggaggtcagtgtggctrcagaggagggacttgggggtaatggtagttcacgagggcagggaggggcagtagccataccatgggggctactaggccatgggaagatcgttggcctttt

SEQ ID NO: 30064 - DNA, 201 bp, Homo sapiens
tgggggctactaggccatgggaagatcgttggccttttgcccaacagtgagaacattcttcctctatgtttcctggtgacttacaccccttgtaccaagcygaatgcagcttattgaagcaagatagaatacattttttctctttgtctcaacatcagggctctaagtatattgtaaaagtatagcaccttttcttctcca

SEQ ID NO: 30065 - DNA, 201 bp, Homo sapiens
cctgtaatctcagctactcgggaagctgaggcaggagaattgtgagagccccggagatagagtcttcagtgagccgagatggcgccactgcactccacgcygggcaacagagcgagactgtctcaggaaaaaaaaaaagaaatgcatcttgcacatttggtagagattatgttgcaggctttggtgacaatttgcatctgg

SEQ ID NO: 30066 - DNA, 201 bp, Homo sapiens
ctccttgctttgtcgtaggactccacttgttttgagcctagaggagtttggtgtcactctgaaagggttttaggtgaaggggaggaaagaatgccaagttrtacatggagagcaggcgaccaaggggaagggtgggggtcctgggtgcccccgatgggtcttggtaagggcctcacaagatggaagatgttcatctaaggg

SEQ ID NO: 30067 - DNA, 201 bp, Homo sapiens
tcctggtgacttacaccccttgtaccaagctgaatgcagcttattgaagcaagatagaatacattttttctctttgtctcaacatcagggctctaagtatrttgtaaaagtatagcaccttttcttctccaggccaaatatttccagttttttctgtagtttttttgttttattattatttttagttgacatttaactgta

SEQ ID NO: 30068 - DNA, 201 bp, Homo sapiens
tttgttttattattatttttagttgacatttaactgtatgtatttactggtgacagtgtgatatttcagtacatgtatacagtgtgtagtgatcaaatcasggtagttactatatctgttccctcaaacatttaccatttctttgtgttgggaacattcaaagtctgctcttccagctacttgaaaatatacaataaactg

SEQ ID NO: 30069 - DNA, 201 bp, Homo sapiens
agctgtgacaaacagatcactgggccctgcccctggagttctgactcagtagaaatggaagggggcctgaaaatttcccaactgctgctgctgcttttagrgtgggtaaccagactttgagggtgcgggactggaggagagtaggctgggaggctgtaccatcgggtgaagctgcagtgtagggtcttggagtctgatggg

SEQ ID NO: 30070 - DNA, 201 bp, Homo sapiens
gccttgcaggctgctctgtgaatagtgggctgaataatggtataagtccgtgaattcagagctgatggaattacggttagcatggcaggaaatcattagtrcctttgtcccagtcctgtccagtgtgtttattgcttgtacagatgaagacctaaagcacaggcttgtacaatttgcagtgatgcagatattgaagggaga

SEQ ID NO: 30071 - DNA, 201 bp, Homo sapiens
cggagagctgtgacaaacagatcactgggccctgcccctggagttctgactcagtagaaatggaagggggcctgaaaatttcccaactgctgctgctgctyttagagtgggtaaccagactttgagggtgcgggactggaggagagtaggctgggaggctgtaccatcgggtgaagctgcagtgtagggtcttggagtctg

SEQ ID NO: 30072 - DNA, 201 bp, Homo sapiens
aggaactaaaagaaaatcatataatcggagaaacttatttgtactcgtgaaattgatcagaaataaatagaagtcctgtaggggagggagatgtggcttgrgaacaattaatgtaaaggaggtcttagaatgttagcagtagagagaactagagggatcatttacttcaagcccctcattttatagacattactagtctcc

SEQ ID NO: 30073 - DNA, 201 bp, Homo sapiens
acattactagtctcctacaatgtgccgggcactttgcccttattattttgtgaactcctcagactgatcctataaggtagagttcccaccttccagaagargaaacaggtctagaggatccaagttgacttggctgagatgtgaaagccctagtggatgataagaataatcagtatgtgacttggattgatctatctgtct

SEQ ID NO: 30074 - DNA, 201 bp, Homo sapiens
cctacaatgtgccgggcactttgcccttattattttgtgaactcctcagactgatcctataaggtagagttcccaccttccagaagaagaaacaggtctaraggatccaagttgacttggctgagatgtgaaagccctagtggatgataagaataatcagtatgtgacttggattgatctatctgtctgtctgtctgtcta

SEQ ID NO: 30075 - DNA, 201 bp, Homo sapiens
aatgtgccgggcactttgcccttattattttgtgaactcctcagactgatcctataaggtagagttcccaccttccagaagaagaaacaggtctagaggawccaagttgacttggctgagatgtgaaagccctagtggatgataagaataatcagtatgtgacttggattgatctatctgtctgtctgtctgtctatctat

SEQ ID NO: 30076 - DNA, 201 bp, Homo sapiens
gaggatccaagttgacttggctgagatgtgaaagccctagtggatgataagaataatcagtatgtgacttggattgatctatctgtctgtctgtctgtctrtctatctatctatctatctatctatctatctatctatctatctatctatccatctatccatccatcctatgtatttatcatctgtcctatctctatctaa

SEQ ID NO: 30077 - DNA, 201 bp, Homo sapiens
ccagcattcccttcttgcccaaaccaagtgctacaaggcttggttggggggcagtcagcattccagctcagcctgagtggaaatttagttaactcaggagrcatttcttgtgagcctactatgtactaagcatggctaggtgctgaggttacaaataatgtgcaggacatggtctttacctttataagcttattttaggtt

SEQ ID NO: 30078 - DNA, 201 bp, Homo sapiens
aatgtgcaggacatggtctttacctttataagcttattttaggttagctaaggaaataacatgattgcatggattatttagagatcagttaatagttatayatacatgttgagatgaggtcttgctatgttgcctaggctggtcttggactcctgggctcaagtgatcctcccacctctgcctcacgagtaggtgagatta

SEQ ID NO: 30079 - DNA, 201 bp, Homo sapiens
gaactgcagcaggaagacctgagcatagttatagctgctgcattgaggggagtcctgacatgaatgacagacaagctgcagtcatctctccttggagcctrttagggctggaacagatctttatttgtctggaatgcttaagacctctcttcccctctggacgctcttccagctcagggattctaagcacgcagttttgga

SEQ ID NO: 30080 - DNA, 201 bp, Homo sapiens
tcctcctccctccctccctccctccctccctacgtcacttccttccttccctccctccttccctccctccctccctccctcactccctccctcactccttycttccttccttccttccttccttccttcctttctttcttttctttctttctttcttttcattcgttcttcttttttttttttgagatggagtctcgctct

SEQ ID NO: 30081 - DNA, 201 bp, Homo sapiens
agttacctcctggcagggggctgccagaaacgctccttctcgattattggtgagttctgggcactgcagggaggacttcagagggagggctggctgagctyagccctggtgtgggggaggattcctgctctcaggacagtgtctgagcggaaaggtcactgctgagaacaaggagaggaacagcctttctgtgacacgtag

SEQ ID NO: 30082 - DNA, 201 bp, Homo sapiens
tcctttcccttttccttttccctggtgagcaacagaatggacaagaatctgatggtgcccataagtgcatattcactgagatgtttcatatggcttgcgtsatacaacgtagactaagggacaagacacgtaagagaaattaaaccatgaaagactgtctggggttagtaaatgacaaatcgccaagtgaatggtaagtga

SEQ ID NO: 30083 - DNA, 201 bp, Homo sapiens
cattcaattcaaaggcctccctaacataatgttcccaaaatcctttaacgaactatttctcaggtgggttcctttcccttttccttttccctggtgagcarcagaatggacaagaatctgatggtgcccataagtgcatattcactgagatgtttcatatggcttgcgtgatacaacgtagactaagggacaagacacgta

SEQ ID NO: 30084 - DNA, 201 bp, Homo sapiens
agcattcaattcaaaggcctccctaacataatgttcccaaaatcctttaacgaactatttctcaggtgggttcctttcccttttccttttccctggtgagsaacagaatggacaagaatctgatggtgcccataagtgcatattcactgagatgtttcatatggcttgcgtgatacaacgtagactaagggacaagacacg

SEQ ID NO: 30085 - DNA, 201 bp, Homo sapiens
gcagggcccccaggttcagaagtccggtctggtaaatgccgcatcatttatgagtgtctgctgttgtggctccaagggccgttcagggtgacagagtgttytgtgtgggagttcacactgaccttgaaactttccttgacagcctccagaatctacttccccaaccctctggtgctttctgtctttctagggcatagcaag

SEQ ID NO: 30086 - DNA, 201 bp, Homo sapiens
cagcctgtgtagtcccgcagggcccccaggttcagaagtccggtctggtaaatgccgcatcatttatgagtgtctgctgttgtggctccaagggccgttcrgggtgacagagtgttctgtgtgggagttcacactgaccttgaaactttccttgacagcctccagaatctacttccccaaccctctggtgctttctgtctt

SEQ ID NO: 30087 - DNA, 201 bp, Homo sapiens
gtttcatctcattccctgccctttgctttccccactgggcatttcacccagctgttggtgttatccagatgccagctgggatgacctgccccttaggaacyagttaagacggcctcagccttcccattttgtagattttgggagaagcccagggccctcccagggggattcatgctctctcattcacctgtgaatctgagg

SEQ ID NO: 30088 - DNA, 201 bp, Homo sapiens
cttgcccagcctgcatttcccatcactgggcctgggagccccattctgcacctggggtcgacattctcagattaaccctcgcctctggtccccagcaacgstcagacttaagagtcccctggagggtaaatgtgagggtgtcaacaggaacatggggacactcatctgtcagaggtcccgtggcctggatccttgtgggat

SEQ ID NO: 30089 - DNA, 201 bp, Homo sapiens
ccctttgctttccccactgggcatttcacccagctgttggtgttatccagatgccagctgggatgacctgccccttaggaaccagttaagacggcctcagscttcccattttgtagattttgggagaagcccagggccctcccagggggattcatgctctctcattcacctgtgaatctgaggtgctgtggctgaggggct

SEQ ID NO: 30090 - DNA, 201 bp, Homo sapiens
acttaagagtcccctggagggtaaatgtgagggtgtcaacaggaacatggggacactcatctgtcagaggtcccgtggcctggatccttgtgggatgaccrtacagaactcctactagttttcagtgagcaagaacatttcaaatccctctgaggctgtcccaccactaatttctctgacttttgtggccgttcctctcct

SEQ ID NO: 30091 - DNA, 201 bp, Homo sapiens
tatccagatgccagctgggatgacctgccccttaggaaccagttaagacggcctcagccttcccattttgtagattttgggagaagcccagggccctcccrgggggattcatgctctctcattcacctgtgaatctgaggtgctgtggctgaggggctggttttgggatggcctcaccacccctccaaagtgccacaggct

SEQ ID NO: 30092 - DNA, 201 bp, Homo sapiens
tgattaagatgggccacaattgggcctgcacaccaacccaggcatggtgaggtcatggctggatgggctggggcagctgctctcccgcagctcctggcacsgccgacaggagttgaaagaagacaggagtagctgatgcagggccttggagccagggagatgctggaagtgtgcaaattagctggcccttgttttgcatcc

SEQ ID NO: 30093 - DNA, 201 bp, Homo sapiens
cctctgcctcccaaggtgctgggattactggcatgaaccaccgtgcctggcctcgtttttcttttttttttgagtcgctctgtggccaggttggagtgcartggcacgatcttggctgattgtagcctcgtactccctggttcaagcgattctcttgcctcagcctcctgagtagctgggattgcaggcgcacaccaccac

SEQ ID NO: 30094 - DNA, 201 bp, Homo sapiens
ggagtgcagtggcacgatcttggctgattgtagcctcgtactccctggttcaagcgattctcttgcctcagcctcctgagtagctgggattgcaggcgcayaccaccacacccagctaatttttgtattattagtagagacgggatttcaccatgttggccaggatggtctcaatctcttgaccttgtgatccacccgcct

SEQ ID NO: 30095 - DNA, 201 bp, Homo sapiens
ttttgtattattagtagagacgggatttcaccatgttggccaggatggtctcaatctcttgaccttgtgatccacccgcctcgacctcccaaagtgctggsattacaggcgtcagccaccatgcctggcccagctatcccactttgagagataggactgattatgtgttcagatgaagcaacctatttctgcattgtgaag

SEQ ID NO: 30096 - DNA, 201 bp, Homo sapiens
tccacccgcctcgacctcccaaagtgctgggattacaggcgtcagccaccatgcctggcccagctatcccactttgagagataggactgattatgtgttcrgatgaagcaacctatttctgcattgtgaagtttaccccatcaacaatttatagttttactatttataagtgtttgttgtctaagatttattatgtcatta

SEQ ID NO: 30097 - DNA, 201 bp, Homo sapiens
cccaggctggagtgcagtgagtggtgcgatcttggctcactgcaacctccgcctcctgggttcaagcaattctcctgcctcagcctcccaagtagctgggmttacaggtgccaccatgcttggctaatttttgtatttttagtagagacagggtttcaccatattggccaggctggtctcgaactcctgacctcaggtgat

SEQ ID NO: 30098 - DNA, 201 bp, Homo sapiens
ctcgacctcccaaagtgctgggattacaggcgtcagccaccatgcctggcccagctatcccactttgagagataggactgattatgtgttcagatgaagcracctatttctgcattgtgaagtttaccccatcaacaatttatagttttactatttataagtgtttgttgtctaagatttattatgtcattaggagtttca

SEQ ID NO: 30099 - DNA, 201 bp, Homo sapiens
ttccgcatcccctcatgtctgccaattcgaccccctgccccagccctccgaggccagcgccctgggcccctccctccaccttcccagctggagtggcagcygctgtgtcttttctggtttttattcctagtccttcccttttccgtcctgcatgctgtcgccagggttgtctttatttagctcttctctgtgaggcagggc

SEQ ID NO: 30100 - DNA, 201 bp, Homo sapiens
gcacagacttaccatgtagctactttgtgggatggtgtgaggagattgatgagaagcacacacattttttttcctcttgcaaattggttgtgctccctttrggaagacaggaccacaggctttctgaaggcaaggaccagggctggccatctctgcctccctgggcctagcatagcccctggcatgcagtggatacacaag

SEQ ID NO: 30101 - DNA, 201 bp, Homo sapiens
aattactatggtgtaaaacacttaaatgattttaaaccccaaattataaaacaagacatattcccaggagtcttactctgtgttttctctaccttattccwtcctccaccctataatttatatatgtgaatatatataatatataatatatatatatatagagagagatagggtcttgctctgtcacccaggcacaagtgc

SEQ ID NO: 30102 - DNA, 201 bp, Homo sapiens
cctccgaggccagcgccctgggcccctccctccaccttcccagctggagtggcagccgctgtgtcttttctggtttttattcctagtccttcccttttccrtcctgcatgctgtcgccagggttgtctttatttagctcttctctgtgaggcagggcctcctccattgtcttcagccacctgcctcacctgtgatgccggg

SEQ ID NO: 30103 - DNA, 201 bp, Homo sapiens
catgcagtggatacacaagaagtgtctgctaaactgagatgtgcattgtttctttggggaagaaggctaaaggagaaatttaataaggctccaagccagcyctagagatagcctatcagaacaaagaaagttctcaagtctagctgctttttaatgggtaaaatgtgcccttgtcattgtaggctcaggtggttgaaagac

SEQ ID NO: 30104 - DNA, 201 bp, Homo sapiens
ctaccttattccttcctccaccctataatttatatatgtgaatatatataatatataatatatatatatatagagagagatagggtcttgctctgtcaccyaggcacaagtgcagttatgcgacctcaactaacttcagcctccaccccctaggctcagacgatcctccccctcaacctcctgagtagctggaactacaga

SEQ ID NO: 30105 - DNA, 201 bp, Homo sapiens
gctggagtggcagccgctgtgtcttttctggtttttattcctagtccttcccttttccgtcctgcatgctgtcgccagggttgtctttatttagctcttcyctgtgaggcagggcctcctccattgtcttcagccacctgcctcacctgtgatgccgggcactgcgggagtgttccttcgtctgtgcctttgttagctgtt

SEQ ID NO: 30106 - DNA, 201 bp, Homo sapiens
ccagtgtgtctttgggatagattcctggaagtgagattctgggtcaaattataaatacacatttacttttgctaagtattgctaaacaattcttctccatrgggatggtaacattttcctgcaggccttttaatagaacaaggggtctcattcagtaagttcattatacagaagctagaagactgagaagataaatgataa

SEQ ID NO: 30107 - DNA, 201 bp, Homo sapiens
tctggcagagcagactcaaacactggcacctagagtcctagagtgggtgggcttccttgcccagcctgcatttcccatcactgggcctgggagccccattytgcacctggggtcgacattctcagattaaccctcgcctctggtccccagcaacggtcagacttaagagtcccctggagggtaaatgtgagggtgtcaaca

SEQ ID NO: 30108 - DNA, 201 bp, Homo sapiens
gtattcaagtctgtgggaccatgaaggcctcacgaggggccacccctgagagactggtcatagcttttctaaggctggtgggcagggaaaggaggaggacraaatctgctttataagcagccctgcatatgggcggagaccacatttggttttatttattgccacattctcagcacctagagcggcttctgtgtagtaggt

SEQ ID NO: 30109 - DNA, 201 bp, Homo sapiens
ctgacaaacttccaggatgctggtctccctggcatgctttctggggaagctttgtctgttgctctctcatctcacttttcttttgtaaagaacaccgtacsctataaattactaggtaaatgtcaagtaacctcttggggaagcccaaatctgcacgttggtgagcagtattgggatcgagtgttcgtcttgtatgggagg

SEQ ID NO: 30110 - DNA, 201 bp, Homo sapiens
atactcctcaggaagaagaagagggagggctgttcttctcagtatcagacaggaaacagggccaccccagggaatggggttggccagaacctctgtagctyatatgaagcctgtggacactggagggtcctgacccgagcccagagctcgtcctgttaggctggtacaacccgcaactccagtgttgcaagggccagtctg

SEQ ID NO: 30111 - DNA, 201 bp, Homo sapiens
gaccttttcactgatttctactgaaacctccttggtggttttagggaggtggaaacctttacaacccagaaaaggaacagtatttcccacagtccctctgytatttctgcaggtctggctggggcatcttgccagccccccattgccccactcttgtcctctcctggctggctcacccccgccagtcccttcttctaacac

SEQ ID NO: 30112 - DNA, 201 bp, Homo sapiens
gacaggttcctctgttatttactctaggagggctggggctctccttctctcccatacacttctcctggttctctcctgtttgatttttctgcttctgctgmattcttggtttattcagccttgcaggccttactttacaaacttatagccatagcgacctccgggctcccctgtggcacccgctcagctctgcctcctgtg

SEQ ID NO: 30113 - DNA, 201 bp, Homo sapiens
gcctagttgaagaatcagtgagattacgaaatcaaagcctacggagagataaaattctctgcaatataggatgttttaaaaaaatattttccttaagggargctgagtgtgtgattcttgaataaaatgtgagatcaaactgatttttagtctccctgggaatgaagatcctgatgactcaactggaagagaattcagaat

SEQ ID NO: 30114 - DNA, 201 bp, Homo sapiens
tcttaatgtaattggcaggctttccctttacaatgaaattatctagaaattaggaggcagactaatatgtagttagggttgatttagatttcgagccatcyaaggacagaaaactcccagtgttcagactggaatggtgagctgggattaaatttttgaattcccagtgggccaagtagagattcagatctgaatgccact

SEQ ID NO: 30115 - DNA, 201 bp, Homo sapiens
cactcatcccctccgtgggccctaccctgtggtgggacttacatgttaagccaggcttcacgtctagaaaccaccttcctgagagaagagcacattcccamtgggaccctgggctccagccctgccccagcttgttggactaactctggtgccctgcaggtcggctcccagtgggcctccccggagaacccctgcctcatc

SEQ ID NO: 30116 - DNA, 201 bp, Homo sapiens
actggcttttccttctgcctgctcctgaagacacgccaagttcatggcttgatttatgagagcaaatggtttaaattaatctctgagcaagcttactgactcctaaccttgaccttgggacaggtcgtctgtctgggtgctccaaattgacttggtgattcataatagaaaagcctcaggaccccaatgaatggatctctg

SEQ ID NO: 30117 - DNA, 201 bp, Homo sapiens
ttctcctttgtcagctgcttgggagcaaacacaatagctaagcttcagatctctggctctgctttctctcctcctgctgcctgccactgagatgtgcttgytttccctcctcctcccctgcacccgcctgatgtctccagggaagatgcctggtcttctttaatgaactggaaatgtgattaagatgggccacaattgggc

SEQ ID NO: 30118 - DNA, 201 bp, Homo sapiens
atggcaacggtgggcaggggctgagttctgagaccggttctgaggaaggaagcacaggccccatctgcaagcctcagtgtcagtgtgagatactgccaacytctggggaagagtgatgtctttgcctccaggggtgggaaaggcatagcatggggtaggcctcttctgaaactcagcacaaagtaaaagggattttcccag

SEQ ID NO: 30119 - DNA, 201 bp, Homo sapiens
gagaaggtgtctgaccaggtgtgcaaggatttctctgagcccgtggctcacagggttcctgtgtacccatagtggcccctgtgggagggagaggtgctgaygactgatggggacctggaaacagggtgctggcaggtgcagtagtgtggtcacccaactcagcctgaggccatgagccccagatttggaggcagacctggg

SEQ ID NO: 30120 - DNA, 201 bp, Homo sapiens
tccgccagaatgcagaccagtgctgccccgagtatgagtgtggtatgtgtcccaccagggggatgtctccagggcccaaccctagccccagggggcaccaygttgaaggtgctgaaaggtgtctctgttctcaggcacagggtgtgtgaaaggaggtgggtaaggaccgattggatactccaaaaaagtggaaagggttac

SEQ ID NO: 30121 - DNA, 201 bp, Homo sapiens
cagaggcgcgatctcggctcactgcaagctccgcctcccgggttcacgccattctcctgcctcagcctcccgagtagctgggactacaggcgcccgccacyacgcctggctaatttttcgtatttttttttttgtagagacggggtttcaccgtgttagccgggatggtctccatcacctgacctcgtgatccgcctgcct

SEQ ID NO: 30122 - DNA, 201 bp, Homo sapiens
cctgagtagctgggactacaggcgcccaccgccatgcccagctaatttttttcttttttttgtatttttagtagagacggggtttcaccgtgttaaccagratggtctcaatctcctgacctcgtgatctgcccaccttggcctcccaaagtgctgggattacaggcgtgagccactgcgcctggctgctttttggttttt

SEQ ID NO: 30123 - DNA, 201 bp, Homo sapiens
gggctgtatctagaaactgaggctgggtactacaagctgtccggtgaggcctatggctttgtggccaggatcgatggcagcggcaactttcaagtcctgcwgtcagacagatacttcaacaagacctgcgggctgtgtggcaactttaacatctttgctgaagatgactttatgacccaagaaggtaagatgttctgggat

SEQ ID NO: 30124 - DNA, 201 bp, Homo sapiens
aagcatttatcttcaacagaacatgtacaaacacaggttagcgtctacattttagtaacatttgttcttggagacacttgtaagaaggcttggattataaytaagtattcatgttgctaaagatgtaggttgaaaagaaatcagctttgagtggttgtgtggatggcctagaacaacgagtatattttttcatatcctagg

SEQ ID NO: 30125 - DNA, 201 bp, Homo sapiens
ggacagatgttaaacaatgacatctcacttggatgtggaatggtccatgggatctcaagttcaggtggaacagaggagattctgtgggaatatggaagtcrttgtacactgtagggctcagaagtgtccacaggttcttcctgaaccattttaatttcttcgctcttttctgcagccactgtgatgttgtcaacctcacct

SEQ ID NO: 30126 - DNA, 201 bp, Homo sapiens
ctgtcctgcttgagctaacattttaaacagtcatgttgactttgaataatcacagcatgcctcctcagtagcccaaagaggcacagaaaatacccattccrttagagacaaagcagttcactcttcatgttctcattaaatattgctcaagccttttatttgcaaaggacctaccagccctttctgctatttctgctcatg

SEQ ID NO: 30127 - DNA, 201 bp, Homo sapiens
gacaggaaacagggccaccccagggaatggggttggccagaacctctgtagctcatatgaagcctgtggacactggagggtcctgacccgagcccagagcycgtcctgttaggctggtacaacccgcaactccagtgttgcaagggccagtctgacccaggaagtcagcttttcaaactgtgctcctcagattgcctcaga

SEQ ID NO: 30128 - DNA, 201 bp, Homo sapiens
ctgaaaacctacaaacatgcacaaagagggtggcccctgcctatacccaggaccatggtcatgatggacgcgacaggccacagttgcctttgtctgggcaygggccactctgcagagcgtgagtgcatgctgcagtcacccgagtgcgcagcccatcagcagagcagtagggcaggtgctctgtgattttgttcatcccat

SEQ ID NO: 30129 - DNA, 201 bp, Homo sapiens
tggtgctaatgatgactttgatcttaaggtccactgtgtgtgatagtggtataaaacgcttttccttggccatcacttgcctctcctttcttttccttacsgtctttgtgtgtttatattttaggactgtctcttgaacattgctggattgtgtgcctttttaaagaaatccaatttgataatctctacctttttattatt

SEQ ID NO: 30130 - DNA, 201 bp, Homo sapiens
gggggtggtggcaatgggtcctcttaatgagccagtggccaaggctcagtgagtgagtaatcagaggagggagaagtctggagggtggaatcaggcctgcrgtgggaagatttggccacagggagtcaggagtggggggtgaagagaatggctgcaagtgtttggcattttctacacctcatctggaaggagaagaaataa

SEQ ID NO: 30131 - DNA, 201 bp, Homo sapiens
tttgaattcccagtgggccaagtagagattcagatctgaatgccactaacccctgtgtgaaaggaaacccccatgtcagcaacctggagtcagcagtaccygaagagaggccttcacaaaggtgcctagggatcttctcggtccccagagaggcagggtatgcccttacatcaccatgacttcgcctttcctcttacccca

SEQ ID NO: 30132 - DNA, 201 bp, Homo sapiens
gctggccgacacagagggcactcggagtgacattttctggggaagatcctcctggtgacttttctgaaccatggtcttgggccctttcagcttcttgcccrtggtgacaacccttggggtcaggctacccatgtgcagtcttcgtggacagattgcagggctgcaggggtcccaggccagccttcccgggcttctgccagc

SEQ ID NO: 30133 - DNA, 201 bp, Homo sapiens
gcagagcattagagatttcctttgtggtgagggctggaccggctgggtttctatcaggctttatgcttgatgccaaggtcctacatactccagacatcctwcagtggaagaggaagtggtgtagataacaccaaacatcatccagtccccaaatcactaactggtactgtcacttgcagttagagatggtccttccttaaa

SEQ ID NO: 30134 - DNA, 201 bp, Homo sapiens
actggcgctatctctggataggctagagtgcagtggcactattttggttcactgcaaccttggcctcctgggttcaagcacttttcctgcctcagcctccragtagctgggattacaggcgtgcgccaccacactcggctaatttttgtatttctagtagagatgtggttttgctatgttggctgggctggtcttgaactc

SEQ ID NO: 30135 - DNA, 201 bp, Homo sapiens
tttatgcttgatgccaaggtcctacatactccagacatccttcagtggaagaggaagtggtgtagataacaccaaacatcatccagtccccaaatcactamctggtactgtcacttgcagttagagatggtccttccttaaaatgtatggaagaattttcatgtacatgctggcaagatggtggggactcttgctggggag

SEQ ID NO: 30136 - DNA, 201 bp, Homo sapiens
gtggcactattttggttcactgcaaccttggcctcctgggttcaagcacttttcctgcctcagcctccgagtagctgggattacaggcgtgcgccaccacrctcggctaatttttgtatttctagtagagatgtggttttgctatgttggctgggctggtcttgaactcctgacctcaagtgatctgcccacctcggcctc

SEQ ID NO: 30137 - DNA, 201 bp, Homo sapiens
ggttgggacatcacatcttgtggttttccttctgctctgccctcgactgtggtgtcacttactcccctttgcttccccaggctccttctctataaagtggratctatcatgaccagcctaccttatcaatataggagagaaaatcttcatgcctgaaggtcagtgatcacaaatggcatacttgaccttaacatagtactt

SEQ ID NO: 30138 - DNA, 201 bp, Homo sapiens
agcgatggctcatgggagctatgggtgggtgggcaggagacagggtatgagagtgaggtgagtggggggttgggggatgctggggggcctgaccctggtgyctctgcttccagcccgggaagactgtgatgatcgatgtgtgcacgacctgccgctgcatggtgcaggtgggggtcatctctggattcaagctggagtgca

SEQ ID NO: 30139 - DNA, 201 bp, Homo sapiens
ttctgtgcatcttggagttgcagattccatcgtgcagaagggccctttggaggtcttccctcccatccccctgcccaggtccgtgaactgtcccggggagmtggcactcctcttcccctctggggatggagcttccatcatctactccctcaaccttccttaaccctcctagcgtctcatgggagagctcttataaaatgg

SEQ ID NO: 30140 - DNA, 201 bp, Homo sapiens
gcccagagcaagcccttgacatacttaaaacagcactcgcttgagtcccagctcttcatcactgactagctctgtgatgataggcaagttaccccagggtytgccgcctggccagccccgagccccgcagcctgtgtggacaggttcctctgttatttactctaggagggctggggctctccttctctcccatacacttct

SEQ ID NO: 30141 - DNA, 201 bp, Homo sapiens
ccggggagctggcactcctcttcccctctggggatggagcttccatcatctactccctcaaccttccttaaccctcctagcgtctcatgggagagctcttrtaaaatggacccctcctcctgcctctggcagcccctcctgttttgcggtcccttgtgcacttactacctgcctcttctcccttttgttctgcttaaccta

SEQ ID NO: 30142 - DNA, 201 bp, Homo sapiens
ttagggaatgatgagacagtagatggtagcttggtagctttttgtatgtatgtatgcatgtatgtatgcatgtatgtatgtatgtatgtatgcatgtatgyatgtatgtatgtatgtatgtatttttagacagagtctctctctgtcgcccaggctggagtgcagtggtgagatctcggctcactgcaagccccgcctccc

SEQ ID NO: 30143 - DNA, 201 bp, Homo sapiens
gagttgcctctatgtgggtaccagagccactctgctggttgactgtagagactgtgtgaggggtaagggtgggatccaaacacacacctcaagttctagtscagtttccaggtgtgccatctcttcatcttccattgtggggcaaggctgcagggtgagaggcatttgggcctactggggagtgtgtctataattttctgt

SEQ ID NO: 30144 - DNA, 201 bp, Homo sapiens
gggctgagagaagcccatcccaccctatgtatgacgttgctagagcacatgcatagcaggtatttggctgctagggacggtgttattgtctctagtacacrgtataatccatctgtattgtttaaaaattgttttaaaaatgtcagtagtttttagggtacggggttttgcttttggttacatgggtaagttctttggtgg

SEQ ID NO: 30145 - DNA, 201 bp, Homo sapiens
ccattcttgcagcagtaaggtgggttatctcattgtggttttaatttgcatttccctgatgattagtgatgctgaacattttttcatatgtttgttggctrtttatatatcttcttttgagaaacgtctattctccatcactattcgtaactaagtggttagcgaaggcctctcttaggagatgaatttgaacagagattg

SEQ ID NO: 30146 - DNA, 201 bp, Homo sapiens
cagagaattcaagtgacttgccaaaggtcataactgctgggtggcagggccaggttcagaacccaggtgacttgacacctgcataagaactcccaggccaccccatcagagccacaccatccctgttgcttacactcctcccgtgctgacatggggaccagtgactgctgcacccttaagttcccaccacttctgttactg

SEQ ID NO: 30147 - DNA, 201 bp, Homo sapiens
agctaataatttttagggaatgatgagacagtagatggtagcttggtagctttttgtatgtatgtatgcatgtatgtatgcatgtatgtatgtatgtatgyatgcatgtatgtatgtatgtatgtatgtatgtatttttagacagagtctctctctgtcgcccaggctggagtgcagtggtgagatctcggctcactgcaa

SEQ ID NO: 30148 - DNA, 201 bp, Homo sapiens
cgcccaccgccatgcccagctaatttttttcttttttttgtatttttagtagagacggggtttcaccgtgttaaccagaatggtctcaatctcctgacctygtgatctgcccaccttggcctcccaaagtgctgggattacaggcgtgagccactgcgcctggctgctttttggtttttattttattaaaattgtttaaaa

SEQ ID NO: 30149 - DNA, 201 bp, Homo sapiens
tacaagcacgtgccaccatgcctggctaattttttgtatttttagtagagacggggtttcaccatgttagccaggatggtctcgatctcctgatctctcaygatctgcctacctcagcctcccaaagtgctgggatcacagacatgagccaccgcacctggctgttttattttatttttaaaaattcatttcagccacttc

SEQ ID NO: 30150 - DNA, 201 bp, Homo sapiens
cgccatgcccagctaatttttttcttttttttgtatttttagtagagacggggtttcaccgtgttaaccagaatggtctcaatctcctgacctcgtgatcygcccaccttggcctcccaaagtgctgggattacaggcgtgagccactgcgcctggctgctttttggtttttattttattaaaattgtttaaaacactctt

SEQ ID NO: 30151 - DNA, 201 bp, Homo sapiens; identical to SEQ ID NO: 5839

SEQ ID NO: 30152 - DNA, 201 bp, Homo sapiens
tgtctgatgatggcctgttcctcataggcagtgctttctcatggcatccacatgtggcagaaggtggaaaggcaaaaggcactagggcattccctttgactttttttttttttaaataacagcacaaattcactcaggagagtggagccctcatgacttaaatcacttaggccccatctcttaatatcatcagttgggagt

SEQ ID NO: 30153 - DNA, 201 bp, Homo sapiens
caccacagaacaagttctttgagcttcctggaagaaacccaaccattgtccctggggattctatagttgtgggatgagtgacgcaatgacaatgttgaggyctttgtcttgatgcccttgaccccagagggacagctcctggatgaaggcctctgcgtggagagcaccgagtgtccctgcgtgcattccggaaagcgctac

SEQ ID NO: 30154 - DNA, 201 bp, Homo sapiens
tgccgggaagacctgcggcctgtgtgggaattacaatggcaaccagggcgacgacttccttaccccctctgggctggcggagccccgggtggaggacttcrggaacgcctggaagctgcacggggactgccaggacctgcagaagcagcacagcgatccctgcgccctcaacccgcgcatgagtatgtgaacccgggggca

SEQ ID NO: 30155 - DNA, 201 bp, Homo sapiens
cagtagatggtagcttggtagctttttgtatgtatgtatgcatgtatgtatgcatgtatgtatgtatgtatgtatgcatgtatgtatgtatgtatgtatgyatgtatttttagacagagtctctctctgtcgcccaggctggagtgcagtggtgagatctcggctcactgcaagccccgcctcccaggttcacgccattct

SEQ ID NO: 30156 - DNA, 201 bp, Homo sapiens
atctaagtaagtacataagtagagaaacccagccctctcctattccagaaacaaaataaaacacacccacatctccctcctcccacccaccccccatcacrgtaacacgaggaagcttcgttttagctggttattaattcagtgagtcttcatcttcatggaacaatttgacctctgaccaaggagaatgtcagacccaga

SEQ ID NO: 30157 - DNA, 201 bp, Homo sapiens
agcctcctgagtagctgggactacaggcgcccaccgccatgcccagctaatttttttcttttttttgtatttttagtagagacggggtttcaccgtgttarccagaatggtctcaatctcctgacctcgtgatctgcccaccttggcctcccaaagtgctgggattacaggcgtgagccactgcgcctggctgctttttgg

SEQ ID NO: 30158 - DNA, 201 bp, Homo sapiens
cccacatctccctcctcccacccaccccccatcacagtaacacgaggaagcttcgttttagctggttattaattcagtgagtcttcatcttcatggaacawtttgacctctgaccaaggagaatgtcagacccagaaaaatattctgagttgatgctaaatccagctgcctaaattgtgaacagacaatctccaccttata

SEQ ID NO: 30159 - DNA, 201 bp, Homo sapiens
gggtctgccgcctggccagccccgagccccgcagcctgtgtggacaggttcctctgttatttactctaggagggctggggctctccttctctcccatacasttctcctggttctctcctgtttgatttttctgcttctgctgaattcttggtttattcagccttgcaggccttactttacaaacttatagccatagcgacc

SEQ ID NO: 30160 - DNA, 201 bp, Homo sapiens
gcactccagcctgggtgacacagcgagactccatctcaaacaaaaaaaaagaaaaaagaggacagattttcataatttctttctttttttcccaaacatasagttgtgctgttggcaggtgggtcaccctcggctgcccttcagtgttctccaggcagatgaaggggaggtggtgggtgcttcagtgggtgaggtggggtc

SEQ ID NO: 30161 - DNA, 201 bp, Homo sapiens
tatagatgtttttcttttatggttagtgctttttatgtcctgtttaagaagtttttgtccattctaaggtcatgaagatagtatcctatgttttcttttaraagcattatagtttagttttacttttaggtctatgatccatgaggaataaattttaaatgtggtataaagtaggggtctcccatgtggctatccagtggg

SEQ ID NO: 30162 - DNA, 201 bp, Homo sapiens
gggggtggtggcaggtgcctgtaatcccagctactcaggaggctgaggcaggagaatcacttgaacccagggggcagaggttgcagtgagccgagattgtrccactgcactccagcctggtgacagagcgagactctgtctcaaaaaaaaaaaaaaaaaaaaaaagaattgcctgtgtatgtatggaccaatcgctaggct

SEQ ID NO: 30163 - DNA, 201 bp, Homo sapiens
gtgaaagaaaacaggtaaaaatcctttccctgcttcccctaagtgaagagtaatcttttatgtttatttatttattttttgagacagggtctcactctgtyttccaggctggagtgcagcggtatgatcatggctcattgcagccttgacttcctgggctcaggtgatcctcccatctcagccttccaggtagctgagact

SEQ ID NO: 30164 - DNA, 201 bp, Homo sapiens
cccaaagtgctgatattacgggcatgaagccacctcactggccttgtttggtattaatacacctatatcaactttcttattttgactaatttgtctattasatctttcttctcaacctatctatctaaattaaaagtgcgtctcttgaaaacaacatactaattgaattttgctttttaaaatctaaaggtgacaatctcc

SEQ ID NO: 30165 - DNA, 201 bp, Homo sapiens
cttttggttcaactgagtttttcttttttttcttttttttagtactatatctctttattggccttttcactgtatttcttcatattactattttagtggtygctctagacttatcacagtacactttgattgaataatataacatttcatgtacaacgtactttttccataatttgtacatttgttgtcatacagtttact

SEQ ID NO: 30166 - DNA, 201 bp, Homo sapiens
actatacaactaggttatgtggtataacctgttactcccaggtgacaaacctgtatggcatgttactgtgctgaatactgtaggcaactgtaacacaatgrttagcatttgtatatctaaacacatgtaaacatagaaaaggtacagtaaaaaatatataaaggataaaaatgacatactgtatagggcacttaccaagaa

SEQ ID NO: 30167 - DNA, 201 bp, Homo sapiens
gacaaacctgtatggcatgttactgtgctgaatactgtaggcaactgtaacacaatgattagcatttgtatatctaaacacatgtaaacatagaaaaggtmcagtaaaaaatatataaaggataaaaatgacatactgtatagggcacttaccaagaatggagcttataggactggaagttgctcttggtgagtcagagag

SEQ ID NO: 30168 - DNA, 201 bp, Homo sapiens
cttgttggggacttggcctttggagtgttttctgctccctgatcgtaggtctctaaggacttgctttatgaatccaggtgctcctgtgttgggtgcatatrtatttaggatagttagctcttcttgttgaattgatccctttaccattatgtaatggccttcttttgatctttgttggttcaaagactgttttatcagata

SEQ ID NO: 30169 - DNA, 201 bp, Homo sapiens
ggtccaacagtttgttggaacttgcatgatttctttaagtggcatgtatgtgacaagtggctctggctactctagccactggtttagtcaggcaggaatgrcctccacagcatccctgataacaccatccattttcagcttgtacaagccagtgaggcagcactgccctcacttctctgtggcagcccatctcagtcccag

SEQ ID NO: 30170 - DNA, 201 bp, Homo sapiens
aacaatggggatatgttctaagaaatgcatcgttaggtgatttttgttgtgcaaagatcgtggagtgcacatacgcaaatccagatggtatggtctactayacaactaggttatgtggtataacctgttactcccaggtgacaaacctgtatggcatgttactgtgctgaatactgtaggcaactgtaacacaatgattag

SEQ ID NO: 30171 - DNA, 201 bp, Homo sapiens
atttttgaaatttttaatttgtttaacttcttttttttttttttcgagacagggtctcattcgtcacccaggctggagtgcagaggcattatcatagctcrttgcagcttaaactcctgggatcaactgatcctcctgcctcagcctcccaaacaggtggaactataggcatttttttatctttaaacttttttgttaaaa

SEQ ID NO: 30172 - DNA, 201 bp, Homo sapiens
caaagtgctgggattacaggcgtgagccaccgcactcgaccgataccattttaaatagcactgctaggccagagcggggtggctcatgcctgtaattactygcaccaaggagctcaagaccagcctgggcgacacggtgagatcttgtctctacaaaaagaaaaaaaaaattagctggatgtggtggtacatacttgtgat

SEQ ID NO: 30173 - DNA, 201 bp, Homo sapiens
ggcatatcattaaaactattcctagaatagacttattatttacgtgggagagccctcactgaatttccaccagaaacaagtctattctgtagctcattcgkgttggtttggagtgtttgtgtgttccagggtgcatgctatgtgtgtgcatggtgtgtgtgcgtgtggtgtgtgtgtgtgtgtgtgtgtgtgtctgtgtgt

SEQ ID NO: 30174 - DNA, 201 bp, Homo sapiens
cctgacgtcccccacattcgaggcctgccatcgtgccgtcagcccgctgccctacctgcggaactgccgctacgacgtgtgctcctgctcggacggccgckagtgcctgtgcggcgccctggccagctatgccgcggcctgcgcggggagaggcgtgcgcgtcgcgtggcgcgagccaggccgctgtggtgcgtgccctcc

SEQ ID NO: 30175 - DNA, 201 bp, Homo sapiens
aacctgaatcatccccttcaggagccccagttcctgcggtaggtgaagctccaagggcagccagccccacgtcccctggctgcctggagctgcctcacacrggctcagccctgggctgccccttggacttcctgatgctggtctctccttgggctgcccagagcaagcccttgacatacttaaaacagcactcgcttgagt

SEQ ID NO: 30176 - DNA, 201 bp, Homo sapiens; identical to SEQ ID NO: 5859

SEQ ID NO: 30177 - DNA, 201 bp, Homo sapiens
ccacattcgaggcctgccatcgtgccgtcagcccgctgccctacctgcggaactgccgctacgacgtgtgctcctgctcggacggccgcgagtgcctgtgsggcgccctggccagctatgccgcggcctgcgcggggagaggcgtgcgcgtcgcgtggcgcgagccaggccgctgtggtgcgtgccctccctgcccgcagc

SEQ ID NO: 30178 - DNA, 201 bp, Homo sapiens
ctgcatggagggaatgagggaaataaaatgcaaggctggtctggagttctccctgcattagtgattagtgcaatcctagaacactccgatgccctgttacrcagctttgtgttgcaaaaaggggatttggacagtcaaaaaagcctgagtgtaggctctgctccatttccacagtggaaaccaggggttctcagtcggggt

SEQ ID NO: 30179 - DNA, 201 bp, Homo sapiens
gaaaacccgtgttctcctctgctctccctcttcactgagtgttccgagggcagttgtgctgtcttagcctccaattcctcatcttttgaaatggaatctcrctcgtgttgtccaggctggaaggctggattgcagtggtgcgatctcggctcactgcaacctccccctcccaggttcaagcgattctcctgcctcagcctc

SEQ ID NO: 30180 - DNA, 201 bp, Homo sapiens
tgaaggcagagttcctgaaggtgttttcgaggtgaatggtttgacggaggagggcctgagggcaaatcccgaaacccaggcccttcacctgctattctacytgcatttgggtactgagagtgagcggaggtgctcagtacctttgggagaggatgacgctgtggtatccaggtgttcctgtgggaaacactaagttttgga

SEQ ID NO: 30181 - DNA, 201 bp, Homo sapiens
ccacctgagacctaagtggtcccgggacccacaacagtggcctgcattcatggctggcctacgtggtgctggcattgtggcatcttcacgtggccccaacrggccgtctgggactggtcatttccacaggtcattctcactctgggacactcttctctgaccaggtgagctgatttgcctaagtccccaccgccagtaagt

SEQ ID NO: 30182 - DNA, 201 bp, Homo sapiens
aggacaaaaaaccaaacaccgcatgttctcactcatagatgggaattgaacaatgagaacacatggacacaggaaggggaacatcacactctggggactgktgtggggtggggggagtggggagggatagcattaggagatatacgtaatgctaaatgacgagttaatgggtgcagcacaccagcatggcacatgtataca

SEQ ID NO: 30183 - DNA, 201 bp, Homo sapiens
ttaatgggtgcagcacaccagcatggcacatgtatacatacgtaactaacctgcacattgtgcacatgtaccctaaaacttaaagtataataaaaaaaaarttcctgcctgctaattgcaatactggggccatttctgtgtctgtttatattaagtgataattctcttggtatagatcaaatttttctatttctttgcatg

SEQ ID NO: 30184 - DNA, 201 bp, Homo sapiens
ctgaaaaaaagaaaaagttactttgcagggcacggtggctcacgcctgtaatcctagcactttgggaggcccaggcaggcagatcatgaggtcaggagatygagaccatcctggctatggtgaaaccccatctgtactaaaaatacaacaaattagctgggcatggtggcgggcacctgtagtcccagctactcgggaggc

SEQ ID NO: 30185 - DNA, 201 bp, Homo sapiens
catactgagtgggaggtaaagacaggattctcaagtggagaacctgatcctgaggtcgggttgaggagggagactgggaggtttgtctcctggagacaaargggagggagaatgcaagagaagccttgtttgcctcccggggcacctttctgaggctccagctgtaccctagctactcgctttgtctcctgggtgcattaa

SEQ ID NO: 30186 - DNA, 201 bp, Homo sapiens
catttattcaacaaatactgagttcctgtatgtgtcaaacatggtcctaggcgctgtggatacagcaggggaaaaaagtttttttgtttaggggtgtgtgkgtgtgtgtgtgtgtgtgtgtgtgtgtatgtgtcttccatgtatttgtttttttattgctgctataacaaatcaccaaaaacttgatagcttaaaacaaca

SEQ ID NO: 30187 - DNA, 201 bp, Homo sapiens
cctcagatttcctgttttccactggtctctgaatttggtgtttattaggtgaacacaagccttattttctttggccattcatgtcttcacattctctcgcktcctccattatcttgtagaactctttccgcctcctctgaaacagcatgcagttcacctgtgattcctcttcctcccagaaaatcacctgtcctgcttgag

SEQ ID NO: 30188 - DNA, 201 bp, Homo sapiens
tagttattttgttgctcttcttgacaagagtgtacttggtgtagggcctcacaatttggagttgattgatcttttttttttctttcttgagatggagtctygctctgttgccaggctggagtgcaatgtcacgatctcggctcactgcaacctccgcctcctgggttcaagcgatttccctgtctcagcctcccgagtagc

SEQ ID NO: 30189 - DNA, 201 bp, Homo sapiens
ccaccacacccagctaatttttgtagttttagtagagatgggatttcatcatgttggccaggatggtctcgatctcttgacctcgtgatccgcccacctcrgcctcccaaagtgctgggattacaggtgtgagccaccgtgcctggcctggaggtggttgatctttaagattttctctacccttgggcgtctgtaagactg

SEQ ID NO: 30190 - DNA, 201 bp, Homo sapiens
tatattgtaaaagtatagcaccttttcttctccaggccaaatatttccagttttttctgtagtttttttgttttattattatttttagttgacatttaacygtatgtatttactggtgacagtgtgatatttcagtacatgtatacagtgtgtagtgatcaaatcagggtagttactatatctgttccctcaaacatttac

SEQ ID NO: 30191 - DNA, 201 bp, Homo sapiens
gccttccctccttcttctccttgcctcttccattcacttaattggcagttttggtctggaatggacttttcttggagactgggaagaattttgttacattwgtttgcttggtagcatagttgtgattcatagagtacagttgtcaggggagagcctggcccagagaaggtcagtagatctcaaggaaggacccttggaatg

SEQ ID NO: 30192 - DNA, 201 bp, Homo sapiens
cttgccaaaggtcataactgctgggtggcagggccaggttcagaacccaggtgacttgacacctgcataagaactcccaggccaccccatcagagccacascatccctgttgcttacactcctcccgtgctgacatggggaccagtgactgctgcacccttaagttcccaccacttctgttactgcctgagcttaacctta

SEQ ID NO: 30193 - DNA, 201 bp, Homo sapiens
ctttgtgttgggaacattcaaagtctgctcttccagctacttgaaaatatacaataaactgttgataattatagtcaccctgtggtgctaccgaacactaraacttatccctcctctttgtgtagttttcacttgtttctcactcattcgtaactactttttcagaacttgttgcatgttgcactccatgatgggtgaaca

SEQ ID NO: 30194 - DNA, 201 bp, Homo sapiens
aatggacccctcctcctgcctctggcagcccctcctgttttgcggtcccttgtgcacttactacctgcctcttctcccttttgttctgcttaacctagggsaaggtgaggacagctggtctccacctagtatggagacaggtgtgggagatccgccgtccaggggctcgcccccactcccgccccagggctaactcttggg

SEQ ID NO: 30195 - DNA, 201 bp, Homo sapiens
gtggatcagaacatcagcttatgctgaggacttcctgtattcctgcagaagggctggtactgtccctgccatgtccctgcatccccacaacagccctgggrtgtagctgtagtcatcccagttttaccaatggagaaccaaggctcatgaaggttgcatgatccttccaaggcctgacagacaataaaaggtggagctgag

SEQ ID NO: 30196 - DNA, 201 bp, Homo sapiens
ctagtatggagacaggtgtgggagatccgccgtccaggggctcgcccccactcccgccccagggctaactcttgggcagtggatgaccctttggggcggcrggaagaaggttttgctggcaggattggaaactaatcagccagacagttcatgagataatccggctgaatttttacactcgaagcaggttgtggggcgttg

SEQ ID NO: 30197 - DNA, 201 bp, Homo sapiens
gcaaggttaagtgcagttgtctctctcttttttttttttttttgagacagagtctcgctctgtcacccaggctggagtgcaatggcatgatcttggcttartgcagcctctgcctcctgggctcaagcgattctcctgcctcaacctcccgagtacctgggattacaggcacctgccaccacgcccagctaatttttgtat

SEQ ID NO: 30198 - DNA, 201 bp, Homo sapiens
gctaactcttgggcagtggatgaccctttggggcggcgggaagaaggttttgctggcaggattggaaactaatcagccagacagttcatgagataatccgrctgaatttttacactcgaagcaggttgtggggcgttgccccggctctgggggagcagggagcgtttactgtctcgcccctcagccccacggacccgagtg

SEQ ID NO: 30199 - DNA, 201 bp, Homo sapiens
tgaaggttgcatgatccttccaaggcctgacagacaataaaaggtggagctgaggccgggcacggtggctcatgcctgtaatcccagtactttgggaggcyaaggtgggtggatcacctgaggtcaagagtttgagaccagcctggccaacatggtgaaaccccatctctactaaaaatacaaaaattagccgggtgtggt

SEQ ID NO: 30200 - DNA, 201 bp, Homo sapiens
cgaggggcgggcgcgccgggacggagctgagccgcgatggaattagccccgcggcggcataagcctgcccagaagcgcgcggccgcgggccggcggggtcygcgtccacatcatggcgactcccgggccgcgcggtgagttttccggctggacctggtcctggtctcctacaggtggtaggagggagggagtgaaggaggc

SEQ ID NO: 30201 - DNA, 201 bp, Homo sapiens
gggtatgagtgtgagtggcgctataacagctgtgcacctgcctgtcaagtcacgtgtcagcaccctgagccactggcctgccctgtgcagtgtgtggaggkctgccatgcccactgccctccaggtgaggcctctatccctgggggtcaggctggtgggatgggatagggatggatggaaaggtgcttctaggtcttgctt

SEQ ID NO: 30202 - DNA, 201 bp, Homo sapiens
gtcacgtgtcagcaccctgagccactggcctgccctgtgcagtgtgtggagggctgccatgcccactgccctccaggtgaggcctctatccctgggggtcrggctggtgggatgggatagggatggatggaaaggtgcttctaggtcttgcttcatctcagcctccacctgccacgtcctatctctgacctgcaaggctgc

SEQ ID NO: 30203 - DNA, 201 bp, Homo sapiens
ttatgtatatagttcagtggtatcaggtacattcatgtagttgtacaaccatcaccaccatccatctccagaactcttttcatcttgcagaactgaaactytatattcattacacaataacttcccattcttccctctgggctcctggaaaccatcattttactttctgtctatgattttgactactctaagtatctcata

SEQ ID NO: 30204 - DNA, 201 bp, Homo sapiens
ggcccacattgcccttgtactcacgaaggcaccccccgccccccttggtggtgccacgtggtcagcacgccctgcagatcctattggatgtcaggttgtargcctggtggccattgtccctgctggcacctgtgtgctcaccttcctggttgtctttgcagactgcagccagcccctggacgtgatccttctcctggatgg

SEQ ID NO: 30205 - DNA, 201 bp, Homo sapiens
tgcaaaagatgcgatttcattcttatggccaaatagtcttccattgtgtatatgtaccacattttcttcatctaatcatctgttgatgggcatttaggttsataccatgtctttgctattgtgaataatgcacaataaatatactagtgcaggtatatttttgatatattgatttcttttcctttgggtagatatccagta

SEQ ID NO: 30206 - DNA, 201 bp, Homo sapiens
ccgaggcgggcggatcatgaggtcaggagatcgagaccatcttggctaacacagtgaaaccctgtctctactaaaaatacaaaaaattagccgggcgtggwggcgggcacctgtagtaccagctacttgggaggctgaggcaggagaatggtgtgaacccgggaggcagagcttgcagtgagccgagatcgcgccactgta

SEQ ID NO: 30207 - DNA, 201 bp, Homo sapiens
tttcattatgtgtttctgtggattgggctatagagacagtatataataggtcttaataaatattggatgggtggatgaatggaaattggtggtgtaatttwtctagggattgtgacctccacaataatccagactcctttacttgtagaaatctgatttatctaagtaagtacataagtagagaaacccagccctctccta

SEQ ID NO: 30208 - DNA, 201 bp, Homo sapiens
gctgcagtgagttgagattgcatcactacactccagcctgggtgaaaatgtgagaccctgtctcaaaagaaaaaaaaaaacccgcaaaaagggaagggagwccctgctgggccagttctgtttaactcttaggaaagaaagtctaatggtggttagcgagggagagggtataaggaggggtgttcaacctcccatcctatc

SEQ ID NO: 30209 - DNA, 201 bp, Homo sapiens
ttattgtttaatttaatacaagtttgattcaggtaaaaacagacctagagcctggtgtggtggcccacacctgcattcccagctactggggaggctgatgkgggaggattgcttgagcccaggtgttctgggctgcagagcactatgcatcaatatgggggcctcctggggagtgggggacaactgggttgcctgaggagg

SEQ ID NO: 30210 - DNA, 201 bp, Homo sapiens
gcatgagcactataagtactaaagcacagatgctgtgagagcctggagtatgcagtgacttggggactgggcttaggttccatgtcatattcttaccttcrttctgcaaaaatattttgagcattcgtaatccactgtataagaatttagagataagagacacagcccatacccttaagtaaggagctcacagttgaatgg

SEQ ID NO: 30211 - DNA, 201 bp, Homo sapiens; identical to SEQ ID NO: 5782

SEQ ID NO: 30212 - DNA, 201 bp, Homo sapiens
gccgggttcaagcaattgtcctgcctcagcctcctgaataactgggactacaggcgcccgccaccatgcctggctaattttttgtatttttaatagagacrgggtttcaccatatcggccaggctggtctcaatctcctgacgtcgtgatctgccctcctcggcctcccaaaatgctgagattacaggcgtgagccaccgc

SEQ ID NO: 30213 - DNA, 201 bp, Homo sapiens; identical to SEQ ID NO: 5783

SEQ ID NO: 30214 - DNA, 201 bp, Homo sapiens
cctctggactcatcccctgccacctgccataacaacatcatgaagcagacgatggtggattcctcctgtagaatccttaccagtgacgtcttccaggactkcaacaagctggtgaggaccttgagggtagtgggaagcagacggtcccaaggcttggcctggtggtatggacacagagtgtgaccttctaacgtggacact

SEQ ID NO: 30215 - DNA, 201 bp, Homo sapiens; identical to SEQ ID NO: 5786

SEQ ID NO: 30216 - DNA, 201 bp, Homo sapiens
actggatttggaatcagagtctaggccctattgtcctgcatacctgccccatagcactgcagtgaggcagctgcagggcctgatgtatttccccattctcyttgctgaattgaggcaaagaaagacagtgaccagcacatatgtgtgtttgtgtttttgtaaaagcacccacatgctcatgaggctaagagtgggttgtga

SEQ ID NO: 30217 - DNA, 201 bp, Homo sapiens; identical to SEQ ID NO: 5787

SEQ ID NO: 30218 - DNA, 201 bp, Homo sapiens
cacatgggtctgcagtcctggaggctttgcctgttgtggccacagccttgtctcctgtctacacagcccagagctgcgaggagaggaatctccgggagaaygggtatgagtgtgagtggcgctataacagctgtgcacctgcctgtcaagtcacgtgtcagcaccctgagccactggcctgccctgtgcagtgtgtggagg

SEQ ID NO: 30219 - DNA, 201 bp, Homo sapiens
acacggtcacttgatttcacctgtgggctggcaggccgtgccactttccgggacactggcaaaaaggtgatgttaccagcagagcctggaaatttggcatrgtagtgtaggaatttgtgtgtggggggccactgctctactacagacttgtggtgtgtgcttggggctgggcacagagcctggccagtacctggcacatga

SEQ ID NO: 30220 - DNA, 201 bp, Homo sapiens; identical to SEQ ID NO: 5791

SEQ ID NO: 30221 - DNA, 201 bp, Homo sapiens
tcctttttcgggggaagatcttttcttattgtgtgtgcttctataaattcaaaggtaatggaagcctattgttaacatttaaacaatgccaataaggagtaaaaaaaaaaaaaaaatgcaagtcttactttatcacacagcctcttccccacccaattccaccctctgccttcaaggtaacctctgttaaaggtggtgatg

SEQ ID NO: 30222 - DNA, 201 bp, Homo sapiens
tgtgtatgatgcacaaaataggtgaccatttaacgtttgttgagtgaatgaatgtgacatgtttatgaaatctatgattttagggtaaaggacactaaaarggaaaggatatatatttggataatataacgaacttacaagagctgaaaagctgctaatagaaaatccgttccaacctgaagcacattgcaaattcctaga

SEQ ID NO: 30223 - DNA, 201 bp, Homo sapiens
tgaccatttaacgtttgttgagtgaatgaatgtgacatgtttatgaaatctatgattttagggtaaaggacactaaaagggaaaggatatatatttggatratataacgaacttacaagagctgaaaagctgctaatagaaaatccgttccaacctgaagcacattgcaaattcctagaactttctggagagctgaattga

SEQ ID NO: 30224 - DNA, 201 bp, Homo sapiens
ctattccttgcaaaaaactgggagttctttgaaggcaagggaagatcttgcttatttttgtatcatctgtgtatgatgcacaaaataggtgaccatttaaygtttgttgagtgaatgaatgtgacatgtttatgaaatctatgattttagggtaaaggacactaaaagggaaaggatatatatttggataatataacgaac

SEQ ID NO: 30225 - DNA, 201 bp, Homo sapiens
gttgattttaggttagaaacttaaaaaatatgcttttggccaggtgcagtggctcacgtctgtaatcccagcactttgggaggccgaggcgggcggatcaygaggtcaggagatcgagaccatcttggctaacacagtgaaaccctgtctctactaaaaatacaaaaaattagccgggcgtggtggcgggcacctgtagta

SEQ ID NO: 30226 - DNA, 201 bp, Homo sapiens
ttgggaggccgaggcgggcggatcatgaggtcaggagatcgagaccatcttggctaacacagtgaaaccctgtctctactaaaaatacaaaaaattagccrggcgtggtggcgggcacctgtagtaccagctacttgggaggctgaggcaggagaatggtgtgaacccgggaggcagagcttgcagtgagccgagatcgcg

SEQ ID NO: 30227 - DNA, 201 bp, Homo sapiens
tccagggctcatttgctcctctcagtgtgtcttaacgtgcacccgtcatttccggagccaagcacctgattcgatcctttccagcaactgcttctgctgtstgagttgcctctatgtgggtaccagagccactctgctggttgactgtagagactgtgtgaggggtaagggtgggatccaaacacacacctcaagttctag

SEQ ID NO: 30228 - DNA, 201 bp, Homo sapiens
ctgcttctgctgtctgagttgcctctatgtgggtaccagagccactctgctggttgactgtagagactgtgtgaggggtaagggtgggatccaaacacacrcctcaagttctagtccagtttccaggtgtgccatctcttcatcttccattgtggggcaaggctgcagggtgagaggcatttgggcctactggggagtgtg

SEQ ID NO: 30229 - DNA, 201 bp, Homo sapiens
aagcccacttctgaacttagcctttgccctccagagtctccatgccctatgcctccaaagggctgtatctagaaactgaggctgggtactacaagctgtcyggtgaggcctatggctttgtggccaggatcgatggcagcggcaactttcaagtcctgctgtcagacagatacttcaacaagacctgcgggctgtgtggca

SEQ ID NO: 30230 - DNA, 201 bp, Homo sapiens
tcctggggaccaggcagagggatgtgtacatccctgaggcacctcatccttaatcctgccttcatacacatctcaaaggcaggcccacacctgggtccagkactgcacagtctagcctggcccctggctgggcctgtcagggcacatgcgagcatgaagtgccagacagtgagggcctgtggagcttgtccttgacaagct

SEQ ID NO: 30231 - DNA, 201 bp, Homo sapiens
tttttctatagtggttgtactagtttacattctcagcagcagtgttaaagtgttcccttttcatcacatccatgccgacatctagtaaaatttttgacttyttagttatagccattcttgcagcagtaaggtgggttatctcattgtggttttaatttgcatttccctgatgattagtgatgctgaacattttttcatatg

SEQ ID NO: 30232 - DNA, 201 bp, Homo sapiens
tgttcatagtagtctcttactaacctttttatttctgcgctatcaattgtaatgtaagctcttctatttctgattttatttatttgagtcttctctttttstcttggttaatctagctaaagctttgttaattttgttgacctttaaaaaaccaattctaagttttattgatattttgtattctatatttcatttattttt

SEQ ID NO: 30233 - DNA, 201 bp, Homo sapiens
tactaaccagtgtcctgggaacagctgaaaaaactgggtaccaggttcttcgtgttgggctgaggccacaaacacgtgagacctcccagaggcacaagctsctcccagctcagaactcccggtttcaggttgtttacctgagaagagaagactgctttgtcctcagccaatcagatagtgtttgcccacaaccgaggtttt

SEQ ID NO: 30234 - DNA, 201 bp, Homo sapiens
ggaagctgaaggctcatgccctccctaccttggtgaccccagattttatttaaagtggattttcccattttataaatcacggcagagctgatacagaccaytacctgtgatggctctggggttgtcagtgggaatggagggttagaagtgaccggaagaggccgggtgcacgggtgcaatggctcatgcttgcagtcccag

SEQ ID NO: 30235 - DNA, 201 bp, Homo sapiens
aaggggtctatgagaacttcgcgcaggcaggaacacacgcggaagggtctgagggcgtgggaacaggcggaaagtagacacctactcaaggagagcttggytgggtttggattatgatggggccgtaactacctgctaagagaagctgaggccacagacttggaacagcctctcagcgggcagctgtgcctttcctgggga

SEQ ID NO: 30236 - DNA, 201 bp, Homo sapiens
tggccttgcttccatgtccatagtgagaggaggcctgcacctctgtacaagcctttgaggggattttccatgaagcctgatggccatctgactcctcaccygtaggctcctgaatgaggctcagtcaaggtgtaggaactgtattctgagaagccaaaggaagtccattagatattatttactctgtgatactcctcagga

SEQ ID NO: 30237 - DNA, 201 bp, Homo sapiens
tataaatcacggcagagctgatacagaccactacctgtgatggctctggggttgtcagtgggaatggagggttagaagtgaccggaagaggccgggtgcaygggtgcaatggctcatgcttgcagtcccagcactttgggaggccgaggggggcggatcacctgaggttgggagatcgagaccagcctggccaacatggtg

SEQ ID NO: 30238 - DNA, 201 bp, Homo sapiens
agtgtgggcatcttttccaggcctgcctgcttggctttgatggtgaagtgggtggaggcctagcaagcggcagggccctagcaccaggcattggggctagracactgatttccttaggaccaacgtccctgtgctgccggactggatttcgagaacggtgagcagatggggtcaggtttctattcctgtgggctttctgtg

SEQ ID NO: 30239 - DNA, 201 bp, Homo sapiens
tatatatccagtgacattatcatgaatgaggtcaggagattgagaccagcctggctaacacacggtgaaaccccgtctctactaaaaatacaaaaaattasccgggcgtggtggcgggcgcctgtagttccagttactcgggaggctgaggcaggagaatggcgtgaacccgggaggtggagcttgtagtgagccgagatc

SEQ ID NO: 30240 - DNA, 201 bp, Homo sapiens
cacattcttgagcttcctggaagaagccctaagcccagacttgtgcctcccctactggatgacctggaacaaaattcttttgctcatgtcttcatctgtaktaatggagatgaggaatttcccttccttatattgcattatgtgaaagataaacaccacagaacaagttctttgagcttcctggaagaaacccaaccattg

SEQ ID NO: 30241 - DNA, 201 bp, Homo sapiens
acctcatccttaatcctgccttcatacacatctcaaaggcaggcccacacctgggtccaggactgcacagtctagcctggcccctggctgggcctgtcagrgcacatgcgagcatgaagtgccagacagtgagggcctgtggagcttgtccttgacaagctagaatctctctgtgccttttggggaccccttggctgtgtg

SEQ ID NO: 30242 - DNA, 201 bp, Homo sapiens
tccagtgacattatcatgaatgaggtcaggagattgagaccagcctggctaacacacggtgaaaccccgtctctactaaaaatacaaaaaattagccgggygtggtggcgggcgcctgtagttccagttactcgggaggctgaggcaggagaatggcgtgaacccgggaggtggagcttgtagtgagccgagatcttgcca

SEQ ID NO: 30243 - DNA, 201 bp, Homo sapiens
ttgctttgatccttagagaaaggaactcacacatgcaccgtagagtgactgggtgggaaaagtcttcctccttcaccaaatggcaatggtgtctctctctmtatatatttctttttctgtagagtagatagcaaagatgagagcaggtggaggaaatatatagggcaggttgggaagggatccagatgcccttttcagctt

SEQ ID NO: 30244 - DNA, 201 bp, Homo sapiens
ctggggcgtgggggagatggtgtgggaattagggtggggacaagctgagggctttgggttgcagggtgatgaaggggagtcctagtccccacccacagatrtgtcagcctgggctgggaagctggcgctgccgaggtcagcactgcctgggtggtggtgagatcatgggcagatggcctcctggttccccattggccctgg

SEQ ID NO: 30245 - DNA, 201 bp, Homo sapiens
aaatacaaaaattagccaggcgttgtggtgggtgcctgtatcccagctgctcgggaggttgaggcacaagaatcacttgaacttgggaggtggaggttgckgtgagccgagattgcgccattgcactccagcctgggcacagagtgagactctgtctcaaaaaaaaaaaaaaaaaaaaaaaaaaaaaagtgaccagaggaa

SEQ ID NO: 30246 - DNA, 201 bp, Homo sapiens
gcatgagggaggtctcttccagacttcagttagctcctcattcatccagaaacccagcccatcccctctctccctagatgctggcggaaggcatcctgccytgacaataatgcctcctcagggctggctcagctccccacccagtggacgcatcctgcttgggtctagcctgttgcccccataactaaccctctgatgttt

SEQ ID NO: 30247 - DNA, 201 bp, Homo sapiens
acagagcagttcagctgtcccccatgtgctgccaggttctctcttagactctgatgctcatcaagccattttcttaaacacagaggattccgtctttggcrgttttagtccagatgctaggagaatcacagttctttcagtctggtcagaaggataaggtgggtggtgccaagtcctggcagccttgggagctggtgctgg

SEQ ID NO: 30248 - DNA, 201 bp, Homo sapiens
tacatatttatttgccttgtagtttattttattctcatgaccgttggggctggctccttgacttgaccatatatatatatatatatatatatatatatttwtttttttttttttttttttgacggagtctcggagtctcggctcactgcaagctctgcctcccgagttcacgccagtctcctgcctcagcctcccgagtag

SEQ ID NO: 30249 - DNA, 201 bp, Homo sapiens
tctactgctgcattcaatcttttgcaatattgcatgtcatgtggcctctggaaaattccactctatacttgtaagagaatgaggagggaaaaggcaaatarcgtcttcatagtattatgaaagtagttttggtctcgcagaccccttgaaagtctcagggacccctatgggtctcaagaccacactttgagaaccactgcg

SEQ ID NO: 30250 - DNA, 201 bp, Homo sapiens
tcatgaccgttggggctggctccttgacttgaccatatatatatatatatatatatatatatatttttttttttttttttttttttgacggagtctcggartctcggctcactgcaagctctgcctcccgagttcacgccagtctcctgcctcagcctcccgagtagctgggactacaggtgcccgccaccatgcctggct

SEQ ID NO: 30251 - DNA, 201 bp, Homo sapiens
ctactgctgcattcaatcttttgcaatattgcatgtcatgtggcctctggaaaattccactctatacttgtaagagaatgaggagggaaaaggcaaatagygtcttcatagtattatgaaagtagttttggtctcgcagaccccttgaaagtctcagggacccctatgggtctcaagaccacactttgagaaccactgcgc

SEQ ID NO: 30252 - DNA, 201 bp, Homo sapiens
gttcgtgtagaaatcataaatatttcattgtgtgaaaacaacttgtaagctagattttctcacttcgcaagaattcctgaatttgaacaataattgcagaraaatcttagtcatatatcaagtgagtaactcatagccaaaaattaaaaaatcaaaatgataaaaaatccttccaaaaattttacagcaaaattatattca

SEQ ID NO: 30253 - DNA, 201 bp, Homo sapiens
ccctgcagggcccagctctgccttaggcatagcagtgtggaaaagatccttgcacaggcttcatttagtcagaactgtcactgaccagaggtttatttcamatagtgagtgtcgctaagtgacactaagagagtctctaagtgtcgcccccactctcctaaccctggccgagctgacctccgagacaagccaaggggatgg

SEQ ID NO: 30254 - DNA, 201 bp, Homo sapiens
cccagcctgtcttaaaggcattgcccttccctgttgagtcacatagactcaaggttccttttaatctccaggcttttaggttcttggtgcatggccacccrtacagtattacaacagcctgttttctggtcaagctctgtaaagtcaagctctgttttctagtcaagctcttctttatcttagaagagctgccgacaaata

SEQ ID NO: 30255 - DNA, 201 bp, Homo sapiens
tccaacctttccattcttgcagagaaaaatcaatgtctaataggattaaagaggccctcccttcccagctaccttcaaacaccaagttcagggtggttgtrggagcgggaggctgcagggtctctccagaggctccccactccattgttcaggctcacggccaaggcttacttttataacatctgtgaaatgccctgccag

SEQ ID NO: 30256 - DNA, 201 bp, Homo sapiens
ctttgcaattgtgaattgagctgctataaacatacatgtgcatgtgtcttttttatataatgacttcattttctttaggtagatgcccagtagtgggattrctggatctaatggtgttctacttttagttctttaaagactctccatactgtttttctatagtggttgtactagtttacattctcagcagcagtgttaaag

SEQ ID NO: 30257 - DNA, 201 bp, Homo sapiens
attcctagaactttctggagagctgaattgaggaatttcaggatggagattttttctccttcagtatcaagaatccaaagaaagattttcactgggaaagraagcagttgtggtcttgaagcagatatgatccagagcaagtcatttaaccgtccaaagcctcggtttctcatgtgtaaatgagcatgcacattctctggg

SEQ ID NO: 30258 - DNA, 201 bp, Homo sapiens
aggatggagattttttctccttcagtatcaagaatccaaagaaagattttcactgggaaagaaagcagttgtggtcttgaagcagatatgatccagagcamgtcatttaaccgtccaaagcctcggtttctcatgtgtaaatgagcatgcacattctctgggctcagccctgtgatattttctcttctcttcttacatata

SEQ ID NO: 30259 - DNA, 201 bp, Homo sapiens
ggtgtgaacccgggaggcagagcttgcagtgagccgagatcgcgccactgtactccagcctgggcaacagagtgagactccatctcaaaaaaaaaaaaaawatacacacacacacacacacacgctttttttgtggcgggggcctgggtttgtatattttcccgttactagatgtaagtcaaaacctgcataaagctactg

SEQ ID NO: 30260 - DNA, 201 bp, Homo sapiens
aggtgtgtgcacaggcagctccactcggcacatcgtgacctttgatgggcagaatttcaagctgactggcagctgttcttatgtcctatttcaaaacaagkagcaggacctggaggtgattctccataatggtgcctgcagccctggagcaaggcagggctgcatgaaatccatcgaggtgaagcacagtgccctctccgt

SEQ ID NO: 30261 - DNA, 201 bp, Homo sapiens
tgtgaacccgggaggcagagcttgcagtgagccgagatcgcgccactgtactccagcctgggcaacagagtgagactccatctcaaaaaaaaaaaaaatayacacacacacacacacacacgctttttttgtggcgggggcctgggtttgtatattttcccgttactagatgtaagtcaaaacctgcataaagctactgtc

SEQ ID NO: 30262 - DNA, 201 bp, Homo sapiens
atctagttatctatcctatatctatgtatgtatctatctgtctgtctaatctatctaacctgtgtatctatttataatctatcctatctctatctaacctrtgtatctatcatctatcctatctctgtctaacatatgtatctatcatctattctatatctatctgtctatctaccctatgttttatcatctatcctatct

SEQ ID NO: 30263 - DNA, 201 bp, Homo sapiens
ggcctggtaattctttaggcttgaagggacagttctaatggaactttccagaatgcctaatatgaagaccatggcgtggtccaagagctcggaaaaccagrtcaccaaatgattcctcccatcctgtccctgccctggaaaatctgcttaggaaaaattattgagcaatctctgccatttgctttctcctctgtttggccc

SEQ ID NO: 30264 - DNA, 201 bp, Homo sapiens
aaaatacaacaaattagctgggcatggtggcgggcacctgtagtcccagctactcgggaggctgaggcaggagaatggcgtgaacccgggaggcggagctkgcagtgagccgagatcgcgccactgcactccagcctgggcgacagagcgagactctgtctcaaaaaaaaaaaaaaaaaagtttctctacgcaatcacttt

SEQ ID NO: 30265 - DNA, 201 bp, Homo sapiens
ggaagaattgcttttctgaggtcaatgctcagcttggctgttggcaagtcaacctttaggaatctgtgtattcagggtatagcagtggaagtatagcagtragagagacgcttccagaaaactctccaaccacacctatagcaacagtacatcaccaaggcggcctggattaagaggaggaaatatttaaagtccatctca

SEQ ID NO: 30266 - DNA, 201 bp, Homo sapiens
ctgaccccctgagaccttgttttttttctttaatggcattttgaatgttctgctgtatcttggagggtgtgtacacagattgaggcatcctaatttgttgyctcctccatagtacctagtacatcataggtgcacagtaaatgactagaatcttggctgataaaagcctggagacagctcactgcacactgctgggaggtg

SEQ ID NO: 30267 - DNA, 201 bp, Homo sapiens
gggtggtggcaggtggaaaagaacctggaccgtgccaagaaagaagagactgagttggaggctactggtgggggctagggacaggtgtggcaggcaatgayggggagcaaagagtatattacagataaataagccttgaagatggggaggtcaggaagggcaggatccttcacgtgcagacatcatctctagctgtccctc

SEQ ID NO: 30268 - DNA, 201 bp, Homo sapiens
taactctggtgccctgcaggtcggctcccagtgggcctccccggagaacccctgcctcatcaatgagtgtgtccgagtgaaggaggaggtctttatacaayaaaggaacgtctcctgcccccagctggaggtccctgtctgcccctcgggctttcagctgagctgtaagacctcagcgtgctgcccaagctgtcgctgtgg

SEQ ID NO: 30269 - DNA, 201 bp, Homo sapiens
aaggctgggtgcggtggctcatgcctgtaatcccagcacttttggaagccgagatgggcggatcacttgagttcaggagtttgagaccagcctggccaacmtggtgaaatcccgtctccactaaaaatacaaaaattagctgggggtggtggtgcacacctataatcccagctacttgggaaactgaggcaggagaatcac

SEQ ID NO: 30270 - DNA, 201 bp, Homo sapiens
cttagacattcccagattctcctctaacaggtgagatgtggttgtgcaaaactggaatgtccatcagtttggttttcgatcagcgaggtatgagagtgcawgcatctccacggccttgctgagtgtgttgttacagtttttatttattttttttgcaaatttcttacttttcaggaaagaaatagtatctcagtgtacttg

SEQ ID NO: 30271 - DNA, 201 bp, Homo sapiens
agacattcccagattctcctctaacaggtgagatgtggttgtgcaaaactggaatgtccatcagtttggttttcgatcagcgaggtatgagagtgcatgcwtctccacggccttgctgagtgtgttgttacagtttttatttattttttttgcaaatttcttacttttcaggaaagaaatagtatctcagtgtacttgaaa

SEQ ID NO: 30272 - DNA, 201 bp, Homo sapiens
tagagacggggtttcaccgtgttagccaggatggtctcgatctcctgacctcgtgatccacccgcctcagcctcccaaagtgctgggattacaggcgtgasccaccgcactcgaccgataccattttaaatagcactgctaggccagagcggggtggctcatgcctgtaattacttgcaccaaggagctcaagaccagcct

SEQ ID NO: 30273 - DNA, 201 bp, Homo sapiens
tgagagtgcatgcatctccacggccttgctgagtgtgttgttacagtttttatttattttttttgcaaatttcttacttttcaggaaagaaatagtatctsagtgtacttgaaattcatttctctaatgatgagtgaggttaaacattttatcatatgtttaattgccattttttggtctaattttgtgaattttctgctc

SEQ ID NO: 30274 - DNA, 201 bp, Homo sapiens
cagagtctccatgccctatgcctccaaagggctgtatctagaaactgaggctgggtactacaagctgtccggtgaggcctatggctttgtggccaggatcdatggcagcggcaactttcaagtcctgctgtcagacagatacttcaacaagacctgcgggctgtgtggcaactttaacatctttgctgaagatgactttat

SEQ ID NO: 30275 - DNA, 201 bp, Homo sapiens
ggcctggcccctggccccgactgtagatttatacaggcttgctctggagacccttggtacaattcaagctgattgaatttccctctcctcaaaacgggtcrtttctttcctcttttttgctgtcccctttcccaaataccaactggctccagtttacccttcaggacccagtccttccattgagatattcttgcacttttt

SEQ ID NO: 30276 - DNA, 201 bp, Homo sapiens
cctcagaggggacaagtgaccagagcttggcatctaccacctccatttcagttatagcaattgtgcttaaaggattgtgctgctagatacattcataattwatttttcagtgcatatgttttcaggttgggtggctagtagacctacttagtttcattcttatttgggaaaccaatgaaaacagggtggagaagagagcca

SEQ ID NO: 30277 - DNA, 201 bp, Homo sapiens
gcagaaatagtacctgctgggtcactgaaaaggtaagagagggataatatgtatagagtttagcccagtggggctcaactgttaagagccatgatgatgawgaggaggaggaggaggacgagaaggaggaggaggaggaggaggaggagttgttgttagctggctccccatattctcccactgtcccgtgttttccgctgg

SEQ ID NO: 30278 - DNA, 201 bp, Homo sapiens
aagaaatagtatctcagtgtacttgaaattcatttctctaatgatgagtgaggttaaacattttatcatatgtttaattgccattttttggtctaattttrtgaattttctgctcatgcctttccccattttcccattagaaaagttgtgataagaaacacatgagatctaccctattaataaattttccagtgtacaata

SEQ ID NO: 30279 - DNA, 201 bp, Homo sapiens
ttgaaattcatttctctaatgatgagtgaggttaaacattttatcatatgtttaattgccattttttggtctaattttgtgaattttctgctcatgccttkccccattttcccattagaaaagttgtgataagaaacacatgagatctaccctattaataaattttccagtgtacaataccatattgttagctatttgcaa

SEQ ID NO: 30280 - DNA, 201 bp, Homo sapiens
atttctctaatgatgagtgaggttaaacattttatcatatgtttaattgccattttttggtctaattttgtgaattttctgctcatgcctttccccatttkcccattagaaaagttgtgataagaaacacatgagatctaccctattaataaattttccagtgtacaataccatattgttagctatttgcaagttgttgta

SEQ ID NO: 30281 - DNA, 201 bp, Homo sapiens
agtgtgtgtgaaggatgtgcacatgtgtctgcacaaacgtgggaagaaccagtgctcacctctagagtagggtggggactggagggtagccgggtttctttgtgtgtgtgtgtgtgtatgaagtgatgatgttatgggatatgtttcatatgtttttctgttcttttcagataaatactttatttttttgagatggagtct

SEQ ID NO: 30282 - DNA, 201 bp, Homo sapiens
gtgtgtgtgaaggatgtgcacatgtgtctgcacaaacgtgggaagaaccagtgctcacctctagagtagggtggggactggagggtagccgggtttctttgtgtgtgtgtgtgtgtatgaagtgatgatgttatgggatatgtttcatatgtttttctgttcttttcagataaatactttatttttttgagatggagtctc

SEQ ID NO: 30283 - DNA, 201 bp, Homo sapiens
ttcttgttgaattgatccctttaccattatgtaatggccttcttttgatctttgttggttcaaagactgttttatcagatactaggattgcaacccctgcttttttttttttgccttccatttgcttggtagaccttcctccctccctttattttgagcctatgtatgtctctgcacgtgagatgggtctcctgaatacag

SEQ ID NO: 30284 - DNA, 201 bp, Homo sapiens
tgaaaatcctggagaccagctaactgggcttgctcagcctctctgtgccccagattctttatctggctaataaggatgaaaatccctgtatttcgtatgayctggaattccagttaggatcaaataagatggaagatatatatatacatatacatatatgtatatgtgtgtgtgtgtgtgtatatatatatatacacacac

SEQ ID NO: 30285 - DNA, 201 bp, Homo sapiens
gcaacagaagtcacagacaagtggtccgtgtcttcacagggatgaatcttacaaacacggtgctcgatgggaaaagcaaaacacagcatgctatgtgataycatttatacaaactaaacatacatacaaagcaaccacagacgttttataaaaatatgcagtcagttaggagacttttacatagtccaggcaagaggtcat

SEQ ID NO: 30286 - DNA, 201 bp, Homo sapiens
attatagtcatttaagcagaatgatacagaaatccaggagggaaagggaaaagaatattttgtgtcataatgtctgccattgttaagagagattatgtacsttgattgtgctaaacacaatatattcattatcttagtgtttttcaaaggtgtattttgcagggtattaacagttacttgtggtcaagtgagtttaaagaa

SEQ ID NO: 30287 - DNA, 201 bp, Homo sapiens
tctatgagacccctattttgcccgtggagaccttaacccagtggatagctgtgagttggtggccttgattgtgatgacagtcacccttctttgatggcctmttgtttcctatggacatgctgatgaagacagctcttccttgagaaagcttcttggatgggtttgaaagagagaaagagaagggttgggtccgttgctctc

SEQ ID NO: 30288 - DNA, 201 bp, Homo sapiens
tgcagaactctttagtctttttaatatactactgtaccttgcagatatttaagagagtttttgtttctcaaacttatttgatcatggagcgtgtgtgtgcrtgcgtgtgtgtgtgtgtgtgtgtgtgtgtgtgtgtgtgtgtgagaatcccttgggactgggattccacagaatacattattgtatcctgtgtcactcata

SEQ ID NO: 30289 - DNA, 201 bp, Homo sapiens
tgcattctgaggacagcacttggatacctgtcacgtgacgaggtgactcgcacttcagccacaggggattctaacttgcaggttcatattgtaagagattyggttattttcacaactgcttccttacgatgccggcgagtgtgcaaattattgcggccagattcgagagagcagagaagtccgtgtaatttattaagggtg

SEQ ID NO: 30290 - DNA, 201 bp, Homo sapiens
cagcccagggattctgacttgggctgtcctaagataccattttatttatttatttatttttattttttattttttttgagacagagtcttgctctgtcacycaggctggagtgcagtggcgcgatctccgctcactgcaagctccgcctcctgggttcacgccgttcttctgcctcagcctcccaaagaactgggaccaca

SEQ ID NO: 30291 - DNA, 201 bp, Homo sapiens
agaactctttagtctttttaatatactactgtaccttgcagatatttaagagagtttttgtttctcaaacttatttgatcatggagcgtgtgtgtgcatgygtgtgtgtgtgtgtgtgtgtgtgtgtgtgtgtgtgtgtgagaatcccttgggactgggattccacagaatacattattgtatcctgtgtcactcataaat

SEQ ID NO: 30292 - DNA, 201 bp, Homo sapiens
gggctgtcctaagataccattttatttatttatttatttttattttttattttttttgagacagagtcttgctctgtcacccaggctggagtgcagtggcrcgatctccgctcactgcaagctccgcctcctgggttcacgccgttcttctgcctcagcctcccaaagaactgggaccacagacgccagccacctcgcctg

SEQ ID NO: 30293 - DNA, 201 bp, Homo sapiens
ctatgtgactccaaagatctggctctttccactatatgaaatggcccttttgctgcatcttttttgggctgatttgcttgggagtcactgagtcatcaaawttttttttttttttttttttttttttttttttttttttttagctctatgggagttattgagtgtattttgaaagcatatttaccagactcctccgtcttg

SEQ ID NO: 30294 - DNA, 201 bp, Homo sapiens
tcagactttaactcctgctggctctcataccggttctggcctggtgatagtcacgcctgggccctggaacctggcgattgcaactgcctgcgtgcagttgkcctgggcttgtgcagcagtgccatctgccggccgcgttgctgcatagcctggccaggcctggagagccactacggttgcttttagaagcttggccttagc

SEQ ID NO: 30295 - DNA, 201 bp, Homo sapiens
actgcccatatgggccttgcctctgtcttccccagcaagaccaatgcgcttcccttcgagaggaaggccaaaggtctgctatcttgtcctgagcctttccmatctcctacccaggcccattgcctttctcctccccagtgataacagaatgactcactgggctttttcaggtgagtttccacctccccctctagtccgagt

SEQ ID NO: 30296 - DNA, 201 bp, Homo sapiens
cacgcctgggccctggaacctggcgattgcaactgcctgcgtgcagttggcctgggcttgtgcagcagtgccatctgccggccgcgttgctgcatagcctsgccaggcctggagagccactacggttgcttttagaagcttggccttagcttgttttttaaattttttatttttattcttttccctgccttgggcaggcct

SEQ ID NO: 30297 - DNA, 201 bp, Homo sapiens
gttgtctttatttagctcttctctgtgaggcagggcctcctccattgtcttcagccacctgcctcacctgtgatgccgggcactgcgggagtgttccttcktctgtgcctttgttagctgtttcccacctggaattcctcctcctttcccctttgcccaagtcttcctgtgcttcataggtgcacccttgtgagactctct

SEQ ID NO: 30298 - DNA, 201 bp, Homo sapiens
acaaagcaatgtggcaaccacctttctgaaagccattagaacctcacaacctcctttcagcctgcttttgtttgcctgtgaggctctgtcagagggctggstcagggactggcccttgccggaggcagggagagctgacctctgtgaattctgggcttcgtacctagaatgtcctgtgccctttctgaaccttgctttgcc

SEQ ID NO: 30299 - DNA, 201 bp, Homo sapiens
gacacggctgtttgccagacagcacagaggccagagagagactatgggagtcctggttcctgctcctccgtagagactgctcttcctaagctacggctgcwggatctggctctcatacctgccaagagagagccatcaacaaccaacagcctgctgagtcacttcccccggggagccttagtttccgtggcatggtcagac

SEQ ID NO: 30300 - DNA, 201 bp, Homo sapiens
cacacgggcaggggcagctgccacggtgcacgctgaagctgcaagcagtgtgtggacagaagtcccacagcaggctggtggcatcacctggtatcaagccrcagggggacacttcccaggctcagggcgctgccgccttgtcagctttactgggagtgctgaaggccaggtgcctccaaggctgagagtccaaagaggaga

SEQ ID NO: 30301 - DNA, 201 bp, Homo sapiens
aaatcagccagaaccattccgtggttggtggtctcttaccaggaaggaatgctggtcagtacacacacacacacacacacacacacacacacacacacacwcactctctctctctcactcactcactcactaactagctgggcatggtggcatgcacgcacgcacacacactagctgggcatggtggcacacgcgcgtgca

SEQ ID NO: 30302 - DNA, 201 bp, Homo sapiens; identical to SEQ ID NO: 5846

SEQ ID NO: 30303 - DNA, 201 bp, Homo sapiens
tctgggacactcttctctgaccaggtgagctgatttgcctaagtccccaccgccagtaagtggcagagctgggctttaaggcctaggcttgtcatagccaygccgtgggtgcccgcccggcagaaggggattgggcaaggcagggccgtggaggggctgctgttggccccgagacgcagagcagctgatggctgtccccat

SEQ ID NO: 30304 - DNA, 201 bp, Homo sapiens
ctgaagtgggttgagcttggatacctgggactgtatttagggtctgtgagttaaagactttaggatgactcaggacctcatccagtgtcctctacactggraaaattctggaactagatgtgggctagatcagttagtcttgcaaagagatggtcacccagccaggttatcttttgtgtaacccttaaagaaggcacgaag

SEQ ID NO: 30305 - DNA, 201 bp, Homo sapiens
aatcagccagaaccattccgtggttggtggtctcttaccaggaaggaatgctggtcagtacacacacacacacacacacacacacacacacacacacacayactctctctctctcactcactcactcactaactagctgggcatggtggcatgcacgcacgcacacacactagctgggcatggtggcacacgcgcgtgcac

SEQ ID NO: 30306 - DNA, 201 bp, Homo sapiens
gctacgacgtgtgctcctgctcggacggccgcgagtgcctgtgcggcgccctggccagctatgccgcggcctgcgcggggagaggcgtgcgcgtcgcgtgrcgcgagccaggccgctgtggtgcgtgccctccctgcccgcagccctccgggccgccccccaaatccgtccacgtgtgcttttcgaagccctttctctgcg

SEQ ID NO: 30307 - DNA, 201 bp, Homo sapiens
tcattctcactctgggacactcttctctgaccaggtgagctgatttgcctaagtccccaccgccagtaagtggcagagctgggctttaaggcctaggcttktcatagccatgccgtgggtgcccgcccggcagaaggggattgggcaaggcagggccgtggaggggctgctgttggccccgagacgcagagcagctgatgg

SEQ ID NO: 30308 - DNA, 201 bp, Homo sapiens
aatgagcacttcataggagcaatcaatgagatggtttccatggagcacttggaaatgtatcttatgccaggcatggtggctcacgcctgtaatcccagctytttgggaggctcagtgggcagagcgcttgagcccaggggttggagaccagcctgggcaacatggtgaaaccccatggctacaaaaaatacaaacattagc

SEQ ID NO: 30309 - DNA, 201 bp, Homo sapiens
atcagccagaaccattccgtggttggtggtctcttaccaggaaggaatgctggtcagtacacacacacacacacacacacacacacacacacacacacacwctctctctctctcactcactcactcactaactagctgggcatggtggcatgcacgcacgcacacacactagctgggcatggtggcacacgcgcgtgcaca

SEQ ID NO: 30310 - DNA, 201 bp, Homo sapiens
tttctgtaactatccaaggctgtctcagaggctgcacccatcagttcttcctgctgtccataggagagacctgtaaaggatgctttttcttagatttccascctgctgtggacccatgcttttgtaaatacaataaaaatgaattctcataaaaataaaacaaaagcaatgacaaaaataatatgatcccacccaactaaa

SEQ ID NO: 30311 - DNA, 201 bp, Homo sapiens
aaaaccccagggagtgcatttttgaggttttctctagtttcaaattgtgggtggggaaaaggctagacaatagcctgagcacatgaccctctctgggacamcctcatctgcactctgagttcagtgacgtaattctctgaatgacatttttgatggggtaggcagcatggcagaatggagggaaagacacaggcctcagtc

SEQ ID NO: 30312 - DNA, 201 bp, Homo sapiens
acatggtgaaaccccatggctacaaaaaatacaaacattagccaggcatagtggtgtgtgcctgtagtcccaggtacttgggaggctgagatggggggatygcttgagcctgggagattaaggctgcagtgagctgtgatggcatcactgcactccagcctgctgggtgacagagatcctatcacacacacatacacacac

SEQ ID NO: 30313 - DNA, 201 bp, Homo sapiens
gaaccattccgtggttggtggtctcttaccaggaaggaatgctggtcagtacacacacacacacacacacacacacacacacacacacacacactctctcwctctcactcactcactcactaactagctgggcatggtggcatgcacgcacgcacacacactagctgggcatggtggcacacgcgcgtgcacacacacaca

SEQ ID NO: 30314 - DNA, 201 bp, Homo sapiens
gatgagtgaggttaaacattttatcatatgtttaattgccattttttggtctaattttgtgaattttctgctcatgcctttccccattttcccattagaaragttgtgataagaaacacatgagatctaccctattaataaattttccagtgtacaataccatattgttagctatttgcaagttgttgtacagcagatctc

SEQ ID NO: 30315 - DNA, 201 bp, Homo sapiens
gtggcctctccctccagggaccctttgtgcagaaggaactcgcggcaggtcatccacggcccgatgcagccttttcggaagtgacttcgtcaacacctttsatgggagcatgtacagctttgcgggatactgcagttacctcctggcagggggctgccagaaacgctccttctcgattattggtgagttctgggcactgca

SEQ ID NO: 30316 - DNA, 201 bp, Homo sapiens
ggctgttaggcaaacatccccatggaaacacccggttcaggtagattgaatgccagttaagagctggagggcatgaaaggcatgacttactcctgtctgcrttcatcactgttaggtttgattcagcatatccttattccctgccatgagtgccctgggaatacagctcctgtctttgaaaagcttgcagagaaatggagg

SEQ ID NO: 30317 - DNA, 201 bp, Homo sapiens
taaacattttatcatatgtttaattgccattttttggtctaattttgtgaattttctgctcatgcctttccccattttcccattagaaaagttgtgataaraaacacatgagatctaccctattaataaattttccagtgtacaataccatattgttagctatttgcaagttgttgtacagcagatctctagaagtttttg

SEQ ID NO: 30318 - DNA, 201 bp, Homo sapiens
accattccgtggttggtggtctcttaccaggaaggaatgctggtcagtacacacacacacacacacacacacacacacacacacacacacactctctctcwctcactcactcactcactaactagctgggcatggtggcatgcacgcacgcacacacactagctgggcatggtggcacacgcgcgtgcacacacacacaca

SEQ ID NO: 30319 - DNA, 201 bp, Homo sapiens
tctgcttatagcctactgggtattgcttagtcatatggctgcccccagctgcaagggaggctgagaaatggaatcttattcctagcagctctgtgccccgygggggtgggaaattgaaaactgaggattctgtgactaagaaggggagaatagctcctggacaactttcaacctcttccacttttcccctctttcacaggt

SEQ ID NO: 30320 - DNA, 201 bp, Homo sapiens
cacactctctctctctcactcactcactcactaactagctgggcatggtggcatgcacgcacgcacacacactagctgggcatggtggcacacgcgcgtgmacacacacacacacacacaaacacatactagctgggcatggtggtgcaccagtaatcccagctaatgggagggctgaggtgggaagatggcttgaacctg

SEQ ID NO: 30321 - DNA, 201 bp, Homo sapiens
agatctaccctattaataaattttccagtgtacaataccatattgttagctatttgcaagttgttgtacagcagatctctagaagtttttgttttgtgtgrctgaaactatgcccactgaacagcaacttcccattttccccttcccctagcccccgcaaccaccattctgctttttgcttctatgaatttgacgatttta

SEQ ID NO: 30322 - DNA, 201 bp, Homo sapiens
cagggccatgcaagatctcatggtgttgggatccagggtccctctgtcttatttctctgttgtccccagtgggggcttctaccttgtgcaccaaaacgccrgctcaagcttcaggcatcacaactacattcccgcagtagaaagagaagggactaaggaagaagcagtcccttattttgaggacacttggtggaggttgca

SEQ ID NO: 30323 - DNA, 201 bp, Homo sapiens
ttctcctggtctggctcaggagctcacatcaattgcagtcctgtcagtcactgaatagcctcagatttcctgttttccactggtctctgaatttggtgttyattaggtgaacacaagccttattttctttggccattcatgtcttcacattctctcgcgtcctccattatcttgtagaactctttccgcctcctctgaaac

SEQ ID NO: 30324 - DNA, 201 bp, Homo sapiens
tatgaaaggatttccttctttctaaagactgaatagtattccattgcatgtatataccacattttctttatccatttgtccactgatgtgcatttggattrtttctaactcttggctattgtgaataatgttgcagtgaatgtggaagtgtataagtacctttttgagatcctgatttcaatgcttttggatgaataccca

SEQ ID NO: 30325 - DNA, 201 bp, Homo sapiens
actgttttatcagatactaggattgcaacccctgcttttttttttttgccttccatttgcttggtagaccttcctccctccctttattttgagcctatgtrtgtctctgcacgtgagatgggtctcctgaatacagcacactgatgggtcttgactctttatccaattggccagtctgtgccttttaattggggcatttag

SEQ ID NO: 30326 - DNA, 201 bp, Homo sapiens
aggagccccaaggagaaggtgaggagggtcccttagagagctccatggccaagtctcctacttctcatgagcactggaccccagctatcttagagagaggwatgtcaagctctgcagaaaccatccatttggtggaaatctatcaacaggtttcaccaggtccttgtgagtcagaatcttggaatgcgggtgggaatcttg

SEQ ID NO: 30327 - DNA, 201 bp, Homo sapiens
caagtgctttagtgaggtccaagaatccagggggcagtccctggtttggcccaattctctgcatgtcctcgtgtaagttactttcctactctgcctctcartcttccctctctgaggtaaacagagctccacggaaccccccatggataggcaccctttctttacagcagactggctcacctgagtgcaggatgggagaag

SEQ ID NO: 30328 - DNA, 201 bp, Homo sapiens
ccattgcatgtatataccacattttctttatccatttgtccactgatgtgcatttggattatttctaactcttggctattgtgaataatgttgcagtgaaygtggaagtgtataagtacctttttgagatcctgatttcaatgcttttggatgaatacccagaagtgggattactgggtcatatgctaatactagttttaa

SEQ ID NO: 30329 - DNA, 201 bp, Homo sapiens
cattatgatgttcgctggttattttgcccattaattgataccgtttcttcgtagcatcgatggtctttacaatttggcatgtttttgcagtggctggtacyggttgtttctttccatgtttagtgcttccttcaggagctcttgtaaggcaggcctggtggtgacaaaatctctcagcatttgcttgtctgtaaaggattt

SEQ ID NO: 30330 - DNA, 201 bp, Homo sapiens
ccttttccttttccctggtgagcaacagaatggacaagaatctgatggtgcccataagtgcatattcactgagatgtttcatatggcttgcgtgatacaasgtagactaagggacaagacacgtaagagaaattaaaccatgaaagactgtctggggttagtaaatgacaaatcgccaagtgaatggtaagtgatagcgca

SEQ ID NO: 30331 - DNA, 201 bp, Homo sapiens
aaatgtgattaagatgggccacaattgggcctgcacaccaacccaggcatggtgaggtcatggctggatgggctggggcagctgctctcccgcagctcctggcaccgccgacaggagttgaaagaagacaggagtagctgatgcagggccttggagccagggagatgctggaagtgtgcaaattagctggcccttgttttg

SEQ ID NO: 30332 - DNA, 201 bp, Homo sapiens
acattttctttatccatttgtccactgatgtgcatttggattatttctaactcttggctattgtgaataatgttgcagtgaatgtggaagtgtataagtayctttttgagatcctgatttcaatgcttttggatgaatacccagaagtgggattactgggtcatatgctaatactagttttaattttttgaggaaccttct

SEQ ID NO: 30333 - DNA, 201 bp, Homo sapiens
gcatcgatggtctttacaatttggcatgtttttgcagtggctggtactggttgtttctttccatgtttagtgcttccttcaggagctcttgtaaggcaggyctggtggtgacaaaatctctcagcatttgcttgtctgtaaaggattttatttctctttcacttatgaagcttagtttgggtggatatgaaattctaagtt

SEQ ID NO: 30334 - DNA, 201 bp, Homo sapiens
cctttcccttttccttttccctggtgagcaacagaatggacaagaatctgatggtgcccataagtgcatattcactgagatgtttcatatggcttgcgtgwtacaacgtagactaagggacaagacacgtaagagaaattaaaccatgaaagactgtctggggttagtaaatgacaaatcgccaagtgaatggtaagtgat

SEQ ID NO: 30335 - DNA, 201 bp, Homo sapiens
ttgcatcactgcactccagcccagcggacagtgcgagactccatctcaaaaaaaaaaaaagaaagaaaagaatattctaaaaaaagacttaattccccccsccaccccaccccaaaacaagtggagacaggcaaacttccttatcttctaggttgggggatggatttttttcctggtccactgtttggaagatgtttccct

SEQ ID NO: 30336 - DNA, 201 bp, Homo sapiens
tggctattgtgaataatgttgcagtgaatgtggaagtgtataagtacctttttgagatcctgatttcaatgcttttggatgaatacccagaagtgggattrctgggtcatatgctaatactagttttaattttttgaggaaccttcttactgttttctgtagtcgcgacaccactttacattcctaccatcaatgcacaag

SEQ ID NO: 30337 - DNA, 201 bp, Homo sapiens
ggaaggacccttggaatgcaggatcccagagaagttagttgtcagatgatggccctggttttagagttggggtgcccacccactatgccccagtgacaccragctcagagctggggtttgcaataagtacacacgtgtctttccccgttttgatgagaactgctctctcaagtctctctttcttgagtcattgataggcta

SEQ ID NO: 30338 - DNA, 201 bp, Homo sapiens
ctgaatgacaatatcaacttttctttaggtttcttaacctacagcagcaaaccaatcatgcacaatattagtataacactgcagactattctagggtgttkccttatcattgagtcatgggccagcatgttttgagagctatttgtaaaattgctaataaccaacttttgagaacggttccactatttagggtccaacagt

SEQ ID NO: 30339 - DNA, 201 bp, Homo sapiens
gctattgtgaataatgttgcagtgaatgtggaagtgtataagtacctttttgagatcctgatttcaatgcttttggatgaatacccagaagtgggattackgggtcatatgctaatactagttttaattttttgaggaaccttcttactgttttctgtagtcgcgacaccactttacattcctaccatcaatgcacaaggg

SEQ ID NO: 30340 - DNA, 201 bp, Homo sapiens
ctctccttgcccccgccccccgcgccccccctccccgcccacaggccgtggtgtgtgatgttcccctccctgtgtccatgtgttctcattggaacttggckttttatgttgctcatttgacaagcccttgaggagagttggataaggacctagcacccaagcattcaattcaaaggcctccctaacataatgttcccaaaa

SEQ ID NO: 30341 - DNA, 201 bp, Homo sapiens
tatcaacttttctttaggtttcttaacctacagcagcaaaccaatcatgcacaatattagtataacactgcagactattctagggtgtttccttatcattsagtcatgggccagcatgttttgagagctatttgtaaaattgctaataaccaacttttgagaacggttccactatttagggtccaacagtttgttggaact

SEQ ID NO: 30342 - DNA, 201 bp, Homo sapiens
atatgctaatactagttttaattttttgaggaaccttcttactgttttctgtagtcgcgacaccactttacattcctaccatcaatgcacaagggtttcartttcttcacattcttgttaacacgtggtatttcctggtgtgtgtgtgtgtgtgtgtgtgtgtgtgtgtttgataatggccattctagcacgtatgaggtg

SEQ ID NO: 30343 - DNA, 201 bp, Homo sapiens
cctcaggaaatccgacccctgcactcacacagtgttctctgcttcccaccaagatcttggcagttgcggttttggtttttgtcttcaccgcctgcccgccygaattgatgaggagcaggacgctgacctggctgtccgtgtgtggtgatctttgagagagcagaaagcattcattaagttcttctcttttattaaatctct

SEQ ID NO: 30344 - DNA, 201 bp, Homo sapiens
gccctcacttctctgtggcagcccatctcagtcccagaaagcattaacaattcattcattcatttattcaacaaatactgagttcctgtatgtgtcaaacrtggtcctaggcgctgtggatacagcaggggaaaaaagtttttttgtttaggggtgtgtgtgtgtgtgtgtgtgtgtgtgtgtgtgtatgtgtcttccatg

SEQ ID NO: 30345 - DNA, 201 bp, Homo sapiens
tttgaggaaccttcttactgttttctgtagtcgcgacaccactttacattcctaccatcaatgcacaagggtttcaatttcttcacattcttgttaacacktggtatttcctggtgtgtgtgtgtgtgtgtgtgtgtgtgtgtgtttgataatggccattctagcacgtatgaggtgatacctcattatggttttgatttg

SEQ ID NO: 30346 - DNA, 201 bp, Homo sapiens
ttcattcattcatttattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagct

SEQ ID NO: 30347 - DNA, 201 bp, Homo sapiens
ttcattcatttattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagcttaaa

SEQ ID NO: 30348 - DNA, 201 bp, Homo sapiens
tttattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagcttaaaacaacaca

SEQ ID NO: 30349 - DNA, 201 bp, Homo sapiens
tattcaacaaatactgagttcctgtatgtgtcaaacatggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagcttaaaacaacacatt

SEQ ID NO: 30350 - DNA, 201 bp, Homo sapiens
aaagctctgtcctgtacaattttaaccctatgaagattctgctagcaccagctcttttcttttcccacatcccttcgtttggggactgtgataactaccawgagctctaaatccatttgcatacccttgtgtttgcagaaccaccaatgacctgtgctttttccctccaacagcatttgccgaaacagccagtggatctgc

SEQ ID NO: 30351 - DNA, 201 bp, Homo sapiens
agatcacacagccagctagtggtggacctgggcgtgaacccaggtatttgggatacagagcccgttcccttagctgcgttgccactttgctacacttcctyctggcttgtgtctcttgcagtatttttctgtgggaggctagggagggtgagggctgtgggcagatgggtgcagcccatttcgctgtggtaggcatgagtg

SEQ ID NO: 30352 - DNA, 201 bp, Homo sapiens; identical to SEQ ID NO: 5853

SEQ ID NO: 30353 - DNA, 201 bp, Homo sapiens
aaaacaagccataggaggttaagtagctgccccaagtcgccagctagcaaggtgcagagccaggactcatgccctgcctggctccctccctttcctgttcrggtcacattggttcaggctactcaagttatttctaccagtgggcccttgtgtttctcttggggagttgggctttgcaggttcttaaggtttctttaagtt

SEQ ID NO: 30354 - DNA, 201 bp, Homo sapiens
tgaggcaaatacttaacctctttgtatatcatctatacaaaggatacacatctttgtgtatcctcatctataaaatggggataataatagcacctacttgmttaaaatagtatctggcacatgacaagtgctcaaaaaaaaatgcttgctcccactgctgttactactaccttttactgacactggcgtctaatccattcc

SEQ ID NO: 30355 - DNA, 201 bp, Homo sapiens
gcaggtggatcatttgaggtcaggagtttgagaccaacctggccaatggtgaaaccctgtctatactaaaaacaaaaacaaaaacaaaaaacccacagaarttagctgggcatggtggcacatgcctgtaatctcagctactcgggaagctgaggcaggagaattgtgagagccccggagatagagtcttcagtgagccga

SEQ ID NO: 30356 - DNA, 201 bp, Homo sapiens
agtctgaggctggtgtggccctgatgccagcaggtagcgtgggacatggcagtgagctgtgagggaggaggggaggctgcagggagcctggaagcaggagygtgggttcctgcgtggttccaccactgactgagtgtggctctgtcaccttccttagttgccccatctgtaaaatgaggccttgacctgaatgacccagct

SEQ ID NO: 30357 - DNA, 201 bp, Homo sapiens
tgcttgcatatgcattccaccttggccaccccaggggaagtgccctcacctcccattcttctcccttcctctgtgtctctccaggggagtgccttgtcacwggtcaatcacacttcaagagctttgacaacagatacttcaccttcagtgggatctgccagtacctgctggcccgggattgccaggaccactccttctcca

SEQ ID NO: 30358 - DNA, 201 bp, Homo sapiens
atgcattccaccttggccaccccaggggaagtgccctcacctcccattcttctcccttcctctgtgtctctccaggggagtgccttgtcacaggtcaatcmcacttcaagagctttgacaacagatacttcaccttcagtgggatctgccagtacctgctggcccgggattgccaggaccactccttctccattgtcattg

SEQ ID NO: 30359 - DNA, 201 bp, Homo sapiens
ggaggctgaggcaggagaatcccttgaaccaggaagtcggaggttgcagtgagctgagatcgtgccactatactccagcctggtgacagagcgagactctrtctcaaaacaaaacaaaacaaaacaaaaaacaccactggcctagtaaattctttacccactccatgcttcagtttctaaatctgaaaggctgtctgtatc

SEQ ID NO: 30360 - DNA, 201 bp, Homo sapiens
cccttgaaccaggaagtcggaggttgcagtgagctgagatcgtgccactatactccagcctggtgacagagcgagactctgtctcaaaacaaaacaaaacaaaacaaaaaacaccactggcctagtaaattctttacccactccatgcttcagtttctaaatctgaaaggctgtctgtatcagcctttgtctgaggagagc

SEQ ID NO: 30361 - DNA, 201 bp, Homo sapiens
ctgcctccctcctgtggcagtagggggaatggcaggtcatagcggggggtgcagaggcttcttcctgggggaccctatttgcgctctgtccaccttgatcrcccttcctcctgacacccccttaaacctcatggccaccccatcttcccctaagtcattgctcttcagtgctaccatccttttgagacaccccatttcctc

SEQ ID NO: 30362 - DNA, 201 bp, Homo sapiens
tgaaccaggaagtcggaggttgcagtgagctgagatcgtgccactatactccagcctggtgacagagcgagactctgtctcaaaacaaaacaaaacaaaamaaaaaacaccactggcctagtaaattctttacccactccatgcttcagtttctaaatctgaaaggctgtctgtatcagcctttgtctgaggagagctgtg

SEQ ID NO: 30363 - DNA, 201 bp, Homo sapiens
ggggtgcagaggcttcttcctgggggaccctatttgcgctctgtccaccttgatcacccttcctcctgacacccccttaaacctcatggccaccccatctkcccctaagtcattgctcttcagtgctaccatccttttgagacaccccatttcctcccaaatacatctgcctgccaccaccctgtcctctccccacctctg

SEQ ID NO: 30364 - DNA, 201 bp, Homo sapiens
atttcttcacattcttgttaacacgtggtatttcctggtgtgtgtgtgtgtgtgtgtgtgtgtgtgtgtttgataatggccattctagcacgtatgaggtratacctcattatggttttgatttgcatttccctgatgatcagtaatgttggatattttttcatataattgagtttttggatgtctctttggaggaatgtc

SEQ ID NO: 30365 - DNA, 201 bp, Homo sapiens
cactgtttctctggaaatgaccctggcaggtggacagtgcaaatattactgccattttataaatgaggcaaccagggcacaggaagtggagggatggtgcmgcactccagaacttccagggctaggatagactcctctgatcagaggactgatcccactctgacccccaccaaccgtgtcatggcagagcgaggattagtt

SEQ ID NO: 30366 - DNA, 201 bp, Homo sapiens
gtgtctgggacattccacagaatcagcgcatgctgttgctgatgggaactggtcccgtctggccccagcaatcacctggggagtgtttaaaaaaaaaaaamtcttgctgatccccatcccaaactactgcattcagatctcctagggtgagacccagaaatctctataaagccccttgtcccatccccctcattcatagtg

SEQ ID NO: 30367 - DNA, 201 bp, Homo sapiens
tgctcatttttaaattgggttatttgcattttttttttttttgctattgagttgtatgagttcctaatatattttggatattaaccctttatcaaatgtayggtttgcaaatattttcttccattctgtaggctgcctttttattctgttgattgtttctttggctgcacagaagctttttggtttgatgtagtcccactt

SEQ ID NO: 30368 - DNA, 201 bp, Homo sapiens
gggggatcgcttgagcctgggagattaaggctgcagtgagctgtgatggcatcactgcactccagcctgctgggtgacagagatcctatcacacacacatacacacacacacacacacacacacacacacacgcaaaaaaaaaaaaaaaaggaagaaaaagaaaaaaaaatgcatcttgggccaggcgcggcagctcatgc

SEQ ID NO: 30369 - DNA, 201 bp, Homo sapiens
caaggttcaggacagggtcagatgaccccatggcctatagaactgtctttttatatatatttttcttttttctttttctttacacagattcctggggctcrtggaaagggactatcttgtgggttttattatgaagcaggaaagggggtgtttgagttggggcaggaggtggggagcctcagaatactgacaccagggctt

SEQ ID NO: 30370 - DNA, 201 bp, Homo sapiens
aaggagagaggtaggaggcggaatggccttggccgtggtaaccagggaggtagtgaaaaggccagaggcgccccagggcatgacaaataagaaagtcatcytcaacactgaccgtgagggtcccaacttgcttcagaggctgcagctggggaggagctggaagagcagctggagagaacccctgaacccctgcccctggga

SEQ ID NO: 30371 - DNA, 201 bp, Homo sapiens
ggggatcgcttgagcctgggagattaaggctgcagtgagctgtgatggcatcactgcactccagcctgctgggtgacagagatcctatcacacacacatacacacacacacacacacacacacacacacacgcaaaaaaaaaaaaaaaaggaagaaaaagaaaaaaaaatgcatcttgggccaggcgcggcagctcatgcc

SEQ ID NO: 30372 - DNA, 201 bp, Homo sapiens
aaagtttttttgtttaggggtgtgtgtgtgtgtgtgtgtgtgtgtgtgtgtgtatgtgtcttccatgtatttgtttttttattgctgctataacaaatcascaaaaacttgatagcttaaaacaacacatttattatcatatggttctagaggtcggaaagctaaaattggtgggcagggctgcattcatcttagaggctc

SEQ ID NO: 30373 - DNA, 201 bp, Homo sapiens
cttctgctaacttacggcttagtttattcattttctagttcttacattgtaaaattaggttatttgtttgagatctttcttactgtagacatttactgctrtaaactttccttttattgcttttgctgtttcccataagctttgctatgttgtgctttagtttttgtttttctcaaaatattttctgatttttcttttgat

SEQ ID NO: 30374 - DNA, 201 bp, Homo sapiens
gggatcgcttgagcctgggagattaaggctgcagtgagctgtgatggcatcactgcactccagcctgctgggtgacagagatcctatcacacacacatacacacacacacacacacacacacacacacacgcaaaaaaaaaaaaaaaaggaagaaaaagaaaaaaaaatgcatcttgggccaggcgcggcagctcatgcct

SEQ ID NO: 30375 - DNA, 201 bp, Homo sapiens
tgtcacagcaccttttgaactctgaccctcctgcctccctctgatcagaccctgtgatgacattcagcccacacagataatccaggttaaactcttcatcycatgggagccactgttttgccttccataatcctggtgcagattatatcctagcgggaatgttactatagatagtttgggctgatgagccctgtgaagagg

SEQ ID NO: 30376 - DNA, 201 bp, Homo sapiens
aaaacagcctatacttataacagtctattctaagcttataacaacttaatttcaattgctcacgaaaactctactcttttactgcctctcccccactttayattattgatgtcacaaattatattttttaatgttgtgtattcattaactgatttttatagtgatagttatttttataagtttgtcttttaagtactatac

SEQ ID NO: 30377 - DNA, 201 bp, Homo sapiens
ggatcgcttgagcctgggagattaaggctgcagtgagctgtgatggcatcactgcactccagcctgctgggtgacagagatcctatcacacacacatacayacacacacacacacacacacacacacacgcaaaaaaaaaaaaaaaaggaagaaaaagaaaaaaaaatgcatcttgggccaggcgcggcagctcatgcctg

SEQ ID NO: 30378 - DNA, 201 bp, Homo sapiens
gaacttgttgcatgttgcactccatgatgggtgaacatggagacaggtgagacatatcttcctgattacatttatgagagagcagaattctgcccagcctrctctgaacaggctgcacttctccaggcaaggggactcaccttcccagaggcaggcagttctataactttccctccttggacccctacacctccattggtg

SEQ ID NO: 30379 - DNA, 201 bp, Homo sapiens
attgattataatatatgttgtagcggacttctttaaattcattctagttggagtcttttgggcttcttgaagctggatgtctattttcttccctaaatttrttcattatttctactttccattgggttttaatcttattcgttattttaaatatttgaactattagctcattatctgtgatataggttgcagtactattta

SEQ ID NO: 30380 - DNA, 201 bp, Homo sapiens
gcagtgagctgtgatggcatcactgcactccagcctgctgggtgacagagatcctatcacacacacatacacacacacacacacacacacacacacacacrcaaaaaaaaaaaaaaaaggaagaaaaagaaaaaaaaatgcatcttgggccaggcgcggcagctcatgcctgtaatcccagcactttgggaggccaaggca

SEQ ID NO: 30381 - DNA, 201 bp, Homo sapiens
acttccttctggcttgtgtctcttgcagtatttttctgtgggaggctagggagggtgagggctgtgggcagatgggtgcagcccatttcgctgtggtaggyatgagtgtccctcctctttgggaccagcatgtcctcaaagggactgttttctttctagagagtaagggttatgagcatgagctttagggctgcagagagc

SEQ ID NO: 30382 - DNA, 201 bp, Homo sapiens
tagctttaaataaaatggggccagcaaggaagctcaggaatgggtcttggcaatggcaaggctttgctgctcacctcgggcctcctctgagtctctgtccygctcctcctcctcttcctcgaatgccctctgcctccattgccgccaggaatgttcccctttcccctgagccggagagcatgctcctgggcttgacggtgc

SEQ ID NO: 30383 - DNA, 201 bp, Homo sapiens
gacagattctgccaatgctattgttgtctaggtggggagacagatatttggtgcttcttactccaccatcttccccgtctcccaccctgtaggttttttgttttttttttgtggtgggggaatactgtcttgatctggtttagatattggtgttaaaactggtttcattaaaagctttaagaagttttctctccttttcag

SEQ ID NO: 30384 - DNA, 201 bp, Homo sapiens
gtggcgtgatctcagctcactgcaacctctgcctcctgggttcaagcaattctcctgcctcagcctcccgagtagctgggattacaggcacctgccaccayacccggctaattttttgtatttttagtagagacggggtttcaccatgttggccaggctggtctcgaactcctgaccttgggtgctccgcctgtctcagcc

SEQ ID NO: 30385 - DNA, 201 bp, Homo sapiens
acctcgggcctcctctgagtctctgtcccgctcctcctcctcttcctcgaatgccctctgcctccattgccgccaggaatgttcccctttcccctgagccrgagagcatgctcctgggcttgacggtgctcatccctcaacttgtctctcaaggagaaagtgtgtggcctgtgtgggaattttgatggcatccagaacaat

SEQ ID NO: 30386 - DNA, 201 bp, Homo sapiens
tctttttttttttttttttttttttgagacagagtctcgctctgtggctcaggctggagtgcagaggcgcgatctcggctcactgcaagctccgcctcccrggttcacgccattctcctgcctcagcctcccgagtagctgggactacaggcgcccgccaccacgcctggctaatttttcgtatttttttttttgtagaga

SEQ ID NO: 30387 - DNA, 201 bp, Homo sapiens
tcttgattcacattttctttcactaaatttctgaaaaatgctgctccattgttgccttgctttgtatattgcttttgaaaattctgataccaatataattmttttgtccttgtaaattatttgatctttttgcctgaaggcctggaaaattttttctttatgtttgaagtctaatagtgtactgtaatatgtctcagagtt

SEQ ID NO: 30388 - DNA, 201 bp, Homo sapiens
ggcgcatgcctgtaatcctagctacttgggaggctgaggcaggagaatcgcctgaacccggggaggcggaggttgcagtgagccaagatcgcgccattgcrctctggccttggtgacaagagtgacacttctcttggaaaaaaaataaaaataaaaataaaaataaataaaatttgggtattttcttgttttctacttatg

SEQ ID NO: 30389 - DNA, 201 bp, Homo sapiens
tctgggaaacaaaaagtaaaatcaacagtttctaggggaagcaatgcctggcaaaacatttccttctgcatgagaagtaactccccttggcatgtgccaaygcttctctttcagccccagtcttaggatttgttctcttattgaagtatcttgttttcaacaccagagccagagatttccttttcctgtcactgctgcatt

SEQ ID NO: 30390 - DNA, 201 bp, Homo sapiens
tcttattgaagtatcttgttttcaacaccagagccagagatttccttttcctgtcactgctgcatttgtccagaccaaaagaccttcctctcccacccccyaaaaccccttggtgcccatttcttgtctcacagaaattcttttctggccttaattttggtgattttgagtcctcgtattatgacttatttttgtgtcttc

SEQ ID NO: 30391 - DNA, 201 bp, Homo sapiens
cccaccccctaaaaccccttggtgcccatttcttgtctcacagaaattcttttctggccttaattttggtgattttgagtcctcgtattatgacttatttktgtgtcttcatctctaatgacaaggaggaattccgcaaggttaagtgcagttgtctctctcttttttttttttttttgagacagagtctcgctctgtcac

SEQ ID NO: 30392 - DNA, 201 bp, Homo sapiens
ttctaacttgcaggttcatattgtaagagattcggttattttcacaactgcttccttacgatgccggcgagtgtgcaaattattgcggccagattcgagasagcagagaagtccgtgtaatttattaagggtgcgcagcgtgccgcctgcagcacgggacacgtgttcttggctataacacaaagaaaatggagctgggcc

SEQ ID NO: 30393 - DNA, 201 bp, Homo sapiens
gataacctgggcccaggaggcagaaactgcagcgagccatgttcacatcactgcaccccaacctgggcaacagagcacaaccctgtctcaataagtgaatraatgaatgaataaataacactctcctagagcacctgttaccagtaactcacagtgttgcctttttgtttgctgccttacaatatactcaattgtcgcatg

SEQ ID NO: 30394 - DNA, 201 bp, Homo sapiens
taagagagtctctaagtgtcgcccccactctcctaaccctggccgagctgacctccgagacaagccaaggggatgggagaagacctggttttagagtgggrcatgggagtgatggctggcttggtgggggtgaatgaaaacgcctttggggagcatcaaactctgagaaaggagagagaaaagatgctgagaggcgggaag

SEQ ID NO: 30395 - DNA, 201 bp, Homo sapiens
gagagagaaaagatgctgagaggcgggaagggagtggaggtgcaccaccagttatgccgccttgcccagggtgccctgactgcgggcattgcattccagcrcatcaggaggagaacctagtcattcacttacttattcattcatttgttcaacgattcattcattcaacaaacacttactgagtgtctgctggcactgctg

SEQ ID NO: 30396 - DNA, 201 bp, Homo sapiens
cactgctgtggactgaatgtctgtgtcctccccaaatttatatgttgaaatcctaacccccaaggtgatggtgttacgaggtggggcctttgggagatgakgaagaatgagatttgtgcccttttaaaagacctcagagagcttgctagccccttccaccatgtgaggacacagctagaaggcaccatctatgaaccggaa

SEQ ID NO: 30397 - DNA, 201 bp, Homo sapiens
ctgcctcatgcctttcccatcagaacaaaaagtggttctcgctttttggtcttgaatgcctttacactcttaaaaattattgaggacctcaagatcttgtaggaggattatatttattggtatttatcagattgaaaattaaattagagacatttaaaatatgtatttattaactcattcaaaaattataataataaaccc

SEQ ID NO: 30398 - DNA, 201 bp, Homo sapiens
tgcctcatgcctttcccatcagaacaaaaagtggttctcgctttttggtcttgaatgcctttacactcttaaaaattattgaggacctcaagatcttgtaggaggattatatttattggtatttatcagattgaaaattaaattagagacatttaaaatatgtatttattaactcattcaaaaattataataataaaccca

SEQ ID NO: 30399 - DNA, 201 bp, Homo sapiens
ggtcgggcaacagtgatgatgtggaactccaaacttactgttagagtcacagatggaaatggccgccctactagatacctatcctactaagtgaaaggatragtagattcagggcagggaaaaccaaggaaggctttctggaggacgtgtacttggctagggttttaaaaagctgctttcttggcagagaagacttgtttc

SEQ ID NO: 30400 - DNA, 201 bp, Homo sapiens
gcctcatgcctttcccatcagaacaaaaagtggttctcgctttttggtcttgaatgcctttacactcttaaaaattattgaggacctcaagatcttgtaggaggattatatttattggtatttatcagattgaaaattaaattagagacatttaaaatatgtatttattaactcattcaaaaattataataataaacccac

SEQ ID NO: 30401 - DNA, 201 bp, Homo sapiens
tctccacatgccagacattcttctaaatgtgttagctcattcaaccttcacaaagactgggtggatactgttattccatccagtgaggatactgcccaagrtcacacagccagctagtggtggacctgggcgtgaacccaggtatttgggatacagagcccgttcccttagctgcgttgccactttgctacacttccttct

SEQ ID NO: 30402 - DNA, 201 bp, Homo sapiens
agtagctgggattacaggcgtgcgccaccacaccctgctaattttgtgtttttagtagagacggggtttctccatgttggtcaggctggtctcgaactccygacctcaggtgatccgcccgcctcggccttggttcctcatctttaaaatggagatactgtgagcatcaagggagacaggttatctgaaaatgtgactgct

SEQ ID NO: 30403 - DNA, 201 bp, Homo sapiens
gttctcgctttttggtcttgaatgcctttacactcttaaaaattattgaggacctcaagatcttgtaggaggattatatttattggtatttatcagattgraaattaaattagagacatttaaaatatgtatttattaactcattcaaaaattataataataaacccactacacattaatataaacatcactgttttgggg

SEQ ID NO: 30404 - DNA, 201 bp, Homo sapiens
aagaattggtggtctaaagatgagccaggctggggcagtggctcacatctgtaatccccagcactttgggaggtggaagtgggaggaatgcttgagcctgrgagtttgagagcagcctgggcaacatagtgaggccctgtccctaaatacaaagaaaaaaaaatagttggccatggtggtgcatacctgtagacccagcca

SEQ ID NO: 30405 - DNA, 201 bp, Homo sapiens
ctctgttccttacgtgggtgggaacatggaagtcaacgtttatggtgccatcatgcatgaggtcagattcaatcaccttggtcacatcttcacattcactycacaaaacaatgagttccaactgcagctcagccccaagacttttgcttcaaagacgtatggtctgtgtggtaagaacattttctcaactcctcttctccc

SEQ ID NO: 30406 - DNA, 201 bp, Homo sapiens
gggaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagcta

SEQ ID NO: 30407 - DNA, 201 bp, Homo sapiens
agaattggtggtctaaagatgagccaggctggggcagtggctcacatctgtaatccccagcactttgggaggtggaagtgggaggaatgcttgagcctggkagtttgagagcagcctgggcaacatagtgaggccctgtccctaaatacaaagaaaaaaaaatagttggccatggtggtgcatacctgtagacccagccac

SEQ ID NO: 30408 - DNA, 201 bp, Homo sapiens
agccagcttaacatggggtgttcacttggaatcgccatgcagagacaggggctgctgggcccccaggcatttccacgaggtcagggtcacttgagtttcawctccccctcataatccacacaggtttgtgctagaggtctggcctctcgggccaccgttttctgggtttcagtggtcacagaggaatttgaagggccatgg

SEQ ID NO: 30409 - DNA, 201 bp, Homo sapiens
ggaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctac

SEQ ID NO: 30410 - DNA, 201 bp, Homo sapiens
tctcacagaaattcttttctggccttaattttggtgattttgagtcctcgtattatgacttatttttgtgtcttcatctctaatgacaaggaggaattccscaaggttaagtgcagttgtctctctcttttttttttttttttgagacagagtctcgctctgtcacccaggctggagtgcaatggcatgatcttggcttag

SEQ ID NO: 30411 - DNA, 201 bp, Homo sapiens
gctctatgtgactccaaagatctggctctttccactatatgaaatggcccttttgctgcatcttttttgggctgatttgcttgggagtcactgagtcatcaaaattttttttttttttttttttttttttttttttttttttttagctctatgggagttattgagtgtattttgaaagcatatttaccagactcctccgtc

SEQ ID NO: 30412 - DNA, 201 bp, Homo sapiens
gaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacg

SEQ ID NO: 30413 - DNA, 201 bp, Homo sapiens
attttggtgattttgagtcctcgtattatgacttatttttgtgtcttcatctctaatgacaaggaggaattccgcaaggttaagtgcagttgtctctctcttttttttttttttttgagacagagtctcgctctgtcacccaggctggagtgcaatggcatgatcttggcttagtgcagcctctgcctcctgggctcaagc

SEQ ID NO: 30414 - DNA, 201 bp, Homo sapiens
ttttgctgcatcttttttgggctgatttgcttgggagtcactgagtcatcaaaattttttttttttttttttttttttttttttttttttttttagctctwtgggagttattgagtgtattttgaaagcatatttaccagactcctccgtcttggcctaaaatggctgtcatctctcttcaaagttgaccccgtgtatatt

SEQ ID NO: 30415 - DNA, 201 bp, Homo sapiens
aaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgt

SEQ ID NO: 30416 - DNA, 201 bp, Homo sapiens
tctctcttttttttttttttttgagacagagtctcgctctgtcacccaggctggagtgcaatggcatgatcttggcttagtgcagcctctgcctcctgggytcaagcgattctcctgcctcaacctcccgagtacctgggattacaggcacctgccaccacgcccagctaatttttgtatttttagtagagtcaaggtttc

SEQ ID NO: 30417 - DNA, 201 bp, Homo sapiens
tcattattcttttcttataagctgtttgcccttgtgaagtgtccattttctgggagattgtttgcctaaacaaggttatggatcaaacacactttaatgtwaattgatttcattttcaccaaaaccgtgctgctaacatcatagagaatgggtggctgctttgcctcttgttggtggtggtggcaggtttggggtgtgtgg

SEQ ID NO: 30418 - DNA, 201 bp, Homo sapiens
aagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgtg

SEQ ID NO: 30419 - DNA, 201 bp, Homo sapiens
cgctctgtcacccaggctggagtgcaatggcatgatcttggcttagtgcagcctctgcctcctgggctcaagcgattctcctgcctcaacctcccgagtasctgggattacaggcacctgccaccacgcccagctaatttttgtatttttagtagagtcaaggtttcaccatgttggtcaggctggccttgaactcctgac

SEQ ID NO: 30420 - DNA, 201 bp, Homo sapiens
gtaaaactcttagaaaaatatcttgaacatatttattattagttacctgtgggaggcagcagagcatggtggtttaaaaccatggatttgggccgggcatrgtggctcacacctgtaatcccagcactttgggaggctgaggcaggtggatcacttgaggtcaggaattcgagacccagcctggccaacgtggtgaaatcc

SEQ ID NO: 30421 - DNA, 201 bp, Homo sapiens
aaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgtgggac

SEQ ID NO: 30422 - DNA, 201 bp, Homo sapiens
cctcctgggctcaagcgattctcctgcctcaacctcccgagtacctgggattacaggcacctgccaccacgcccagctaatttttgtatttttagtagagwcaaggtttcaccatgttggtcaggctggccttgaactcctgactcaggtgatctacccacctcggcctcccaaagtgctgggattacaggtgtgagccac

SEQ ID NO: 30423 - DNA, 201 bp, Homo sapiens
gggccgggcatggtggctcacacctgtaatcccagcactttgggaggctgaggcaggtggatcacttgaggtcaggaattcgagacccagcctggccaacrtggtgaaatcctgtctctactaaaatacaaaaattagttgggtatggtggcacatgcctatagtcccaactatttgggaggctgaggcaggagaatcact

SEQ ID NO: 30424 - DNA, 201 bp, Homo sapiens
ggccctcacagtctattgtgagtagctgacagtagcatgagcactataagtactaaagcacagatgctgtgagagcctggagtatgcagtgacttggggaytgggcttaggttccatgtcatattcttaccttcattctgcaaaaatattttgagcattcgtaatccactgtataagaatttagagataagagacacagcc

SEQ ID NO: 30425 - DNA, 201 bp, Homo sapiens
ggccagcagcactgcattattcaactcttcttgctggaatgcagattagaaactaagaatcttgccttcccactcattccctctttgagaccattgagctrcatttctccttctacctggacccccttatccttaaattgaccatcagaacatttgcacccagactaagagccagagttcctgacacctggccataggcct

SEQ ID NO: 30426 - DNA, 201 bp, Homo sapiens
attggggactgcgcctgcttctgcgacaccattgctgcctatgcccacgtgtgtgcccagcatggcaaggtggtgacctggaggacggccacattgtgccrtgagtactgacgccctcatgttctcagatgccctcccttcttcccatgtgtctatgcttgaagaccttgtgagtgcagggggatatcttcatgggcgaga

SEQ ID NO: 30427 - DNA, 201 bp, Homo sapiens
agaagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcat

SEQ ID NO: 30428 - DNA, 201 bp, Homo sapiens
gcctgcttctgcgacaccattgctgcctatgcccacgtgtgtgcccagcatggcaaggtggtgacctggaggacggccacattgtgccgtgagtactgacrccctcatgttctcagatgccctcccttcttcccatgtgtctatgcttgaagaccttgtgagtgcagggggatatcttcatgggcgagagaagacagagtg

SEQ ID NO: 30429 - DNA, 201 bp, Homo sapiens
atatttgccaatatgagtgatcaactcatacattcatgtctatagaatcttgcttctttggacagaagcaacttaatgtttttatgtagaaaactgggccrggcacagtgactcatacctgtaatccctgtgttttgggaggctgaggccagaggattccttgagcccaggagttcaagaccagcctgggcaacatagcaa

SEQ ID NO: 30430 - DNA, 201 bp, Homo sapiens
tcatacattcatgtctatagaatcttgcttctttggacagaagcaacttaatgtttttatgtagaaaactgggccgggcacagtgactcatacctgtaatmcctgtgttttgggaggctgaggccagaggattccttgagcccaggagttcaagaccagcctgggcaacatagcaagaccccatctgtacaaaaattaaaa

SEQ ID NO: 30431 - DNA, 201 bp, Homo sapiens
cttcactaatcatctctttgcttttcctaccttcgaggcaaaaggagcctatcctgtcggccccccatggtcaagctggtgtgtcccgctgacaacctgcrggctgaagggctcgagtgtaccaaaacgtgccagaactatgacctggagtgcatgagcatgggctgtgtctctggctgcctctgccccccgggcatggtg

SEQ ID NO: 30432 - DNA, 201 bp, Homo sapiens
gatgttggctccctgcaacctctgcctcccgggctcaagtgattctcctgcctcagcctcaccagtagctgggattacaggcgcccaccactacacccggytagtttttgtatttttagtagagacagggtttcgccatgttgggcagactggtcttgaattcctgacctcaggtgatctgcccacctcggcctcccaaag

SEQ ID NO: 30433 - DNA, 201 bp, Homo sapiens
ttgagggcaggagttcgagaccagtctgggcaacgtagggagcccccatttctattaaaataataataataataataataataataataataataataataataaatttgccgggcgtggtggggcgcgcctgtaatcccaactacttgggagctacgtgggacggttgcatgaacccaggaaggcaaggccgcagtgagc

SEQ ID NO: 30434 - DNA, 201 bp, Homo sapiens
aagagctgccaccaatgtaagccagaggtcagaagcccaggtgagaagatgccctcccagtcccacacagggaccctggctcaggcagccgctggtccccrtgagtgggcaactctgagtctcttgaatttagtcacagactctaggggaccaaaggacagtgtggaaggtaggtccattctctccttcactaatcatctc

SEQ ID NO: 30435 - DNA, 201 bp, Homo sapiens
agagctgccaccaatgtaagccagaggtcagaagcccaggtgagaagatgccctcccagtcccacacagggaccctggctcaggcagccgctggtccccgygagtgggcaactctgagtctcttgaatttagtcacagactctaggggaccaaaggacagtgtggaaggtaggtccattctctccttcactaatcatctct

SEQ ID NO: 30436 - DNA, 201 bp, Homo sapiens
agagatgactaatgcacattccctgtggttgaggaaaggagaaaatgtgtgcccccataattataatacatatctgcatgctgaaaaatacacatttgctcatagtgggaaaggaagttgatgaccatacagatataattgggggtcacttggggaaaactgggtaaagggtacatgggatctttctgcattacttcttgt

SEQ ID NO: 30437 - DNA, 201 bp, Homo sapiens
tcaggcagccgctggtccccgtgagtgggcaactctgagtctcttgaatttagtcacagactctaggggaccaaaggacagtgtggaaggtaggtccattmtctccttcactaatcatctctttgcttttcctaccttcgaggcaaaaggagcctatcctgtcggccccccatggtcaagctggtgtgtcccgctgacaac

SEQ ID NO: 30438 - DNA, 201 bp, Homo sapiens
ggtttcgccatgttgggcagactggtcttgaattcctgacctcaggtgatctgcccacctcggcctcccaaagtgctgggattataggcgtgagccactgygcccggccagcttctttgttttcttctgtatgccccaaatttttaataatggacatgatgacattttaaatcagtaagtaaatgtcattgaaactaatgg

SEQ ID NO: 30439 - DNA, 201 bp, Homo sapiens
ccaaatgacagattgaacatgacatttacgggggcgggtggaattttctcccttaaaactaggtattagttaaaaaccagaagaaggcacgggttctgcaygtgctcagaaagggaagggctgattctcttgttcattcaacagatatttattgaacagcagctgcattaaaaatgttcaaaatcattacagtcagctggg

SEQ ID NO: 30440 - DNA, 201 bp, Homo sapiens
gaagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatc

SEQ ID NO: 30441 - DNA, 201 bp, Homo sapiens
cgggtggaattttctcccttaaaactaggtattagttaaaaaccagaagaaggcacgggttctgcatgtgctcagaaagggaagggctgattctcttgttyattcaacagatatttattgaacagcagctgcattaaaaatgttcaaaatcattacagtcagctgggcaaggtggctcacgcctgtaatcccagcactttg

SEQ ID NO: 30442 - DNA, 201 bp, Homo sapiens
aagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatct

SEQ ID NO: 30443 - DNA, 201 bp, Homo sapiens
tgggcggatcacttgaggtcaggagtttgagaccagcctggtcaacatggtgaaaccctgtctccactaaacatacaaaaattagctgggcatggtgatgygtgcctgtaatcccagctactctggaggctgaggccggagaattgcttgaacccgggaagtggaggttgcagtgagctgagatcatgccgctgcactcca

SEQ ID NO: 30444 - DNA, 201 bp, Homo sapiens
gccttgtcagctttactgggagtgctgaaggccaggtgcctccaaggctgagagtccaaagaggagatggtcctggcccatattggtctccaccacacggycacttgatttcacctgtgggctggcaggccgtgccactttccgggacactggcaaaaaggtgatgttaccagcagagcctggaaatttggcatggtagtg

SEQ ID NO: 30445 - DNA, 201 bp, Homo sapiens
agaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatctg

SEQ ID NO: 30446 - DNA, 201 bp, Homo sapiens
gggtgtggtggcacatgcctgtaatcccagctactcgggaggctgaggcaggagaatcgcttgaaccagggagtaggaggttgcagtgagccgagatcgarccactgcactccagcctggtgacagagtgagacttggtctccaaacaaaacaaagcaaaacaaaactgaataaaattattacagtctgagaaatgcaaat

SEQ ID NO: 30447 - DNA, 201 bp, Homo sapiens
cagaaccaatagattctggtttaggtgcttcaacaatccagaagtctctaatattggtgacgcccatagtcccctagttccccaacattatctccagatgscgcaggccatcaccacatgggtctgcagtcctggaggctttgcctgttgtggccacagccttgtctcctgtctacacagcccagagctgcgaggagagga

SEQ ID NO: 30448 - DNA, 201 bp, Homo sapiens
atgactgtggctgtaccacaaccacctgccttcccgacaaggtaaggactgcttggctattaactatcagttaatagtttactcatttatttattgctgtyagtttatccttctatccacccatccattcatccatccacctacccatccaatatttgctaagcaacatgtgctcctcatggaagatttgcatcctaccca

SEQ ID NO: 30449 - DNA, 201 bp, Homo sapiens
tcctgggttcaagcaattctcgtgcctcagcctcccaagtagctggaattacaggcatgcgccaccacacctggctaattttttgtatttttagtagagayggggttttgccatgttggccaggctggtcttgaactcctgacctcaagtgatctgcctgcctcggcctcccaaagtgctgggattacaggcatgagccac

SEQ ID NO: 30450 - DNA, 201 bp, Homo sapiens
agaaccaatagattctggtttaggtgcttcaacaatccagaagtctctaatattggtgacgcccatagtcccctagttccccaacattatctccagatggygcaggccatcaccacatgggtctgcagtcctggaggctttgcctgttgtggccacagccttgtctcctgtctacacagcccagagctgcgaggagaggaa

SEQ ID NO: 30451 - DNA, 201 bp, Homo sapiens
acctgatcaagggtgccatgtgcatcacacccagaggcacataatgtccagctgtcctcctccctccctccctccctccctccctacgtcacttccttccytccctccctccttccctccctccctccctccctcactccctccctcactcctttcttccttccttccttccttccttccttcctttctttcttttctttc

SEQ ID NO: 30452 - DNA, 201 bp, Homo sapiens
aaaaggagcctatcctgtcggccccccatggtcaagctggtgtgtcccgctgacaacctgcgggctgaagggctcgagtgtaccaaaacgtgccagaactrtgacctggagtgcatgagcatgggctgtgtctctggctgcctctgccccccgggcatggtgagtcaccaggcacagagctggtgcctgcccttcagtttt

SEQ ID NO: 30453 - DNA, 201 bp, Homo sapiens
cctgtctacacagcccagagctgcgaggagaggaatctccgggagaacgggtatgagtgtgagtggcgctataacagctgtgcacctgcctgtcaagtcaygtgtcagcaccctgagccactggcctgccctgtgcagtgtgtggagggctgccatgcccactgccctccaggtgaggcctctatccctgggggtcaggct

SEQ ID NO: 30454 - DNA, 201 bp, Homo sapiens
ctttcttttctttctttctttcttttcattcgttcttcttttttttttttgagatggagtctcgctctgtcgcccaggctggagtgcagtggcgcagtctyggctcactgcaagctccacctcccgggttcacaccattctcctgcctcagcctcccgagtagctgggactacaggcgcccgccaccatgcccggctaatt

SEQ ID NO: 30455 - DNA, 201 bp, Homo sapiens
ggcggattacgaggtcaggagatcgagaccatcccggtaacacggtgaaacgctgtctctactaaaaatacaaaaaattagctgggcgtggtggcgggcgyctgtagtcccagctacttgggaggctgaggcaggagaatgccgtgaacccaggaggcggaggttgcagtgagctgagattgcaccactgcactccagcct

SEQ ID NO: 30456 - DNA, 201 bp, Homo sapiens
gcaaggctgctgcaggttccgtgggttctttcatcagagtcaggacagtcgtgatttttctcaagtcgagctcctccaaaatgcttttctgtgcctatttrtgggattctcacctaaagcagcccctgccgatagaactttctgcagtgggggaatgttgtattgaatgtaactgtgacgagtgtgtctgaggaactgaag

SEQ ID NO: 30457 - DNA, 201 bp, Homo sapiens
ttttttgagatggagtctcgctctgtcgcccaggctggagtgcagtggcgcagtcttggctcactgcaagctccacctcccgggttcacaccattctcctrcctcagcctcccgagtagctgggactacaggcgcccgccaccatgcccggctaattttttgtatttttagtagagacacggtttcactgtgttagccagg

SEQ ID NO: 30458 - DNA, 201 bp, Homo sapiens
tgcctcagcctcaccagtagctgggattacaggcgcccaccactacacccggctagtttttgtatttttagtagagacagggtttcgccatgttgggcagrctggtcttgaattcctgacctcaggtgatctgcccacctcggcctcccaaagtgctgggattataggcgtgagccactgcgcccggccagcttctttgtt

SEQ ID NO: 30459 - DNA, 201 bp, Homo sapiens
ggctgctgcaggttccgtgggttctttcatcagagtcaggacagtcgtgatttttctcaagtcgagctcctccaaaatgcttttctgtgcctatttatggsattctcacctaaagcagcccctgccgatagaactttctgcagtgggggaatgttgtattgaatgtaactgtgacgagtgtgtctgaggaactgaagtttt

SEQ ID NO: 30460 - DNA, 201 bp, Homo sapiens
gtggcgcagtcttggctcactgcaagctccacctcccgggttcacaccattctcctgcctcagcctcccgagtagctgggactacaggcgcccgccaccaygcccggctaattttttgtatttttagtagagacacggtttcactgtgttagccaggatggtctcgatctcctgaccttgtgatccacccgcctctgcctc

SEQ ID NO: 30461 - DNA, 201 bp, Homo sapiens
caggttccgtgggttctttcatcagagtcaggacagtcgtgatttttctcaagtcgagctcctccaaaatgcttttctgtgcctatttatgggattctcayctaaagcagcccctgccgatagaactttctgcagtgggggaatgttgtattgaatgtaactgtgacgagtgtgtctgaggaactgaagttttgaatttta

SEQ ID NO: 30462 - DNA, 201 bp, Homo sapiens
agagatagggtcttgctctgtcacccaggcacaagtgcagttatgcgacctcaactaacttcagcctccaccccctaggctcagacgatcctccccctcarcctcctgagtagctggaactacagacatatgccaccacatccggctaatttttgtatgtttttgtagagacaaggtttcatcatgttacccatgccggtc

SEQ ID NO: 30463 - DNA, 201 bp, Homo sapiens
ggtgtgtgcttggggctgggcacagagcctggccagtacctggcacatgagaggtgctcaccctatgtctgctggaggaatgagtgaatgtcttttcctakgcctgacaccgtggagacccctgtctgctactcccaaataatttgttctgctagataaagctggggttttgaatctttattcatctttctacaatgtttt

SEQ ID NO: 30464 - DNA, 201 bp, Homo sapiens
cagtttgtgctgacaagtggttgagatgaggcttgacagctgactgctcaaagaaagcatgaggaagagaggtcactctgctgtggaaccctggaaaggcrtcccggaggagggcaaccctgagtggaccttgagcaatgaatgggttgaatgtcgaatagaccttccagggaagggcatggtgaatgaataaccggcagc

SEQ ID NO: 30465 - DNA, 201 bp, Homo sapiens; identical to SEQ ID NO: 5835

SEQ ID NO: 30466 - DNA, 201 bp, Homo sapiens
ggtgcccacaggtcccagctcacagcgattgttacccttgggcctggcactggccaggggttttttcgggggccagaagtccatgttcaaaggggaaaagrgggtcacgaggatcaatcttttctcctgctttaaagaaatgtttttgctactgcatgccctgatagtcgccacaccagcagccgcctacctgggcagcaa

SEQ ID NO: 30467 - DNA, 201 bp, Homo sapiens
ataggttacttaagtgttttgtttacttgttttccataactgggtgttgttgacttttacaaaactgaaagcttttctgctttataatttaatcgtttttwaaaataaattttaagcttatattatgaagtgcacataaatctatagattccatcttcctggtgcattgatctttgtatcacctttttctactctttggtg

SEQ ID NO: 30468 - DNA, 201 bp, Homo sapiens
actgttgcatttacattttatactatttgtcttgctttttccatttttctcctagatcaatctagtttttaaaaatttcttgttttttttcgataggtttrgaaaacatacattcaattctattctttcagtagcctcccttaaaatcttactatgcagtatagccttaactaagtctaaagtgatcatgacctgtttctt

SEQ ID NO: 30469 - DNA, 201 bp, Homo sapiens
caattctattctttcagtagcctcccttaaaatcttactatgcagtatagccttaactaagtctaaagtgatcatgacctgtttcttccttctgagccatrcaaggaccttaatacactttcactcctgtcttacatgtcattgctatctggtattttggttctaatttttaataactctccaacttatcattaccattgt

SEQ ID NO: 30470 - DNA, 201 bp, Homo sapiens
aataatttttagggaatgatgagacagtagatggtagcttggtagctttttgtatgtatgtatgcatgtatgtatgcatgtatgtatgtatgtatgtatgyatgtatgtatgtatgtatgtatgtatgtatttttagacagagtctctctctgtcgcccaggctggagtgcagtggtgagatctcggctcactgcaagccc

SEQ ID NO: 30471 - DNA, 201 bp, Homo sapiens
tgctatctggtattttggttctaatttttaataactctccaacttatcattaccattgttattgttttatataatgactgcctgctcatatttacccccakatttactattttatttatttaccttttcttggcatcctgtttctaggctgaattttcttcttcctggcagggcgaggtggctcacacctgtaatcccagc

SEQ ID NO: 30472 - DNA, 201 bp, Homo sapiens
ccattttaatgtctaacttggtacaattcagaatgggaggagtgggaggatgggacacaggaaagtcatcctgcccagcagatgagagcgatccaggaatcctcacggtgagtgtgggcagcagcccctctgcctcccactccccactgcgtggattcttgtaagtttctctttctggttgacatcaactgtgtaagcaag

SEQ ID NO: 30473 - DNA, 201 bp, Homo sapiens
gtcagaaaggtaagtggtttgctcagtgttaccaataagtggcagaatcaagattcacaccttgtttttattttttctttttttttttgagacagagtctygctctgtcacccaggctggagtgcagtggtgcgatctcggctcactgcaagctccgcctcctcgattcatgccattctcctgcctcggcctccctagtag

SEQ ID NO: 30474 - DNA, 201 bp, Homo sapiens
ctcccatgtggctatccagtgggtccagcaccatttgttgaaagatgatcctttcctcattaaattatgtcggtgcctttgtaaaaaatgaattgctggcygggcgtgctggctcacgcctgtaatcccagcactttgggaggctgaggcaggtggatcaccaggtcaagagatcaagaccatcgtggctaacatggtgaa

SEQ ID NO: 30475 - DNA, 201 bp, Homo sapiens
cctttgtaaaaaatgaattgctggccgggcgtgctggctcacgcctgtaatcccagcactttgggaggctgaggcaggtggatcaccaggtcaagagatcragaccatcgtggctaacatggtgaaaccccttctctactaaaaatacaaaaattagctgggggtggtggcaggtgcctgtaatcccagctactcaggagg

SEQ ID NO: 30476 - DNA, 201 bp, Homo sapiens
ctgaggcaggagaatcacttgaacccagggggcagaggttgcagtgagccgagattgtgccactgcactccagcctggtgacagagcgagactctgtctcaaaaaaaaaaaaaaaaaaaaaaagaattgcctgtgtatgtatggaccaatcgctaggctcctttttttctgatcctttgtctatccttatggtctcaccac

SEQ ID NO: 30477 - DNA, 201 bp, Homo sapiens
actgtaactttatggttagccttgaaattagataatttaagtttttcaactttgctgtttttcaagattgttttgggtatttaatgtcctttcaatttctrtataaatttagagtcatcctgttaatttttattaaaaaaatgtttaaagtgtgccggattatattgaatctataggttaatctggagagaagggatgtct

SEQ ID NO: 30478 - DNA, 201 bp, Homo sapiens
gcacaaattttgttacacttattacctagtatttaaagtttttggacgatattgcaaatggaagttttttttaaattttatgttttgtttgttgcttttayaaaattagtttttatattttgatcttgtattcttcagccttgctaaattcacttattagttgtagtaatagtgttttttttttttttttgagggggcaga

SEQ ID NO: 30479 - DNA, 201 bp, Homo sapiens
tgtccaacaatgatagactggattaagaaaatgtggcacatatacaccatggaatactatgcagccataaaaaatgatgagttcttgtcctttgtagggayatggatgaaactggaaatcatcattctcagtaaactatcgcaaggacaaaaaaccaaacaccgcatgttctcactcatagatgggaattgaacaatgaga

SEQ ID NO: 30480 - DNA, 201 bp, Homo sapiens
tggggtggggggagtggggagggatagcattaggagatatacgtaatgctaaatgacgagttaatgggtgcagcacaccagcatggcacatgtatacataygtaactaacctgcacattgtgcacatgtaccctaaaacttaaagtataataaaaaaaaagttcctgcctgctaattgcaatactggggccatttctgtgt

SEQ ID NO: 30481 - DNA, 201 bp, Homo sapiens
tccttttggatgcaagtctcaagatgacaatagaataattgtccagtaaacaattgaatttgtaagtctgaagctcagggaaaaggtctcatttaataggwctggctgctacaacttgagtgagatgtgcacatgcagagtgaaggaatgctacctaggggactgagaactgacaaaagctggttggagttggatgttgac

SEQ ID NO: 30482 - DNA, 201 bp, Homo sapiens
tttacgtgggagagccctcactgaatttccaccagaaacaagtctattctgtagctcattcgtgttggtttggagtgtttgtgtgttccagggtgcatgctatgtgtgtgcatggtgtgtgtgcgtgtggtgtgtgtgtgtgtgtgtgtgtgtgtctgtgtgtctgtgtgtgtggttgtcctcctgcagcctcagttcagc

SEQ ID NO: 30483 - DNA, 201 bp, Homo sapiens
gagtatatagacactaagaaactgctggagggaaagaagaaagggaatgaatgaaagagcaatggtgaccatttttcaatcgtttggggattgaaaagacdtaacggtccctggaagtagacagggagaaaggggttgttagggacagaaaggagcagaatagcagagtgttatgccacagactccagggcaggctgcctg

SEQ ID NO: 30484 - DNA, 201 bp, Homo sapiens
ttaattaagaggaaatacctctaatattttgtcattaaaggctttatggtatgttttattgtctggtagcactagtacctccacatagctttattctaaaktgttttcctggctattcttttatgtttgttttttctgtatagactttagtgtcaacttgtttacctccataaaaagtttgttggtatttttattggaatt

SEQ ID NO: 30485 - DNA, 201 bp, Homo sapiens
ttctttttaaatagcgattttcttttgtcatttgttaatttatatacatgtctattatcttttttcttgatcaaattaactcatgatttgtctttctggayttttttaaaaatcaagatttcaatttatttattatgtttactgtttttatattctctactttatggatttctgcttttatccttgctattttatgacttc

SEQ ID NO: 30486 - DNA, 201 bp, Homo sapiens
gtatgcaggaggtttactggggagctctcgagcagccttggttaggaagtgagagaagcagagttgggcagtgggagaagttgaactgcttgtgatagcaytgatagagcttcagcggggcctcagctgatccttcaaggagctctggaaggtggagtggcccctgttggtcactggatgtgggctgccctgggtaaggag

SEQ ID NO: 30487 - DNA, 201 bp, Homo sapiens
attgggggagctgcaggtcctggggtataatcctggctgcgtagaaaagctgggggaagtttcaaaaagaagatgagtagggaggtcagggcaggagtggmggaggaaccatgtctagaactcttgaccgtgtgattgctctagggaatcgagtgccctgtcttagaggctgaatgttcacatcttctggggaggagaagg

SEQ ID NO: 30488 - DNA, 201 bp, Homo sapiens
tctcttaccaggaaggaatgctggtcagtacacacacacacacacacacacacacacacacacacacacacactctctctctctcactcactcactcactmactagctgggcatggtggcatgcacgcacgcacacacactagctgggcatggtggcacacgcgcgtgcacacacacacacacacacaaacacatactagc

SEQ ID NO: 30489 - DNA, 201 bp, Homo sapiens
attttgttacacttattacctagtatttaaagtttttggacgatattgcaaatggaagttttttttaaattttatgttttgtttgttgcttttataaaatyagtttttatattttgatcttgtattcttcagccttgctaaattcacttattagttgtagtaatagtgttttttttttttttttgagggggcagattccta

SEQ ID NO: 30490 - DNA, 201 bp, Homo sapiens
acacacacacacactctctctctctcactcactcactcactaactagctgggcatggtggcatgcacgcacgcacacacactagctgggcatggtggcacrcgcgcgtgcacacacacacacacacacaaacacatactagctgggcatggtggtgcaccagtaatcccagctaatgggagggctgaggtgggaagatggc

SEQ ID NO: 30491 - DNA, 201 bp, Homo sapiens
ccccgtccttgtccatccagccagcatgccctaatccctagaagctgctcagatgcctccaggagccccaaggagaaggtgaggagggtcccttagagagstccatggccaagtctcctacttctcatgagcactggaccccagctatcttagagagaggtatgtcaagctctgcagaaaccatccatttggtggaaatct

SEQ ID NO: 30492 - DNA, 201 bp, Homo sapiens
ctcctcccttttagttaaaaatgaggcttcctcgtgggaaaggggagcgttttggttcctaatgagagctttcttttgcagggaaaatcctggatgagctkttgcagacctgcgttgaccctgaagactgtccagtgtgtgaggtggctggccggcgttttgcctcaggaaagaaagtcaccttgaatcccagtgaccctg

SEQ ID NO: 30493 - DNA, 201 bp, Homo sapiens
ctgagttagaaaggaccctagggatcccctgacacaaccccctcatttttagatgaggaagctggggcccagagaatggaagcaaatgttccaaggaagtsagtagcagggctgggtgagagccagctctcccgattgctgatctaggtcctcagccactttgcaccatgttctgaaccctacaacatggggttggggtta

SEQ ID NO: 30494 - DNA, 201 bp, Homo sapiens
ggcccagagaatggaagcaaatgttccaaggaagtgagtagcagggctgggtgagagccagctctcccgattgctgatctaggtcctcagccactttgcaycatgttctgaaccctacaacatggggttggggttagaaggtgggagagacatccagaaaatgcacaagaagcccacttctgaacttagcctttgccctcc

SEQ ID NO: 30495 - DNA, 201 bp, Homo sapiens
ctaggtcttgcttcatctcagcctccacctgccacgtcctatctctgacctgcaaggctgctgcaggttccgtgggttctttcatcagagtcaggacagtygtgatttttctcaagtcgagctcctccaaaatgcttttctgtgcctatttatgggattctcacctaaagcagcccctgccgatagaactttctgcagtgg

SEQ ID NO: 30496 - DNA, 201 bp, Homo sapiens
atccccctcattcatagtgaagaagatcaaggtcagggaggggagctgaacaggtcagtgcagaaccgatgctgacagcattcctggactctgcagccacmcaggccaactccagggcgcatgctctttgtgcttctctccatcctctgtccgttcctaggacactgcccaccatggcaatccagggccttggactctgca

SEQ ID NO: 30497 - DNA, 201 bp, Homo sapiens
gatttgcatttctctgatggccagtgatgatgagcattttttcatgtgttttttggctgcataaatgtcttcttttgagaagtgtctgctcatgtccttcrcccactttttgacggggttgtttgtttttttcttgtaaatttgtttgagttcattgtagattctggatattagccctttgtcagatgagtaggttgtgaa

SEQ ID NO: 30498 - DNA, 201 bp, Homo sapiens
atcaaggtcagggaggggagctgaacaggtcagtgcagaaccgatgctgacagcattcctggactctgcagccacccaggccaactccagggcgcatgctstttgtgcttctctccatcctctgtccgttcctaggacactgcccaccatggcaatccagggccttggactctgcatttccaggactcagtctaggatgta

SEQ ID NO: 30499 - DNA, 201 bp, Homo sapiens
tgccccgtcctgccctgccggggatgaacggtctgtcctgggtggtgtcccttagggtgcttcggggctgtgtcacgtatgtgcggctttaccacacccasccagccagtgactacaaagccacgtgtcccggacccatttcctgaatggctcctgccctctgtcaaacgggcttcccaaagccccgtgtcctgcccctgc

SEQ ID NO: 30500 - DNA, 201 bp, Homo sapiens
gccttactcgtgctgtgtgtttcatcttccagtctcaatgggtgcctagttatggtcactgtccccaaattatcaggattaagtggggacttctgaggtcmccttgcaagaagtctcctctttccccagcccttccagtgattaaaagccatgcagacggataagcagtctgtgatggttccacagatgagctgagccggc

SEQ ID NO: 30501 - DNA, 201 bp, Homo sapiens
gtatcttggagaagggttaaggggcaatagtttggtgtcagaaagcccagaaaagagtgcttatgtgtttcggtctttcagtcagcctgaatgtcgctcarctacagggtagagagaggaaggaggagagcctgtccttgcagtgaggagctggttccattgggaagaacagagagtgcttaggtgatatctgtgaaggca

SEQ ID NO: 30502 - DNA, 201 bp, Homo sapiens
atgtgccctgtgctgggtggggcatttgattggggccaatttcatggggaaaaggaggagggatgggatggagggcaccatggctccttgctttgtcgtargactccacttgttttgagcctagaggagtttggtgtcactctgaaagggttttaggtgaaggggaggaaagaatgccaagttatacatggagagcaggcg

SEQ ID NO: 30503 - DNA, 201 bp, Homo sapiens
tgacaccagggcttttggggatggaagtgtggaggcgagagctggagggaggccagctggggcagaggcggtgcaagaggaggtgcagctaggggcccccyggtctccttcccctgggtgtgttatgtacgctttgtccccgtggggctggcggtccaggcagcaaggctccagccagcagaaatcacatcctctgtgtgc

SEQ ID NO: 30504 - DNA, 201 bp, Homo sapiens
ggcccagtgtgccctgctggtatggagtataggcagtgtgtgtccccttgcgccaggacctgccagagcctgcacatcaatgaaatgtgtcaggagcgatkcgtggatggctgcagctgccctggtaatgaacttcccactttatttacagatcagagaccttgccagcacccttggctttgggaagtgagatgaaggcca

SEQ ID NO: 30505 - DNA, 201 bp, Homo sapiens
atcccagcactttgggaggccgaagtgggcggatcatgaggtcaggagatggagactatcctggctaccacggtgaaaccccgtctctactaaaaatacaraaaatgagccaggtgtggtggcaggtgcctgtagtcccagctactcgggaagctgaggcaggagaatggcatgaaccttggaggcggagcttgcagtgag

SEQ ID NO: 30506 - DNA, 201 bp, Homo sapiens
tctttcttctttttctctgttggggtttcttcccctgggtaatatctctaagattcctttgtggccaaagctctgtcctgtacaattttaaccctatgaakattctgctagcaccagctcttttcttttcccacatcccttcgtttggggactgtgataactaccatgagctctaaatccatttgcatacccttgtgtttg

SEQ ID NO: 30507 - DNA, 201 bp, Homo sapiens
ggaggccgaagtgggcggatcatgaggtcaggagatggagactatcctggctaccacggtgaaaccccgtctctactaaaaatacaaaaaatgagccaggygtggtggcaggtgcctgtagtcccagctactcgggaagctgaggcaggagaatggcatgaaccttggaggcggagcttgcagtgagctgaaatcgcacca

SEQ ID NO: 30508 - DNA, 201 bp, Homo sapiens
gtgtctctctctatatatatttctttttctgtagagtagatagcaaagatgagagcaggtggaggaaatatatagggcaggttgggaagggatccagatgyccttttcagctttgatgggtccatgtttggccctgaagatgggattgcctcaagccaggcaggttgatggagaatcactggagacattggcagaggcctc

SEQ ID NO: 30509 - DNA, 201 bp, Homo sapiens
gcctgtagttccagctacttgggaggctgagacaggagaatggcgtgaacccgggagggagaacttgcagtgagcagtgatcgtgccgcttcactccagcytgggcgacagagcgagactccgtctcaaaaaaaaaagaaaacactaaagatgaatatttcaatcttctttaatttcaattacataaacattcaattagtg

SEQ ID NO: 30510 - DNA, 201 bp, Homo sapiens
tgcccacccttcggaagacccagtgctgtgatgagtatgagtgtgcctgcaactgtgtcaactccacagtgagctgtccccttgggtacttggcctcaacygccaccaatgactgtggctgtaccacaaccacctgccttcccgacaaggtaaggactgcttggctattaactatcagttaatagtttactcatttattta

SEQ ID NO: 30511 - DNA, 201 bp, Homo sapiens
agtgggcggatcatgaggtcaggagatggagactatcctggctaccacggtgaaaccccgtctctactaaaaatacaaaaaatgagccaggtgtggtggcrggtgcctgtagtcccagctactcgggaagctgaggcaggagaatggcatgaaccttggaggcggagcttgcagtgagctgaaatcgcaccactgcactcc

SEQ ID NO: 30512 - DNA, 201 bp, Homo sapiens
ggagatcctcttgtcaacctcccttttccagtaggaaataaagagccattatttctggagcaggagtaacttgccctaggcctcatggtcgtttagttacmgggcaaggaccagaactcgggtctcctggttcctgaccagtcttgcctcctgcaccccggtcttcaagggggtgcttcacgttagccagttcactttctt

SEQ ID NO: 30513 - DNA, 201 bp, Homo sapiens
ttatttctgcccatcctcctgtatgtcatcaaggggagggaatgtttccttgacttcccctcatcattggatcttattcccaaacaaatttatagtttttygcctctgaaggtgtatatatgtaatcactatatactgtaacttaaacatagcgatggactaaaataagacacgacaagaaaccaaattctgtatttacct

SEQ ID NO: 30514 - DNA, 201 bp, Homo sapiens
acccattaactcgtcatttagcattaggtatatctcctaatgctatccctccccactctcccaaccccacaacagtccccagagtgtgatgttccccttcstgtgtccatgtgttctcattgctcaattcccatctatgagtgagaacatgcggtgtttggttttttgtccttgcaatagtttactgagaatgatgatttc

SEQ ID NO: 30515 - DNA, 201 bp, Homo sapiens
ttttcttgtaaatttgtttgagttcattgtagattctggatattagccctttgtcagatgagtaggttgtgaaaattttctcccattttgtaggttgcctrttcactctgatggtagtttcttttgctgtgcagaagctctttagtttaattagatcccatttgtcaattttggctttcgttgccattgcttttggtgttt

SEQ ID NO: 30516 - DNA, 201 bp, Homo sapiens
tggagggagaaaggcacatgaaggcatggagaagtgacagggaaagggcatttcctcatcatctttcacctcatctccctcatcgtaattgtaaccgtccrtccatccatccatccatccatccatccatccatccatccatccatctatccatccatccttcttcagtctccaagcgtctgctgagctctgatgcccatg

SEQ ID NO: 30517 - DNA, 201 bp, Homo sapiens
agggctgggtcagggactggcccttgccggaggcagggagagctgacctctgtgaattctgggcttcgtacctagaatgtcctgtgccctttctgaacctygctttgccctcagttcctggaagcctgggtcccggaccaccagccctgtcagatctgcacatgcctcagcgggcggaaggtcaactgcacaacgcagccc

SEQ ID NO: 30518 - DNA, 201 bp, Homo sapiens
ggaaggtggagtggcccctgttggtcactggatgtgggctgccctgggtaaggaggtggaactcccttgggctgagggccattcctgaggaatgactcagyggtgagcccttggcagccaacactggacagctggtggatgagtcctcgggctctgaatgggcacctacgctgtgccccgacacctacgctgtgccccgac

SEQ ID NO: 30519 - DNA, 201 bp, Homo sapiens
ttagttgcactctatatatgtgtgtgtgtttgtgtaaatatgtatatatactgtatatgtgtgtatatatgtaattatatatgtgtgtgtatatatatgtrtatatatacacgtgtgtgtgtgtgtctgtgtgtctctgtgtgtgtgtatttagagataaggtcttgctaagttgcccaaactgatcttgaactcttgggc

SEQ ID NO: 30520 - DNA, 201 bp, Homo sapiens
ggggctgtgtgtaccttcgagaaggctgctctctgccctgggccgtctcccatttgaaaaatcagagaactgcactcaggcctctaaagtcactgcgggcrtcaagaatgtgatgctttcaagagttttgctgtcctccccaccgctcttcctaccctattgtctgaagtcaatttcagaaataaatggatttttttcccc

SEQ ID NO: 30521 - DNA, 201 bp, Homo sapiens
gtaaatcagccagaaccattccgtggttggtggtctcttaccaggaaggaatgctggtcagtacacacacacacacacacacacacacacacacacacacwcacactctctctctctcactcactcactcactaactagctgggcatggtggcatgcacgcacgcacacacactagctgggcatggtggcacacgcgcgtg

SEQ ID NO: 30522 - DNA, 201 bp, Homo sapiens
tgctatcatttattgagtgagtgaaaggtgtcaagggcaggaccagaggaattaatcctgaaggagggcagggcactttgggggaagggggccttacttgkgggtatttgatcttccttcttagctgactgattgctgactgtggaagtaataagtaagaccttcttgacctgggaacttcttagaggcctttgagctact

SEQ ID NO: 30523 - DNA, 201 bp, Homo sapiens
ataaagccctcaacacagtggcacacagcaggtggcatctgaatgttagctgctatcatttattgagtgagtgaaaggtgtcaagggcaggaccagaggarttaatcctgaaggagggcagggcactttgggggaagggggccttacttgggggtatttgatcttccttcttagctgactgattgctgactgtggaagtaa

SEQ ID NO: 30524 - DNA, 201 bp, Homo sapiens
aataaagccctcaacacagtggcacacagcaggtggcatctgaatgttagctgctatcatttattgagtgagtgaaaggtgtcaagggcaggaccagaggrattaatcctgaaggagggcagggcactttgggggaagggggccttacttgggggtatttgatcttccttcttagctgactgattgctgactgtggaagta

SEQ ID NO: 30525 - DNA, 201 bp, Homo sapiens
ttgcttttcctaccttcgaggcaaaaggagcctatcctgtcggccccccatggtcaagctggtgtgtcccgctgacaacctgcgggctgaagggctcgagygtaccaaaacgtgccagaactatgacctggagtgcatgagcatgggctgtgtctctggctgcctctgccccccgggcatggtgagtcaccaggcacagag

SEQ ID NO: 30526 - DNA, 201 bp, Homo sapiens
gcggcccgacccttacaaagtaccccttgtgctctgggtagaatggctttgtgtggtgggagaagaattcctttctcctcatggcctacacccccagagcragaaacaggcctctcttgtttatgaggctggtgtttgttttctggatgccccttcttggccctggggattcttcctgctgggctctgctatcccaagggc

SEQ ID NO: 30527 - DNA, 201 bp, Homo sapiens
ttcagtgctaccatccttttgagacaccccatttcctcccaaatacatctgcctgccaccaccctgtcctctccccacctctgcctgagtcctgtcctgcygggttccaggtgacctccgcatccagcgtacagtgacggcctccgtgcgcctcagctacggggaggacctgcagatggactgggatggccgcgggaggct

SEQ ID NO: 30528 - DNA, 201 bp, Homo sapiens
gtatgtatctatctatcaaatctatctcatgtatctagttatcattctatctatctatctatctatctatctatctatctatctatctatctatcctaacycatgtaatctctgtctccatcatcatcacttacctaaaacagtagaagtctgcatgaataggaatgtagcatcccactcacaggtaataaaagagtaacc

SEQ ID NO: 30529 - DNA, 201 bp, Homo sapiens
cagttcactttctttttgtttgttttgttttttgagagagggtctcactctgttgcccaggctggagggcagtggcacgatcttggctcaccacaacctcygccttccaggctgaagcgattctcctgcctcaacctcccgagtagctgagattacaggtgcccaccatcatgcccagctaatttttgtatttttaataga

SEQ ID NO: 30530 - DNA, 201 bp, Homo sapiens
atttgcagtgatgcagatattgaagggagagcagatagatcaggggacagtccaaggaactaaaagaaaatcatataatcggagaaacttatttgtactcrtgaaattgatcagaaataaatagaagtcctgtaggggagggagatgtggcttgagaacaattaatgtaaaggaggtcttagaatgttagcagtagagaga

SEQ ID NO: 30531 - DNA, 201 bp, Homo sapiens
tctgataatttctaaaatctcttgtggcagtacagggctctgatgatttgggaacagggatggagctggtaaatttacactgcagttcactttcccccgcmcccccttttgcagcctagggcttagctgccttttattacattcatatttatgtttcacccggggaacttttttttttttattaaaaccatctcattagct

SEQ ID NO: 30532 - DNA, 201 bp, Homo sapiens
ggcttcgtacctagaatgtcctgtgccctttctgaaccttgctttgccctcagttcctggaagcctgggtcccggaccaccagccctgtcagatctgcacrtgcctcagcgggcggaaggtcaactgcacaacgcagccctgccccacggccaaaggtgagagtcctcccctccctggtgccttcatggaggaacaagggc

SEQ ID NO: 30533 - DNA, 201 bp, Homo sapiens
caagggaaattcacatacaaaccctttgcttgtaactccaggcaaaccaccgatggacaaaacctctggcgttgtataaagttacctaaaggtgaattacrtcactgtccccagttggctttagattctcactctgcactgttggattcctggcaccagaggtggtatctattgtgctcacttttttgtttttgttattgc

SEQ ID NO: 30534 - DNA, 201 bp, Homo sapiens
ttaaggctgcagtgagttatgatcgcaccactgcactctgacctggccaacagagaaagaccctgtgtgtgtgtgtgtgtgtgtgtgtgtgtgtgtgtgtrtacatatatatatatataaagtagatggtcctgttggaagaggagttatgagaaacagtgaaaggaattagcatctatatttcaggagcagtgtaggcat

SEQ ID NO: 30535 - DNA, 201 bp, Homo sapiens
gcacttcagtttcttccttagcatttgctatttagaaattggggaaagtaatgaggagtgaatgagatgctgcttgtgaatattctttgcttgtccaccartgttagaaatgatgcattatcagtatgtggcagcatccgcaggatttcttaatttaggacattctcctggaatgctaagggcccactgaaatattcttta

SEQ ID NO: 30536 - DNA, 201 bp, Homo sapiens
caacacatttattatcatatggttctagaggtcggaaagctaaaattggtgggcagggctgcattcatcttagaggctctgagagaggtcccttttcttgscttttttacattccggaggctgcctgcattcttggcttgtggccccatcctccatattcaacgctggcaatgtagcatcttctactttttttctcctttt

SEQ ID NO: 30537 - DNA, 201 bp, Homo sapiens
agctacaaggggtggcaagtcctagaaccacagtccttgctgtccaacattcccgctgaggccttacttcttctcctctctcttctagagctgaactgccygaaaggccaggtgtacctgcagtgcgggaccccctgcaacctgacctgccgctctctctcttacccggatgaggaatgcaatgaggcctgcctggagggc

SEQ ID NO: 30538 - DNA, 201 bp, Homo sapiens
tcatatggttctagaggtcggaaagctaaaattggtgggcagggctgcattcatcttagaggctctgagagaggtcccttttcttgccttttttacattcyggaggctgcctgcattcttggcttgtggccccatcctccatattcaacgctggcaatgtagcatcttctactttttttctccttttctgcttctgtctgt

SEQ ID NO: 30539 - DNA, 201 bp, Homo sapiens
cgtgcccaaggcccagtgcccctgttactatgacggtgagatcttccagccagaagacatcttctcagaccatcacaccatgtggtaagtgcaggcagcastgtcagggacctctaaaacagcagagctggggaggaaaacgggacccccaagtcctttacttcatggatgggtaaactggggcccaaggaaggaagtgac

SEQ ID NO: 30540 - DNA, 201 bp, Homo sapiens
tctgaacctatatacatttacaaattcaaaagtttgaatttttttttttttttttttgagacggagtctcgctctgtcacccaggctggagtgcagtggcrcgatctcggctcactgcaagctctgcctcctgggttcacgccattctcctgcctcagccttccgagtagctgggactacaggcacccgccaccatgcctg

SEQ ID NO: 30541 - DNA, 201 bp, Homo sapiens
gcaggtgccttagctttctcattggaaaagtgagggcagtggtaaaacatatcctcaccgtaggactgcagtgaggattacatgagtgatttaaataaagycctcaacacagtggcacacagcaggtggcatctgaatgttagctgctatcatttattgagtgagtgaaaggtgtcaagggcaggaccagaggaattaatc

SEQ ID NO: 30542 - DNA, 201 bp, Homo sapiens
ctgtagacccagccacttgaaatactgaggtgggaagattgcttgagcccaggaagccaaggctgcagtgaactgtgatcgcgccactgcattctagcccrggcgacagagggaaatccagtcaccagacacagtacctgatagtctactagggaagaccagttagaaacatcccaattggccaggcacagtggctcacgc

SEQ ID NO: 30543 - DNA, 201 bp, Homo sapiens
tttgggaggctgaggcaggtggatcacttgaggtcaggaattcgagacccagcctggccaacgtggtgaaatcctgtctctactaaaatacaaaaattagytgggtatggtggcacatgcctatagtcccaactatttgggaggctgaggcaggagaatcacttaaactcgggaggcagaggttgcaatgagccgagatca

SEQ ID NO: 30544 - DNA, 201 bp, Homo sapiens
cactgcattctagcccgggcgacagagggaaatccagtcaccagacacagtacctgatagtctactagggaagaccagttagaaacatcccaattggccasgcacagtggctcacgcctgtaatcccaacacttagggaggctgaggtgggcggatcacgaggtcagtagatcgagaccatcctggctaacacggtgaaaa

SEQ ID NO: 30545 - DNA, 201 bp, Homo sapiens
ttgactcctctgctgtgtggctggaatagttttttaaaaaagctgtaaatattacatcatttcacctgcaaacacttcagtatgtatttcaataaataaaygattaaaaaagtaaaggtaccattattaacctgaacatgaacaataattccttaataacgtctaacattcaatccatgttcacttctttttttttttttt

SEQ ID NO: 30546 - DNA, 201 bp, Homo sapiens
cccgccaccatgcctggctaattttttgtatttttagtagagacagggtttcactgtgttagccagggtggtctccaactcctgacctcgtgatctgcccycctcggcctcccaaagtgctgggcttacaggtgtgagccactgtacctggcctgaagtttttaaagttacctatttgtaactaaattgatttctaaattt

SEQ ID NO: 30547 - DNA, 201 bp, Homo sapiens
tcttatttcctcaacctgactgtcagccattcgagggctaggacggtgtgttcagacctgcccatgatgggcactgtgtttgctgatgagaagcagttgtrctgcaagaggctaggcctgtggtgtctggggccagaatgctaagttcgaagcctggatgtgccacttggtcaaatttcttaacttcttggtgtctcagtt

SEQ ID NO: 30548 - DNA, 201 bp, Homo sapiens
cagattttcacgaatgagtcttatttcctcaacctgactgtcagccattcgagggctaggacggtgtgttcagacctgcccatgatgggcactgtgtttgytgatgagaagcagttgtactgcaagaggctaggcctgtggtgtctggggccagaatgctaagttcgaagcctggatgtgccacttggtcaaatttcttaa

SEQ ID NO: 30549 - DNA, 201 bp, Homo sapiens
attcagattttcacgaatgagtcttatttcctcaacctgactgtcagccattcgagggctaggacggtgtgttcagacctgcccatgatgggcactgtgtytgctgatgagaagcagttgtactgcaagaggctaggcctgtggtgtctggggccagaatgctaagttcgaagcctggatgtgccacttggtcaaatttct

SEQ ID NO: 30550 - DNA, 201 bp, Homo sapiens
caatttatttttctcattcagattttcacgaatgagtcttatttcctcaacctgactgtcagccattcgagggctaggacggtgtgttcagacctgcccaygatgggcactgtgtttgctgatgagaagcagttgtactgcaagaggctaggcctgtggtgtctggggccagaatgctaagttcgaagcctggatgtgcca

SEQ ID NO: 30551 - DNA, 201 bp, Homo sapiens
ttccacggtgtgtgtgtatcacaatttatttttctcattcagattttcacgaatgagtcttatttcctcaacctgactgtcagccattcgagggctaggayggtgtgttcagacctgcccatgatgggcactgtgtttgctgatgagaagcagttgtactgcaagaggctaggcctgtggtgtctggggccagaatgctaa

SEQ ID NO: 30552 - DNA, 201 bp, Homo sapiens
cacttcttttctgcctggcttccttcacccagcataacgcttttgggattcatccatgatgctgtctgttttgatagttttctccttctcattgctaggtrgtattccacggtgtgtgtgtatcacaatttatttttctcattcagattttcacgaatgagtcttatttcctcaacctgactgtcagccattcgagggcta

SEQ ID NO: 30553 - DNA, 201 bp, Homo sapiens
tcctgcagctgtcccccgtctatgccgggaagacctgcggcctgtgtgggaattacaatggcaaccagggcgacgacttccttaccccctctgggctggcrgagccccgggtggaggacttcgggaacgcctggaagctgcacggggactgccaggacctgcagaagcagcacagcgatccctgcgccctcaacccgcgca

SEQ ID NO: 30554 - DNA, 201 bp, Homo sapiens
gtgcctgtgcggcgccctggccagctatgccgcggcctgcgcggggagaggcgtgcgcgtcgcgtggcgcgagccaggccgctgtggtgcgtgccctcccwgcccgcagccctccgggccgccccccaaatccgtccacgtgtgcttttcgaagccctttctctgcgttgtttcctgtggaaagagggcgtagggcattgt

SEQ ID NO: 30555 - DNA, 201 bp, Homo sapiens; identical to SEQ ID NO: 5851

SEQ ID NO: 30556 - DNA, 201 bp, Homo sapiens
tcagtatgtatttcaataaataaacgattaaaaaagtaaaggtaccattattaacctgaacatgaacaataattccttaataacgtctaacattcaatccrtgttcacttcttttttttttttttgagactgaattttgctcttgttgcccaggctggagtgcagtggcacaatctcggctcgctgcaacctccacctctg

SEQ ID NO: 30557 - DNA, 201 bp, Homo sapiens
tgttcacttcttttttttttttttgagactgaattttgctcttgttgcccaggctggagtgcagtggcacaatctcggctcgctgcaacctccacctctgrggttcaagcgattctcttgcctcatcctcccgagtagctgggattacaggcacctgccaccacgccccgctaatttttgtattttagtagagacggggtt

SEQ ID NO: 30558 - DNA, 201 bp, Homo sapiens
cacttcttttttttttttttgagactgaattttgctcttgttgcccaggctggagtgcagtggcacaatctcggctcgctgcaacctccacctctggggtycaagcgattctcttgcctcatcctcccgagtagctgggattacaggcacctgccaccacgccccgctaatttttgtattttagtagagacggggtttcgc

SEQ ID NO: 30559 - DNA, 201 bp, Homo sapiens
gagtacttggcacatcatgtgcaggtcaggtattcacacctgctatccccgcccttctgcctctgtgcagatagactaaaatccttatacacattcattargacacatgtctgcagatgttcagcacagctttgtttgtggtggtaaggagcaggtgacaacctatgtcaatcactgggacactgagtgggtaaaaggtgt

SEQ ID NO: 30560 - DNA, 201 bp, Homo sapiens
cttctgcctctgtgcagatagactaaaatccttatacacattcattaggacacatgtctgcagatgttcagcacagctttgtttgtggtggtaaggagcargtgacaacctatgtcaatcactgggacactgagtgggtaaaaggtgtattgtgcaacagaagtcacagacaagtggtccgtgtcttcacagggatgaatc

SEQ ID NO: 30561 - DNA, 201 bp, Homo sapiens
aaatttttctataatggtggtgaatttgtcactttcttcatgtaattctgtcaaattttgctttgtgtgtgtgtgtgtgtgtgtgtgtgtgtgtgtgtgtrtgtatatatatttctttctttctttctttctttttttttttttttaaagacagagtcttgctctgtcacccaggccggattgcagtggtgagatctcagc

SEQ ID NO: 30562 - DNA, 201 bp, Homo sapiens
ctatgtcaatcactgggacactgagtgggtaaaaggtgtattgtgcaacagaagtcacagacaagtggtccgtgtcttcacagggatgaatcttacaaacwcggtgctcgatgggaaaagcaaaacacagcatgctatgtgatatcatttatacaaactaaacatacatacaaagcaaccacagacgttttataaaaatat

SEQ ID NO: 30563 - DNA, 201 bp, Homo sapiens
atttttctataatggtggtgaatttgtcactttcttcatgtaattctgtcaaattttgctttgtgtgtgtgtgtgtgtgtgtgtgtgtgtgtgtgtgtgtrtatatatatttctttctttctttctttctttttttttttttttaaagacagagtcttgctctgtcacccaggccggattgcagtggtgagatctcagctc

SEQ ID NO: 30564 - DNA, 201 bp, Homo sapiens
acaagggctaaacacggatagcaatggaggtggtgctggtaatgggggcatggaggaggggaggctcttctgtctcctccctgccaaagtcagggagggasttgttaggaaaatgcctggggttgatcctcacaggatctgacaaaaatataagaacttagcttacaggagtgccataggaagcaaagaatttccagaaaa

SEQ ID NO: 30565 - DNA, 201 bp, Homo sapiens
cactacagcctccacctcccagattcaagcgattcttctacctcagcctcctgagtagctgggactacatccaggtgtcaccacgcctggctaatttttgwatttttagtagagatgaggtttcagcatgttggccaggctagtcttgaactcctgacctcaagtgatctctccgcctctgcctcccaaagtgctgggatt

SEQ ID NO: 30566 - DNA, 201 bp, Homo sapiens
  misc_feature (1)...(201): n = A,T,C or G, or insertion/deletion polymorphism (see Tables 1-2)
actgtggcagcagggttgactcttacggggatcattagggatagggaggcagtattgtgtaatggccttgcattcagatagctcttggttcaaatcctgcntctgtcatgtattatctgtgggattaaacatcaaagtgttgttaccacattattattatgattgttattactattgtctttatgattatagtcatttaag

SEQ ID NO: 30567 - DNA, 201 bp, Homo sapiens
gggaacccagaacacttagagatttactgctgtatttccccacctgccgacacacacacacccatagtcagtgaaggagttagcctgtgacgccggaggakttcacacttcagagagtctatgtgtcaggcacacagtctgatctgtttaaaatttaacatgcccaagacatgctagtagatttatgtacaaagatgctca

SEQ ID NO: 30568 - DNA, 201 bp, Homo sapiens
aggagaatggcatgaaccttggaggcggagcttgcagtgagctgaaatcgcaccactgcactccagcctgggcgacagagtgagactccgtctcaaaaaawatatatatatatatattgaatctttctagggaattgttcctttaatgtaatgactctcatttttaccagtgctttttgccttcaatctgtctgatattag

SEQ ID NO: 30569 - DNA, 201 bp, Homo sapiens
tcgtatgacctggaattccagttaggatcaaataagatggaagatatatatatacatatacatatatgtatatgtgtgtgtgtgtgtgtatatatatatayacacacacacacacatatatatgtatatatatacacacatacactctgcatgtagaatttttatgtaaattaatgcatggtcctttccattagtatttct

SEQ ID NO: 30570 - DNA, 201 bp, Homo sapiens
gaaacaaacttttttgtcatgaaggaaaaaatacagatagccttaaatattagtaaccacaataattatattatgaccccaaatccaaaaaagaggacagygggacctcaaatacaggctgtggctatcctgttaggcgctcatttcattcctgaagcactgggcatgcattctgaggacagcacttggatacctgtcacg

SEQ ID NO: 30571 - DNA, 201 bp, Homo sapiens
aacatttgtgtatagatttctacaccccgccgcattttttattgtgctatgatacatgtaacataaaatttactatctttttttttttttttttttttttkgagtcggagtttcactcttgttgcccaggctgcagtgcaatggtgtgatctcagctcactccaacctccgcctcccgggctgaagcaattctccagtctc

SEQ ID NO: 30572 - DNA, 201 bp, Homo sapiens
cagatttgcaagatggaatcacttttagatagcataaaattgtgaatttagtgccagtttctggcactggtggagaattgggattggcatcaggattgttyactcggaaggtattatgagtccaatgcctaaaccctgtaagctttccaaagggaaacatttatggcctaaattaggtcttttgaaaatatttaaggccta

SEQ ID NO: 30573 - DNA, 201 bp, Homo sapiens
aacaaacttttttgtcatgaaggaaaaaatacagatagccttaaatattagtaaccacaataattatattatgaccccaaatccaaaaaagaggacagcgrgacctcaaatacaggctgtggctatcctgttaggcgctcatttcattcctgaagcactgggcatgcattctgaggacagcacttggatacctgtcacgtg

SEQ ID NO: 30574 - DNA, 201 bp, Homo sapiens
gtctgctcctccgtgcctgagggccagaagtgttgagggctgaatgcctcctgaagcagccttgacaataactgacaggaaggagtaagtgtagaaactcycctgctccctgacccaagagtgggaagattcagaggcatggatcttacattttcccagacttccctccagaaggaagctttcttgtccacttggtggctg

SEQ ID NO: 30575 - DNA, 201 bp, Homo sapiens
gggaggctgcttagctctgatggtgcttccagacccatcatttgtcagtggttgtgctgcttgacagtaacccccatagggagaggttggctcaggcttgrctatgagtgagggatgttagtggggcctccctgctccaccgaatctgtgtctcagctcttgggcatgtattcacctgccattgtagatgtggtcgtggtt

SEQ ID NO: 30576 - DNA, 201 bp, Homo sapiens
tttattattattatttttttctttttgagatggagtctcactctgtcgcctaggctggagtgcagcggcgtgtctcggctcacagcaacctccgcctgccrggttcaagcaattgtcctgcctcagcctcctgaataactgggactacaggcgcccgccaccatgcctggctaattttttgtatttttaatagagacgggg

SEQ ID NO: 30577 - DNA, 201 bp, Homo sapiens
cattgtgaagctcccatcttcctctgctttcttgcagggcaaatgtgccagcaaagccatgtactccattgacatcaacgatgtgcaggaccagtgctccygctgctctccgacacggacggagcccatgcaggtggccctgcactgcaccaatggctctgttgtgtaccatgaggttctcaatgccatggagtgcaaatg

SEQ ID NO: 30578 - DNA, 201 bp, Homo sapiens
atcacattcccacttccctgccgatgcttcctgtcctcccaaatcaattatctacactaaaatactcagggtctgcttctgggacttcaaactaagacacygcatatagaattctccacaaatggacttcttctctcagcacttctctttggatcttctaattctatcatgtttcttaattctgcctccattttttttttt

SEQ ID NO: 30579 - DNA, 201 bp, Homo sapiens
gtgtccatgtgttctcattgctcaattcccatctatgagtgagaacatgcggtgtttggttttttgtccttgcaatagtttactgagaatgatgatttccratttcatccatgtccctacaaaggacatgaactcatccttttttatggctgcatagtattccatggtgtatatgtgccacattttcttaatccagtctat

SEQ ID NO: 30580 - DNA, 201 bp, Homo sapiens
tgatactcacttctgcaaggtcaatgagagaggagagtacttctgggagaagagggtcacaggctgcccaccctttgatgaacacaagtgtctggctgagrgagtgagtactcattctgctttcctctttactgtctcaatctctaagaacaagattcttctgaatagtgtgcatcccagctccggcataatttctcagtg

SEQ ID NO: 30581 - DNA, 201 bp, Homo sapiens
tggtgccctgcaggtcggctcccagtgggcctccccggagaacccctgcctcatcaatgagtgtgtccgagtgaaggaggaggtctttatacaacaaaggwacgtctcctgcccccagctggaggtccctgtctgcccctcgggctttcagctgagctgtaagacctcagcgtgctgcccaagctgtcgctgtggtaaggc

SEQ ID NO: 30582 - DNA, 201 bp, Homo sapiens
gccaggctgcagtatgtcaaggtgggaagctgtaagtctgaagtagaggtggatatccactactgccaggtaagggctctgcttcaataagggctgggtgyggagggctgagcctccgtgttcggatacctatccttagttacattctagaaggatctggaaaattcgcagggaagagaagggaaataaactggaagcatt

SEQ ID NO: 30583 - DNA, 201 bp, Homo sapiens
ctccagccctgccccagcttgttggactaactctggtgccctgcaggtcggctcccagtgggcctccccggagaacccctgcctcatcaatgagtgtgtcygagtgaaggaggaggtctttatacaacaaaggaacgtctcctgcccccagctggaggtccctgtctgcccctcgggctttcagctgagctgtaagacctc

SEQ ID NO: 30584 - DNA, 201 bp, Homo sapiens; identical to SEQ ID NO: 5860

SEQ ID NO: 30585 - DNA, 201 bp, Homo sapiens
ttctgagtctaaagctccctggcaccctatagcatagctgaatacttacgagccctggctgggcgcagtgctcagtgtggccttgtcctatcctcagcctkcaggaaggaggagtgcaaaagagtgtccccaccctcctgccccccgcaccgtttgcccacccttcggaagacccagtgctgtgatgagtatgagtgtgcc

SEQ ID NO: 30586 - DNA, 201 bp, Homo sapiens
gccatcgtgccgtcagcccgctgccctacctgcggaactgccgctacgacgtgtgctcctgctcggacggccgcgagtgcctgtgcggcgccctggccagytatgccgcggcctgcgcggggagaggcgtgcgcgtcgcgtggcgcgagccaggccgctgtggtgcgtgccctccctgcccgcagccctccgggccgcccc

SEQ ID NO: 30587 - DNA, 201 bp, Homo sapiens
ccaccacatcccaggctcgctcctctcgccccacagccaggttctccgaggaggcgtgcgcggtcctgacgtcccccacattcgaggcctgccatcgtgcygtcagcccgctgccctacctgcggaactgccgctacgacgtgtgctcctgctcggacggccgcgagtgcctgtgcggcgccctggccagctatgccgcgg

SEQ ID NO: 30588 - DNA, 201 bp, Homo sapiens
ggcctgcgcggggagaggcgtgcgcgtcgcgtggcgcgagccaggccgctgtggtgcgtgccctccctgcccgcagccctccgggccgccccccaaatccrtccacgtgtgcttttcgaagccctttctctgcgttgtttcctgtggaaagagggcgtagggcattgtgacaaacacgggtggggaggacggttcatttgc

SEQ ID NO: 30589 - DNA, 201 bp, Homo sapiens
ctgggtgcttctgggtgagatcagacctgccttgcttggagggggtcagggagaaagcaggctgccccagagccctgcctaagccaggacttcccaccatygtgaagctcccatcttcctctgctttcttgcagggcaaatgtgccagcaaagccatgtactccattgacatcaacgatgtgcaggaccagtgctcctgct

SEQ ID NO: 30590 - DNA, 201 bp, Homo sapiens
tcccggaccaccagccctgtcagatctgcacatgcctcagcgggcggaaggtcaactgcacaacgcagccctgccccacggccaaaggtgagagtcctccyctccctggtgccttcatggaggaacaagggcccctgcaaggccccccagccacccatcttcacctctggcagagcagactcaaacactggcacctagagt

SEQ ID NO: 30591 - DNA, 201 bp, Homo sapiens
tctggtggaccccgagccttttgtggccctgtgtgagaagactttgtgtgagtgtgctggggggctggagtgcgcctgccctgccctcctggagtacgccyggacctgtgcccaggagggaatggtgctgtacggctggaccgaccacagcgcgtgcagtaagtcggccccctgccccgtcctgccctgccggggatgaac

SEQ ID NO: 30592 - DNA, 201 bp, Homo sapiens
gtgggtgactgtggaccgaccactcgtgtagagcatgctgggcatggggcggagccaacagcagcctcctcagtccccacctcacacccgggctggcccasagaggcaggcagtgtgctggggacacagggcatgcagaccaggcagggaacctatgatccggggggatatgcgcccctttagagctttcccagagattct

SEQ ID NO: 30593 - DNA, 201 bp, Homo sapiens
ttatctcacacctgagctgggactggagtgttctgtccgctggaggagggctgggcttccatagacccacacctgggtgacaggagggtctccctgggccrtgaacgcatggtgggttgtcccatgggttgaatatcatggcgagaggtaaaaacatgcagcatgcagaccaagaggcctgggagcccccagcccggcctg

SEQ ID NO: 30594 - DNA, 201 bp, Homo sapiens
aaaaatacagatagccttaaatattagtaaccacaataattatattatgaccccaaatccaaaaaagaggacagcgggacctcaaatacaggctgtggctrtcctgttaggcgctcatttcattcctgaagcactgggcatgcattctgaggacagcacttggatacctgtcacgtgacgaggtgactcgcacttcagcca

SEQ ID NO: 30595 - DNA, 201 bp, Homo sapiens
acaataattatattatgaccccaaatccaaaaaagaggacagcgggacctcaaatacaggctgtggctatcctgttaggcgctcatttcattcctgaagcrctgggcatgcattctgaggacagcacttggatacctgtcacgtgacgaggtgactcgcacttcagccacaggggattctaacttgcaggttcatattgta

SEQ ID NO: 30596 - DNA, 201 bp, Homo sapiens
atattgtaagagattcggttattttcacaactgcttccttacgatgccggcgagtgtgcaaattattgcggccagattcgagagagcagagaagtccgtgyaatttattaagggtgcgcagcgtgccgcctgcagcacgggacacgtgttcttggctataacacaaagaaaatggagctgggcctggaaacaccctgtttg

SEQ ID NO: 30597 - DNA, 201 bp, Homo sapiens
ggaccccgagccttttgtggccctgtgtgagaagactttgtgtgagtgtgctggggggctggagtgcgcctgccctgccctcctggagtacgcccggaccwgtgcccaggagggaatggtgctgtacggctggaccgaccacagcgcgtgcagtaagtcggccccctgccccgtcctgccctgccggggatgaacggtctg

SEQ ID NO: 30598 - DNA, 201 bp, Homo sapiens
tgtgcaaattattgcggccagattcgagagagcagagaagtccgtgtaatttattaagggtgcgcagcgtgccgcctgcagcacgggacacgtgttcttgrctataacacaaagaaaatggagctgggcctggaaacaccctgtttgggcccatctgatggtgcagacatcatccctcggggtgttcctctgtccagtctg

SEQ ID NO: 30599 - DNA, 201 bp, Homo sapiens
atttttctcaggtttgtcaaagatcagatagttgtagattatttctgtgtcttttgactcttgcttagagtggactgtttcatcatgtttcataattttcrattgtgaactcatctttgaagggttttgtgttaatatttcaatatggagttactaaatcttataagaagtataaataggaatctcaaatccatatgaggg

SEQ ID NO: 30600 - DNA, 201 bp, Homo sapiens
attcgagagagcagagaagtccgtgtaatttattaagggtgcgcagcgtgccgcctgcagcacgggacacgtgttcttggctataacacaaagaaaatggrgctgggcctggaaacaccctgtttgggcccatctgatggtgcagacatcatccctcggggtgttcctctgtccagtctgtcccttgtgaaggggcagggt

SEQ ID NO: 30601 - DNA, 201 bp, Homo sapiens
tcctctgcccagttcaagtggttcttctgcctcagcctcctgagtagctgggattacaggcatccacccccacgcctggctaatttttgtagttttagtaraaacagggtttcaccatgttggacaggctgatcttgaactcttgacctcaagtgatccacctgcctcggcctcccaaagtgcaagaattatagatgtgag

SEQ ID NO: 30602 - DNA, 201 bp, Homo sapiens
gcagcacgggacacgtgttcttggctataacacaaagaaaatggagctgggcctggaaacaccctgtttgggcccatctgatggtgcagacatcatccctyggggtgttcctctgtccagtctgtcccttgtgaaggggcagggttgtgggatgtcactaagggcttggggaaggggtcacggattctgcattcttctgag

SEQ ID NO: 30603 - DNA, 201 bp, Homo sapiens
ctgatcttgaactcttgacctcaagtgatccacctgcctcggcctcccaaagtgcaagaattatagatgtgagccactgtggccagcccattgtttcttaragtagattttttttcttgtgaactttctcatggagggtgttgtcatcctttaagggtcccagcttcacaatgggggtctcaggatctccttcctacatca

SEQ ID NO: 30604 - DNA, 201 bp, Homo sapiens
tgttgtggccacagccttgtctcctgtctacacagcccagagctgcgaggagaggaatctccgggagaacgggtatgagtgtgagtggcgctataacagcygtgcacctgcctgtcaagtcacgtgtcagcaccctgagccactggcctgccctgtgcagtgtgtggagggctgccatgcccactgccctccaggtgaggc

SEQ ID NO: 30605 - DNA, 201 bp, Homo sapiens
actaagggcttggggaaggggtcacggattctgcattcttctgaggacttgacaggggaaagggaagtggctttttcccgggggcagatctgcggggggcwgaaagagcaggaatggggtgcagagggcagacccgtcaggccaggcttccctgctttcccactccatgctcttgtgcaatccttcagtctttaccggaag

SEQ ID NO: 30606 - DNA, 201 bp, Homo sapiens
ttgagcactgtatgcatgcttattgtttaatttaatacaagtttgattcaggtaaaaacagacctagagcctggtgtggtggcccacacctgcattcccasctactggggaggctgatgggggaggattgcttgagcccaggtgttctgggctgcagagcactatgcatcaatatgggggcctcctggggagtgggggaca

SEQ ID NO: 30607 - DNA, 201 bp, Homo sapiens
aaaaatattttcagctgggcgcagtggctcacgcctgtaatcccagcactttgggaggctgaggcgggcggattacgaggtcaggagatcgagaccatccyggtaacacggtgaaacgctgtctctactaaaaatacaaaaaattagctgggcgtggtggcgggcgcctgtagtcccagctacttgggaggctgaggcagg

SEQ ID NO: 30608 - DNA, 201 bp, Homo sapiens
tactatatacatttcttaaagttctttttttttttttttgggacagtatctcactctattggctaggctggagtgcgcgattatggctcactgcaacctcracctcctgggctcaaggggtcctccctcctacctcagcctcctgagtagctgtgaccacaggcatgcaccgccaggcccagctaattttttatttttatt

SEQ ID NO: 30609 - DNA, 201 bp, Homo sapiens
ggattgtgtggcctctgatttttcaggtttttctggaccctgactttcccgtttgctttatttttatgtctccagtcactttccaagcacctttccatttytttttgctcccagtccccttgaaactatgcttttcaggttgtcaccaaatattgcgtgtgtttttagcacctgctctggtctgttgggatacttcaaaat

SEQ ID NO: 30610 - DNA, 201 bp, Homo sapiens
gaggcgggcggattacgaggtcaggagatcgagaccatcccggtaacacggtgaaacgctgtctctactaaaaatacaaaaaattagctgggcgtggtggygggcgcctgtagtcccagctacttgggaggctgaggcaggagaatgccgtgaacccaggaggcggaggttgcagtgagctgagattgcaccactgcactc

SEQ ID NO: 30611 - DNA, 201 bp, Homo sapiens
ttcagtgtcttgcaaggaccttcttgctgtgacctgaagccgggtcctgtggctcattcctgtaatcccagcactttgggaggccaaggtgggtggatcaygagatcaggagatcgaaaccatctgggcgcctgtagtcccagctactcgggagactgaggcaggagaatgacgtgaacccaggaggcggagcttagcact

SEQ ID NO: 30612 - DNA, 201 bp, Homo sapiens
gactgctcctagtgtctgtcgggaccggaagtggaactgcacagaccatgtgtgtgatgccacgtgctccacgatcggcatggcccactacctcaccttcracgggctcaaatacctgttccccggggagtgccagtacgttctggtgcaggtgagaggtggggagatggggagagggtgctgtttctttctaggaggggt

SEQ ID NO: 30613 - DNA, 201 bp, Homo sapiens
aggaggcggaggttgcagtgagctgagattgcaccactgcactccagcctgagcgacagagcgagactccgtctcaaaaaaaaaaatttcttttttttttwaaaatttttttgagacggagttttgctctgtcacccaggctgcagtgcagtggcatggtctcggctcactgcaacccccacctcccaggttctagtgatt

SEQ ID NO: 30614 - DNA, 201 bp, Homo sapiens
gcagcggcattccctgtctttgggctcatgacttcaatttctgcctctgtggtcacatggccttctcctctcctgtgtgtgctaatgcctgccaaccctgrcaaggctgggaggactgccccaccccttccacagagccctgttgccacttacaaggtagccttgtagcagctctgtctgcatcagagttgccattcatga

SEQ ID NO: 30615 - DNA, 201 bp, Homo sapiens
tgatgacattcagcccacacagataatccaggttaaactcttcatcccatgggagccactgttttgccttccataatcctggtgcagattatatcctagcrggaatgttactatagatagtttgggctgatgagccctgtgaagaggggatgtaagagcagaatctttggggaagggagggaatgagtcatgccagtatct

SEQ ID NO: 30616 - DNA, 201 bp, Homo sapiens
tttgtgcctctctgtgtgtgggtgtttggggcaagaatgctttatgtggggcaagacctcactcaatgggtaattccctccccactgtggaacaggctgayttgggctgaggaggtaggtgcagctgtgaagctggactcctgtggggaacaggggttgttgcccttttgggattgtgctcagagactcatcatctgagga

SEQ ID NO: 30617 - DNA, 201 bp, Homo sapiens
tgtgtcttccatgtatttgtttttttattgctgctataacaaatcaccaaaaacttgatagcttaaaacaacacatttattatcatatggttctagaggtyggaaagctaaaattggtgggcagggctgcattcatcttagaggctctgagagaggtcccttttcttgccttttttacattccggaggctgcctgcattct

SEQ ID NO: 30618 - DNA, 201 bp, Homo sapiens
aggcccagctaattttttatttttattttttgtagagatggggtcttgctgtgttgtgtaggctagtctcaaattactgagcacagacaatcctcttgccwctgcctcccaaagtgttaggattacaggtgtgagcctccacgtctggccttaaagttctttttcaagttttcctcctgttctttcttttttttttttttt

SEQ ID NO: 30619 - DNA, 201 bp, Homo sapiens
tatgttactaatgagaggacctctgcaaagggatgatggcagttctcagcctcagcctcagtctgatgaattggagagtccgccacacatgctgaaatggkcctccagggtacagcactggcagggattgggctaagtcagaggctcaggtcagagcccttcttgaacctgcagtgtgtgattcccagcactagcactgag

SEQ ID NO: 30620 - DNA, 201 bp, Homo sapiens
ttatgtggggcaagacctcactcaatgggtaattccctccccactgtggaacaggctgacttgggctgaggaggtaggtgcagctgtgaagctggactccygtggggaacaggggttgttgcccttttgggattgtgctcagagactcatcatctgaggagcaaggttccttggtggtgctgtgagtcagcctccctgggc

SEQ ID NO: 30621 - DNA, 201 bp, Homo sapiens
ctcccttccagcaccctgggcagtgcacagtctgcaggtgttgtgcagtggccctggacagggggatggttgaaatgacccctggagtttgcttcccacgrtatggctttgtggaattctccgccattttaatgtctaacttggtacaattcagaatgggaggagtgggaggatgggacacaggaaagtcatcctgcccag

SEQ ID NO: 30622 - DNA, 201 bp, Homo sapiens
gtattctgtgttccttcattgcctccatggcccagatgggcccctcaaacccaaggtgcccaacttgtcatctctgccatgactgctcctagtgtctgtcrggaccggaagtggaactgcacagaccatgtgtgtgatgccacgtgctccacgatcggcatggcccactacctcaccttcgacgggctcaaatacctgttc

SEQ ID NO: 30623 - DNA, 201 bp, Homo sapiens
ggctgcctggctcactttggacaaccccttcccttctttgcctcagtttcccccttttagggacagccactaggcttccctgtctcctgctgggccccatrctgggcctatgaagtccacactccacgctacaggtcctcaacttccttgggcttcctggagggttgggaggcacccagagtattctgtgttccttcattg

SEQ ID NO: 30624 - DNA, 201 bp, Homo sapiens
cggcgccctggccagctatgccgcggcctgcgcggggagaggcgtgcgcgtcgcgtggcgcgagccaggccgctgtggtgcgtgccctccctgcccgcagycctccgggccgccccccaaatccgtccacgtgtgcttttcgaagccctttctctgcgttgtttcctgtggaaagagggcgtagggcattgtgacaaacac

SEQ ID NO: 30625 - DNA, 201 bp, Homo sapiens
ccagatgggcccctcaaacccaaggtgcccaacttgtcatctctgccatgactgctcctagtgtctgtcgggaccggaagtggaactgcacagaccatgtktgtgatgccacgtgctccacgatcggcatggcccactacctcaccttcgacgggctcaaatacctgttccccggggagtgccagtacgttctggtgcagg

SEQ ID NO: 30626 - DNA, 201 bp, Homo sapiens
gagccagtggggataatggtcttctcctggcactcctctttccccaggattactgcggcagtaaccctgggacctttcggatcctagtggggaataagggmtgcagccacccctcagtgaaatgcaagaaacgggtcaccatcctggtggagggaggagagattgagctgtttgacggggaggtaagtgcagcctcatctc

SEQ ID NO: 30627 - DNA, 201 bp, Homo sapiens
gatattaaatatgctcaataccaacctctgtcctggtttcaaacagcaggaaattatccaaccacgatgtgattaggaaaccaaacaataaaaagtgtgtrttgatcctatatctttataactaattataatctttaatttctccacattttccctttgtgtccaggagtgatcatacctctatgccctttctttctaaag

SEQ ID NO: 30628 - DNA, 201 bp, Homo sapiens
aaaaattctgggattatgtgattacgttctttctgttttttgggggtacgaaggtggaaagggtcaaaagaactataatttgtttttcttctgaaagcaamgctaataatttttagggaatgatgagacagtagatggtagcttggtagctttttgtatgtatgtatgcatgtatgtatgcatgtatgtatgtatgtatgt

SEQ ID NO: 30629 - DNA, 201 bp, Homo sapiens
gtccctctcttgggggtcacacagtggggaagtctgcctgcatccagggccgctggactcctgtccattttttcagatgaactcagcaaacatttgctggrcatctcctgggtgctaagcatcttgccaggtgctggggttggaggcaagggagacagcctttgctcttgtgaaggcacttgtggtacagagtcaggggcc

SEQ ID NO: 30630 - DNA, 201 bp, Homo sapiens
tcacttccatgctctctcctccctcccttgcttcttccaagcccctgccacacccttaacactgttgcccccttcggcttattttctgcctcctttccctyttcttccaaatctttcttctcgcataactgccctccacctttccttttcttggcctaactttgccctctgcctcctgctgtggggattttgcctccctga

SEQ ID NO: 30631 - DNA, 201 bp, Homo sapiens
cccagagggacagctcctggatgaaggcctctgcgtggagagcaccgagtgtccctgcgtgcattccggaaagcgctaccctcccggcacctccctctctygagactgcaacacctggtaatgggggctgcgcagcgtgctctgggagacctgcctgggggactggggagggaagctgggtcagcaggggtggtggcaggt

SEQ ID NO: 30632 - DNA, 201 bp, Homo sapiens; identical to SEQ ID NO: 5803

SEQ ID NO: 30633 - DNA, 201 bp, Homo sapiens
cgacgtgtgctcctgctcggacggccgcgagtgcctgtgcggcgccctggccagctatgccgcggcctgcgcggggagaggcgtgcgcgtcgcgtggcgckagccaggccgctgtggtgcgtgccctccctgcccgcagccctccgggccgccccccaaatccgtccacgtgtgcttttcgaagccctttctctgcgttgt

SEQ ID NO: 30634 - DNA, 201 bp, Homo sapiens
ggtcctcctcttaccactgtttgctgaatgccacaaggtcctggctccagccacattctatgccatctgccagcaggacagttgccaccaggagcaagtgkgtgaggtgatcgcctcttatgcccacctctgtcggaccaacggggtctgcgttgactggaggacacctgatttctgtggtgagtctccaagttacctctg

SEQ ID NO: 30635 - DNA, 201 bp, Homo sapiens
ctcttacccggatgaggaatgcaatgaggcctgcctggagggctgcttctgccccccagggctctacatggatgagaggggggactgcgtgcccaaggccyagtgcccctgttactatgacggtgagatcttccagccagaagacatcttctcagaccatcacaccatgtggtaagtgcaggcagcagtgtcagggacctc

SEQ ID NO: 30636 - DNA, 201 bp, Homo sapiens
tcctcacaggctggccctggcccagggaatgcactttgagcagccctgttctcagccgaagattgtctctcctcctctaaggtgcctctcagtgtccaccrtatgcccagaagcacctgtttgaaaatattggcgggggcagagaaagaacccctctctttctggtttgtcccaggcctggcacctgcttagagcagaggt

SEQ ID NO: 30637 - DNA, 201 bp, Homo sapiens
tgaagatgtggaggcagcgagtatagacgagtctcgtgaagctcggctatgattttcttctctgcagctactgtgaggatggcttcatgcactgtaccatragtggagtccccggaagcttgctgcctgacgctgtcctcagcagtcccctgtctcatcgcagtgagtactgtccccctggaaggcccattgactccatcc

SEQ ID NO: 30638 - DNA, 201 bp, Homo sapiens
ttaacaagcgagaggtttaaaaaaagcggaacctcataagtcttcataggaggagtcatcacgctcagcaggagtgctttaatcagatcactctcctcctygcaagcttctggctgagttcagctgctttggcctgaaagtactgatggggtaggagaatgaacgagaggcagttggaaggtaaaaaagattctggagagt

SEQ ID NO: 30639 - DNA, 201 bp, Homo sapiens
tcagctgctttggcctgaaagtactgatggggtaggagaatgaacgagaggcagttggaaggtaaaaaagattctggagagtgggtcacgatggtgttcaygtatggagagttggggacaatggggccttttcagagaaaggtaacaagaccagtattttcctactttataattttcttggagtggaccaacacgtaggac

SEQ ID NO: 30640 - DNA, 201 bp, Homo sapiens
ccacctctgacgcacaagtgggcttcttgatgtcagctctggttacgggtggtggcagggagggacacgtggcagtgggcagatcactatagattttaacrtgtagctacatacatcttaacgtgtagctatgcacacaggactgctcctggcagaagtgcgtacttcatcactcttttctatactctgggctttcccact

SEQ ID NO: 30641 - DNA, 201 bp, Homo sapiens
tgaaatggaggacacagaggcatcttgtgcacagcctctgtaaatcagccagaaccattccgtggttggtggtctcttaccaggaaggaatgctggtcagyacacacacacacacacacacacacacacacacacacacacacactctctctctctcactcactcactcactaactagctgggcatggtggcatgcacgca

SEQ ID NO: 30642 - DNA, 201 bp, Homo sapiens
tgcaaattattgcggccagattcgagagagcagagaagtccgtgtaatttattaagggtgcgcagcgtgccgcctgcagcacgggacacgtgttcttggcyataacacaaagaaaatggagctgggcctggaaacaccctgtttgggcccatctgatggtgcagacatcatccctcggggtgttcctctgtccagtctgtc

SEQ ID NO: 30643 - DNA, 201 bp, Homo sapiens
cccactgttctgtcttgtttttcccattagcctcaggctttcaacatcagtgtgtctgttttacagacaccctgtggccaatctcaggtagatgtggcttycagggtgaggctgagcgaattcataacaggaggcctaaagagcatccgggcctcctccctggctgcctggctcactttggacaaccccttcccttctttg

SEQ ID NO: 30644 - DNA, 201 bp, Homo sapiens
ccgtggttggtggtctcttaccaggaaggaatgctggtcagtacacacacacacacacacacacacacacacacacacacacacactctctctctctcacwcactcactcactaactagctgggcatggtggcatgcacgcacgcacacacactagctgggcatggtggcacacgcgcgtgcacacacacacacacacaca

SEQ ID NO: 30645 - DNA, 201 bp, Homo sapiens
caaagttgaccccgtgtatatttgtaggatctggggcagtgtgtgtctgtgcacatgtgaacgtgtacatgtgaatgtgtgcagtggccctgtccttcatscttgacagtgatactacagaccgtggtagagatagaagcatatttggcttctaggaaaggagaatgtgttttgtgatcatggactgcactcaagacctaa

SEQ ID NO: 30646 - DNA, 201 bp, Homo sapiens
cgggaccggaagtggaactgcacagaccatgtgtgtgatgccacgtgctccacgatcggcatggcccactacctcaccttcgacgggctcaaatacctgtyccccggggagtgccagtacgttctggtgcaggtgagaggtggggagatggggagagggtgctgtttctttctaggaggggtgggaggtgtggcctcaggt

SEQ ID NO: 30647 - DNA, 201 bp, Homo sapiens
tgggctttgcaggttcttaaggtttctttaagttctaaaaccctttattagcctggtgcggtggctcatacctgtagacccagctgctcaggaggctgagkcaggaggatcacttgagcccaggaggtagaggctgcagtgagctacaattgcaccactgcactccagcctgggcaacagagtgagaccctgtctataaaa

SEQ ID NO: 30648 - DNA, 201 bp, Homo sapiens
gctggggtcagaagagctgccaccaatgtaagccagaggtcagaagcccaggtgagaagatgccctcccagtcccacacagggaccctggctcaggcagcygctggtccccgtgagtgggcaactctgagtctcttgaatttagtcacagactctaggggaccaaaggacagtgtggaaggtaggtccattctctccttca

SEQ ID NO: 30649 - DNA, 201 bp, Homo sapiens
atgctgggcatggggcggagccaacagcagcctcctcagtccccacctcacacccgggctggcccagagaggcaggcagtgtgctggggacacagggcatrcagaccaggcagggaacctatgatccggggggatatgcgcccctttagagctttcccagagattctatatggaagtttcccagcctcagcagcaaaagag

SEQ ID NO: 30650 - DNA, 201 bp, Homo sapiens
tggagtgctgtggcatgatcttggctcactgcagcctccgcttcccgggttcaagcgattctcctgcctcagcctccagagtagctgggactacaggtgcrtgccaccatgcccagctgatttttgtatttttagtagagatggggtttcaccatattggccaggatggtcttgatctgttgaccttgtgatccacccacc

SEQ ID NO: 30651 - DNA, 201 bp, Homo sapiens
gcgcaaagtagatagaaatccctggcttcatggaacatgcgttctagtgggcccagtggcttggggaggacagtaaacaagtaagtgagatgtgtagtatrtcagatggtgagaagaacatatataggatatcagaggggaagcagcagggaggggagattggagtgtccagggatggagtgttgcgggtgttgcaaattc

SEQ ID NO: 30652 - DNA, 201 bp, Homo sapiens
tccctggctgcctggctcactttggacaaccccttcccttctttgcctcagtttcccccttttagggacagccactaggcttccctgtctcctgctgggcmccatgctgggcctatgaagtccacactccacgctacaggtcctcaacttccttgggcttcctggagggttgggaggcacccagagtattctgtgttcctt

SEQ ID NO: 30653 - DNA, 201 bp, Homo sapiens
tgtgtgttgtatggacatatgtatgcatgtatgtgtgcatgtgtgtatgcatgagcatgtctgtgtgggtgtatgcatgtgcgtgtgtgtgggtgtatgcrtgtgcgtgtgtgtgactgtgtatgagtacatgggtgtatgtgtgtgtatgcgtgagcgcgtgtgtgtgtatggctacgtgtgtgtatgtatgtgtatgct

SEQ ID NO: 30654 - DNA, 201 bp, Homo sapiens
tagagaaacccagccctctcctattccagaaacaaaataaaacacacccacatctccctcctcccacccaccccccatcacagtaacacgaggaagcttcsttttagctggttattaattcagtgagtcttcatcttcatggaacaatttgacctctgaccaaggagaatgtcagacccagaaaaatattctgagttgatg

SEQ ID NO: 30655 - DNA, 201 bp, Homo sapiens
gatcccgagggcatgggtggctcaaaggttgagaccagaacttgtgacctcaagatcactccatccttctgtgtcttcttctgtccctctcagagagtttyccccacacccactctctgttgcattctgcctctcagacctaccttccgtgcttctgctcagaatcttctagtctggtcactggaaaatgtaatatttttc

SEQ ID NO: 30656 - DNA, 201 bp, Homo sapiens
attttggacttcagagttttggattaggaatgctcagcttgtatttctgttcagggagatgggccccagggaagacagggacctcgccccaccagtcattrcatttgggccaagctgccagtgggcacggggtctggagggtcctttcgttgcaggccttacactgcccatgagcacttcgtgagtgtgcttgcagtggcg

SEQ ID NO: 30657 - DNA, 201 bp, Homo sapiens
atgtgcgtgtgtgtgactgtgtatgagtacatgggtgtatgtgtgtgtatgcgtgagcgcgtgtgtgtgtatggctacgtgtgtgtatgtatgtgtatgcygtgtgtgtgtgtatgagtacatgggtgtatgtgtgtgcatctgtgtatgtgtgagcacgtgtgtgagtgtgtgtatgagtacatagatgtatgtatatgt

SEQ ID NO: 30658 - DNA, 201 bp, Homo sapiens
atagtacctgctgggtcactgaaaaggtaagagagggataatatgtatagagtttagcccagtggggctcaactgttaagagccatgatgatgatgaggargaggaggaggacgagaaggaggaggaggaggaggaggaggagttgttgttagctggctccccatattctcccactgtcccgtgttttccgctggagtgcc

SEQ ID NO: 30659 - DNA, 201 bp, Homo sapiens
ttatccgaaatgcttgggaccacaactgttttggattttggattattttggactttgaaatatttgcatatacataatgaggtgtcttagggatgggaccyaaatctaaacatgacatttatttatggttcatatataccttatacacgttgcctgagggtaagtttatacaacattttaaatatgtatttaatgtgtatt

SEQ ID NO: 30660 - DNA, 201 bp, Homo sapiens
gcgtgtgtgtgtatggctacgtgtgtgtatgtatgtgtatgctgtgtgtgtgtgtatgagtacatgggtgtatgtgtgtgcatctgtgtatgtgtgagcaygtgtgtgagtgtgtgtatgagtacatagatgtatgtatatgtgtgtttgagtgtatgcatgtgcctgtgtgtatttgggtgtatgtgtgtgtgtgggtgt

SEQ ID NO: 30661 - DNA, 201 bp, Homo sapiens
ggaaccagccttccttctagagcggtttgtgaacccagatggatttcaaattgagtgcactcgaggtattgtgtaagagaggacagattttcggccgggcrcggtggctcacgcctgtaatcccagcactttgggaggctgaggtgggtggatcacgaggtcaggagattgagaccatcctggctaacatggtgaaacccc

SEQ ID NO: 30662 - DNA, 201 bp, Homo sapiens
gaggagaattggctttggtcgggggatcatgagtttagttttgaatatactgagtttgaggtgtgtttgagactcactacattagtgagaccatgtaggcrtttgagtatatgggtctggggttcaaaggagcggtccgagctgctgatgtagatttatgagtcatgtctgtgattggaactggggatggcagcagagtgt

SEQ ID NO: 30663 - DNA, 201 bp, Homo sapiens
ctttgggattctctgggtgtttttagctgggctattgttacctgctcttctctcccaagtcaggaagtctcatgctgtgtcctggaaaccctttcctctcrttgaagattatgttttgtctcctctccagctctcttatgacctaactccacaccactgtggccttcatagcagtcctcacttaatatcaaggtcctatta

SEQ ID NO: 30664 - DNA, 201 bp, Homo sapiens
ggtcgggttgaggagggagactgggaggtttgtctcctggagacaaaagggagggagaatgcaagagaagccttgtttgcctcccggggcacctttctgargctccagctgtaccctagctactcgctttgtctcctgggtgcattaaagtccttactaaccagtgtcctgggaacagctgaaaaaactgggtaccaggtt

SEQ ID NO: 30665 - DNA, 201 bp, Homo sapiens
agtggatatgaatttcagtggtatgttggaggccaagtccaagggcttgatgatgaatcagatacagaggatgagggagaagacagtggcagggatgatcytgggtttctggttgcgaagccagatggatggcgtcaccattcagtgaatcagccctggaggagaattggctttggtcgggggatcatgagtttagttttg

SEQ ID NO: 30666 - DNA, 201 bp, Homo sapiens
ccttttgatgtcccgaagggacaaacactagacggaggtggttctcttcattttaactgtgaggtttaagtgacttgccacaaaatttggccagggactgytgtgctggcctgccccgcctctctgcacagctcccctctgggtccaatccatcccctaaattacccctttatttccaggcctatctacctccatgaattt

SEQ ID NO: 30667 - DNA, 201 bp, Homo sapiens
ggtgagtgatgggacgagtatttttgccaggctttcttctgaagtcttcaggggacattcatagactttatcttagtagccttttgatgtcccgaagggasaaacactagacggaggtggttctcttcattttaactgtgaggtttaagtgacttgccacaaaatttggccagggactgttgtgctggcctgccccgcctc

SEQ ID NO: 30668 - DNA, 201 bp, Homo sapiens; identical to SEQ ID NO: 5818

SEQ ID NO: 30669 - DNA, 201 bp, Homo sapiens
tgcctcccggggcacctttctgaggctccagctgtaccctagctactcgctttgtctcctgggtgcattaaagtccttactaaccagtgtcctgggaacarctgaaaaaactgggtaccaggttcttcgtgttgggctgaggccacaaacacgtgagacctcccagaggcacaagctcctcccagctcagaactcccggtt

SEQ ID NO: 30670 - DNA, 201 bp, Homo sapiens
tgaagatgtcatgagttggtgagtgatgggacgagtatttttgccaggctttcttctgaagtcttcaggggacattcatagactttatcttagtagccttytgatgtcccgaagggacaaacactagacggaggtggttctcttcattttaactgtgaggtttaagtgacttgccacaaaatttggccagggactgttgtg

SEQ ID NO: 30671 - DNA, 201 bp, Homo sapiens
gtgtagtcccgcagggcccccaggttcagaagtccggtctggtaaatgccgcatcatttatgagtgtctgctgttgtggctccaagggccgttcagggtgrcagagtgttctgtgtgggagttcacactgaccttgaaactttccttgacagcctccagaatctacttccccaaccctctggtgctttctgtctttctagg

SEQ ID NO: 30672 - DNA, 201 bp, Homo sapiens
cctgctaccaccactaggtgacagcaaagcacaactcactgccctgctcacccttcctgagtccggcggcaagggtaactctgggagcatcgtagagggcrgagaagaagaaaccctgaggtcccattatgtcagccccttctatcacacgggaggagactgaggacagaaagggaacagagccgggtcaagccttcatag

SEQ ID NO: 30673 - DNA, 201 bp, Homo sapiens
tgggaatgaggaggatgggggtccctttgctaagtggtccgcaccgtgataaatgaagggcagagaaaccgcctggaaacggcatggtatcggaacctcayacttccaggtttgaatcctgcctcctaacatctacttaagtgagtggcaagtcacttaacatcttggcgtcttaattttcttatctgtaaaactggcttg

SEQ ID NO: 30674 - DNA, 201 bp, Homo sapiens
tctgcccacctcggcctcccagagtgctgggattacaggcatgagccactgtgcctggccactgaattcttgaaactgaaattttcaagagtagcgtttcrttgtttcataaacccaaacatcctcccattcatcccatctcttaaatgtaaattcacataagcaagcgctgtcacttggagaacgtacggggctcttctc

SEQ ID NO: 30675 - DNA, 201 bp, Homo sapiens
agagtgcagtggcactattttggttcactgcaaccttggcctcctgggttcaagcacttttcctgcctcagcctccgagtagctgggattacaggcgtgcrccaccacactcggctaatttttgtatttctagtagagatgtggttttgctatgttggctgggctggtcttgaactcctgacctcaagtgatctgcccacc

SEQ ID NO: 30676 - DNA, 201 bp, Homo sapiens
caggctacccatgtgcagtcttcgtggacagattgcagggctgcaggggtcccaggccagccttcccgggcttctgccagctccctgtctccccttaccaygggaagtggcaccagcctgggaaatgggttgagcttcccggctgcaccttcccactgatggcccacagtgctgcttcttggccggagtatctgagctcag

SEQ ID NO: 30677 - DNA, 201 bp, Homo sapiens
cccgggacggggaggagggcagattggggccactccagggaccagcgttgaccttggtttcatctcattccctgccctttgctttccccactgggcatttyacccagctgttggtgttatccagatgccagctgggatgacctgccccttaggaaccagttaagacggcctcagccttcccattttgtagattttgggaga

SEQ ID NO: 30678 - DNA, 201 bp, Homo sapiens
atcataggtgcacagtaaatgactagaatcttggctgataaaagcctggagacagctcactgcacactgctgggaggtgggcggtgatatcagtaggtctygtggagactgggtggggttgagccaagtctcaggagtgttgagaccgtccagagagaggcacacgtgttgtgcatcttcagattcggccctgctggggag

SEQ ID NO: 30679 - DNA, 201 bp, Homo sapiens
ctgagaccttgttttttttctttaatggcattttgaatgttctgctgtatcttggagggtgtgtacacagattgaggcatcctaatttgttgtctcctccrtagtacctagtacatcataggtgcacagtaaatgactagaatcttggctgataaaagcctggagacagctcactgcacactgctgggaggtgggcggtga

SEQ ID NO: 30680 - DNA, 201 bp, Homo sapiens
gggagccatccgtaatattgacactgtttgcccatggtgagaggcaacaggaaacaaaaataatatgcgaatctcgatcattcagccttctagagaggcgyacgagaatgacagcagatccctaaaggtattaattactgtcttctgtgttctttgagtctttgtttctgaccccctgagaccttgttttttttctttaat

SEQ ID NO: 30681 - DNA, 201 bp, Homo sapiens
agcaaggcagggctgcatgaaatccatcgaggtgaagcacagtgccctctccgtcgagctgcacagtgacatggaggtgagaagtactttctgtggatccrtggtaaggcaatagaatgtcaggaaaaccacctggacctggtggcagttgcttttagttgatgctcttgttaggagctctgccttctgcttaagtggagg

SEQ ID NO: 30682 - DNA, 201 bp, Homo sapiens
ctcagtacctttgggagaggatgacgctgtggtatccaggtgttcctgtgggaaacactaagttttggaaaccctttggttttcttctcctctcacaggcsatctgaggccagggaaataacttgctgtcaaataaagagagtgctgcttagaggtcatttttagaaaattgacaaccaatatatttcgtgtttcagtggg

SEQ ID NO: 30683 - DNA, 201 bp, Homo sapiens
agcatggctgtccccggcactgtgatggcaacgtgagctcctgtggggaccatccctccgaaggctgtttctgccctccagataaagtcatgttggaaggyagctgtgtccctgaagaggcctgcactcagtgcattggtgaggatggagtccagcaccaggtaggagcctgggcctttcacttcccatggggctgcttcc

SEQ ID NO: 30684 - DNA, 201 bp, Homo sapiens; identical to SEQ ID NO: 5823

SEQ ID NO: 30685 - DNA, 201 bp, Homo sapiens
ttctgaaggcaaggaccagggctggccatctctgcctccctgggcctagcatagcccctggcatgcagtggatacacaagaagtgtctgctaaactgagawgtgcattgtttctttggggaagaaggctaaaggagaaatttaataaggctccaagccagccctagagatagcctatcagaacaaagaaagttctcaagtc

SEQ ID NO: 30686 - DNA, 201 bp, Homo sapiens
tgaaaattctggtttcctaacataattaactacttatttgctttatcttgcaatatacctgtaatagtttcaaaactaacctgtaatcctagcactttggsaggccaaggtgggcgggttacctgaagttgggagttcaagaccagctggccaacatggtgaaaccccatctctactaaaaaatacaaaaaattagttggg

SEQ ID NO: 30687 - DNA, 201 bp, Homo sapiens
cctccagataaagtcatgttggaaggcagctgtgtccctgaagaggcctgcactcagtgcattggtgaggatggagtccagcaccaggtaggagcctgggyctttcacttcccatggggctgcttccctcttgggtcaaaagggagatatgttcaccagtgattggcctcttccaactgtggcagcagggttgactcttac

SEQ ID NO: 30688 - DNA, 201 bp, Homo sapiens
gggtcagggagaaagcaggctgccccagagccctgcctaagccaggacttcccaccattgtgaagctcccatcttcctctgctttcttgcagggcaaatgkgccagcaaagccatgtactccattgacatcaacgatgtgcaggaccagtgctcctgctgctctccgacacggacggagcccatgcaggtggccctgcact

SEQ ID NO: 30689 - DNA, 201 bp, Homo sapiens; identical to SEQ ID NO: 5832

SEQ ID NO: 30690 - DNA, 201 bp, Homo sapiens
ggacctgccagagcctgcacatcaatgaaatgtgtcaggagcgatgcgtggatggctgcagctgccctggtaatgaacttcccactttatttacagatcaragaccttgccagcacccttggctttgggaagtgagatgaaggccacttgtgtttgctccccgttgctgaaatcagaagccttttattaagtttttaaatg

SEQ ID NO: 30691 - DNA, 201 bp, Homo sapiens
tctctgcagctactgtgaggatggcttcatgcactgtaccatgagtggagtccccggaagcttgctgcctgacgctgtcctcagcagtcccctgtctcatygcagtgagtactgtccccctggaaggcccattgactccatcctgcccagattcctcacgtgtggaatggcgggagagagctgggtgacaccgtcagatgt

SEQ ID NO: 30692 - DNA, 201 bp, Homo sapiens
cttgttacaagtcctggggacgtttagcctacagcatctgaaggtaagtaaacaataagtaaacaaccagccggactgggtttaactcagcaacggtccgytgaggacagagcaaatttgactttggcatccctggagtggcctctcagtttcagaagttttttccagtgtcttacccaaaaccgcattcaggaagggttc

SEQ ID NO: 30693 - DNA, 201 bp, Homo sapiens
gtggtgcgatctcggctcactgcaagctccgcctcctcgattcatgccattctcctgcctcggcctccctagtagctgggactacaggcgcccgccaccaygcccggctaattttttgtattttagtagagacggggtttcaccgtgttaaccaggctggtctcgatctcctgacctcgtgatccgcccgcctcagcctcc

SEQ ID NO: 30694 - DNA, 201 bp, Homo sapiens
tgcgatctcggctcactgcaagctccgcctcctcgattcatgccattctcctgcctcggcctccctagtagctgggactacaggcgcccgccaccacgccyggctaattttttgtattttagtagagacggggtttcaccgtgttaaccaggctggtctcgatctcctgacctcgtgatccgcccgcctcagcctcccaaa

SEQ ID NO: 30695 - DNA, 201 bp, Homo sapiens
ggttcacgccattctcccgcctcagcctcccgagtagctgggactacatgcgcctgtcaccacgcccagttaattctttatattttttagtagagacgggktttcaccgtgttagccaggatggtctcgatctcctgatctcatgatctgcccgcctcggcctccgaaagtgttgggattacaggcgtgagccaccgcgcc

SEQ ID NO: 30696 - DNA, 201 bp, Homo sapiens
aagctgctaatagaaaatccgttccaacctgaagcacattgcaaattcctagaactttctggagagctgaattgaggaatttcaggatggagattttttcyccttcagtatcaagaatccaaagaaagattttcactgggaaagaaagcagttgtggtcttgaagcagatatgatccagagcaagtcatttaaccgtccaa

SEQ ID NO: 30697 - DNA, 201 bp, Homo sapiens
aaaggcacccctttctcaagaaacttcaccaccacctgccgggaaacggccaagataaacataataactgaacatataatgtacatgtatatacctctacmatgtctaccatatgaacagtagtcacttggtgtgttgccactgtgtggactgtgtggcttgcatcatgacatgtgatggtgttggcctggcttcctcagg

SEQ ID NO: 30698 - DNA, 201 bp, Homo sapiens
ggagtgggccagagggcagaaaagaggactgagtcagaacttgggggaatgttcagagggcaagaggaagaaaaagaggattgcatgagagaggccaaagrtcaaaggccagtaaaaagggcagaaccagagcagtgccatatcatggaaatgaagggcagaagggagtaaggacctcctctgcaggactgctgacttggc

SEQ ID NO: 30699 - DNA, 201 bp, Homo sapiens
tttttctttttatctttctctgatgattttattatctgaaattcttagggatttaattcttgctcatggtagattgttttctcaagtgttgaaaaatttgygattttgaattcatcgtcaagagagctttatttgcatgagtgcaaaggatgaaaattctagactgggcgtggtggctcacgcctgtaatcccagcacttt

SEQ ID NO: 30700 - DNA, 201 bp, Homo sapiens
ggttcttagcagggagcaaataggatccaagagtaacttcagggggtgggttttgggagctgcatgaggtatgatggcagggagagcatctgcaggaaaaygttgacgttgaccgataagaaggtagcgaggccttggatcaagcgatagcagtagaaatggagagtggaagccagaagccagagacgctgggaaagcaga

SEQ ID NO: 30701 - DNA, 201 bp, Homo sapiens
tctctgatgattttattatctgaaattcttagggatttaattcttgctcatggtagattgttttctcaagtgttgaaaaatttgtgattttgaattcatcrtcaagagagctttatttgcatgagtgcaaaggatgaaaattctagactgggcgtggtggctcacgcctgtaatcccagcactttgggagaccgaggtggg

SEQ ID NO: 30702 - DNA, 201 bp, Homo sapiens
taccttcgaggcaaaaggagcctatcctgtcggccccccatggtcaagctggtgtgtcccgctgacaacctgcgggctgaagggctcgagtgtaccaaaaygtgccagaactatgacctggagtgcatgagcatgggctgtgtctctggctgcctctgccccccgggcatggtgagtcaccaggcacagagctggtgcctg

SEQ ID NO: 30703 - DNA, 201 bp, Homo sapiens
tgaagcaggagaatggcgtgaacccgggaggcgaagcttgcagtgagccgagatcgcaccactgcactccagcctgggcgacagggtgagactctgtctcmaaaaaaaaaaaaaaaaaaaaagagttaagtctttgagacacccttgctgggcgcttcccagccatcttgcagacctcagccctaggcagccctcctttac

SEQ ID NO: 30704 - DNA, 201 bp, Homo sapiens
tgcttttcctaccttcgaggcaaaaggagcctatcctgtcggccccccatggtcaagctggtgtgtcccgctgacaacctgcgggctgaagggctcgagtrtaccaaaacgtgccagaactatgacctggagtgcatgagcatgggctgtgtctctggctgcctctgccccccgggcatggtgagtcaccaggcacagagc

SEQ ID NO: 30705 - DNA, 201 bp, Homo sapiens
aaaccatctagggtaggtccaagtactgctgtctgtgtcagttaggagtaggttcagctgtgagtgacaggacttatacaatctaagtttatttatctctyatgtaaagaagtttggggtaggatgtccagggccatgcaagatctcatggtgttgggatccagggtccctctgtcttatttctctgttgtccccagtggg

SEQ ID NO: 30706 - DNA, 201 bp, Homo sapiens
tcaaaaaaaaaaaaaaaaaaaaaagagttaagtctttgagacacccttgctgggcgcttcccagccatcttgcagacctcagccctaggcagccctccttkactccctggtaaattccttctttcattgtatgcccgttcgaagctaaagccctgtccttccgtgtccctgaatactggagaagcaggtgctttgggtctg

SEQ ID NO: 30707 - DNA, 201 bp, Homo sapiens
tctttgcttttcctaccttcgaggcaaaaggagcctatcctgtcggccccccatggtcaagctggtgtgtcccgctgacaacctgcgggctgaagggctcragtgtaccaaaacgtgccagaactatgacctggagtgcatgagcatgggctgtgtctctggctgcctctgccccccgggcatggtgagtcaccaggcaca

SEQ ID NO: 30708 - DNA, 201 bp, Homo sapiens
gtctttgagacacccttgctgggcgcttcccagccatcttgcagacctcagccctaggcagccctcctttactccctggtaaattccttctttcattgtaygcccgttcgaagctaaagccctgtccttccgtgtccctgaatactggagaagcaggtgctttgggtctggtttctcctggtctggctcaggagctcacat

SEQ ID NO: 30709 - DNA, 201 bp, Homo sapiens
tcatctctttgcttttcctaccttcgaggcaaaaggagcctatcctgtcggccccccatggtcaagctggtgtgtcccgctgacaacctgcgggctgaagrgctcgagtgtaccaaaacgtgccagaactatgacctggagtgcatgagcatgggctgtgtctctggctgcctctgccccccgggcatggtgagtcaccag

SEQ ID NO: 30710 - DNA, 201 bp, Homo sapiens
atgcccgttcgaagctaaagccctgtccttccgtgtccctgaatactggagaagcaggtgctttgggtctggtttctcctggtctggctcaggagctcacrtcaattgcagtcctgtcagtcactgaatagcctcagatttcctgttttccactggtctctgaatttggtgtttattaggtgaacacaagccttattttct

SEQ ID NO: 30711 - DNA, 201 bp, Homo sapiens
ccttcactaatcatctctttgcttttcctaccttcgaggcaaaaggagcctatcctgtcggccccccatggtcaagctggtgtgtcccgctgacaacctgygggctgaagggctcgagtgtaccaaaacgtgccagaactatgacctggagtgcatgagcatgggctgtgtctctggctgcctctgccccccgggcatggt

SEQ ID NO: 30712 - DNA, 201 bp, Homo sapiens
ctaaagccctgtccttccgtgtccctgaatactggagaagcaggtgctttgggtctggtttctcctggtctggctcaggagctcacatcaattgcagtccygtcagtcactgaatagcctcagatttcctgttttccactggtctctgaatttggtgtttattaggtgaacacaagccttattttctttggccattcatgt

SEQ ID NO: 30713 - DNA, 201 bp, Homo sapiens
ttcctcctttggtcttagtccagtgcttccttttactattatcttgtttttgcgggtccatctgtacatcttgtgttttgcttcctgtctcatgtacaggrggcctccttgctgtgtaggcctgtgttcaattctaggggtcagttgtctggcagatgggcttagagttggagtacctcatcttattccctgcctgaatct

SEQ ID NO: 30714 - DNA, 201 bp, Homo sapiens
acttaattggcagttttggtctggaatggacttttcttggagactgggaagaattttgttacatttgtttgcttggtagcatagttgtgattcatagagtmcagttgtcaggggagagcctggcccagagaaggtcagtagatctcaaggaaggacccttggaatgcaggatcccagagaagttagttgtcagatgatggc

SEQ ID NO: 30715 - DNA, 201 bp, Homo sapiens
tttttttttgatattcaagttgtcctccctggggtaaatgggggctcttttaagttggctctggagcctgttggcatggcctcatgagtctttcgtagctktcttgctttctgaaacaataaggcgtgctgggctcaccctgggcatttcctgccctagtccttggatctgccattttgacaaaagtccccctacctttta

SEQ ID NO: 30716 - DNA, 201 bp, Homo sapiens
tgcagtatgtcaaggtgggaagctgtaagtctgaagtagaggtggatatccactactgccaggtaagggctctgcttcaataagggctgggtgtggagggytgagcctccgtgttcggatacctatccttagttacattctagaaggatctggaaaattcgcagggaagagaagggaaataaactggaagcattttttttt

SEQ ID NO: 30717 - DNA, 201 bp, Homo sapiens
taatagtttactcatttatttattgctgtcagtttatccatctatccacccatccattcatccatccatctgcccatccaatatttactaagcaactactrtgttctaacagaattggcactgtgctaggtgctatgggagaaatgttaagatgaagttcctatgtatgcccttgttagtatatatgacaatagtctataa

SEQ ID NO: 30718 - DNA, 201 bp, Homo sapiens
cagttaatagtttactcatttatttattgctgtcagtttatccttctatccacccatccattcatccatccacctacccatccaatatttgctaagcaacrtgtgctcctcatggaagatttgcatcctacccagcattcccttcttgcccaaaccaagtgctacaaggcttggttggggggcagtcagcattccagctca

SEQ ID NO: 30719 - DNA, 201 bp, Homo sapiens
actcccgggccgcgcggtgagttttccggctggacctggtcctggtctcctacaggtggtaggagggagggagtgaaggaggcggcatccgaactcccacycttcgggattggggacccccaagggagcctgggcagggtggtgcgggaagttgaccccgtttttccagggtagggactctgagggacgtctatgtaattt

SEQ ID NO: 30720 - DNA, 201 bp, Homo sapiens
tgacttaatcttctgagtctaaagctccctggcaccctatagcatagctgaatacttacgagccctggctgggcgcagtgctcagtgtggccttgtcctaycctcagcctgcaggaaggaggagtgcaaaagagtgtccccaccctcctgccccccgcaccgtttgcccacccttcggaagacccagtgctgtgatgagta

SEQ ID NO: 30721 - DNA, 201 bp, Homo sapiens
tagagattctacatctgacacctctgagaatgaaggaacccgccccttccagatgtatgtgggaaagtgatagagcagggattgagcagccttcacttctmctccattagagttcctagcttcacatttccctttttgattaatgttcatatttttctgcagatggactgcttttggtaacattgaataactcccagcccg

SEQ ID NO: 30722 - DNA, 201 bp, Homo sapiens
tatctatccatctatccatccatcctatgtatttatcatctgtcctatctctatctaacctatgtatctatttatcatctatcctgtctctatctatcctwtgtatctatcatctatcctatctctatctaagctatatatctatttatcatctatcctctatcatctatctatctatctatctatctatctatctatcta

SEQ ID NO: 30723 - DNA, 201 bp, Homo sapiens
ctgcctgtgtcttgctagcttgaacttctcatgtttactgatatgtcattttaccgtcaagaaaaaagctgaatcggaaaactgcatgttttgattatttwaaaaaaacccaaaacgatggaagagagctgggtaaaaaggatgcaagaagagaaacttgtggggctagtgtgtgcggagcggtgtctcggcagtcttctt

SEQ ID NO: 30724 - DNA, 201 bp, Homo sapiens
ggaaaatggcatagattatgctgagtaggcttggtggggagtttagtggggcagaagggaggaagaatggatagaagttttatgtaactactcagtaattmaaaggttactgtctctccatccatcaccccactcccaactttgggtagcctctaaggtctctcttggtaggaaaccagatccagggacagggaattaact

SEQ ID NO: 30725 - DNA, 201 bp, Homo sapiens; identical to SEQ ID NO: 5852

SEQ ID NO: 30726 - DNA, 201 bp, Homo sapiens
gaaagtgctaacctggaggtctgtggagtgcaggggtctctcctgggctcaccggcgatttctaatggctcgttttcctaatggctgcacatcatctgatscccctgagttctgcatggagggaatgagggaaataaaatgcaaggctggtctggagttctccctgcattagtgattagtgcaatcctagaacactccgat

SEQ ID NO: 30727 - DNA, 201 bp, Homo sapiens
aataaactggaagcatttttttttaagcaaatgttttattgaagtaactggaaatttttgactccaggaaaaaaacaaaaatggaggaaagactcagcaahtcctttacagaaaatggagagttatttatgcaagatgggggccacaattcttgaagatcagtcaaacatatataaaattttcctgcataaaacatgcata

SEQ ID NO: 30728 - DNA, 201 bp, Homo sapiens
aaaattctagactgggcgtggtggctcacgcctgtaatcccagcactttgggagaccgaggtgggcagatcacgaggtcaggagtttgagaccagcctggytaacatagtggaaccccatctctactaaaaatacaaaaaattagctgggtgtagtggtgtgtgcatgtaatcccagctacttgggaggctgaggcaggag

SEQ ID NO: 30729 - DNA, 201 bp, Homo sapiens
cttgatcaaattaactcatgatttgtctttctggacttttttaaaaatcaagatttcaatttatttattatgtttactgtttttatattctctactttatkgatttctgcttttatccttgctattttatgacttctttccttgaattttcttttagtttaccttttgtgcttttctatttaattggaactgggaatttca

SEQ ID NO: 30730 - DNA, 201 bp, Homo sapiens
cagcactttgggagaccgaggtgggcagatcacgaggtcaggagtttgagaccagcctggctaacatagtggaaccccatctctactaaaaatacaaaaawttagctgggtgtagtggtgtgtgcatgtaatcccagctacttgggaggctgaggcaggagaattgcttgaagccgggaggcagaggttgcagtgagccat

SEQ ID NO: 30731 - DNA, 201 bp, Homo sapiens
gtagactaagggacaagacacgtaagagaaattaaaccatgaaagactgtctggggttagtaaatgacaaatcgccaagtgaatggtaagtgatagcgcarcttaggggaattagctcctgtcacagagctgatgcttttttcttgctgggagcaggatgggtgagtgattcagaaagggctgctttccatccccagagct

SEQ ID NO: 30732 - DNA, 201 bp, Homo sapiens
gtagtggtgtgtgcatgtaatcccagctacttgggaggctgaggcaggagaattgcttgaagccgggaggcagaggttgcagtgagccatgattgcatcaytgcactccagcccagcggacagtgcgagactccatctcaaaaaaaaaaaaagaaagaaaagaatattctaaaaaaagacttaattccccccgccacccca

SEQ ID NO: 30733 - DNA, 201 bp, Homo sapiens
acagagcgagactctgtctcaaaacaaaacaaaacaaaacaaaaaacaccactggcctagtaaattctttacccactccatgcttcagtttctaaatctgraaggctgtctgtatcagcctttgtctgaggagagctgtgttctttggaggtgtcttcaggcctctgaagggcccatttgtggcatgggtgatgagatggt

SEQ ID NO: 30734 - DNA, 201 bp, Homo sapiens
ggggaaaaggagaaaggtgtccttctgtcctgctggggacctgctcactattctagagggtaagcctagtggccggagggatctctctggaggccaggagrtgatgaagatgatgatgatgatgataggggtcatcatttattaaggtaagtcttccgcgtgcatattccattcagtcttcactagtcttgtcccagagga

SEQ ID NO: 30735 - DNA, 201 bp, Homo sapiens
gtcctgagacacagtgtttactgtgaaggcttgtcccttatgaagttccagtagaaacccaggtgtttacccagcccctccaactcgttagaattcagacrgcaaactctctcccgtgtggtgtgtggtaactgaaatttctgctcaggtgtttgagctttccagctgtcgttttgtctctgggctccttgtaggctctcc

SEQ ID NO: 30736 - DNA, 201 bp, Homo sapiens
ttttttttcttgagacggagtcttgctctgtcacccaggctggagtgcagtggctcgatctcagctcactgcaagctccgcctcccgggttcacgccattytcctgcctcagcctcccgagtagctgggactacaggcgcccgccaccgcgcctggctaattttttgtgtttttagtagagacggggtttcactatgttag

SEQ ID NO: 30737 - DNA, 201 bp, Homo sapiens
gcagagaagcactctgaagtcattgtgcacgttttagtttgtcccctctgccactacctgggctgcctctttggcatgaaagttctcactcttaccatctygatactggaggtgggaggacgggaaggcagtgggccataggagacaggaggagcagcagagcgatggctcatgggagctatgggtgggtgggcaggagac

SEQ ID NO: 30738 - DNA, 201 bp, Homo sapiens
agtggctcgatctcagctcactgcaagctccgcctcccgggttcacgccattttcctgcctcagcctcccgagtagctgggactacaggcgcccgccaccrcgcctggctaattttttgtgtttttagtagagacggggtttcactatgttagccaggatggtcttgatcccttgacctcgtgatccgcccacctcggcct

SEQ ID NO: 30739 - DNA, 201 bp, Homo sapiens; identical to SEQ ID NO: 5772

SEQ ID NO: 30740 - DNA, 201 bp, Homo sapiens
tttttcagttccatatgaattttaagattgcattttctaattctgtgaaaaatgacattggtactttgataaggattacattgaatctgtagattgctttgggcagtatggtcattttaacaatatgaattctgatccattagcatggcaattctatttttaatttttttttttttttgagacggagtctcgctcagtcac

SEQ ID NO: 30741 - DNA, 201 bp, Homo sapiens
cggggtttcactatgttagccaggatggtcttgatcccttgacctcgtgatccgcccacctcggcctcccaaagtgctgggattacaggcgtgaaccaccrtgcccggccccccaatggccttttctactgtctcatgctgattctgcctctggtgccatttttcttccttgggagtgtgcatcttcctctcctggggcgg

SEQ ID NO: 30742 - DNA, 201 bp, Homo sapiens
gggctcctgtaatctgaaacacttaggcctctgtctgggagatgctgacttcccgtttgaaacctagcagctacatctcccaaactgctggtattaggagsctcttggtggcgagaagtgtggttatgtccctgatcccaggatgtccagtttcctcactggccccatgtgaagactgaaggagttgggcaccacttctta

SEQ ID NO: 30743 - DNA, 201 bp, Homo sapiens
aaagctgcctgtgttatcaggttgagggcatcagcaaagtggtagaaccaagaatactcgtgcttgctgcagtgtgtctgggacattccacagaatcagcscatgctgttgctgatgggaactggtcccgtctggccccagcaatcacctggggagtgtttaaaaaaaaaaaaatcttgctgatccccatcccaaactact

SEQ ID NO: 30744 - DNA, 201 bp, Homo sapiens
cctagaacaaatgtatgctctgaattttctaggatcgtccttgtttcagtttactctggtgtttccacatagactgttgattttcagaccatgtttataayttgaggtacggaaaacatgatccctgtttcccaaatccagttcgtggtggctgcccctgaggctcctgtgtgtgctggggtgccctattcttgcatgttt

SEQ ID NO: 30745 - DNA, 201 bp, Homo sapiens
aacctcacacttccaggtttgaatcctgcctcctaacatctacttaagtgagtggcaagtcacttaacatcttggcgtcttaattttcttatctgtaaaaytggcttgcaggctgttgggaagactggagatgagagcagcgagcacatgggaggtgcttagtgagtggtggtttaatgaccactaactattacagtaagt

SEQ ID NO: 30746 - DNA, 201 bp, Homo sapiens
cttggctaatggtcacgtctgttgtatggccttaagtctaaagtactggtggagtaggtttgagcagagacatggggaggactaaatgcctagaaaagagracttgaagttttcctttttcttccaccctcatgtatcaccttcgcctgtccctagaacaaatgtatgctctgaattttctaggatcgtccttgtttcagt

SEQ ID NO: 30747 - DNA, 201 bp, Homo sapiens
agagaaaccgcctggaaacggcatggtatcggaacctcacacttccaggtttgaatcctgcctcctaacatctacttaagtgagtggcaagtcacttaacmtcttggcgtcttaattttcttatctgtaaaactggcttgcaggctgttgggaagactggagatgagagcagcgagcacatgggaggtgcttagtgagtgg

SEQ ID NO: 30748 - DNA, 201 bp, Homo sapiens
gacttaagagtcccctggagggtaaatgtgagggtgtcaacaggaacatggggacactcatctgtcagaggtcccgtggcctggatccttgtgggatgacsgtacagaactcctactagttttcagtgagcaagaacatttcaaatccctctgaggctgtcccaccactaatttctctgacttttgtggccgttcctctcc

SEQ ID NO: 30749 - DNA, 201 bp, Homo sapiens
ggtgggcagggaaaggaggaggacgaaatctgctttataagcagccctgcatatgggcggagaccacatttggttttatttattgccacattctcagcacytagagcggcttctgtgtagtaggtgctaactcaccgcttgtttcaatgaaacaaatgagttcactcacgaaaacttatgtctacaggtgtgtgtccaccg

SEQ ID NO: 30750 - DNA, 201 bp, Homo sapiens
tacagatagccttaaatattagtaaccacaataattatattatgaccccaaatccaaaaaagaggacagcgggacctcaaatacaggctgtggctatcctrttaggcgctcatttcattcctgaagcactgggcatgcattctgaggacagcacttggatacctgtcacgtgacgaggtgactcgcacttcagccacaggg

SEQ ID NO: 30751 - DNA, 201 bp, Homo sapiens
aaagagtaacctttctgaactctgcatggacgtctctctttctggccctcagtgtgtgacccagtgagctgtgacctgcccccagtgcctcactgtgaacrtggcctccagcccacactgaccaaccctggcgagtgcagacccaacttcacctgcggtaaggcctctgtggatgaggaggggtggtgtggcctctctctg

SEQ ID NO: 30752 - DNA, 201 bp, Homo sapiens
atacacatttacttttgctaagtattgctaaacaattcttctccatagggatggtaacattttcctgcaggccttttaatagaacaaggggtctcattcartaagttcattatacagaagctagaagactgagaagataaatgataatggtttcaaaatgtttgaactgctattatgacattcacagggtggagacccgtt

SEQ ID NO: 30753 - DNA, 201 bp, Homo sapiens
tgtggatgttctgctgctggtggcaatgatctgagcatgcctactcctccttatctccctcccaagtctaatcttagccagcgttgtattaaatagattaygcatacatcctgaaggatgcaacttccagatgtttctctttcaaaatgcatcctgtcttcttgttttccccaactccaattccttatacccaaagtgaat

SEQ ID NO: 30754 - DNA, 201 bp, Homo sapiens
agaagaatctactgtaaattactaaacacaggtttgacaggattaatacaagaatggggtgattactggggactatggagatatactgaagaaaaggtcaygccaaagcaacccattttcattttcaataagattttgaggctgctagatatagagaagaccacacactgggcaccttgagttcagcaggttgtttgctag

SEQ ID NO: 30755 - DNA, 201 bp, Homo sapiens
tcatcatcacttacctaaaacagtagaagtctgcatgaataggaatgtagcatcccactcacaggtaataaaagagtaacctttctgaactctgcatggaygtctctctttctggccctcagtgtgtgacccagtgagctgtgacctgcccccagtgcctcactgtgaacgtggcctccagcccacactgaccaaccctgg

SEQ ID NO: 30756 - DNA, 201 bp, Homo sapiens
tattcccaggagtcttactctgtgttttctctaccttattccttcctccaccctataatttatatatgtgaatatatataatatataatatatatatatakagagagagatagggtcttgctctgtcacccaggcacaagtgcagttatgcgacctcaactaacttcagcctccaccccctaggctcagacgatcctcccc

SEQ ID NO: 30757 - DNA, 201 bp, Homo sapiens
aaaggagcctatcctgtcggccccccatggtcaagctggtgtgtcccgctgacaacctgcgggctgaagggctcgagtgtaccaaaacgtgccagaactaygacctggagtgcatgagcatgggctgtgtctctggctgcctctgccccccgggcatggtgagtcaccaggcacagagctggtgcctgcccttcagttttc

SEQ ID NO: 30758 - DNA, 201 bp, Homo sapiens
agggcccaaccctagccccagggggcaccacgttgaaggtgctgaaaggtgtctctgttctcaggcacagggtgtgtgaaaggaggtgggtaaggaccgaytggatactccaaaaaagtggaaagggttacctctggagaataggatttgcttcctagaagaatctactgtaaattactaaacacaggtttgacaggatta

SEQ ID NO: 30759 - DNA, 201 bp, Homo sapiens
tccacctcccaggttcaagctattctcctgcctcagcctctggagtagctgggattacaggcacacatcaccatgcgcagctaatttttgtatgtttattrgagacagggtttcaccatgttgaccaagctggtctcaaactcctgacctcaagtggtccgcccacctcggcctcccgaagtgctgggattacaggtgtga

SEQ ID NO: 30760 - DNA, 201 bp, Homo sapiens
tggtgaaaccccatctctactaaaaaatacaaaaaattagttgggtgtggtggtgtgcacctgtaattccagctactctgtaggctgaagcaggagaatcrcttgaatccgggaggtggaggttgcagtgagccgagattgtgccattgcactctggcctgggctacagagtgagactttgtctcaaaaaataaataaata

SEQ ID NO: 30761 - DNA, 201 bp, Homo sapiens
cttttcctaccttcgaggcaaaaggagcctatcctgtcggccccccatggtcaagctggtgtgtcccgctgacaacctgcgggctgaagggctcgagtgtrccaaaacgtgccagaactatgacctggagtgcatgagcatgggctgtgtctctggctgcctctgccccccgggcatggtgagtcaccaggcacagagctg

SEQ ID NO: 30762 - DNA, 201 bp, Homo sapiens
gttggacacctgcttttggtcatctgttgtgtgttacccattctcaggatagttggaaaattgtgtgatttattcttgagtttaaatatctgaggtctgcrtttaaaaggagagaaaaaagaacactgaaacatatacagaacatgactctctccttccgcatcccctcatgtctgccaattcgaccccctgccccagccc

SEQ ID NO: 30763 - DNA, 201 bp, Homo sapiens
tctcttttaaagccattgtggtcagatggccttctctccccacattagttgtaaccatttaggaatgattctgttgggtccattaaaactcctttttagcwcccaaactcaggtcttttcaagcctgggtctggaaatttctgcaatgcatcctgattcaatgtaacctgctatagcaaggttaagggtgatgacaagtat

SEQ ID NO: 30764 - DNA, 201 bp, Homo sapiens
gtgccatctgccggccgcgttgctgcatagcctggccaggcctggagagccactacggttgcttttagaagcttggccttagcttgttttttaaatttttwatttttattcttttccctgccttgggcaggccttaagcttcctgggaaatgaaaatccccagcggaggaggttggacacctgcttttggtcatctgttgt

SEQ ID NO: 30765 - DNA, 201 bp, Homo sapiens
aaagtcaggaaactcctgggattctgtgcagattgggaaaagccgtttagccttttggagtttcagttttctaacaagagtttccatataaaaataaggcyagaaattttgactgttttgcccagaggagcgagtatgtgatacaaatgctattaagtgcacctgggctttggaaagaaaggtgctgtatcagtcatctgc

SEQ ID NO: 30766 - DNA, 201 bp, Homo sapiens
caccttcattcagactttaactcctgctggctctcataccggttctggcctggtgatagtcacgcctgggccctggaacctggcgattgcaactgcctgcstgcagttggcctgggcttgtgcagcagtgccatctgccggccgcgttgctgcatagcctggccaggcctggagagccactacggttgcttttagaagctt

SEQ ID NO: 30767 - DNA, 201 bp, Homo sapiens
agcaacctggagtcagcagtacccgaagagaggccttcacaaaggtgcctagggatcttctcggtccccagagaggcagggtatgcccttacatcaccatkacttcgcctttcctcttaccccaaggcaggaatgaagagatagtaattatacttattgactacttcattgcccattagcttctgaatgtagttacaagca

SEQ ID NO: 30768 - DNA, 201 bp, Homo sapiens
cgatctttgtcaccttcattcagactttaactcctgctggctctcataccggttctggcctggtgatagtcacgcctgggccctggaacctggcgattgcractgcctgcgtgcagttggcctgggcttgtgcagcagtgccatctgccggccgcgttgctgcatagcctggccaggcctggagagccactacggttgctt

SEQ ID NO: 30769 - DNA, 201 bp, Homo sapiens
tgttttcttagggtaaaattatgaaaattccaggcacctgctgtgacacatgtgagtgcgttactaatatcttgtcccttgaaacccatcagagcaagtcyaggggctctttgcagcttgctccttgaaacccattagcaagccgcatgactgttctttggagtaagctttatttcagaaagatatttcgtgaccactggt

SEQ ID NO: 30770 - DNA, 201 bp, Homo sapiens
ttccattaaagaaacttttttttttaaactgaaaaataaagcccagaaaaccttttattaagggaaataaactagggtataaaactattgtagtaatttcrgaagagcaaaatattcactagttttcatagctcttgtttattttacaaaacagagtctaaagaggtgagtctttggagtaggatcagaagggaccaagag

SEQ ID NO: 30771 - DNA, 201 bp, Homo sapiens
gcgtgaaacaaactctggtctatgaagtccggactagctggtggggctgggaggtagttcccttcgttcatctctagttcagttatcagctagccagtttrctgttgctatatctcaatccttcaagcatttaactggtcggaagagtctacatagcagccctgttcataggatacaagctgtaaaactgggactccactt

SEQ ID NO: 30772 - DNA, 201 bp, Homo sapiens
taattgaaaactttgaaaacaacacagccacttttagtgatttcagaaaatacagtttaaatgaatgaaaacaaacatcatatccagccacgtgcattttyaactttgactttcaaagcagagaaagaataaaaacctaatgtgaagaacatttccattaaagaaacttttttttttaaactgaaaaataaagcccagaaa

SEQ ID NO: 30773 - DNA, 201 bp, Homo sapiens
ctgctacaacttgagtgagatgtgcacatgcagagtgaaggaatgctacctaggggactgagaactgacaaaagctggttggagttggatgttgactttcygaattctaggtgaaactactggataagagagatgagaggccagcaaaatcagcctacttacaattgggatgttttaaggaggttaactatggctgctttt

SEQ ID NO: 30774 - DNA, 201 bp, Homo sapiens
tctagggtacaagtaaaattttcacagtaatcttttataatatcaaaaattctttttaaatagcgattttcttttgtcatttgttaatttatatacatgtytattatcttttttcttgatcaaattaactcatgatttgtctttctggacttttttaaaaatcaagatttcaatttatttattatgtttactgtttttata

SEQ ID NO: 30775 - DNA, 201 bp, Homo sapiens
atttctggctcatgagtgtcaaatgtctgcaaggtcctgagagcaggaagactgtgaactttatcttagtgtctccaaacccctatcctttgcttctcctytctggtgctattttcccctttcactgcccgcctcatcttcagtccaacacattagaatatgcattcaagttgtataaagtttccatccaaatattttgga

SEQ ID NO: 30776 - DNA, 201 bp, Homo sapiens
catttggttttatttattgccacattctcagcacctagagcggcttctgtgtagtaggtgctaactcaccgcttgtttcaatgaaacaaatgagttcactyacgaaaacttatgtctacaggtgtgtgtccaccgaagcaccatctaccctgtgggccagttctgggaggagggctgcgatgtgtgcacctgcaccgacat

SEQ ID NO: 30777 - DNA, 201 bp, Homo sapiens
aataggtctggctgctacaacttgagtgagatgtgcacatgcagagtgaaggaatgctacctaggggactgagaactgacaaaagctggttggagttggaygttgactttccgaattctaggtgaaactactggataagagagatgagaggccagcaaaatcagcctacttacaattgggatgttttaaggaggttaacta

SEQ ID NO: 30778 - DNA, 201 bp, Homo sapiens
taccagctcaactttggtaacagacaaaactctgctcttatacagctctatccccacactctttcagttattgatgtcataaacattacatctttatacaytgtgtgttcaaaaacatagacgtatataaattttaatgcattagcctcttaaatcatgtagaaaacaaaaagtgaagtcacaaactaagattacaataat

SEQ ID NO: 30779 - DNA, 201 bp, Homo sapiens
atacatttttggcaagatttggtgataagcaggggatgagaaaaaaggggaagtcaaggataactctcagatttcttgtttgaaagactgggtgattaacrccacttaccaaaatagggaataccagagaaagatgagatttgggacaaaaatcaaatttccttttggatgcaagtctcaagatgacaatagaataattgt

SEQ ID NO: 30780 - DNA, 201 bp, Homo sapiens
ttgtggaattttggtgttggtgaaggctttttcagcatctatggagataatctcttgattttttttctttaaatatattgatatggtatattatttgaagraatttcctaatgttgatcccacttggctatgctttgttattttcataatgtggtgttggattctgtttggtaatattttatttagtacgttggttttgac

SEQ ID NO: 30781 - DNA, 201 bp, Homo sapiens
gacaagcaatggatgagtttgagatacatttttggcaagatttggtgataagcaggggatgagaaaaaaggggaagtcaaggataactctcagatttcttktttgaaagactgggtgattaacgccacttaccaaaatagggaataccagagaaagatgagatttgggacaaaaatcaaatttccttttggatgcaagtct

SEQ ID NO: 30782 - DNA, 201 bp, Homo sapiens
taattgtttataatcatcatctgcaggaaggttagtccaatacaagccactgtgccgtaactacagccagaacctcatcaaaagtttctaagctgaggagkcacaagagtagacgtaggctttaagaaggtcattctggcagatgtgtggtaacctgtagcaggggagcaagaatgaaggtaggaagacaaaataagacta

SEQ ID NO: 30783 - DNA, 201 bp, Homo sapiens
cccagcccctccaactcgttagaattcagacagcaaactctctcccgtgtggtgtgtggtaactgaaatttctgctcaggtgtttgagctttccagctgtygttttgtctctgggctccttgtaggctctcctatagatgtataattaagggatcaaccaaagagttcagaggagtttatttgcagatttaggggcttctt

SEQ ID NO: 30784 - DNA, 201 bp, Homo sapiens
gtttactgtgaaggcttgtcccttatgaagttccagtagaaacccaggtgtttacccagcccctccaactcgttagaattcagacagcaaactctctcccrtgtggtgtgtggtaactgaaatttctgctcaggtgtttgagctttccagctgtcgttttgtctctgggctccttgtaggctctcctatagatgtataatt

SEQ ID NO: 30785 - DNA, 201 bp, Homo sapiens
ctcctcggcctcccaaaatgctgagattacaggcgtgagccaccgcgcctggcctggatatttttatttcatcccttttttaatctttaccttacttccattttttttttttaagctctttatccctctgtgttgcttttttaggtcgtttgcttggctcaagtgttgtgctcatgctggttggtgagaattgattgtgtg

SEQ ID NO: 30786 - DNA, 201 bp, Homo sapiens
tgccgctgctttcgcggcagcggctccagagtggcctggtctctcctgcagctgtcccccgtctatgccgggaagacctgcggcctgtgtgggaattacartggcaaccagggcgacgacttccttaccccctctgggctggcggagccccgggtggaggacttcgggaacgcctggaagctgcacggggactgccaggac

SEQ ID NO: 30787 - DNA, 201 bp, Homo sapiens
tttggttttatttattgccacattctcagcacctagagcggcttctgtgtagtaggtgctaactcaccgcttgtttcaatgaaacaaatgagttcactcaygaaaacttatgtctacaggtgtgtgtccaccgaagcaccatctaccctgtgggccagttctgggaggagggctgcgatgtgtgcacctgcaccgacatgg

SEQ ID NO: 30788 - DNA, 201 bp, Homo sapiens
tctccccaaagctctgtagggtcataatcgcacatcctattgaatggatgagactgaggctcaatggcatgaggtgataaagctgggatttatattcatarcatcagtcatcctatagtgtcctagccctgccattgacctcactggaactgtgagctgaactctgggctaactcatgttcattggagcatgggtatccat

SEQ ID NO: 30789 - DNA, 201 bp, Homo sapiens
ggtttcatctcattccctgccctttgctttccccactgggcatttcacccagctgttggtgttatccagatgccagctgggatgacctgccccttaggaascagttaagacggcctcagccttcccattttgtagattttgggagaagcccagggccctcccagggggattcatgctctctcattcacctgtgaatctgag

SEQ ID NO: 30790 - DNA, 201 bp, Homo sapiens
gagaaaggggtggaatagaaacttattccaaaagggttggctcagtgtacatatttaacaggttatgggaggagctatgaatattcataatgggaggaggyatttgcatatacagtaagcaaacatacatgttacatatgtcccacattcattttgggatggagacttaacatttaaatgcattaaaattagcctctatag

SEQ ID NO: 30791 - DNA, 201 bp, Homo sapiens
tgcagaatagtgaaaacaacatttcagtaactacactattctgtccctgatgttataagccaggatagggaccattttatatgattctccccaaagctctrtagggtcataatcgcacatcctattgaatggatgagactgaggctcaatggcatgaggtgataaagctgggatttatattcatagcatcagtcatcctat

SEQ ID NO: 30792 - DNA, 201 bp, Homo sapiens
tgcctcatcaatgagtgtgtccgagtgaaggaggaggtctttatacaacaaaggaacgtctcctgcccccagctggaggtccctgtctgcccctcgggctwtcagctgagctgtaagacctcagcgtgctgcccaagctgtcgctgtggtaaggcatgcaggctggggctgggctggaccgggcaccacctttaagcctct

SEQ ID NO: 30793 - DNA, 201 bp, Homo sapiens
cattatcttagtgtttttcaaaggtgtattttgcagggtattaacagttacttgtggtcaagtgagtttaaagaacaccagctaaccatagttaaacaggyttctttattgcagaactctttagtctttttaatatactactgtaccttgcagatatttaagagagtttttgtttctcaaacttatttgatcatggagcgt

SEQ ID NO: 30794 - DNA, 201 bp, Homo sapiens
caggagggaaagggaaaagaatattttgtgtcataatgtctgccattgttaagagagattatgtaccttgattgtgctaaacacaatatattcattatctyagtgtttttcaaaggtgtattttgcagggtattaacagttacttgtggtcaagtgagtttaaagaacaccagctaaccatagttaaacaggtttctttat

SEQ ID NO: 30795 - DNA, 201 bp, Homo sapiens
gtgtctttatagcagcatgatttgtagtactttgggtatatacccagtaatgggatggctgggtcaaatggtatttctagttctagatccctgaggaatcrccacactgacttccacaatggttgaactagtttacagtcccaccaacagtgtaaaagtgttcctatttctccacatcctctccagcacctgttgtttcct

SEQ ID NO: 30796 - DNA, 201 bp, Homo sapiens
cagaatgatacagaaatccaggagggaaagggaaaagaatattttgtgtcataatgtctgccattgttaagagagattatgtaccttgattgtgctaaacmcaatatattcattatcttagtgtttttcaaaggtgtattttgcagggtattaacagttacttgtggtcaagtgagtttaaagaacaccagctaaccatag

SEQ ID NO: 30797 - DNA, 201 bp, Homo sapiens
agctggtggatggactgttctcttagtctttctggacctcagtttctgcatcctagaatgagatagttggcctagataacctgtaggttccttagggctcygattttctgaggccatgtggatgatactgcctcctcccaatcagcctgcaaatcaaggggcaaatgttagtttctaagttactggaagcactttctctgc

SEQ ID NO: 30798 - DNA, 201 bp, Homo sapiens
ttattaaaccattgatactgttccactggtccctggggctccctatttatattttttacatctttattcctctctatgcttcagtttgggtaatttctatygatctgtcttaaaattcaaggatcttttcttttcttgtgtcctgtctgcagttaatccaatccagtgagtttttgatttagagtattgtgttttctagtt

SEQ ID NO: 30799 - DNA, 201 bp, Homo sapiens
agacaaatgcgattttaatgtgttagacacatataggcatctgtaaagggctgtgtaaccagtcacattgaatttgaaattccaccaagctttagcacacrcttacagtgtagtccatgcctgagcaggattttgaagtgcaagtagaatcattggttgccaagagtcttctcagttataaacactgcaggattgctagtg

SEQ ID NO: 30800 - DNA, 201 bp, Homo sapiens
tgtgatcttggctcactgcaacctctgcctcctgggttcaagcaatcctcctgccccagcctcttgaatagctggaattacaggcatgcaccaccatgcamggctaatagttgtatttttagtagagatgggatttcaacacgttggccaggctggtctcgaactcctgaccacaagtgatctgccttacttgggctccca

SEQ ID NO: 30801 - DNA, 201 bp, Homo sapiens
atctctaaagtattcataaaccagtaacatacattatcatcaagtacataattgcatgtgctatacttttacatgactggcagcacagtaggtttgtttayacctgcatcaccacaaacatgggagtaatgtgttgtgctatgaagtcaccaggtgataggaatttttctgttccattataattttatgggactgttgtca

SEQ ID NO: 30802 - DNA, 201 bp, Homo sapiens
atacatatacatatatgtatatgtgtgtgtgtgtgtgtatatatatatatacacacacacacacatatatatgtatatatatacacacatacactctgcaygtagaatttttatgtaaattaatgcatggtcctttccattagtatttctatagttcagacaaatgcgattttaatgtgttagacacatataggcatctgt

SEQ ID NO: 30803 - DNA, 201 bp, Homo sapiens
atgctcaatggcactgtcattggggtgagccgctgtcctcttctccagagcaagtggtggggacagggaagggggtactgtgggaaggggagcaggcaagycattgtaaagcagaaatgaaggaaaccagagagacccaaccccagctttccactgcctgtgggacgtgcctggcatcatggagcccaggctaggaccatc

SEQ ID NO: 30804 - DNA, 201 bp, Homo sapiens
actttaagtatgtttcttagtctttggcttgtgttatttctgatgaccagtcagccgccatttttattgttgttttcctgtatgcatttccccccttctawtggatgctttaacagtttttctttagttttcagaagcttgagtatatgcttttgtgtaattttcttcctaccttttctattttggattcatagtttcctg

SEQ ID NO: 30805 - DNA, 201 bp, Homo sapiens
gaagagtgtgagaaagattggcattaattcttctttaaatctttggtagaattatccagtgaaagcatctgagctcttatttattgagagattatgattaytaatttcatctccttactaatgatggggctgttcagattttctgtttattcatcattcaggcttggtaggttgtatgtttcagggatttattcatttctt

SEQ ID NO: 30806 - DNA, 201 bp, Homo sapiens
ttggccttttcactgtatttcttcatattactattttagtggttgctctagacttatcacagtacactttgattgaataatataacatttcatgtacaacrtactttttccataatttgtacatttgttgtcatacagtttacttctacataagaagagagaaattccacaaggtattgctattatttttgctttaaacag

SEQ ID NO: 30807 - DNA, 201 bp, Homo sapiens
gttacttgttctgttgttaattcttttttgtcttttggttcaactgagtttttcttttttttcttttttttagtactatatctctttattggccttttcaytgtatttcttcatattactattttagtggttgctctagacttatcacagtacactttgattgaataatataacatttcatgtacaacgtactttttccat

SEQ ID NO: 30808 - DNA, 201 bp, Homo sapiens
tacagttgtgcaccaccatgcctaactgattttttgtattttttgtagagatggggttttgccatgtttcacaggctggtcacaaactcttgggctcaagygatcttcctatctgggcttcccaaagtgctgatattacgggcatgaagccacctcactggccttgtttggtattaatacacctatatcaactttcttatt

SEQ ID NO: 30809 - DNA, 201 bp, Homo sapiens
tcagctcactgcaagcgttgcctcccggcttcatgccattctcctgcctcagcctcccgaatagctgggactacaggtgcccgccaccatgcccggctaattttttttttgtatttttagtagagatggggtttcaccgtgttagccaggatggtcttgatctcctgacctcttgatccgcccgccttggcctccaaaagt

SEQ ID NO: 30810 - DNA, 201 bp, Homo sapiens
ctgttactgcctgagcttaaccttaagagaagccacattacaggaaaatggcatagattatgctgagtaggcttggtggggagtttagtggggcagaaggraggaagaatggatagaagttttatgtaactactcagtaattcaaaggttactgtctctccatccatcaccccactcccaactttgggtagcctctaaggt

SEQ ID NO: 30811 - DNA, 201 bp, Homo sapiens
acatgcagagtgaaggaatgctacctaggggactgagaactgacaaaagctggttggagttggatgttgactttccgaattctaggtgaaactactggatragagagatgagaggccagcaaaatcagcctacttacaattgggatgttttaaggaggttaactatggctgctttttccccctctggatgcagggttacaa

SEQ ID NO: 30812 - DNA, 201 bp, Homo sapiens
atcctggagaccagctaactgggcttgctcagcctctctgtgccccagattctttatctggctaataaggatgaaaatccctgtatttcgtatgacctggrattccagttaggatcaaataagatggaagatatatatatacatatacatatatgtatatgtgtgtgtgtgtgtgtatatatatatatacacacacacaca

SEQ ID NO: 30813 - DNA, 201 bp, Homo sapiens
gaattctaggtgaaactactggataagagagatgagaggccagcaaaatcagcctacttacaattgggatgttttaaggaggttaactatggctgcttttyccccctctggatgcagggttacaaggaagaaaataacacaggtgaatgttgtgggagatgtttgcctacggcttgcaccattcagctaagaggaggacag

SEQ ID NO: 30814 - DNA, 201 bp, Homo sapiens
accactgtttgctgaatgccacaaggtcctggctccagccacattctatgccatctgccagcaggacagttgccaccaggagcaagtgtgtgaggtgatcbcctcttatgcccacctctgtcggaccaacggggtctgcgttgactggaggacacctgatttctgtggtgagtctccaagttacctctgaaaatcctggag

SEQ ID NO: 30815 - DNA, 201 bp, Homo sapiens
ccttgtgctccataagaacatgtgcttatcatgttcttaatatcaacaggatgtgagctgggacaggtggtagagtctagggaccacctcccagctgaagraggtctgggtgagtggagtgacattgagtcccctcgtggccacctggagaactgttcatctttcagaaccctgcctaggagtgctgtcagaaccctgtct

SEQ ID NO: 30816 - DNA, 201 bp, Homo sapiens
atttatctgtgtgcaacttggtcacacctgcctgtctgcatgtagtaggcatgggggtttggataacgtcgcatccatcctctgcttctctctgtccaggygtgtgcacaggcagctccactcggcacatcgtgacctttgatgggcagaatttcaagctgactggcagctgttcttatgtcctatttcaaaacaaggagc

SEQ ID NO: 30817 - DNA, 201 bp, Homo sapiens
gagtcagactgccttagtttgaatcttatctctgctacttgctagctgggtaattttgggcaaatacttaacctctttgtatatcgtctatacaaaggatraggcaaatacttaacctctttgtatatcatctatacaaaggatacacatctttgtgtatcctcatctataaaatggggataataatagcacctacttgct

SEQ ID NO: 30818 - DNA, 201 bp, Homo sapiens
ctctactgtatttatctgtgtgcaacttggtcacacctgcctgtctgcatgtagtaggcatgggggtttggataacgtcgcatccatcctctgcttctctstgtccaggtgtgtgcacaggcagctccactcggcacatcgtgacctttgatgggcagaatttcaagctgactggcagctgttcttatgtcctatttcaaa

SEQ ID NO: 30819 - DNA, 201 bp, Homo sapiens
acttcttttttgatttgggtgatgttcatatcttcttgattcattgctctagctaagacttctcgtactatgttgaatagaagtggtgagagtgggcatcyttgccgtcttcctgattagaggaaaagcttttagttttgcactattcggtgtgatgttagctgtggtattttcattaatggcctttattttgttgaggta

SEQ ID NO: 30820 - DNA, 201 bp, Homo sapiens
agtgttacttacctaaacctctctacctctcagagccccagtttcctaatctgtaaaaaaaggaggaaattgttctatatgacctcaaagggcctgttccrttctctactgtatttatctgtgtgcaacttggtcacacctgcctgtctgcatgtagtaggcatgggggtttggataacgtcgcatccatcctctgcttct

SEQ ID NO: 30821 - DNA, 201 bp, Homo sapiens
ggctgcacgctgctgaaggataccaggtgtgggcacagccacaggcacctccgtcttgggtttatgaagaagcagctggggctgagatgaggaggcctccraatctaatctttatttctgcccatcctcctgtatgtcatcaaggggagggaatgtttccttgacttcccctcatcattggatcttattcccaaacaaatt

SEQ ID NO: 30822 - DNA, 201 bp, Homo sapiens
tttatcaaatgtatggtttgcaaatattttcttccattctgtaggctgcctttttattctgttgattgtttctttggctgcacagaagctttttggtttgmtgtagtcccacttgtctatttttgcttttgttgccttgtttttggcaatgatatccaagaaatcgtcgccaagaccaatgttgcaaagttcttgtgtttt

SEQ ID NO: 30823 - DNA, 201 bp, Homo sapiens
aagattagctttcaaatcatttatggtggtggtgccttcaatgtgaggatttttaccaaatcatcttatgtaggtgcaaaatgatcagtattcaccaatartgttttaataggaatcttgagaatttgccaattatgtgaatgactcagggtcaaatgagggagcattgagactcaaccattttttttttttttttttttt

SEQ ID NO: 30824 - DNA, 201 bp, Homo sapiens
ggataccaggtgtgggcacagccacaggcacctccgtcttgggtttatgaagaagcagctggggctgagatgaggaggcctccgaatctaatctttatttmtgcccatcctcctgtatgtcatcaaggggagggaatgtttccttgacttcccctcatcattggatcttattcccaaacaaatttatagtttttcgcctct

SEQ ID NO: 30825 - DNA, 201 bp, Homo sapiens
ttcattactgtctctttgacctttatactttcttcattaactcattttcattctcttgattggtttttttttgcttttctctgatgctctttattaaattyttattttgatgtcatcttccttgggtacttataatttagtctttatttcagagttgactttgcacttttattacccacccccaccaagttcactgagttc

SEQ ID NO: 30826 - DNA, 201 bp, Homo sapiens
catttaataggtctggctgctacaacttgagtgagatgtgcacatgcagagtgaaggaatgctacctaggggactgagaactgacaaaagctggttggagytggatgttgactttccgaattctaggtgaaactactggataagagagatgagaggccagcaaaatcagcctacttacaattgggatgttttaaggaggtt

SEQ ID NO: 30827 - DNA, 201 bp, Homo sapiens
ccagggggcaccacgttgaaggtgctgaaaggtgtctctgttctcaggcacagggtgtgtgaaaggaggtgggtaaggaccgattggatactccaaaaaartggaaagggttacctctggagaataggatttgcttcctagaagaatctactgtaaattactaaacacaggtttgacaggattaatacaagaatggggtga

SEQ ID NO: 30828 - DNA, 201 bp, Homo sapiens
ccagtgacattatcatgaatgaggtcaggagattgagaccagcctggctaacacacggtgaaaccccgtctctactaaaaatacaaaaaattagccgggcktggtggcgggcgcctgtagttccagttactcgggaggctgaggcaggagaatggcgtgaacccgggaggtggagcttgtagtgagccgagatcttgccac

SEQ ID NO: 30829 - DNA, 201 bp, Homo sapiens
ggagcaggggtgtctccctgggtgcccactgtgggcagtaagggaagagccagattggcactctcagctaagagaaagcctgcccgggaaaggttgctcargaaaccaccagattcttcccctggacactgggactctgcatgtgtgggccacttcctcttgttcttggtggtcctggaatcacactggatagcaatccat

SEQ ID NO: 30830 - DNA, 201 bp, Homo sapiens
cactcactcactcactaactagctgggcatggtggcatgcacgcacgcacacacactagctgggcatggtggcacacgcgcgtgcacacacacacacacasacaaacacatactagctgggcatggtggtgcaccagtaatcccagctaatgggagggctgaggtgggaagatggcttgaacctgggaggcagaagctgca

SEQ ID NO: 30831 - DNA, 201 bp, Homo sapiens
tggcagggattgggctaagtcagaggctcaggtcagagcccttcttgaacctgcagtgtgtgattcccagcactagcactgagcacctcagtttccttttycttcagctctgtctcctgatgacagtggctctggggagggggaggtggtgggatacaagaaaggtgagagtctactgcttatttttatagaggaatagat

SEQ ID NO: 30832 - DNA, 201 bp, Homo sapiens
gaacagctctatttagggcagagtggcggtgatgatgctgaacaggaggtgtgcagacatgtgagggatagatttgcacatgtgattagctctgcactgcmtgtgatatgttactaatgagaggacctctgcaaagggatgatggcagttctcagcctcagcctcagtctgatgaattggagagtccgccacacatgctga

SEQ ID NO: 30833 - DNA, 201 bp, Homo sapiens
cctctggagaataggatttgcttcctagaagaatctactgtaaattactaaacacaggtttgacaggattaatacaagaatggggtgattactggggactrtggagatatactgaagaaaaggtcatgccaaagcaacccattttcattttcaataagattttgaggctgctagatatagagaagaccacacactgggcac

SEQ ID NO: 30834 - DNA, 201 bp, Homo sapiens
acaacaatcacagtgacactgacaaatactggctacctttcccctctaagcatcatctgttgggaatctgattgtgtcctcttcccaataggattataaaycattgaaaacaccaagtacatcttgaccatattttattttttaaatttatttatttatttatttatttatttttagacagagtctcactctgttgcccag

SEQ ID NO: 30835 - DNA, 201 bp, Homo sapiens
gccagcgaaaccccatctctactaaaaacacaaaaattagccgggcgtggtggtgcatgcctgtaatcccagctactcgggaggctgaggcacgagaatcrcttgaacccaggaggcggaggctgcagtgatccgagattgcactgctgcactccagcctgggtgacagagcgagactctgtctaaaaaaaaaaaaagttt

SEQ ID NO: 30836 - DNA, 201 bp, Homo sapiens
tacctcatttcacaatctccatatattcagagctaacaaaatgcaaatctgacaataaacagccgttctctatttgtctagtgtaagggaaagttataagygaggtagggttcaaggttgctcccattgtgcagttgtacaaaaatgccccttctactttcttggtggtccctgagagtgttcgctttcttggacactgct

SEQ ID NO: 30837 - DNA, 201 bp, Homo sapiens
cataccatttacctatttaaagcgtgcaattcaatggtgtttcatatattcagagttgtgcaaccatcaccccaatcaattttagaacattttcattatcycaaaaagaaacctgtattctttagctatcttgcctaatcccccagccctagccaaccaaactactttccatctccatggatttgcgtattctggacattg

SEQ ID NO: 30838 - DNA, 201 bp, Homo sapiens
agcagatactctgtaagtacacatttcatatacattatatttaaaagtactccactgaacagtgaaatatttccagactcacccacgtcctgcattcacaygaattcttccccgctccctagtctgtttcagaccagaagccctgggcttctctgactagccttggccagttctgatttcgaatattctctcctgcaattt

SEQ ID NO: 30839 - DNA, 201 bp, Homo sapiens
tttcgtttaacgccaaagtctaggctctggaagtgaggcagatctagggtgtatgcttggaggagtggagcagctgacagctcattgcaatttagccgatwctaattaccccctacacaccaggccatcagctgcaggagacacccaagcttcttgacctcagttcaccttctgatgagggaatcagacatgtgatcactt

SEQ ID NO: 30840 - DNA, 201 bp, Homo sapiens
gacagagactccctccaagatgtgaagttgctgtcccagcaataatggctttgagagagtggaaaatgaggtctttgctccctgggcagtgcgggacacaratgtgttctcctgaagcgataaacatggctgggtccacccaaaacaccctgtaggaccaacttatttactttgtcttggatccaaagggtgtctctggac

SEQ ID NO: 30841 - DNA, 201 bp, Homo sapiens
ttatttagaaagatgataatgttttccatattatcaaaacaagaatcaggcagagacttttgaagtttggttgcgtggtatatttgttacctattgctgcwtaacaatttacctaaaacttactggcttaagataacacagatttattatcctgaagtttctgagggtcaggaatgcaggagtggctgagttgggtggtgc

SEQ ID NO: 30842 - DNA, 201 bp, Homo sapiens
ttccccagaatgagggatcccagacaggagagagagtgatcaggataaaagctgcattgtcttttattacctgatggagtattttgttggttaatgttaaygtgggaggtgaccacgtgtaagtgtgatgagcagagggcaaggaccattggggggggcatcttgaagggcttctatagcaagggaggtggtggtggttgt

SEQ ID NO: 30843 - DNA, 201 bp, Homo sapiens
ctgcattgtcttttattacctgatggagtattttgttggttaatgttaacgtgggaggtgaccacgtgtaagtgtgatgagcagagggcaaggaccattgrggggggcatcttgaagggcttctatagcaagggaggtggtggtggttgtggcggtaaaaactaggtcactgtttttgttgttttgtcgatgatatttgtg

SEQ ID NO: 30844 - DNA, 201 bp, Homo sapiens
gatatttgtgttaagatgaagagctgagactcatatctcaacagagtttataaaatgcttttcttttttccatcctgccctctcttctcccttgtctgttygagctagccatgggaatgtggtgttcctgccagtgcatccattgagttcgtttattgttaatttatttattttctgagatggagtttttgctctattgct

SEQ ID NO: 30845 - DNA, 201 bp, Homo sapiens
gcatggtggtgcacccctgtaatcccaggtacttgggaggctgaggcacgagaatcacttgaacccacgaggtggaggttgctctgtctcaaaaaaaaaaraaaaaagcgtttaggagaagctgcggctgataaattacaaatagatgggttttcgtctgacctgctaatcttccactagatggcgtcattgtcaagtgtc

SEQ ID NO: 30846 - DNA, 201 bp, Homo sapiens
gacaggttctgccagtatctctggccagctagctaactaacttttttcttattccaaaaaaatgacttgggaccacttataaaaattatgtattgttcaaygagatacaattaatgaggaaatcaggatgagagaaaaataaaggcagggaaataaagctatggcccatttagcacaaacgcatcccaaagattgctagaa

SEQ ID NO: 30847 - DNA, 201 bp, Homo sapiens
aaccatggctcactacagccttgaactccagggcctcatcctcccaactcagcctccctaatagctgggactacaggcatgcaccaccaagcccagctaattgttttgttttgttttgttttgttgtttgtttgttttagtgatggagtctcactatgctgcccaggccagtctcaaactcctggactcatgtgatcctcc

SEQ ID NO: 30848 - DNA, 201 bp, Homo sapiens
aaaaattatgtattgttcaatgagatacaattaatgaggaaatcaggatgagagaaaaataaaggcagggaaataaagctatggcccatttagcacaaacrcatcccaaagattgctagaagcagaggtgaaatttttgctgtgtgttaacaatcaaagcaaaaagaggaacaaggtccattagaacattctcagaatcca

SEQ ID NO: 30849 - DNA, 201 bp, Homo sapiens
accatggctcactacagccttgaactccagggcctcatcctcccaactcagcctccctaatagctgggactacaggcatgcaccaccaagcccagctaattgttttgttttgttttgttttgttgtttgtttgttttagtgatggagtctcactatgctgcccaggccagtctcaaactcctggactcatgtgatcctcct

SEQ ID NO: 30850 - DNA, 201 bp, Homo sapiens
accatgttggccaggctggtctcaaactcctaacctcagatgatctacccacctcggcctcctaaagtgctaggattacaggcgtgagccaccgtgcccarcctatttcagtctttaaacactggccatgacacactacactgatgcattatgtgatctgtagtttggaagccactgctttaagccatcgagggtcagaca

SEQ ID NO: 30851 - DNA, 201 bp, Homo sapiens
tgcgccaccacacccgattaatttttgtatttttagtaaggacggagtttctccatgttggtcaggctggtctcgaactcctgacctcaggtgatccgccygcctcggcctcccaaagtgctaggattacaggcatgagccaccacgcccagcagaaatgatgtatatcttaggaagctcccgcatagtggcccagtagag

SEQ ID NO: 30852 - DNA, 201 bp, Homo sapiens
atctctgcccggctttggtatcaggatgatgctggcctcatcatcctgagggaggattccctctttttctattgactggaatagtttcagaaggaatggtrccagttcctccttgtacctctggtagaattcggctgtgaatccatctggtcctggactctttttggttggtaagctattgattattgccacaatttcaga

SEQ ID NO: 30853 - DNA, 201 bp, Homo sapiens
atggtgctggttatccccacagtcactgtattatccctgccacagagtgagcacttaatcaatttcagtttaaaaacacaggaggaacttgagccctataragttcagtgtcttgcccagggtactactagagcagtcccctgactccgagaccaggaccctcccacagcaccacctgggccacctggagtcaatcagggc

SEQ ID NO: 30854 - DNA, 201 bp, Homo sapiens
ttttttgaatttttagtagagacggggtttcgccatgttggccagaatggtctcaacctcctgacctcaagtgatctgcccccctcaccctcccaaagtgytgggattacaggtatgagccaccttgcccagccaggatcttctaacatcagaaatgacaaggtctctgggtgcttctggacctggttctggtggggtgca

SEQ ID NO: 30855 - DNA, 201 bp, Homo sapiens
cggctaatttttgtatttttagtagagacaaggttttgccatgttggccaggctattctcaaactcctgaccttaagtgatccacctgtcttggcctcccraagtgctgggattcattctagaacattttcaacaccccagaaacaagtcctgttgagtccactcaggagatccccagcctatccttccctcatccccact

SEQ ID NO: 30856 - DNA, 201 bp, Homo sapiens
cggaagttcaagtgtcctcagctgagtctcacaaaggtaagtgccactcgagtgagtccccaggcattgcctttggcttgggtttaaaccccagtggtggsgggggtgctgtgttcagtgagaagagtctgtgcaccctcagtcgctccaaaggaagtgattagcagacctaccggcctgctaagactggaaggagcaaag

SEQ ID NO: 30857 - DNA, 201 bp, Homo sapiens
tattattactttttgagacaaggtcttgccctgttgcccaggttagagtacagtggtgtgatcgtggctcactgcagcctcaaactcctgggcttaagcaytgctcccacctcagcttcacgagtagttgggaccacaggcatgcaccaccgtatgcagctattttttatatttttttgttgttactatgttcttactgtg

SEQ ID NO: 30858 - DNA, 201 bp, Homo sapiens
caggctggagtgcaatgatgtgatcttggctcactgcaacctctacctcctggattcaagtgattctcctgcctcagcctcctgagtagctgggatgacargtgcccgctaccatgcccggctaatttttgtatttttagtaaaggctaggtttcaccatgttggccagcgggtctcgaactcttgacctcaggtgatcca

SEQ ID NO: 30859 - DNA, 201 bp, Homo sapiens
tcaagtgattctcctgcctcagcctcctgagtagctgggatgacaagtgcccgctaccatgcccggctaatttttgtatttttagtaaaggctaggtttcmccatgttggccagcgggtctcgaactcttgacctcaggtgatccaccgacctaggcctcccaaagagctgggattacaggtgtgagccgccacaccctgc

SEQ ID NO: 30860 - DNA, 201 bp, Homo sapiens
agaaaatgtcagatcccaatatggaagctaacagtcattacggtaaagtcatgttctcctgccatttctaatttcccccaacttgctacatacttccttasccctctcagaagcagaatatgtaagtggtgggattacagttggaagagaaaccctggcttcaacagggtacttcatctcatcagccactgggccatgtaa

SEQ ID NO: 30861 - DNA, 201 bp, Homo sapiens
actccctccaagatgtgaagttgctgtcccagcaataatggctttgagagagtggaaaatgaggtctttgctccctgggcagtgcgggacacagatgtgtyctcctgaagcgataaacatggctgggtccacccaaaacaccctgtaggaccaacttatttactttgtcttggatccaaagggtgtctctggacaaaggct

SEQ ID NO: 30862 - DNA, 201 bp, Homo sapiens
ttcagttggaccatctaagttcagtccttcattttcaaaattaaaaaacaggcctcaaacgggtgcatctcacgttagctagagacagaactggagctagmagtcagatctcttacaaagttgcctttcttcttctgtgggtaagtggggcacccttgggacgctgtgctgggcgtacatgggtgcttgatgaagttactt

SEQ ID NO: 30863 - DNA, 201 bp, Homo sapiens
ctccctccaagatgtgaagttgctgtcccagcaataatggctttgagagagtggaaaatgaggtctttgctccctgggcagtgcgggacacagatgtgttstcctgaagcgataaacatggctgggtccacccaaaacaccctgtaggaccaacttatttactttgtcttggatccaaagggtgtctctggacaaaggctt

SEQ ID NO: 30864 - DNA, 201 bp, Homo sapiens
tccctccaagatgtgaagttgctgtcccagcaataatggctttgagagagtggaaaatgaggtctttgctccctgggcagtgcgggacacagatgtgttctcctgaagcgataaacatggctgggtccacccaaaacaccctgtaggaccaacttatttactttgtcttggatccaaagggtgtctctggacaaaggcttg

SEQ ID NO: 30865 - DNA, 201 bp, Homo sapiens
tgcaacctctgtcccccggcctcaagcatcctcccctctcagcctcctaagtagatcctatctactttaaacatgaagagtaatattctactgtggcctgkgtgaccctgggcaagtcatagagcctctcaagaccttggtcaccttctctgtgagatgaggtatgggctggaggcaggtcagtggtcctcgggctttatt

SEQ ID NO: 30866 - DNA, 201 bp, Homo sapiens
ccatggctcactacagccttgaactccagggcctcatcctcccaactcagcctccctaatagctgggactacaggcatgcaccaccaagcccagctaattgttttgttttgttttgttttgttgtttgtttgttttagtgatggagtctcactatgctgcccaggccagtctcaaactcctggactcatgtgatcctcctg

SEQ ID NO: 30867 - DNA, 201 bp, Homo sapiens
ccattgtttgttgccaaaccaattgactgcattcttttctgttttccatctttcttagtttaggcttcatgttatcggcataattggagaacttttgtctmcttttttttttttcagacagggtctggctctgtcactcaggctggagtgcagtggcatgatcttggctcactgcaacctctgtcccccggcctcaagcat

SEQ ID NO: 30868 - DNA, 201 bp, Homo sapiens
tctttgcatttttgatagagatggggcttcgccatgttgcccaggctgttctggaactcctaaactcaggggatccacccaccttggcctcccaaagtgcygggattacagggatgagctaccatgcccagccaggaatccttttttttaattgtcataaaatatacataatattaagtttaccattttctttttttttga

SEQ ID NO: 30869 - DNA, 201 bp, Homo sapiens
catggctcactacagccttgaactccagggcctcatcctcccaactcagcctccctaatagctgggactacaggcatgcaccaccaagcccagctaattgttttgttttgttttgttttgttgtttgtttgttttagtgatggagtctcactatgctgcccaggccagtctcaaactcctggactcatgtgatcctcctgc

SEQ ID NO: 30870 - DNA, 201 bp, Homo sapiens
atggctcactacagccttgaactccagggcctcatcctcccaactcagcctccctaatagctgggactacaggcatgcaccaccaagcccagctaattgttttgttttgttttgttttgttgtttgtttgttttagtgatggagtctcactatgctgcccaggccagtctcaaactcctggactcatgtgatcctcctgcc

SEQ ID NO: 30871 - DNA, 201 bp, Homo sapiens
ggagtgcagtggtgcaatctcgactcactgcaacctccacttcccggatttaagtgattctcctgcctcagcctcccaagtagatgggattacaggcgccygccaccacactcagctaattttttttttttttttttgagacagagtttcgctcttgatgcccaggctggggtgcaatggagcgatctcggctcactgcaa

SEQ ID NO: 30872 - DNA, 201 bp, Homo sapiens
attgcttgaacccaggaggtggaggttgcagtgagctgagatcacaccactgcactccagcctgggtgacagagcaagactctgtctgtctcaaaaaaaaragagagagagagagagaatgcatctccttccttcttgaaatgcccagattgccgtggtcatatcattgatgagctaagtaatgggattcttgggcttata

SEQ ID NO: 30873 - DNA, 201 bp, Homo sapiens
gttccccaaggtcttggacgtcgagtgttttgctttggagacccccagtagcttcagcctttcttcttgttttcttttttctcttttttttttttggatayggagtctcgctctgtcactcaggctggagtgcagtggtgcaatctcgactcactgcaacctccacttcccggatttaagtgattctcctgcctcagcctc

SEQ ID NO: 30874 - DNA, 201 bp, Homo sapiens
tgtaatccatctactggggaggctgaggcagaagaatcgcttgaacccgggaggcagaggttgcagtgagccaggatcaagccactgctctccagcctggrtggcagagcaagactccgtctaaaaaaaaattaaaaatgcatctcctaactgtcctcctcctttgcgaacccagattgggcagtacacagtccccggggg

SEQ ID NO: 30875 - DNA, 201 bp, Homo sapiens
tgagccaggatcaagccactgctctccagcctggatggcagagcaagactccgtctaaaaaaaaattaaaaatgcatctcctaactgtcctcctcctttgygaacccagattgggcagtacacagtccccgggggtcactgcacactcctgcacgctcaaaggaaacagtggctcctgcacgctcaaaggaagcagtctca

SEQ ID NO: 30876 - DNA, 201 bp, Homo sapiens
ttattattactttttgagacaaggtcttgccctgttgcccaggttagagtacagtggtgtgatcgtggctcactgcagcctcaaactcctgggcttaagcrttgctcccacctcagcttcacgagtagttgggaccacaggcatgcaccaccgtatgcagctattttttatatttttttgttgttactatgttcttactgt

SEQ ID NO: 30877 - DNA, 201 bp, Homo sapiens
ggcaggagaatcccttggacccaggaggtggaggttgtggtcagctgagattgcgccattgcactccagcctgggtgacagagcaagactcggtctcagaacacacacacacacacacacacacacacacacacatatatgctcagccaggtgtggtggctcatacttataatcccagcactttgggcagctgatgtggga

SEQ ID NO: 30878 - DNA, 201 bp, Homo sapiens
agcaccatttcctgtgcatattctcataccccaacttggctgcctttttgatttttacgtatctatttatttcaattgtgtttaatcaggtaatgaagctmtaaagaaacaggaaacatggagacagtggtatagaacaaggtgaaggattacatccttgcataaccttggtgaatacatatgttacattcagtgtatttc

SEQ ID NO: 30879 - DNA, 201 bp, Homo sapiens
gatcaagccactgctctccagcctggatggcagagcaagactccgtctaaaaaaaaattaaaaatgcatctcctaactgtcctcctcctttgcgaacccarattgggcagtacacagtccccgggggtcactgcacactcctgcacgctcaaaggaaacagtggctcctgcacgctcaaaggaagcagtctcagaaccttc

SEQ ID NO: 30880 - DNA, 201 bp, Homo sapiens
ggggggacgtgtagggatttgggaaaaacacctggttttatggtcatggactttcagtacatttttttccaaatcccctacagatcaattactttttctcttttttatacttatttaattttttttagatggagtttcgctcttgttgcccaggctggagtgcaatggcgcgatctcagctcactgcaacctctgcatccc

SEQ ID NO: 30881 - DNA, 201 bp, Homo sapiens
gcaggagaatcccttggacccaggaggtggaggttgtggtcagctgagattgcgccattgcactccagcctgggtgacagagcaagactcggtctcagaacacacacacacacacacacacacacacacacacatatatgctcagccaggtgtggtggctcatacttataatcccagcactttgggcagctgatgtgggag

SEQ ID NO: 30882 - DNA, 201 bp, Homo sapiens
cggcacactggtgggcgtgtcttatggaaagctgctttctctcagtccctgtttagctagtcttcaatttggtccagtgtccaagccctacctttggagtygagttccgccgcctacctcagaacatttgtagagccatttaaaaaggaaaactctctaatgtgaccctttgtagatccactttatgtctgataaggaaag

SEQ ID NO: 30883 - DNA, 201 bp, Homo sapiens
tcaagcatcctcccctctcagcctcctaagtagatcctatctactttaaacatgaagagtaatattctactgtggcctgggtgaccctgggcaagtcataragcctctcaagaccttggtcaccttctctgtgagatgaggtatgggctggaggcaggtcagtggtcctcgggctttattaaaacatcaatagtttggcgc

SEQ ID NO: 30884 - DNA, 201 bp, Homo sapiens
ttgtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcag

SEQ ID NO: 30885 - DNA, 201 bp, Homo sapiens
agatggctggaaacaaaggctggagtttgggaatggagaatcaccggatatgagctgaaaaagtggctgagcctaagcgtgacaggtgtcaggtgccagtmtcaggagtaggcaattgtcctgcatgcagtgaaaagccagaagatggaaggaaggacaggatgcaaatgagttctcggaacgatccacctggtggctggg

SEQ ID NO: 30886 - DNA, 201 bp, Homo sapiens
ggtaggtggatcacttgaggtcagcagttcaaaaccaccctggccaacatggtgtaaccctgtttctactaaaaatacaaaaaattagctgggcatggtgrtacatgtttataatcccagctactcagcaggctgaggcaggagaatcccttgaacctgggaggtggaggttgcagtgacctgagatctcaacattgcact

SEQ ID NO: 30887 - DNA, 201 bp, Homo sapiens
taactgtcctcctcctttgcgaacccagattgggcagtacacagtccccgggggtcactgcacactcctgcacgctcaaaggaaacagtggctcctgcacrctcaaaggaagcagtctcagaaccttcctgcccagctgggaagctccctgggatcattgccatctgtctcccttcctctgaggctaaccccaggctgcat

SEQ ID NO: 30888 - DNA, 201 bp, Homo sapiens
gggtcagggagcaggcatggtgacttcagacctcatggtacgttagaggctaatgtgaagcccatgtgaagctgttggtttaaactgggtcgatatcagtrgctcacatttactgaccatgtgtccagccctgtgtgaagtactgtagtaaattgctccaatggaaactcacaataaccacagaaggccagtaacagcatt

SEQ ID NO: 30889 - DNA, 201 bp, Homo sapiens
gtgggaggatcacttgaggccaggagttggagaccagcctgtgcaacaaagcgagactaggagaatcgctggaatctgggaggaggaggctgcagtgagcygggatcgcaccactgcactccagcctgggtgacagagcaagacattgcctcaaaaaaaaaaaaaaaagaaagaaagaaaaaaagaaaaagactacacagc

SEQ ID NO: 30890 - DNA, 201 bp, Homo sapiens
gaggctaaggcgggcggatcatgaggtcaggagatcgagaccatcctggctaacacggtgaaaccccatctctactaaaaatacaaaaaattagctggacrtggtggcgggcgcctgtagtccagctacatgggaggctgaggcaggagaatggtgtgaacccgggaggcagagcttgcagtgagccaagatcgcaccagt

SEQ ID NO: 30891 - DNA, 201 bp, Homo sapiens
tcagggagcaggcatggtgacttcagacctcatggtacgttagaggctaatgtgaagcccatgtgaagctgttggtttaaactgggtcgatatcagtggcwcacatttactgaccatgtgtccagccctgtgtgaagtactgtagtaaattgctccaatggaaactcacaataaccacagaaggccagtaacagcattgtc

SEQ ID NO: 30892 - DNA, 201 bp, Homo sapiens
cctcccaggttcaagcagttctcctgcctcagtctcccaagtagctgggattacaggcgcccaccaccacacccggctaattttgtatttttagtagagaygaggtttcaccatgttggccaggctggtcttgaactcctgacctcaagtgatccacccgcctcggcctcccaaagtgctgggattacaggcataaaccac

SEQ ID NO: 30893 - DNA, 201 bp, Homo sapiens
ggattgtttctccctctgttctagaaatgctctcccagcccaggatttcttatgatgcccagtttgaggtcataaaaggacagaccatcgaagtccgttgsgaatcgatcagtggaactttgcctatttcttaccaacttttaaaaacaagtaaagttttggagaatagtaccaagaactcaaatgatcctgcggtattca

SEQ ID NO: 30894 - DNA, 201 bp, Homo sapiens
aaaaaaaaattggggcccagtgtggggtaggtttgtgagatcagtgagccagctgggtgcagagcggagtctttgctgacctttccccttcatgttccccrtcatcttctagcatgcagcatttcaggactgcctattttgggaaatggcttaaagggcacagttctggcccttaaaccccctttcaccccctgagtaata

SEQ ID NO: 30895 - DNA, 201 bp, Homo sapiens
tctctaactgctgacctcaggtgatccacccaccttggtctcccaaagtgctgggattataggcgtgagccaccatacctagctctacatctttatcacaytctgttcctttgccttggtgggaaaagttgcagcttagtaccaactgcctcctgcttgagccactgtgcacagttactatcagcctggccctgtaggcac

SEQ ID NO: 30896 - DNA, 201 bp, Homo sapiens
tcctcagtgggaaagtcacctaaatcaaagtagggaagaactgggttatactcaaaaaacaacttcctgactcataatgagctactgggtaaggcagtggracctcttttttcttgagcattgaggtggtgatttttaaagacaatggacaataaattgctctcttctgcctgaagcactgagggattggactaaatcatt

SEQ ID NO: 30897 - DNA, 201 bp, Homo sapiens
aggattgggtgaagcagaggcggtcagcatgtgccctccttgccaagctgtgcagctgcagggatgccatcacctaactggtccctctttccccatttgcrcaaaagctgtgtgggctgcagaggtccaggtagacccgtaaagagggtcacttgggggcaatggagagctttttgggaattcaatttgagttttctagac

SEQ ID NO: 30898 - DNA, 201 bp, Homo sapiens
gaaaaaacatcttttgtttttacaaaagatggggacctatcacactattttacagctttttaaaaaccagacaaaatcttatggacttttgtccatatgargaaatatagatctatctcattttagaactcagaacttgactgtagggatgggccatctctgcaaccctcaaactcctgggcttgagtgatttacctcatc

SEQ ID NO: 30899 - DNA, 201 bp, Homo sapiens
aggcagaggttgcagtgagccaagatcgtgccactgcactccagcctgggtgacagagtgagactctatctcaaaaaaaaaaaaaaaaaaaaaaaaaaaaractgtggccaaatcagatggctggaaacaaaggctggagtttgggaatggagaatcaccggatatgagctgaaaaagtggctgagcctaagcgtgacagg

SEQ ID NO: 30900 - DNA, 201 bp, Homo sapiens
ggagggtgagctggccgtgaccaccccaccatgcgcctggtatatggtgtttgatagcatttgttgcagtgtctgcgttgtttgtgcacctgtctgcctcrcagcctggagctcctgaaagctgggaccaggcccgatcacctttcctcttccacagtgcggggttcacactaggtgtctaggattctgctgagtgagtga

SEQ ID NO: 30901 - DNA, 201 bp, Homo sapiens
ggttgcagtgagctgagatagtgccactgcacaacagcctgggcaacagcgcaagactccatctcaaaaaaaaaaagaaaaaagtgaaagggtaatacagkcacatgatttaaataacaaaagtacagaaagctttacaaagaaaagtccccaactgctcagtttctgccacccacccctctgccacagataataagaatc

SEQ ID NO: 30902 - DNA, 201 bp, Homo sapiens
tctgctctcacactagaaggaaagtctacttgggaagacaatttaggatccgaattttggtagttgaggatggagctaggaaaagcggatacaggaggtasccaagttctgcttggacctgcagggagtgaggctggccgggctccaggtggaaatgcccaggtgaaaagggagacttggagttcaggaaagtaacctgga

SEQ ID NO: 30903 - DNA, 201 bp, Homo sapiens
gattctgctgagtgagtgatttggccaggcctgacatcaagcagagggtgtcttggggatgtggaggatcccccaatagggttggggatccctacagcttyccttgaggcccccacatctggtgccacagaaagagagtgaggggtgtgtgggcatctctgctgtcccagcagtgtggtgccctggtagctcagccactct

SEQ ID NO: 30904 - DNA, 201 bp, Homo sapiens
ctggagtgcaatagcacgatcttggttcactgcaacaatcgcctcctgggtccaagtgattctcatgcctcagccttccaagtagctgggattggaggcaygcaccaccacgcccagctaatttttgtatttttagtagagacggagtttcaccattgttggccaggctggtctcgaactcctggccacaagtgatccacc

SEQ ID NO: 30905 - DNA, 201 bp, Homo sapiens
tcaaggagattgcagtccatttgggggaggacaggccattatgacacatcctataataaaagtgtctggctgggcgcggtggctcacgcctgtaatcccakcactttgggaggctgaggtgggtggatcacaaggtcaggaggtcgagaccatcctggctaacacggtgaaacccgtctctactaaaaatacaaaaaatta

SEQ ID NO: 30906 - DNA, 201 bp, Homo sapiens
tttgggaggccaaggtgggcgatcacctgaggtcaggagttcaagaccagcctggctaacatggtgaaaccccgtctctactaaaaatacaaaaattatcygggcatggtgacgcatgcctgtaattctagctacttgggaggctgaggtaggagaattgcctgaacccgtgaggtggaggttgcagtgagccaagatcac

SEQ ID NO: 30907 - DNA, 201 bp, Homo sapiens
tggtgacgcatgcctgtaattctagctacttgggaggctgaggtaggagaattgcctgaacccgtgaggtggaggttgcagtgagccaagatcacgccacygcactctagcctgggcgacagagcaagactctgtctcaaaaaaaaaaaaagtatccgacagagggaaaaccagggaggtaagggggttgcagaggaaggg

SEQ ID NO: 30908 - DNA, 201 bp, Homo sapiens
cacttcttagccatgtcaccatgggcaaatttcttggcctctcaagacctctgcttcctaatctgtaaactgggaatcataaactccctcacttggttgtygcaagggttgaatgagcacctggcatagacctggtctattgcaagtgcccacaggagcactttgtagaagcaggaactagagatcccagggtgtgttgaa

SEQ ID NO: 30909 - DNA, 201 bp, Homo sapiens
tgacctcaggtgatccgcccgcctcggcctcccaaagtgctaggattacaggcatgagccaccacgcccagcagaaatgatgtatatcttaggaagctccygcatagtggcccagtagagtacgcatttgtttaggggtgcatgctggggaggggcctctcatagggctgcgtatgtcacccacaccaaaagctgaggaga

SEQ ID NO: 30910 - DNA, 201 bp, Homo sapiens
catatggagaatgtagcagttgcttacccaaggcataggattcaaccaaggccaggctttgacttaggaatcagagacccacattaacacttgacttcccrcttcttagccatgtcaccatgggcaaatttcttggcctctcaagacctctgcttcctaatctgtaaactgggaatcataaactccctcacttggttgttg

SEQ ID NO: 30911 - DNA, 201 bp, Homo sapiens
ttttttttgagacaaagtcttgctctgtcaccccaggctggagtgcagtggttcgatctcggctcactgcaacctccgcctcccgggttcaagcgattctmctgcctcagcctcttgggtagctgggattataggcgtgtgccaccgtgcctggctaatttttgtatttttattggagacagggtttcaccatgttggcca

SEQ ID NO: 30912 - DNA, 201 bp, Homo sapiens
tgaccctgccacatatggagaatgtagcagttgcttacccaaggcataggattcaaccaaggccaggctttgacttaggaatcagagacccacattaacayttgacttcccacttcttagccatgtcaccatgggcaaatttcttggcctctcaagacctctgcttcctaatctgtaaactgggaatcataaactccctca

SEQ ID NO: 30913 - DNA, 201 bp, Homo sapiens
ggaaaagtcagcccaagaaaggcagggggcccagacttatgctgtgtggcaaaagccctctttgatgggggaaggggaggactggaaaagcagagagatcyttctggatgtcctgggagagcagccctttgggtggtgggtggaggctggaggcagggaggaatcccctcacagtgccatgagaagggcccccaaacccag

SEQ ID NO: 30914 - DNA, 201 bp, Homo sapiens
gtgtgcatggagtaagtgttccatccgtatttgagtttttcacattttgtcttcagattgctttagaaaatgcctacttgaggttctttcgctgttgggaraggttccagagcccttaggggactaggagggtccaggaatcacggggtcctttgggtccttgcaggtcagatttgcattgggggtgctgtcctcaacctc

SEQ ID NO: 30915 - DNA, 201 bp, Homo sapiens
cttggctcactgcaagctccgcctcccgggttcacgccattctcctgcctcagcctcccgagtggctgggactacaggcacacgccaccacgcccggctartttttgtatttttcagtagagacaaggtttcactatgttggccaggctggtcttgaactcctgacctcatgatccacccgcctcggcctcccaaagtgtt

SEQ ID NO: 30916 - DNA, 201 bp, Homo sapiens
aagtgatttacccaccttggcctcccagagtgtcaggattacaggtgtgagccaccatgcccggtccacaaatattctatttcactcagtattgccatccrttcttacacatctgtctgctcttctggatagtgaaattgtaaagacagagatggtgtttggtttattcttatatcttgaacaatgaatctggctcatagt

SEQ ID NO: 30917 - DNA, 201 bp, Homo sapiens
ctctttttaaggtagaatcatatcattttaaaacatttcagttggaccatctaagttcagtccttcattttcaaaattaaaaaacaggcctcaaacgggtrcatctcacgttagctagagacagaactggagctagaagtcagatctcttacaaagttgcctttcttcttctgtgggtaagtggggcacccttgggacgct

SEQ ID NO: 30918 - DNA, 201 bp, Homo sapiens
gatataagccaattctgttctggggacttgccagaaatgacacaattggccagttgacccacagcctagttcctagcagagattggatagctgattgagcrttgtggctgttttgaggcttgaccagagattcctgccgttggcagaggggaatctgtagtctttgcttcttggtagcaggtgaggctgaaaacgcaagta

SEQ ID NO: 30919 - DNA, 201 bp, Homo sapiens
gccagctgggactgtgctaattcggtaaggcctgggtggagaaggagggcctgggcacgaccatctggtttcggaatggaggtagcagtcatttattaagyacttaatgtatatcgggcactgtacaggagacgttctggctgttctcctgtacatttcctgcaaagacctaatgagatatgattactccatcctacaggt

SEQ ID NO: 30920 - DNA, 201 bp, Homo sapiens
atttttgaaaaaccaattctctggggaatttttagctcaaatacctcatttcacaatctccatatattcagagctaacaaaatgcaaatctgacaataaayagccgttctctatttgtctagtgtaagggaaagttataagtgaggtagggttcaaggttgctcccattgtgcagttgtacaaaaatgccccttctacttt

SEQ ID NO: 30921 - DNA, 201 bp, Homo sapiens; identical to SEQ ID NO: 5970

SEQ ID NO: 30922 - DNA, 201 bp, Homo sapiens
ctgcttgaatcctgtactccctccaggggccaagatgtggcagctcacagaatgcctatatctttttttttttttgtcttttgagacagtctcactctgtygcccaggctggagtgcagtggtgagatctcacctcactgcaacccccgcctcccaggttcaagtgattcttgtgcctcagcctctcaagtagctgggatt

SEQ ID NO: 30923 - DNA, 201 bp, Homo sapiens
aaacctgaagcatcccaggagcacccactccaggagttttctcggccgcggaactcattagttagagcgccctcttgtgttctcatgtggtaatcggtcaytgaaggacttaaaatggtccttagccaacacacagtagaacttttccctcttctgaccccaagaggtcagccacccatttcatgagcatatactggtcgc

SEQ ID NO: 30924 - DNA, 201 bp, Homo sapiens
attgctgtccattgtttgttgccaaaccaattgactgcattcttttctgttttccatctttcttagtttaggcttcatgttatcggcataattggagaacktttgtctacttttttttttttcagacagggtctggctctgtcactcaggctggagtgcagtggcatgatcttggctcactgcaacctctgtcccccggcc

SEQ ID NO: 30925 - DNA, 201 bp, Homo sapiens
ttctcggccgcggaactcattagttagagcgccctcttgtgttctcatgtggtaatcggtcattgaaggacttaaaatggtccttagccaacacacagtaraacttttccctcttctgaccccaagaggtcagccacccatttcatgagcatatactggtcgccccatcagcgttctctgattggctaactgaacccactc

SEQ ID NO: 30926 - DNA, 201 bp, Homo sapiens
caggggagatgagacgtaaatcccagaactatgccaaatacataaaaccccaagttaagggtcaggcagggcacttagatctctcaagttgcctgcctgayccaagtgtagtgtacttccttttgttcctgctctaaaactttttaataaactctcactcctgctctaaaacttgccttggtctctccctgtgccttaaga

SEQ ID NO: 30927 - DNA, 201 bp, Homo sapiens
gtattgagcactccctctgtgtgagacacttggagccctaccttaatccccaagatcatctaacagttgatgggggttctattattattcttgctctgcakatggggaaacgggcccagaggttaactaatttgtccttgttccacagccagtggcagagcaaggactgaacccagggggcctggctgaagccatgctctt

SEQ ID NO: 30928 - DNA, 201 bp, Homo sapiens
aagaactgcaagtgtgcatggagtaagtgttccatccgtatttgagtttttcacattttgtcttcagattgctttagaaaatgcctacttgaggttctttygctgttgggagaggttccagagcccttaggggactaggagggtccaggaatcacggggtcctttgggtccttgcaggtcagatttgcattgggggtgctg

SEQ ID NO: 30929 - DNA, 201 bp, Homo sapiens
tcctggctctcgcctcctccctcttttctcgacctgctcctgaccctgtgatgttgttggggcagttgaactgggttatttgcgttgctcactgccatgtyatcctttgttttgtagatgccgtggaaagcagatactctgtaagtacacatttcatatacattatatttaaaagtactccactgaacagtgaaatatttc

SEQ ID NO: 30930 - DNA, 201 bp, Homo sapiens
tgccatgtcatcctttgttttgtagatgccgtggaaagcagatactctgtaagtacacatttcatatacattatatttaaaagtactccactgaacagtgraatatttccagactcacccacgtcctgcattcacacgaattcttccccgctccctagtctgtttcagaccagaagccctgggcttctctgactagccttg

SEQ ID NO: 30931 - DNA, 201 bp, Homo sapiens
ggcgtgagccactgcgcccgcccggcaaattcaccattttccagtgtatacttaaccattttaaagtgtataattcagttgcattaggtccgttcacattrctgtgcaaccaccaccactatccatctccagagctttttctttttaagtgaaagcaagtttattagagaagtaaagaaacaaaagaatggctactccata

SEQ ID NO: 30932 - DNA, 201 bp, Homo sapiens
agactaagtcttgctctgtcactcaggctggagtgcaatagcacgatcttggttcactgcaacaatcgcctcctgggtccaagtgattctcatgcctcagscttccaagtagctgggattggaggcatgcaccaccacgcccagctaatttttgtatttttagtagagacggagtttcaccattgttggccaggctggtct

SEQ ID NO: 30933 - DNA, 201 bp, Homo sapiens
tgtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagc

SEQ ID NO: 30934 - DNA, 201 bp, Homo sapiens
gtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagct

SEQ ID NO: 30935 - DNA, 201 bp, Homo sapiens
taacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagctc

SEQ ID NO: 30936 - DNA, 201 bp, Homo sapiens
agccaagatcacgccaccgcactctagcctgggcgacagagcaagactctgtctcaaaaaaaaaaaaagtatccgacagagggaaaaccagggaggtaagrgggttgcagaggaagggcagctcagtctggggaagacgaggaaaaattctggagaaatggattcctgaactgagttaggaaggatgggtaggaatttgct

SEQ ID NO: 30937 - DNA, 201 bp, Homo sapiens
tacccaactggtatattggcatatacattgggtcctgctggtctatagtgtgtgctagcaatttagttaagtattgatcatgacttatattttgatggctcatggtatttttttactgatacaatttatattatctcattaaagaaaagtaccagttcaacacatattgagcattttctgtatgctgggcaacttactggg

SEQ ID NO: 30938 - DNA, 201 bp, Homo sapiens
aggcatgcaccaccacacctagataatttttgtatttttagtagagacggggtttcgccatgttggccgggcttgtcttgaactcctgacattgtgatccrtccacctcggcctcccaaaatgctgggattacaggtgtgagccaccacgccctgccagttcagtgtttttcctatggggtctgtgacaaataatgcatct

SEQ ID NO: 30939 - DNA, 201 bp, Homo sapiens
aaacagccagcccagctgtctatctctgtaagagttctcagtcccagctattcctagggtcactgacaacccccaggctctaacccagacctcaggatctygttctggatcccggggtctgggctctcaggtgattgggaggccatagcccaaccctgcgttgagggacctggcagaatgtctggacaagggtcacggtgg

SEQ ID NO: 30940 - DNA, 201 bp, Homo sapiens
cgtgtgcatgtgtctttatagcagcatgatttatagtcctttgggtatatacccagtaatgggatggctgggtcaaatggtatttctagttctagatcccygaggaatcgccacactgacttccacaatggttgaactagtttacagtcccaccaacagtgtaaaagtgttcctgtttctccacatcctctccagcacctg

SEQ ID NO: 30941 - DNA, 201 bp, Homo sapiens
gttgccattgcttttggtgttttagacatgaagtccttgcccatgcctatgtcctgaatggtaatgcctaggttttcttctagggtttttatggttttagktctaatgtttaagtctttaatccatcttgaattaatttttgtataaggtgtaaggaagggatccagtttcagctttctacatgtggctagccagttttcc

SEQ ID NO: 30942 - DNA, 201 bp, Homo sapiens
aggattccctctttttctattgactggaatagtttcagaaggaatggtgccagttcctccttgtacctctggtagaattcggctgtgaatccatctggtcytggactctttttggttggtaagctattgattattgccacaatttcagatcccgttattggtctattcagagattcgacttcttcctggtttagtcttggg

SEQ ID NO: 30943 - DNA, 201 bp, Homo sapiens
attcggctgtgaatccatctggtcctggactctttttggttggtaagctattgattattgccacaatttcagatcccgttattggtctattcagagattcracttcttcctggtttagtcttgggagagtgtgtgtgttgaggaatttatccatttctcctagattttctagtttatttgtgtagaggtgtttgtagtatt

SEQ ID NO: 30944 - DNA, 201 bp, Homo sapiens
gatgcagcatgttcctttctgattgtgccacgctaaggctctgcttcttgttggaaggagtagggtctttctcaccctccagaaatcctggagggatcttkcagcattggtgggcaggtaaaacccagaaacactgtgcttattagagggaaggtggtattgagtgacccccaataaaacagggggcccagggccgcgcgc

SEQ ID NO: 30945 - DNA, 201 bp, Homo sapiens
aggtttgtgagatcagtgagccagctgggtgcagagcggagtctttgctgacctttccccttcatgttccccgtcatcttctagcatgcagcatttcaggrctgcctattttgggaaatggcttaaagggcacagttctggcccttaaaccccctttcaccccctgagtaatacaaaataagccctcccctagataagcaa

SEQ ID NO: 30946 - DNA, 201 bp, Homo sapiens
cctggggtagttttcctgactgtgcaggctgaatgggtgcagttttccaggccgtgccagccactagccagaccacatggcaatggggtcctgaaatcacmccttgctccatgatctgggaggagtcttggacttctccttgtcttctctttttgagcctgggctgagtgtcagcagctgtatgcacagaactttccttac

SEQ ID NO: 30947 - DNA, 201 bp, Homo sapiens
gacctcaagtgatctgcccccctcaccctcccaaagtgctgggattacaggtatgagccaccttgcccagccaggatcttctaacatcagaaatgacaagrtctctgggtgcttctggacctggttctggtggggtgcagtggtggggtacagccttgcctgcagagcctcagaccttttcctatgactgcagtggactga

SEQ ID NO: 30948 - DNA, 201 bp, Homo sapiens
gaatgaaactccatctcaaaaaaataaaaataaatataaatatataaagcttcttaacaaagagcaataaatttgtagacaaatgacaagacaaaggaagratggtttttggcttcccagagtggcaaactgagaaagtcaatcaagtggccacaaatattttatgggggcatttacagcaggtgtgttttcttaggagtt

SEQ ID NO: 30949 - DNA, 201 bp, Homo sapiens
tttatctgctacttcctactttccatagttttcatttttttcttaaaaaaatatgtgctactaatttttttttttttttgagatggagtcttgctgtgtcrcccaggctggagtgcagtggcgcaatctcagctcactgcaacctctgcctcctgggttcaagcgattctcctgcctcagcctcccgagtaactgggacta

SEQ ID NO: 30950 - DNA, 201 bp, Homo sapiens
atagttttcatttttttcttaaaaaaatatgtgctactaatttttttttttttttgagatggagtcttgctgtgtcacccaggctggagtgcagtggcgcratctcagctcactgcaacctctgcctcctgggttcaagcgattctcctgcctcagcctcccgagtaactgggactacaggtgcccaccaccacgcctggc

SEQ ID NO: 30951 - DNA, 201 bp, Homo sapiens; identical to SEQ ID NO: 5967

SEQ ID NO: 30952 - DNA, 201 bp, Homo sapiens
atcttctacttttttgttgctattttttgttttttgagactaagtcttgctctgtcactcaggctggagtgcaatagcacgatcttggttcactgcaacawtcgcctcctgggtccaagtgattctcatgcctcagccttccaagtagctgggattggaggcatgcaccaccacgcccagctaatttttgtatttttagta

SEQ ID NO: 30953 - DNA, 201 bp, Homo sapiens
accatgcccagccaggaatccttttttttaattgtcataaaatatacataatattaagtttaccattttctttttttttgagacggagtcttgctctgtcrcccaggttggagtgcagtggcgcaatcttggctcactgcaagctccgcctcccgggttcacgccattctcctgcctcagcctcccgagtggctgggacta

SEQ ID NO: 30954 - DNA, 201 bp, Homo sapiens
gggtctgggctctcaggtgattgggaggccatagcccaaccctgcgttgagggacctggcagaatgtctggacaagggtcacggtggcaggggaagaggartggggccagcaagctggaggctgcaggcccttgctgggggcctctccatccgtggcccctcaggtccagggttcctctggtgcatgtggccctgctccac

SEQ ID NO: 30955 - DNA, 201 bp, Homo sapiens
tggagtgcaatagcacgatcttggttcactgcaacaatcgcctcctgggtccaagtgattctcatgcctcagccttccaagtagctgggattggaggcatrcaccaccacgcccagctaatttttgtatttttagtagagacggagtttcaccattgttggccaggctggtctcgaactcctggccacaagtgatccaccg

SEQ ID NO: 30956 - DNA, 201 bp, Homo sapiens
gtgattctcatgcctcagccttccaagtagctgggattggaggcatgcaccaccacgcccagctaatttttgtatttttagtagagacggagtttcaccattgttggccaggctggtctcgaactcctggccacaagtgatccaccggccttggtctcccaaagttctgggatgacaggcgtgagccactgcgcccagtcc

SEQ ID NO: 30957 - DNA, 201 bp, Homo sapiens
gagcagagaccgcgccactgcactccagcctgagtgacagagtgagaatccatctaaaaaaaattgcttgctaaagaagtggtctcctgaggtcttaagaygttcctgacaatgtcttgagtgggtgggagagaggctgcagtcattgtgctgtggaatttcagaggtgagaaccacacctaaccaaaattactttccctg

SEQ ID NO: 30958 - DNA, 201 bp, Homo sapiens
aaattgtggtaaaatacaaataatataacatttattattaatgacatttagtacattcacggtgttgtgcaaccatcaccattgtctaattctagaacatwttctttctttttctttttttttttttttttgacagagtctcactcttgttgcccaggctggagtgcagtggttggatctcagctcactgcaaccttcacc

SEQ ID NO: 30959 - DNA, 201 bp, Homo sapiens
atttttttgtagagatgagggtgttactatgttgcccaggctggtcacaaactcctgggctcaagtgatagaactcctgcctcagcctcccaaattctggkattataggtgtgagccactacgcctggccttttatcagtttcttgaagggagatagggtccaaaaaagggttaggaacttctaaataattaaaaactcac

SEQ ID NO: 30960 - DNA, 201 bp, Homo sapiens
ctcattttgttgcccaggctggtctcaaactcctgggctgaagccatcctcctgcctcggcctccgaaagtgctgggataacagatatgagccaccacacmcagctgcgtgtggcattttctattttagtttggtggcacacacatcctcctgggaatctaatccaggaagtttatcttccattctttcaaccccatatcc

SEQ ID NO: 30961 - DNA, 201 bp, Homo sapiens
ctggaagcctctggtcctggaagccaaggggtttcctgtttgtcagtgcttccttgaggagaggagcctgcaggacatggctgatttcttttctttctctstttctctctctctctttctttctctctcgctctctctttttctttttcttcctttctttcctttttcctttctttccttttctctttcctccttctttct

SEQ ID NO: 30962 - DNA, 201 bp, Homo sapiens
ctctctctctttctttctctctcgctctctctttttctttttcttcctttctttcctttttcctttctttccttttctctttcctccttctttctatctttctctctctctctctctccttccttccttctttcttttcttttctttcttttttgtaagacagagtctcactgtgtcacccaggctggagtgcagtggcac

SEQ ID NO: 30963 - DNA, 201 bp, Homo sapiens
tctctctctttctttctctctcgctctctctttttctttttcttcctttctttcctttttcctttctttccttttctctttcctccttctttctatctttctctctctctctctctccttccttccttctttcttttcttttctttcttttttgtaagacagagtctcactgtgtcacccaggctggagtgcagtggcacg

SEQ ID NO: 30964 - DNA, 201 bp, Homo sapiens
accgcagcctcgaacccctgggctcaagcgatcctcccatctcagcttcctgggtagctgggaccagaggcgtgagccgccatagctggctaatttttaattttttttttgcagagatgaggtttcaccatggtgcccaggctggtctcgaacttctgggctcaagtgatcctccctccttggcctcgcaaagtgctggga

SEQ ID NO: 30965 - DNA, 201 bp, Homo sapiens
gcttaggcttctctcacactcatcctcagcctctctttgttcaagtcttccccagagcccagagctgttaaggatcatcatttctttctttctttctttcttttttttttttttgagacagggtcttcgctctgtcacccaggctggagtgcagtggcgcgatcgcagctcactgcaacctccagctcccgggttcaagtg

SEQ ID NO: 30966 - DNA, 201 bp, Homo sapiens
cgggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttc

SEQ ID NO: 30967 - DNA, 201 bp, Homo sapiens
gggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttca

SEQ ID NO: 30968 - DNA, 201 bp, Homo sapiens
gtggcaccatcttggctcactgcaacctccgcctcccaggttcaagcaattctcctgcctcagcctcccaagtagctaggattacaggcatgtgccaccayacccggctaattttgtatttttttagtggagatggggtttcaccatattggtcaggctggtcaaactcctaacctcaagtgatccacccaccctggcctc

SEQ ID NO: 30969 - DNA, 201 bp, Homo sapiens
ggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttcaa

SEQ ID NO: 30970 - DNA, 201 bp, Homo sapiens
ttaagtgaggttctgagggtgaaggtgataggtaagttgctgtgctgtgagaagaaatcatgtgggcttggggcattctttcacccccagggactgtgggracaataagagaagtagggggccaggtgcggtggctcatgcctgtaatcccagcactttaggaggccaaggccggtgaatcattgaggccaggagttcaag

SEQ ID NO: 30971 - DNA, 201 bp, Homo sapiens
gggaagggttgaagggacaagaaggaggtattgtaatcccagcactttgggaggcagaggcgagaggatcacttgagcccaggcattcaagaccagcctgkgcaacaaagcaagaacttatttctacaaaaaatttaaaaataaggaggtatcgagaccctccaggattgggtgaagcagaggcggtcagcatgtgccctc

SEQ ID NO: 30972 - DNA, 201 bp, Homo sapiens
tcgactcactgcaacctccacttcccggatttaagtgattctcctgcctcagcctcccaagtagatgggattacaggcgcccgccaccacactcagctaattttttttttttttttttgagacagagtttcgctcttgatgcccaggctggggtgcaatggagcgatctcggctcactgcaacctccgcctcccggttcaa

SEQ ID NO: 30973 - DNA, 201 bp, Homo sapiens
taacagcattgtcgttattttatcatgacgcaactgaggcttagggcagacagctggtgggtggtgggactgggatttgagcccactggtgtcccaggccyggagcttggcttcttccattgtcttaccacagcctgcactcacaggagagtgactcataagttacaataccatctgctgaccatctgctctcacactaga

SEQ ID NO: 30974 - DNA, 201 bp, Homo sapiens
aacagcattgtcgttattttatcatgacgcaactgaggcttagggcagacagctggtgggtggtgggactgggatttgagcccactggtgtcccaggcccrgagcttggcttcttccattgtcttaccacagcctgcactcacaggagagtgactcataagttacaataccatctgctgaccatctgctctcacactagaa

SEQ ID NO: 30975 - DNA, 201 bp, Homo sapiens
aaggtaacatattttattctaactttgccaccttccaaactccccgtagaagaaagatggagaataatcataatgccttcaaagactttgaacattgctcyagcgtaatattataattctccattttcaagacagagaccagatattgaatgaaaacattggtaaaacatcttctcagatggaattattacaagcacaaga

SEQ ID NO: 30976 - DNA, 201 bp, Homo sapiens
cccgtagaagaaagatggagaataatcataatgccttcaaagactttgaacattgctccagcgtaatattataattctccattttcaagacagagaccagrtattgaatgaaaacattggtaaaacatcttctcagatggaattattacaagcacaagacagttttacttcaaatttgccacaaagggaaagcaatttcaa

SEQ ID NO: 30977 - DNA, 201 bp, Homo sapiens
cagagaccagatattgaatgaaaacattggtaaaacatcttctcagatggaattattacaagcacaagacagttttacttcaaatttgccacaaagggaawgcaatttcaatattctctcagtaaaggcataaataaagtgttccaactaagaaatatctattcataaggctcatcagtagcttcagggtcagctcagctg

SEQ ID NO: 30978 - DNA, 201 bp, Homo sapiens
tattgccatccgttcttacacatctgtctgctcttctggatagtgaaattgtaaagacagagatggtgtttggtttattcttatatcttgaacaatgaatstggctcatagtaggcattcagtcaatgttcatggaataaattaaagtcagtcctagcctgtggctgcattcaataaagggtaacaacaatcacagtgaca

SEQ ID NO: 30979 - DNA, 201 bp, Homo sapiens
gagacaccatgcctggcctactttatatattttcaatgtactatttctgcattacatattttatgtactttttaatatcaatagtatgtctgtattagaartaacaatgtaaaagtgaaataagcactgggagcgtccaaagctattttaaaggtgttgggggtggccaggtgcagtggctctcgcctgtaatcccagcac

SEQ ID NO: 30980 - DNA, 201 bp, Homo sapiens
ctctcttaggttttctgactggggccctgcaaattacacaagacagattaacaagagaaaaacagagaccctctttgtttttctcttgttaatctgcctcaaaaaaaaaaaaaaaggaagaagtagtttctgcttttagtcagataaacaagctctgggaagacttccttctacatctgaaccagctcaaaacaatcctta

SEQ ID NO: 30981 - DNA, 201 bp, Homo sapiens
cccaccttggcctcccaaagtgccgggattacagggatgagctaccatgcccagccaggaatccttttttttaattgtcataaaatatacataatattaartttaccattttctttttttttgagacggagtcttgctctgtcacccaggttggagtgcagtggcgcaatcttggctcactgcaagctccgcctcccgggt

SEQ ID NO: 30982 - DNA, 201 bp, Homo sapiens
aatcataataccaataagcatagaaaaaatgttaggggtcatgtttggttgtcacgtgaactatatccttacagtgatggtgatagtaatttagggtatgycagacttcatctagcttaagtgggtaaacattgtgaaaaagctgggctaggtgccagggcttgagaatgggtgggcagagaaggctgaagatggctgaac

SEQ ID NO: 30983 - DNA, 201 bp, Homo sapiens
acaagagcgaaactccatctcaaaaaagaaagaaagaaagaaactatattcaggccaggcatggtagttcatgcctataatcccagctctttgggaggctraggtgggaggatcacttgaggccaggagttggagaccagcctgtgcaacaaagcgagactaggagaatcgctggaatctgggaggaggaggctgcagtga

SEQ ID NO: 30984 - DNA, 201 bp, Homo sapiens
caatttaggatccgaattttggtagttgaggatggagctaggaaaagcggatacaggaggtagccaagttctgcttggacctgcagggagtgaggctggcygggctccaggtggaaatgcccaggtgaaaagggagacttggagttcaggaaagtaacctggactggagccataggtttaggtgtcagtggctcagagaca

SEQ ID NO: 30985 - DNA, 201 bp, Homo sapiens
tctcatcagccactgggccatgtaatatacggaaacgtaaaaggaaaggtaacatattttattctaactttgccaccttccaaactccccgtagaagaaakatggagaataatcataatgccttcaaagactttgaacattgctccagcgtaatattataattctccattttcaagacagagaccagatattgaatgaaaa

SEQ ID NO: 30986 - DNA, 201 bp, Homo sapiens
ggagtttcaccatgttggtcaggctggtctcaaacccctaacctcatgatccgcccgccttggcctcccaaagtgctgggattacaggcgtgagccaccaygcccagccgttaattctattcttactgcttactcccttattttgtatgttcttcttctatcttacatcttttgcttttgctattgcttaagctagcctac

SEQ ID NO: 30987 - DNA, 201 bp, Homo sapiens
atcattgccatctgtctcccttcctctgaggctaaccccaggctgcatccacctagccaggcaggcctggggtagttttcctgactgtgcaggctgaatgsgtgcagttttccaggccgtgccagccactagccagaccacatggcaatggggtcctgaaatcaccccttgctccatgatctgggaggagtcttggacttc

SEQ ID NO: 30988 - DNA, 201 bp, Homo sapiens
aagactccgtctaaaaaaaaattaaaaatgcatctcctaactgtcctcctcctttgcgaacccagattgggcagtacacagtccccgggggtcactgcacmctcctgcacgctcaaaggaaacagtggctcctgcacgctcaaaggaagcagtctcagaaccttcctgcccagctgggaagctccctgggatcattgccat

SEQ ID NO: 30989 - DNA, 201 bp, Homo sapiens
agtctttaaacactggccatgacacactacactgatgcattatgtgatctgtagtttggaagccactgctttaagccatcgagggtcagacaccaggaagytgggtttggaggggatcgggaggaaagaggggccaggtcctcagccttggcctcctgttgttcaacgtagatttgcgttggacaaacagcaaacaaatga

SEQ ID NO: 30990 - DNA, 201 bp, Homo sapiens
tgggccagaccctgccctgcagacactcacgctttggggtccctctttttcttacccacaacatcctgtttcccaaaaccgtggtgctctcccctctcccsctccacaccacatggaagtcaattgctccctcctttgggttcctagagaatgaatgttctttgtaccttcagggaagacgttggaactgcagcacatggc

SEQ ID NO: 30991 - DNA, 201 bp, Homo sapiens
actagagatcccagggtgtgttgaaatcaaaatgacctttgagggagaccacaccatattccgggtacaaggcagggcgatttcacaactgcacttgggtrgctgatggctggcttctgatttaagcacagcaagcccagaccttggatgtgagcgtgttaacctttacttcaaaatccctaaggccctgttgattgtggc

SEQ ID NO: 30992 - DNA, 201 bp, Homo sapiens
cttcctctgtcacccaggctaaagagcaatggcgcgaccttggctcactgcaacctctgtctcctgggttcaagcgattctcctgtctcagcctcccaagmaactgggattacaggcacgcgccactgtgcctggctaattttttgtatttttagtaaggatggggttttaccatgttggccagcctggtctcgaactcct

SEQ ID NO: 30993 - DNA, 201 bp, Homo sapiens
actgtttagcacccgagtatttgcatgaagagtttcatttcattttttcaagtggaaccatggaggagagtggctgcccaaggtggggtttgtcttttgcygtctgagtggcccctgggatgcaggtatgtccattatttaaatctcttggtgtttacagaccacatgggtaacccctgttgtggcaaggctgagggcctc

SEQ ID NO: 30994 - DNA, 201 bp, Homo sapiens
aacaccgcaagggcaaatggaaaggtaaacgggaaggagatgtctccccagcaggctatttgaggacagtcttccctgcagaagatctcaacctggggtcmacagagtggaaatgttagagtagggagctaggcaaacatgagcaggacaggtgagggcccccacaggaatgtcaggctaccatcaggtgatggtcaggtg

SEQ ID NO: 30995 - DNA, 201 bp, Homo sapiens
ggtggtttggggttagaacaataacaacaacaaatatatctatatattgttttctgtttttatatttcattttaaggccagcagtaccacttctgaactcyaacaacgagaaaatgtcagatcccaatatggaagctaacagtcattacggtaaagtcatgttctcctgccatttctaatttcccccaacttgctacatac

SEQ ID NO: 30996 - DNA, 201 bp, Homo sapiens
gcactccagcctgggtgataagagcgggactctgtctcagaggaaaaaaaaaaaagttgagcagtggctgtctcatgttcctcttcctctgcccttctttkctcagtgtgaatccttttcctgcttttcagccccggtggatgaggtccagatttctatcctgtcaagtaaggtggtggagtctggagaggacattgtgct

SEQ ID NO: 30997 - DNA, 201 bp, Homo sapiens; identical to SEQ ID NO: 5982

SEQ ID NO: 30998 - DNA, 201 bp, Homo sapiens
tcagaagcagaatatgtaagtggtgggattacagttggaagagaaaccctggcttcaacagggtacttcatctcatcagccactgggccatgtaatatacrgaaacgtaaaaggaaaggtaacatattttattctaactttgccaccttccaaactccccgtagaagaaagatggagaataatcataatgccttcaaagac

SEQ ID NO: 30999 - DNA, 201 bp, Homo sapiens
gaaaccctggcttcaacagggtacttcatctcatcagccactgggccatgtaatatacggaaacgtaaaaggaaaggtaacatattttattctaactttgycaccttccaaactccccgtagaagaaagatggagaataatcataatgccttcaaagactttgaacattgctccagcgtaatattataattctccattttc

SEQ ID NO: 31000 - DNA, 201 bp, Homo sapiens
agcagaggaaatagggcagggtggctgccggcgctggcaggcctccagcctctggggccagcacggcttgcttggcccacttgcatggggctctcctggcmgaggaggggccagagccttggctttctagttggggcacctcggccctgcatcctgttccccaagggtccttggacccagcagggctgaaacaaaatggag

SEQ ID NO: 31001 - DNA, 201 bp, Homo sapiens
tcatgctatgacctgggccagagtgcagcggtgcaatcctagctcactgtagcctcaaagtcctgagctcaaacaagcctcccatctcagcctccagagtrgctgggactaccggggcacaccaccacaccaggctaatttttaaaaattttttgagagaagttggtgggaggtgaaaaaaaaaattttttttttttggta

SEQ ID NO: 31002 - DNA, 201 bp, Homo sapiens
gttaatgtccaatcctcacagacacactgtgaggcagatgctcgcattctctccatcttgcctatgaagaaatcaaggctcagagaagttaagcaaatccyctgaggtcacacagctagtctgggcctagaagagccttttctcctactattactctgtgttgcttcataatatggtgtaagttctgtgggagcccagaaa

SEQ ID NO: 31003 - DNA, 201 bp, Homo sapiens
ctgctaatcttccactagatggcgtcattgtcaagtgtctgtaatttcaaaagcgctagggaggaaagactgcccattaattgtttatgccttaacacttyatttttattttcgcttgtttttcttttgagtcacttgaaattaaagaaaaaaaagctgaggccaggcacagcggctcactcctgtaatcccagcactttg

SEQ ID NO: 31004 - DNA, 201 bp, Homo sapiens
tgtttcatcatgttggaccaagctggtctcgaactcctgacctcaggtgatcctcccgcctcgtcctcccaaagtgctgggattacaggcgtgagccaccrcaccccgccagctcctgctccctttcatggtgggtggtgcaaagcaggattgctcttggcccctcaaggccaaactaatgaaactgtgctacgtgcaact

SEQ ID NO: 31005 - DNA, 201 bp, Homo sapiens
ctcagaggaaaaaaaaaaaagttgagcagtggctgtctcatgttcctcttcctctgcccttctttgctcagtgtgaatccttttcctgcttttcagccccrgtggatgaggtccagatttctatcctgtcaagtaaggtggtggagtctggagaggacattgtgctgcaatgtgctgtgaatgaaggatctggtcccatca

SEQ ID NO: 31006 - DNA, 201 bp, Homo sapiens
gtatttcctaccttggtggcttctatgggttcctgggaaggtgggatggtttttgcagttgtattttgctagaggtgacagtggggaggaagtgcatggarggtaaagctgggggtttttttgtttgtttgtttttgttttctttgagatggagttttgctcttgctacccaggctggagtgcagtggtgtgatgttagct

SEQ ID NO: 31007 - DNA, 201 bp, Homo sapiens
acctgataccttgattatcacagagaaaaatgtttttggctactttaaaatgttccataattctgagcaggctggcagtcctaccttttcaccatcaaaamccccccattatttttattatgtatttatttattttatgttttgaggcagggtctcgctctgttgcccaggctggagtgcagtggcacaaccatggctcac

SEQ ID NO: 31008 - DNA, 201 bp, Homo sapiens
attgggcaaaccagaaaagataaatttggggggaaattacatctttgtgtggttagaagaagccatttctgtagatttgtccacacctagtcctgtaatgygtgtagagtggggtgcaagcgtcttggagacacacaaacatgcgcataacacccacatgttgcacacacacattgaatgctttgtaattaacctggtggt

SEQ ID NO: 31009 - DNA, 201 bp, Homo sapiens
caggagagaaggaggcaacagcagagggaagctggggagtgtccaggacatacagggctctaggacaggtagtcagccactcccaggacccggtctcattygccaagccgggagaagtcaggggaaggcacacccatgtagatatttgcaaatatttccaaaataggaaacttacattttgtcataaatggtccccttctt

SEQ ID NO: 31010 - DNA, 201 bp, Homo sapiens
gggtaaaccaaatgaggtgctcgttaaaagaatttagtccttacatgaaaaataccatcaaatgtatgtagagtttcttttagtcctgcagaaatgcatamctgataccttgattatcacagagaaaaatgtttttggctactttaaaatgttccataattctgagcaggctggcagtcctaccttttcaccatcaaaaac

SEQ ID NO: 31011 - DNA, 201 bp, Homo sapiens
gtttcattcttgttgcccaggctggagtgcagtggagcaatctcggctcactgcaatctctgtctcctgggttcaagggattctcttgcctcagcctcccragtatctgggattacaggcgcccaccaccatgctggctaattttatatttttagtagagatggggtttcaccatgttgcccaggctggtctcaactcctg

SEQ ID NO: 31012 - DNA, 201 bp, Homo sapiens
tgtgcctggctcgatgttgccaaagtgctagatattgccaaagtgctcttcaagatggttgaacattttcatcagtagtgatgctagtgtttgttttcccrcatccttaccaacaaactttttctttctttctttcttttttaaatagagattagggtcttgctatgttgaccaggctgttctcgaactcctggcctcaag

SEQ ID NO: 31013 - DNA, 201 bp, Homo sapiens
ctctgtcgcccaggctggagtgcagtggcgcgatctcggctcactgcaacctccgcccaccaggttcaagtgattctcctgcctcagcctcctgagtagcyggcattacagggggctgccaccacgcccagctaatttttgtatttttagtagagacggggtttcaccatcttggccaggctggtcttaaactcctgacct

SEQ ID NO: 31014 - DNA, 201 bp, Homo sapiens
gatgtggatgctgttggtctctggaccacactttgggtggcgagattctggttgattatagaactccagtcaagttgtcactgtcactatattattcagtmacgatcctttcatttaacctgtggctgtgttttatccagctaagattttattatagcttcaactgaaccaggattttagcctatttttaatgctctaacc

SEQ ID NO: 31015 - DNA, 201 bp, Homo sapiens; identical to SEQ ID NO: 5976

SEQ ID NO: 31016 - DNA, 201 bp, Homo sapiens
cccgtcacttgcctctcataggaaacaccatctctaatgaatgcaggcagggatcacccaccacctatgcagagcttcctgctctcattggcttttctcascctcactgtcctcttgctgacatccggttgggaccatttgcgcaactgcagactggcagggccaggcaaacacagcatggcgcctgccaagaaggtggtg

SEQ ID NO: 31017 - DNA, 201 bp, Homo sapiens
agatgagaaccacgcctagccaaaatcacttttcctgtttgcctcagtgacacagctgcagggaccctcgtggatgttgtattaaataaatttgacctttrctctttgcagatctgtgaaatgttgtcttctgaggggccacatgcatctatagtgctgaggactccttgggcctctgaagtcacagagagaaccgagcag

SEQ ID NO: 31018 - DNA, 201 bp, Homo sapiens
taaggcacatcccacctgattactgtggctctggatgggtgctgagtcttgctctgggcaccagccctacctgttgagccagaggcccacctccccatcayggaatctactcactcaatggtccatcttctacttttttgttgctattttttgttttttgagactaagtcttgctctgtcactcaggctggagtgcaatag

SEQ ID NO: 31019 - DNA, 201 bp, Homo sapiens
agccaggggaagggagaagtcttactgccggctccctccaggctcccttcctcgtgatttatcactatggaaactgagctcctttcctcttcgcgctgccrgctggtgggggtgcacattgttgatgccgttgccccacagatcagaagttccttcctctttcctgctgcagaaatgccacagtaacctacgtggcccaag

SEQ ID NO: 31020 - DNA, 201 bp, Homo sapiens
ttcaagcgattctcgtcccttagctctcgagtaactgggatcacaggcacgcaccaccatgcccggctaattttttgaatttttagtagagacggggtttsgccatgttggccagaatggtctcaacctcctgacctcaagtgatctgcccccctcaccctcccaaagtgctgggattacaggtatgagccaccttgccca

SEQ ID NO: 31021 - DNA, 201 bp, Homo sapiens; identical to SEQ ID NO: 5983

SEQ ID NO: 31022 - DNA, 201 bp, Homo sapiens; identical to SEQ ID NO: 5984

SEQ ID NO: 31023 - DNA, 201 bp, Homo sapiens
acccaagtgtagtgtacttccttttgttcctgctctaaaactttttaataaactctcactcctgctctaaaacttgccttggtctctccctgtgccttaaraccacttaaaaccacctctgcccctcagctgagttctgtctttgagaaggcaagcatcaagtttgctgcagacccattggattcaccactggtaacagaa

SEQ ID NO: 31024 - DNA, 201 bp, Homo sapiens
ataattctgagcaggctggcagtcctaccttttcaccatcaaaaaccccccattatttttattatgtatttatttattttatgttttgaggcagggtctcrctctgttgcccaggctggagtgcagtggcacaaccatggctcactacagccttgaactccagggcctcatcctcccaactcagcctccctaatagctggg

SEQ ID NO: 31025 - DNA, 201 bp, Homo sapiens
attggtctattcagagattcgacttcttcctggtttagtcttgggagagtgtgtgtgttgaggaatttatccatttctcctagattttctagtttatttgbgtagaggtgtttgtagtattctctgatggtagtttgtatttctgtgggatcggtgatgatatcccctttatcattttttattgcgtgtatttgattcttc

SEQ ID NO: 31026 - DNA, 201 bp, Homo sapiens
acagtcactcagcggagggaggcttgtgtctctcaatcaggctgatactgacagactttctcttcaatcaggctgatactgacagactttctctttccccrtaggagtgcccagtcccagggtgacactggacaagaaagaggccatccaaggtgggatcgtgagggtcaactgttctgtcccagaggaaaaggccccaat

SEQ ID NO: 31027 - DNA, 201 bp, Homo sapiens
tctcttttttatacttatttaattttttttagatggagtttcgctcttgttgcccaggctggagtgcaatggcgcgatctcagctcactgcaacctctgcmtcccgggctcaagcgattctcctgcctcagcctactaagtagctgggattacaggcatgtaccacacccggctaattttgtatttttagtagagacaggg

SEQ ID NO: 31028 - DNA, 201 bp, Homo sapiens
cgaggtgggcaaatcacctgaggtcaggaattcaagaccagcctggccaacagggcaaaaccccgtctctaaaacaacaacaacaacaaaaaaatccaaaragttagctgggcctggtgggcgcacctgtcattccagctactcgggaggctgaggcaggagatttgcttgaacccaggaggcacacgttgcggtaagctg

SEQ ID NO: 31029 - DNA, 201 bp, Homo sapiens
agacacacaaacatgcgcataacacccacatgttgcacacacacattgaatgctttgtaattaacctggtggttgtgctgtgacttctaccctatgcttgkggttagctaagtaagcccggctgagcagccaggaccacctgctgataaccaggaatcagagtcagctgtccaagactcaaggaaaagggcagagcatcag

SEQ ID NO: 31030 - DNA, 201 bp, Homo sapiens
ctgctctgtgagcacggtggacatgtctggagggagattctggtcattaggaagttttcagtggctcttggcaaacttagaaaaatataggccttccttgrgtgtgagttgtgtgtgtgagttgtgtgtgtgtgtgtgtgtgtgtgtgtatctccgtggaagaatgccaattgtcctttcatgggaaggaatggcttttat

SEQ ID NO: 31031 - DNA, 201 bp, Homo sapiens
gaaagaaggacacagagacagtgtacagtgaagtccggaaagctgtccctggtgagtgagggtctccagtgccccagcctgggggatgccccctagaatcwctgatggggccttgggagtgggcagagaaaagaagaagcaaagaaggccaaaaaaggggtgccacctcttacaccagcgctgtgggcttcctctctccca

SEQ ID NO: 31032 - DNA, 201 bp, Homo sapiens
ttcttcaagactcaactcaatgatgtcttctctttccaaaacaaaatgggtctaccccagggtgccagtcagtacagctctgatgctctctctacattcartggtatttgtgtgtataaaggccacagcggtgtgttaagacacctcgttctgcagtcactctgcctgggtttcaatctgggcaagtcccttaacagctct

SEQ ID NO: 31033 - DNA, 201 bp, Homo sapiens
taaaagctgcattgtcttttattacctgatggagtattttgttggttaatgttaacgtgggaggtgaccacgtgtaagtgtgatgagcagagggcaaggaycattggggggggcatcttgaagggcttctatagcaagggaggtggtggtggttgtggcggtaaaaactaggtcactgtttttgttgttttgtcgatgata

SEQ ID NO: 31034 - DNA, 201 bp, Homo sapiens
ctctcttctcccttgtctgttcgagctagccatgggaatgtggtgttcctgccagtgcatccattgagttcgtttattgttaatttatttattttctgagwtggagtttttgctctattgctcaggctggagtgcaatgatgtgatcttggctcactgcaacctctacctcctggattcaagtgattctcctgcctcagcc

SEQ ID NO: 31035 - DNA, 201 bp, Homo sapiens
gagcagataatgtgtgttagagttgcttagaaaaacaagatggtggacgggccccatgctagtgggtaccatccctactggaaaaaccactgcttggtgcrttagccaaatttgctttaaaattgttttttaaaaagggagggcttttataaaaatcaaatgaactaggactggttagtgggaggctcacgcaagggttgt

SEQ ID NO: 31036 - DNA, 201 bp, Homo sapiens
tactggaaaaaccactgcttggtgcattagccaaatttgctttaaaattgttttttaaaaagggagggcttttataaaaatcaaatgaactaggactggtyagtgggaggctcacgcaagggttgtgctgaggctggaaggcccagagtaggaagagttgtggagtgcagaatgagctctccaagggcagacactgccagc

SEQ ID NO: 31037 - DNA, 201 bp, Homo sapiens
agtaggaagagttgtggagtgcagaatgagctctccaagggcagacactgccagcctcactgttctctgaacccccagtatgggggacagtgcttggcacrgaaaaacccccttaaatgtttgctatgaatggtgctaaggaagaaggcagagaatgtcaaccagaggccaggcactgggcaatatatacacggccccttc

SEQ ID NO: 31038 - DNA, 201 bp, Homo sapiens
tgggtcaggagaaaattaattgaattgcccagtggggaaatgggaggagatttccttcctgaaatcaaacctggcgatcattcccagttgtttaatggccrttgcctctgaaaacattggaggaaatatcttaacaatgagatagccacgtagccaaagactaatttggtattgtttgacttgcttcaatggcacattctg

SEQ ID NO: 31039 - DNA, 201 bp, Homo sapiens
cctttcttttcttctcttttttgagacagggtctctgttgcccaggctggagtgcagtggtgggatcactgctcactgccgcctcaacctcctaggctcargtgattctcccacctcggcctcccaagtagctgggactaccagtgcacaccactaactacccctggctaatttttaatttttttttttgtagagatagca

SEQ ID NO: 31040 - DNA, 201 bp, Homo sapiens
tcccaaagtgttgtgattataggcatgagccaacactcctggccccttcattatttgtattttataaatctcattattgggaatattttatccaaaatagyattaactaagtagtcaatgatttttctatttgtatttatatgtatatttgattaattaaagtccccagtagataagggacaaccttgctaaattgataaa

SEQ ID NO: 31041 - DNA, 201 bp, Homo sapiens; identical to SEQ ID NO: 5974

SEQ ID NO: 31042 - DNA, 201 bp, Homo sapiens; identical to SEQ ID NO: 5975

SEQ ID NO: 31043 - DNA, 201 bp, Homo sapiens
aatatcaaagaaccagcagtaaatctattgaaaaacttcagagtccaaagtatttctaaagcccaaattgtcccttcatatatatttcataattcaatagraaaagaattctttcttcagaatgaactttggcaatagaaaagaaaccttatttccacattcagaaaggatgacaatgctggaaagcaaattaactttttt

SEQ ID NO: 31044 - DNA, 201 bp, Homo sapiens; identical to SEQ ID NO: 5978

SEQ ID NO: 31045 - DNA, 201 bp, Homo sapiens
agaatgaaactccatctcaaaaaaataaaaataaatataaatatataaagcttcttaacaaagagcaataaatttgtagacaaatgacaagacaaaggaargatggtttttggcttcccagagtggcaaactgagaaagtcaatcaagtggccacaaatattttatgggggcatttacagcaggtgtgttttcttaggagt

SEQ ID NO: 31046 - DNA, 201 bp, Homo sapiens
attttttcctttcttttcttctcttttttgagacagggtctctgttgcccaggctggagtgcagtggtgggatcactgctcactgccgcctcaacctcctmggctcaagtgattctcccacctcggcctcccaagtagctgggactaccagtgcacaccactaactacccctggctaatttttaatttttttttttgtaga

SEQ ID NO: 31047 - DNA, 201 bp, Homo sapiens
gtaatcctagcactttgggaggctgaggcgagtggatcacctgcggtcaggagttcaagaccagtctggccaacatggtgaaatcccatctctactaaaartacaaaaaattagccaggcctggtggcacacacctgtaatcccagctactcaggaggctgaggcaggagaatggcgtgaatccgggaggcggaggttgca

SEQ ID NO: 31048 - DNA, 201 bp, Homo sapiens; identical to SEQ ID NO: 5980

SEQ ID NO: 31049 - DNA, 201 bp, Homo sapiens
tcaaaaaaataaaaataaatataaatatataaagcttcttaacaaagagcaataaatttgtagacaaatgacaagacaaaggaaggatggtttttggcttyccagagtggcaaactgagaaagtcaatcaagtggccacaaatattttatgggggcatttacagcaggtgtgttttcttaggagtttctgcttttagggct

SEQ ID NO: 31050 - DNA, 201 bp, Homo sapiens
cttgtcgctacagagaacggaaggctcccttgatggaacttagacagcaaggccagatgcacatccctggaaggacatccatgttccgagaagaacagatratccctgtatttcaagacctctgtgcacttatttatgaacctgccctgctcccacagaacacagcaattcctcaggctaagctgccggttcttaaatcca

SEQ ID NO: 31051 - DNA, 201 bp, Homo sapiens
agttggagaccagcctggccaatatggtgaaaccccgtctctactaaaaatacaaaaaattatctaggcatggtggcatgtacctgtaaccccagctcctygggaggttgaggcaggagaattgcttgaacccgggaggcagaggttgcagtgagccgagatcacgctattgcactccagcctgggcaacaagaatgaaac

SEQ ID NO: 31052 - DNA, 201 bp, Homo sapiens
tcagcctcccgagtagctgggattacaggcacatgtcaccacgcctggctaatttttgtatttttagtagagatggggtttcaccacgttggccaggctgrtctcgaatgcctgacctttggtgatctgcccgccttgtcctcatgtgtgctccacaggcctttgggttgggattgcaggcgtgagccaccatgcccagcc

SEQ ID NO: 31053 - DNA, 201 bp, Homo sapiens
acaagagtctcgctctgtcagccaggctggagtgcagtggtgcgatctcggctcactgcaacctccacctcccgggttcaagcaattctcctgcctcagcytcccaagtaactgggactacaggcgcctgccaccacgcccggctaatttttgtatttttactagagacagggtttcactgtgttggccaggctggtctca

SEQ ID NO: 31054 - DNA, 201 bp, Homo sapiens
cccgtctctactaaaaatacaaaaaattagctggacatggtggcacatgcctgtaatcccagctactcgggaggcaggggcatgagaattgcttgaacccrggaggcagaggttcggtgagccaggattgcgccactgcactccagcctgggcaacggagcaggactttgtctcagaaaaaaagaaagaaagaaagaaaga

SEQ ID NO: 31055 - DNA, 201 bp, Homo sapiens
cagcactttgggaggctgaggcaggcagatcacctgaggtcaggagttcaagaccagcctagccagcgaaaccccatctctactaaaaacacaaaaattasccgggcgtggtggtgcatgcctgtaatcccagctactcgggaggctgaggcacgagaatcacttgaacccaggaggcggaggctgcagtgatccgagatt

SEQ ID NO: 31056 - DNA, 201 bp, Homo sapiens
cagggaagacgttggaactgcagcacatggcacagggagcgactctcccactgcctcctcaggcctctgccttgttttacactcaaggaaacagacccagrggccacaaggcaccaagcaagcagggtcaacactgggggtgggcagggcggcggctggaaccaggtctccattccttaggccccctaggccagcatttgc

SEQ ID NO: 31057 - DNA, 201 bp, Homo sapiens
atcttgatgaattgtttagtcagttacagatcaaactccatgttcttttctctgttctcacgactactcttgactagtctaaaaatatattaggttgttgmaaagtaattgtggtttttgccattacttttttaaaagatggcaaaaaacacaattataagtagcacacattttcttttttttttccttttttttttgaga

SEQ ID NO: 31058 - DNA, 201 bp, Homo sapiens
tgttaggggtactgaatttttaaaaggttttagaaaactagaatttcccttgtcactcaccctaattgttatttttcaactaggtcacaatgacgatgtcrgaaaccatgcaatgaaaccaataaatgataataaaggtaattatctaattacatgtttttattagaaccaacttttacattaaaaaaaagactcatagga

SEQ ID NO: 31059 - DNA, 201 bp, Homo sapiens
tgtctctaaactggcagaccattagggaacctgccaggtctctaacctgcccaggggtgaaggtagagagagccctggttcttgcacaggctgtagccctyggggcctgcagctgcctgcagctgtgcctccaacccacctggaagcctctggtcctggaagccaaggggtttcctgtttgtcagtgcttccttgaggaga

SEQ ID NO: 31060 - DNA, 201 bp, Homo sapiens
tcctaggagttcttaatcccaggttagtaagaaaattgctcaagcatttcagcagggatgctacttacttcccagagggggctataattacatcacaaaargtcctgtcccagaccaaatttggaacactcttcctcttttctttctttcttttttttttagacagggtcttcccaggctggagtgcagtggtgcaatctc

SEQ ID NO: 31061 - DNA, 201 bp, Homo sapiens
attgtgacccccgctgtgacagacaggccctgagcctgcccgaggtccaggaggaactgtatgtgagcttggggctgggtctatactgaggccccttggcrtacttttctcgataagactgaggacttatggccctcccaccattccctccaccaccttcgagaacagcaaccatccccaatgcccacatctcctcttggg

SEQ ID NO: 31062 - DNA, 201 bp, Homo sapiens
atcacggggtcctttgggtccttgcaggtcagatttgcattgggggtgctgtcctcaacctcactcaatgcatggaagttgacacaatggctcaacattascgttgggctgattcatcatttggctgttgacaccagcctctggcccagccaggacagaaaaagggcccctgaggaacttctggctctgttccctctatgg

SEQ ID NO: 31063 - DNA, 201 bp, Homo sapiens
tcacccaggctggagtgcagtggcgcgatcgcagctcactgcaacctccagctcccgggttcaagtgattcttctgcctcagcctcctgagtagctgggamcacagctactgccaccacgcccgggtaattttttttgtatttttagtagagacggtgtttcaccatattggtcaggctgatctcgaactccagacctcag

SEQ ID NO: 31064 - DNA, 201 bp, Homo sapiens
gctggtctcaaactcgtggcctcacgtcgatctgcccaccttggccacccaaagtgctgggattacaggcgtgagccaccgcaccgggcctagggattttyttatggtccctttcataagggcaccagtcccattcatgaggcctccaccctcatgacataaccacctccaaaggctccacctgcaagtactatcacactg

SEQ ID NO: 31065 - DNA, 201 bp, Homo sapiens
aagcactcagtaagtgctttatttatttattcaaaataaataaataaatataaaaggatgactcctccgagtacagtcggcaaaccagcagcagcaatctygggcccagcccagacccacaaaactagtctctggaatctgaacttagccagcttcagatgtttctgatgctgccaatatttgagaagcactgtttgtgtt

SEQ ID NO: 31066 - DNA, 201 bp, Homo sapiens
gggtttcaccatgttggccaggctggtctcaaactcctgacctcaggtgatccgctggcctccacctcccaaagtgctgggattacaggtgtgagccaccrcgcccggcctcacattttctagatttcagtgcattgctgttttttgggatggggaagtgatttttttattttaatgagcaattccataattagttttttg

SEQ ID NO: 31067 - DNA, 201 bp, Homo sapiens
gcaatgtgaaaattcaaggttttctgttttgttttgttttgttttttttgagactaaatctcggtctattgcccaggctggagtgcagtggtgcaatctcrgctcactgcgacctccacctcccgggttcaagcgaattctcctgcctcagcctcctgagtagctgggcccacggcacgtgccaccacacctggctaattt

SEQ ID NO: 31068 - DNA, 201 bp, Homo sapiens
tccatagttttcatttttttcttaaaaaaatatgtgctactaatttttttttttttttgagatggagtcttgctgtgtcacccaggctggagtgcagtggygcaatctcagctcactgcaacctctgcctcctgggttcaagcgattctcctgcctcagcctcccgagtaactgggactacaggtgcccaccaccacgcct

SEQ ID NO: 31069 - DNA, 201 bp, Homo sapiens
ggtttcaccatgttggccaggctggtctcaaactcctgacctcaggtgatccgctggcctccacctcccaaagtgctgggattacaggtgtgagccaccaygcccggcctcacattttctagatttcagtgcattgctgttttttgggatggggaagtgatttttttattttaatgagcaattccataattagttttttgt

SEQ ID NO: 31070 - DNA, 201 bp, Homo sapiens
ggctggagtgcagtggtgcaatctcagctcactgcgacctccacctcccgggttcaagcgaattctcctgcctcagcctcctgagtagctgggcccacggmacgtgccaccacacctggctaatttttgtgtttttagtagagacagggtttcaccatgttggcaaggctggtctccaactcctgacctcaagtgatcctc

SEQ ID NO: 31071 - DNA, 201 bp, Homo sapiens
gtgctactaatttttttttttttttgagatggagtcttgctgtgtcacccaggctggagtgcagtggcgcaatctcagctcactgcaacctctgcctcctrggttcaagcgattctcctgcctcagcctcccgagtaactgggactacaggtgcccaccaccacgcctggctaattttgtatttttagtagagatgggatt

SEQ ID NO: 31072 - DNA, 201 bp, Homo sapiens
tgaaacagagtctcactctgtcacccagactggagtacagcagtgccatctcagctgactgcaactccgtgcaacaccccccggcccctaaggcttaagcratcctcccaagtagctagaaccacagacacacaccaccatgcccagctaagtttttgtatttttggtagagatgaggttttaccatgttgcccagactgg

SEQ ID NO: 31073 - DNA, 201 bp, Homo sapiens
ggcctccacctcccaaagtgctgggattacaggtgtgagccaccacgcccggcctcacattttctagatttcagtgcattgctgttttttgggatggggargtgatttttttattttaatgagcaattccataattagttttttgttgttttaccataatggcttatttgaatattgtaacctatccccaactgtttttat

SEQ ID NO: 31074 - DNA, 201 bp, Homo sapiens
ttacaggcgtgcaccactatgctcagctaattttttgtatttttagtagagatggggtttcatcatgttagccaggctagtctcaaactcctgacctcagrcgatccacctgccttggcctctcaaagtgctgggattacaggtgtgagccaccgcaccgggccctgaaatgtttttcttccagaggccctgtgtgaggaa

SEQ ID NO: 31075 - DNA, 201 bp, Homo sapiens
tgttgggattacaggcatgagccaccacacccagccgtgatactacatttctaaaaaactgtttaaaatgttaaatgaggccagatgtggtgactcacacytgtaatcccagcactttgggaggccagggttggcagatcacctgaggccaggagttcgagaccaccctggccaacatggcaaaactccatttctacaaaa

SEQ ID NO: 31076 - DNA, 201 bp, Homo sapiens
taacaaaatgcaaatctgacaataaacagccgttctctatttgtctagtgtaagggaaagttataagtgaggtagggttcaaggttgctcccattgtgcarttgtacaaaaatgccccttctactttcttggtggtccctgagagtgttcgctttcttggacactgctgaagagttcactttcagttgctttcgttaagca

SEQ ID NO: 31077 - DNA, 201 bp, Homo sapiens
aagacagatcctagtttaaattgttgctactttttttactcctaaatgataaaaatcacacactggagctcattttccattcacctgtgaggctacaagtrtatctgtaatattttgtgcttgtacaaagggaagtggggtgctgcctatctttgaagcctggtttatcttccactttacagctaattttgaacctttgtc

SEQ ID NO: 31078 - DNA, 201 bp, Homo sapiens
cacttgtaatcccagcactttgggaggccagggttggcagatcacctgaggccaggagttcgagaccaccctggccaacatggcaaaactccatttctacwaaaaatacaaaaaaaattagccaggcatggtggtgtgcgcctgtagtcccagcaacttgggaggctgaggcaggagaattccttgaatctgggaggcgga

SEQ ID NO: 31079 - DNA, 201 bp, Homo sapiens
atgggatttgtccatgggattcaccacaaatcccattttacagttgaggatactaaggcatagagaggttaagacgcttgcccaagatcacgcagcaagcmagcccctgagaatcgttcctccccggagtggactccacgctcttgatcactgaggtgtactgtcttcggtttgggaaagtcgggtggtagaaggtggaag

SEQ ID NO: 31080 - DNA, 201 bp, Homo sapiens
ccatggcaacccacggaggcaggatatccataatcttcataattatcctgctggactgatggtgtcaccaagcctcagaaataaccgattttaccagccgygttggctcacacctgtaatcccagcactttgggaggccaaggtggtcgaatcacttgaagccaggagttcaaaaccagcctggccaaaacagtgaaaccc

SEQ ID NO: 31081 - DNA, 201 bp, Homo sapiens
ggcatgccaccatgcctggctaaatttgtatttttagtatagacagggttttaccatgttggccaggctggtctcaaactcctaacctcagatgatctacycacctcggcctcctaaagtgctaggattacaggcgtgagccaccgtgcccagcctatttcagtctttaaacactggccatgacacactacactgatgcat

SEQ ID NO: 31082 - DNA, 201 bp, Homo sapiens
aaaatacaaaaaaaattagccaggcatggtggtgtgcgcctgtagtcccagcaacttgggaggctgaggcaggagaattccttgaatctgggaggcggagkgtgcagtgagccgagatagtgccagctgaggcaggagaattccctggaggtagaggttacggtgagccaagatggcgccaccacactccagcctgagtga

SEQ ID NO: 31083 - DNA, 201 bp, Homo sapiens
cactcaaggaaacagacccaggggccacaaggcaccaagcaagcagggtcaacactgggggtgggcagggcggcggctggaaccaggtctccattccttaggccccctaggccagcatttgcagtgcgtggcctgcaggcttgctctgagtctcccgctctgcggctggggtcctgggacagcctcggccctttcccttcc

SEQ ID NO: 31084 - DNA, 201 bp, Homo sapiens
atgcttcatattatttgatgtcagttaaaaccccaaaatagtgatcaatacatttcttaccaaaggatctactttaaagacagttttacattcaatatccscagcaagactcggcttaccttcagaaaattgctcagaataaggaaacaaatggtgatttcaacatttgaagggggtagccctcatctctcaaaagtaata

SEQ ID NO: 31085 - DNA, 201 bp, Homo sapiens
aaacagacccaggggccacaaggcaccaagcaagcagggtcaacactgggggtgggcagggcggcggctggaaccaggtctccattccttaggccccctaggccagcatttgcagtgcgtggcctgcaggcttgctctgagtctcccgctctgcggctggggtcctgggacagcctcggccctttcccttccttccatctc

SEQ ID NO: 31086 - DNA, 201 bp, Homo sapiens
agcctcggccctttcccttccttccatctcaggcctctttgttcccctccagcccgcacctcactgcagctgcctcacctcaggaggtgacggctgctccrtcttcacctagaaaacagtcatctggagggaactccctcaacttcccgcctgggcctggctgcaggcttatcagcctctccacccatcctctcggtttcc

SEQ ID NO: 31087 - DNA, 201 bp, Homo sapiens
aagtgtgagccaccgcgcccagcagcttcagcttttctgacagtagactgactttgggagtgggtgtgggtttgcggatctgctctatttcctttggttcrgctggccccacttcgcttcccgtgacgacccactgcttactcatgaaagggcttcccccagagctgagcacagagcttaagcagacccggaactggggga

SEQ ID NO: 31088 - DNA, 201 bp, Homo sapiens
agcttgcagtgagccaagatcgcaccagtgcactccaggcctggcgacagagtgagactccatctcaaaaaaaaaaattggggcccagtgtggggtaggtytgtgagatcagtgagccagctgggtgcagagcggagtctttgctgacctttccccttcatgttccccgtcatcttctagcatgcagcatttcaggactgc

SEQ ID NO: 31089 - DNA, 201 bp, Homo sapiens
cacgcccggataatatttttttgtatttttagtagagatggggtttcaccgtgttagccaggatggtctccatctcctgacctcgtgatctgcctgcctcrgcctcccaaagtcctgggattacaggcctgagccaccacacccggccaagaatatcaaaattccattttttaaatctgtatcctggctaacccaaaaggg

SEQ ID NO: 31090 - DNA, 201 bp, Homo sapiens
cctcccaaagtcctgggattacaggcctgagccaccacacccggccaagaatatcaaaattccattttttaaatctgtatcctggctaacccaaaagggtmagacttccagtggacagaatgtaggtatttgaccaccaggagctgggcttctcaggcctgaatgtgcatgcaagacctggttaaaatacaggttatgatt

SEQ ID NO: 31091 - DNA, 201 bp, Homo sapiens
aggcatggtggtgtgcgcctgtagtcccagcaacttgggaggctgaggcaggagaattccttgaatctgggaggcggagggtgcagtgagccgagatagtkccagctgaggcaggagaattccctggaggtagaggttacggtgagccaagatggcgccaccacactccagcctgagtgacaaagcgagactctgtctcaa

SEQ ID NO: 31092 - DNA, 201 bp, Homo sapiens
ttccttgaatctgggaggcggagggtgcagtgagccgagatagtgccagctgaggcaggagaattccctggaggtagaggttacggtgagccaagatggcrccaccacactccagcctgagtgacaaagcgagactctgtctcaaaaaaaaaaaaataaagaaaattttaaatgaagtgccagggactttatgcgcatgtc

SEQ ID NO: 31093 - DNA, 201 bp, Homo sapiens
aaaacccactcagactcctgaaatcagagactatcgtgtcactgggacaaggagcccaatttacagatgaggaaactgaggcctgcactggtagaatagcrtgtctggggtcacctggatggctaatagagtgaggaacagagcccaggcctctatactctgcggccagtcctctgtcacgacagagactccctccaagat

SEQ ID NO: 31094 - DNA, 201 bp, Homo sapiens
agtctgctcccaggatggttctgagagctcacccatgactggtcctgtccccccagaaaaaagaatagagtcatttgatgggagcacagggtttccagccrttgggaaaggaattttgaacctttaagcaaatgggttttgtttataaaagaagcaggtatagcttccctaataatcagctggtgtgggtcaggagaaaat

SEQ ID NO: 31095 - DNA, 201 bp, Homo sapiens
ctgaggcaggagaattccctggaggtagaggttacggtgagccaagatggcgccaccacactccagcctgagtgacaaagcgagactctgtctcaaaaaawaaaaaataaagaaaattttaaatgaagtgccagggactttatgcgcatgtcatgtggagctagagggtcccggggaagctgtcttgcacaaaggagccat

SEQ ID NO: 31096 - DNA, 201 bp, Homo sapiens
aaaattttaaatgaagtgccagggactttatgcgcatgtcatgtggagctagagggtcccggggaagctgtcttgcacaaaggagccataaacctctaagrgcacctgccggctgatgtctcctggctctcgcctcctccctcttttctcgacctgctcctgaccctgtgatgttgttggggcagttgaactgggttattt

SEQ ID NO: 31097 - DNA, 201 bp, Homo sapiens
gtataattataactgctccccacccccaaaaaagccaaatcgtagtggaaaatgactaggaaaaaaaaaagtatcaacagggtttggagaatgaggccagrtatcatttttatctgctacttcctactttccatagttttcatttttttcttaaaaaaatatgtgctactaatttttttttttttttgagatggagtcttg

SEQ ID NO: 31098 - DNA, 201 bp, Homo sapiens
aggagccataaacctctaagggcacctgccggctgatgtctcctggctctcgcctcctccctcttttctcgacctgctcctgaccctgtgatgttgttggrgcagttgaactgggttatttgcgttgctcactgccatgtcatcctttgttttgtagatgccgtggaaagcagatactctgtaagtacacatttcatatac

SEQ ID NO: 31099 - DNA, 201 bp, Homo sapiens
ggaccccacgcctacgtgcattcaagtccctctcccctaccaccacttctagaatctctatttctgcttctggctctgttctctcagtgaatgggaactcttttttttaggaaaaagaaaaatcacaagcagacacccacccccaccgtttatctggtgtccccctatctggcctttctagtttcctttctcagtcgaacc

SEQ ID NO: 31100 - DNA, 201 bp, Homo sapiens
ctttattcccaaagaggataccggtggtgttattgaaaagagcaaaaacttggaaagcacctacatttttaaagtaaggaattggtgaagtcaatagttgyacatccatttaacaattatttagtagctaattggacaattatgcttaagaagttttcagaaaaagtttataaagccatgttatatgaaaaagttaagtta

SEQ ID NO: 31101 - DNA, 201 bp, Homo sapiens
tgggaggtgaccacgtgtaagtgtgatgagcagagggcaaggaccattggggggggcatcttgaagggcttctatagcaagggaggtggtggtggttgtgscggtaaaaactaggtcactgtttttgttgttttgtcgatgatatttgtgttaagatgaagagctgagactcatatctcaacagagtttataaaatgcttt

SEQ ID NO: 31102 - DNA, 201 bp, Homo sapiens
gcagtggagtgagcaaaactgggaggctggagaagtcgctttaaattaacctgaaaatgtttaatatgctttttattttgtttattttttttgagatggartctatctttgttgcccaggctggagtgcagtggtgcaatctcggctcactgcaatatccacctcccaggttcaagtgattcttctgcctcagcctcccga

SEQ ID NO: 31103 - DNA, 201 bp, Homo sapiens
agagagttattttattcctgaagtccggatctatgactcagggacatataaatgtactgtgattgtgaacaacaaagagaaaaccactgcagagtaccagstgttggtggaaggtgagtccttggaactgagcacaggcaagcagatggagcaaagcacacagtggcgtgaataacagctgtgaatgaatagtgacactgg

SEQ ID NO: 31104 - DNA, 201 bp, Homo sapiens
atggtggctcatgcctgtaatcccagttactcagctggctgaggcaggagaatcgcttgaacccgggaggcggaggtttcaatgagctgaaattgtgccaytgcactccagcctgggcaacaagaatgagactccatctcaaaaaaaaaaaaaaaaaagaaacaacaaaaatgtatttctcacagttctggagtttgggaa

SEQ ID NO: 31105 - DNA, 201 bp, Homo sapiens
tcggggtgtcaggtacttttcaggtctgaggtgaggccgtgggcagggcagcttctacccacctcatctcaactctcccttttcttgctcagtgtcacatrtaggaccagttacataatttgtgggtctagtgcaaatgaaaattcaaaattatcaggaatttcaaggtggcgacagcaaggcatcaaaccaagcatggca

SEQ ID NO: 31106 - DNA, 201 bp, Homo sapiens
tggagaatagtaccaagaactcaaatgatcctgcggtattcaaagacaaccccactgaagacgtcgaataccagtgtgttgcagataattgccattcccaygccaaaatgttaagtgaggttctgagggtgaaggtgataggtaagttgctgtgctgtgagaagaaatcatgtgggcttggggcattctttcacccccagg

SEQ ID NO: 31107 - DNA, 201 bp, Homo sapiens
gccaaggccggtgaatcattgaggccaggagttcaagaccagcctggccaacatggtgaaaccccatctctactaaaaatacaaaaattagctgggcatgrtggcgtgcgcctataatcccagccactcgggaggctgaggcaggagaattgcttgaacccaggaagcagaggttgcactgagccaagttgcgccattgca

SEQ ID NO: 31108 - DNA, 201 bp, Homo sapiens
tgggactgggatttgagcccactggtgtcccaggcccggagcttggcttcttccattgtcttaccacagcctgcactcacaggagagtgactcataagttmcaataccatctgctgaccatctgctctcacactagaaggaaagtctacttgggaagacaatttaggatccgaattttggtagttgaggatggagctagga

SEQ ID NO: 31109 - DNA, 201 bp, Homo sapiens
ggtggcttatgcctgtaatcccagcattttggaaggccgaggtgggcaaatcacctgaggtcaggaattcaagaccagcctggccaacagggcaaaacccygtctctaaaacaacaacaacaacaaaaaaatccaaagagttagctgggcctggtgggcgcacctgtcattccagctactcgggaggctgaggcaggagat

SEQ ID NO: 31110 - DNA, 201 bp, Homo sapiens
gcgggactctgtctcagaggaaaaaaaaaaaagttgagcagtggctgtctcatgttcctcttcctctgcccttctttgctcagtgtgaatccttttcctgsttttcagccccggtggatgaggtccagatttctatcctgtcaagtaaggtggtggagtctggagaggacattgtgctgcaatgtgctgtgaatgaaggat

SEQ ID NO: 31111 - DNA, 201 bp, Homo sapiens
ttcctcttcctctgcccttctttgctcagtgtgaatccttttcctgcttttcagccccggtggatgaggtccagatttctatcctgtcaagtaaggtggtrgagtctggagaggacattgtgctgcaatgtgctgtgaatgaaggatctggtcccatcacctataagttttacagagaaaaagagggcaaacccttctatc

SEQ ID NO: 31112 - DNA, 201 bp, Homo sapiens
ggtcccatcacctataagttttacagagaaaaagagggcaaacccttctatcaaatgacctcaaatgccacccaggcattttggaccaagcagaaggctadcaaggaacaggagggagagtattactgcacagccttcaacagagccaaccacgcctccagtgtccccagaagcaaaatactgacagtcagaggtgagtca

SEQ ID NO: 31113 - DNA, 201 bp, Homo sapiens
tgcgtggtgcttttctgacccctggattcagctaggcaaaaatgaaagctattattttcctcattgggcaaaccagaaaagataaatttggggggaaattrcatctttgtgtggttagaagaagccatttctgtagatttgtccacacctagtcctgtaatgcgtgtagagtggggtgcaagcgtcttggagacacacaaa

SEQ ID NO: 31114 - DNA, 201 bp, Homo sapiens
ccaggctttgacttaggaatcagagacccacattaacacttgacttcccacttcttagccatgtcaccatgggcaaatttcttggcctctcaagacctctrcttcctaatctgtaaactgggaatcataaactccctcacttggttgttgcaagggttgaatgagcacctggcatagacctggtctattgcaagtgcccac

SEQ ID NO: 31115 - DNA, 201 bp, Homo sapiens
agagttgcttctgtgaatcccccactgcccagcccagagccctctcagtgcctctgaaccccttctgcagtttgttgagacctcttataccttctacttcrtagtggtgttgtttatcaataattgatacaatataaaattcttggggacagcttcttgcatccccagcatagagaacagtgtgggtcagataagggtcca

SEQ ID NO: 31116 - DNA, 201 bp, Homo sapiens
caccatgctgcaatccagcatggccaaagagagctgatacatttcctgcccctgcttatctgaatgaatgtgctcagatggggctttggtgctcgtgggargaaaccactgcagagcgagttaacagtctactgtgcgtgttgagggtgcaggctccggcaccaaagctcaaccctgccgctcactgcttctgtgaccttg

SEQ ID NO: 31117 - DNA, 201 bp, Homo sapiens
cccctgcttatctgaatgaatgtgctcagatggggctttggtgctcgtgggaagaaaccactgcagagcgagttaacagtctactgtgcgtgttgagggtrcaggctccggcaccaaagctcaaccctgccgctcactgcttctgtgaccttgggtgagttattgaacgtgccgcagcgctgtgagatggtgataatgacc

SEQ ID NO: 31118 - DNA, 201 bp, Homo sapiens
atcatgttggaccaagctggtctcgaactcctgacctcaggtgatcctcccgcctcgtcctcccaaagtgctgggattacaggcgtgagccaccacacccygccagctcctgctccctttcatggtgggtggtgcaaagcaggattgctcttggcccctcaaggccaaactaatgaaactgtgctacgtgcaactgatgca

SEQ ID NO: 31119 - DNA, 201 bp, Homo sapiens
tctgtgggccttctctccagaaaaagcacacatttgcacacaattggaggtagttgatgagcctcctaacacccacccatgcacctcccaggggctgtgtmccccaggttgtgaacagtcactctgtgtaaatagtgagacctacaggcagtaattcagtttggctgtgcttggctggtttatttagaaagatgataatgt

SEQ ID NO: 31120 - DNA, 201 bp, Homo sapiens
tgcagtggcacgatagctcactgcaacctctgcctcctaggttcaagtgatctcctgcctcagcctcccaagtagctgggattacaggtgcccaccaccaygtctgcctaatttttgtatttttatttttattacttttatttatttatttatttatttttttgagatgcagtctcgctctgtcacccaggctggagtgca

SEQ ID NO: 31121 - DNA, 201 bp, Homo sapiens
ggctgtgtcccccaggttgtgaacagtcactctgtgtaaatagtgagacctacaggcagtaattcagtttggctgtgcttggctggtttatttagaaagaygataatgttttccatattatcaaaacaagaatcaggcagagacttttgaagtttggttgcgtggtatatttgttacctattgctgcttaacaatttacct

SEQ ID NO: 31122 - DNA, 201 bp, Homo sapiens
gtactgtgattgtgaacaacaaagagaaaaccactgcagagtaccaggtgttggtggaaggtgagtccttggaactgagcacaggcaagcagatggagcawagcacacagtggcgtgaataacagctgtgaatgaatagtgacactggacttaactctccacccatcaccctctcattcatctgcctggcattttccttac

SEQ ID NO: 31123 - DNA, 201 bp, Homo sapiens
tgatctcagctcactgcaacctctgcctcctgggttcaagcaattctcctgcctcagcctcctgagtagctgggattacaggggttctccaccatgcctgkctaatttttgtatttttttttttagtagaggtggagtttcaccatgttggtcaggctggtctcaaacccctaacctcatgatccgcccgccttggcctcc

SEQ ID NO: 31124 - DNA, 201 bp, Homo sapiens
tagttaaggaatatacattcttattgaaggtataaatttcaataaaacattttctaatatgtacagataatatactgtataaataagaaaaattttagtgktgcatgctaaaaaagataaaaataaaggaagtttgttttggtttttgtttttttgagacagagtctcactctgtcgcccaggctggagtgcagtggtgcg

SEQ ID NO: 31125 - DNA, 201 bp, Homo sapiens
tacagttttaataagcttggttatctagtttactgactttatcaaattaaaaacatggtggagcttaggaagtcctgaaacaggctggaaataactatagraacttcttaaaaaaaaataaatacagggtctcactctgttgcctaggctagagtatggtggcatgatcatggctgactgcagccttcaactcccaggctg

SEQ ID NO: 31126 - DNA, 201 bp, Homo sapiens
gaagtagtaacaaaggacagaagtaatgaatcgtagcgctccagtctgtgtgttatggtgctgcttaagtggttataaagtgatacaacaactttgaagasaaaaaaactcagtttatagtcttttgttgataattaataattagaattcagctgtgaataatatggttaattagagaaaagccctaagcagagagattcc

SEQ ID NO: 31127 - DNA, 201 bp, Homo sapiens
atacaaaaattagccaggcggtagtgccgcacgcctgtaatccccactactcaggaggctgaggcaggagaatcgcttgagcctgggaggcggaggttgcrgtgagccaagattgcaccactgcactccagtctgggtgacagagtgaaaccctgtttccaaaaaaaaaaatctgagcttggtagcacatgcctgaaagtc

SEQ ID NO: 31128 - DNA, 201 bp, Homo sapiens
aatcttcacttgacaattagagtcaaagatgatgtagagttcatatgtgtgctattttctctatctaggaacccctacccttattttaagactgggcgctyctggcccctgtctgaattgggtattttctgtgctcctgtggcactttgtgcatattctgcatctctaaactttggacttcttaaaggcaagaactattta

SEQ ID NO: 31129 - DNA, 201 bp, Homo sapiens
cttggattatgaagtgactctcacaagatggaaatcacatttacaaaattacacagttaatgccacaaaactgacagtaaatctcacaaatgatcgctatstagcaaccctaacagtaagaaatcttgttggcaaatcagatgcagctgttttaactatccctgcctgtgactttcaaggtttgtatctgtgagatggagc

SEQ ID NO: 31130 - DNA, 201 bp, Homo sapiens
tcgtaaaatgttggaattacaggaatgagccacagtgcccagcggggaagcaaaatctaagtttaaaaattgactactttacctgtaagttataataaagkgcttttaggcaaggaagtatatgctacaaaaattgataaatcacatgttttggaaatgactgtaaaatatggaaatttcaaatttgttaatatttattat

SEQ ID NO: 31131 - DNA, 201 bp, Homo sapiens
gtcgcctaggctggagtgcaatggcacgatctcagcctctgcctcctggcttcaagcgattcttgtgcaccagcctcccaagtagctggaattaaaggcaygcaccacaatgcctggctaattttgtatttttagtagagacggggtttcaccgtgttggccaggctggtttcgaactcctgatgtcaagtgatccacctg

SEQ ID NO: 31132 - DNA, 201 bp, Homo sapiens
agcccttataaatacattttgtatggtattatgaatggaggtcttttaaatagataaatttttattcattttaatagcaaagcatttgattactatttttwctaaatagaaaggtaatgctttatatgtattaatattatatagaagtcaggttcataaactacaaataataccttataggtatttaagtacagttctgtg

SEQ ID NO: 31133 - DNA, 201 bp, Homo sapiens
cgcgcccagcccttataaatacattttgtatggtattatgaatggaggtcttttaaatagataaatttttattcattttaatagcaaagcatttgattacwatttttactaaatagaaaggtaatgctttatatgtattaatattatatagaagtcaggttcataaactacaaataataccttataggtatttaagtacag

SEQ ID NO: 31134 - DNA, 201 bp, Homo sapiens
caatctcagctcactgcaacctctgccccccaggttcaagcaattctcctgcctcagcctcctgagtagctggaattacaggtgcaggtcaccacgcccgrgtaatttttgtatttttagtagagacgggatttcaccatgttggtcaggctggtctagaactcctcatctcaggtgatccatccacctcggcctcccaaa

SEQ ID NO: 31135 - DNA, 201 bp, Homo sapiens
ttggcttctacttagttgcctcttacaaacatatgtatatattacttttaaaaatatacttaatggagaaatcagttgatatttttttccagttataaatkaaagttgattttacatagaaaattaatgtgaaacaaaccagttgatgacagttaggatggatgtatatatattacttcctgaaaagaagtgtaagagttg

SEQ ID NO: 31136 - DNA, 201 bp, Homo sapiens
ttttgccaaagaataaagtgatgtctagggaattgtaaggtctgacccagtatcagagagtaacttagtagagattctccactggatgaaggaccatgctrttggaaattgagagtaatatatgcactaagatttacagtaggcatttataaataacagcaagatgatataaacagaccacattataagtttgaaacaaag

SEQ ID NO: 31137 - DNA, 201 bp, Homo sapiens
tgataggtaaagcatgtagttgtgtttaattctcttttacccaatctgattctttgtgttttgttttgtttgttttgttttgttttgttttttgagactckgtctcactctgtctcccaagctggagtgcagtggcgtgatctcactgcaacctccacttcctgggttcaggtgattctcatgcctcagcctcccaagcag

SEQ ID NO: 31138 - DNA, 201 bp, Homo sapiens
caggtgcccaccatgacacccagctaatttttgtatttttagtagagactgggttttagcatgttggttaggctgattctttgtttttaaataggggatcytatcccatgcatttattttcactctgttgtccagggtggagtgcagtggcttactacatccttgaccccttgggctcaagccatcatcccacttcagcct

SEQ ID NO: 31139 - DNA, 201 bp, Homo sapiens
tcaagcagtttcactttactagagaaatatttgacatgagaccccccccaccacaggaaagtattgttgaattgacataatgatggtaattctcagtatcycttaattgctgagaaaatgcacgtgtaaagcagctacctgaagaaagcgaacaaatactggagtaaatcctttttttttttttggtgacagagtctcgct

SEQ ID NO: 31140 - DNA, 201 bp, Homo sapiens
tctgaaagatgctaattaatcccttttagtgcctccagaaaaacctaaaaatttgagttgcattgtgaacgaggggaagaaaatgaggtgtgagtgggatsgtggaagggaaacacacttggagacaaacttcactttaaaatctgaatggtacgttattttaaatttgtttcatgttagatttattaaagttagtcattt

SEQ ID NO: 31141 - DNA, 201 bp, Homo sapiens
acccatacatacccatcactcagcttcaacactggtcagctcatgaccagtcttatttcaaaggtactctttgcctatattgtcttgaagagagaatcgcrggcatcatatttcatccaaagatatttcagtatgcgtctctaaaagatgaggacattttaaaaaaaagcataacaacataccactgttacactcagatat

SEQ ID NO: 31142 - DNA, 201 bp, Homo sapiens
atatttcagtatgcgtctctaaaagatgaggacattttaaaaaaaagcataacaacataccactgttacactcagatataaaatattacattttcagttartgttgatttcccctattgtctcatgaatatgcctatatgtataattttttttacatttgtttcagtcaagattcgaataagctccatactttgtgaattt

SEQ ID NO: 31143 - DNA, 201 bp, Homo sapiens
ttaacttgaaataactgagacctaaatgaccctaaaactataaaacttgtaggaaaaaacctttttgactttatttttattttttatatttttttttttttgagaaggagtctcattttgtcacccaggctggagtgcagtggtgctatctctgctcacttgcagcctcctctgcctcccgggttcaagcagttctcttgc

SEQ ID NO: 31144 - DNA, 201 bp, Homo sapiens
aattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatagt

SEQ ID NO: 31145 - DNA, 201 bp, Homo sapiens
aaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatag

SEQ ID NO: 31146 - DNA, 201 bp, Homo sapiens
atataggagaaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaa

SEQ ID NO: 31147 - DNA, 201 bp, Homo sapiens
atttgaacgtgcggtgagcatgatccagccactgcactccagcctgggtgacagagtgagactgtgaacaacaacaaaaaaatcaagtttcctggatctayacaaaattttcaatttaacaaatttttataaaaatttgttttaaaataaacacccctctaaatggcaaagctagaacagaatctggtcacaatctatagg

SEQ ID NO: 31148 - DNA, 201 bp, Homo sapiens; identical to SEQ ID NO: 6024

SEQ ID NO: 31149 - DNA, 201 bp, Homo sapiens
tacaggcgtgtgccaccacgcctggctaatttttgtatttttagtagagactgggtttcaccacgttggccaggatagtctcaaacttttgaccttgtgayctacccgctttagcctctggcctcccaaagtgctgggattacaggtatgagccaccgcacccagactattttctatttctttcttttttttttctttttg

SEQ ID NO: 31150 - DNA, 201 bp, Homo sapiens; identical to SEQ ID NO: 6025

SEQ ID NO: 31151 - DNA, 201 bp, Homo sapiens
ggcttgtttccacctgaattgactctcccttagctaagagagccagacagactccatcttgactctttcactggcagccccttcctcaaggacttaacttrtgcaagctgactcccagcacatccaagaatgcaattaactgataagatactgtggcaagctatatccgcaattcccaggaattcgtctgattgataacac

SEQ ID NO: 31152 - DNA, 201 bp, Homo sapiens
agcctgggtgacagagtgagactgtgaacaacaacaaaaaaatcaagtttcctggatctatacaaaattttcaatttaacaaatttttataaaaatttgtyttaaaataaacacccctctaaatggcaaagctagaacagaatctggtcacaatctataggttagatataggatgacagggaggagcaagagctgaacaca

SEQ ID NO: 31153 - DNA, 201 bp, Homo sapiens
cctagctcttattgtgaagttagtggagtatacttagaaatgttacaactttaaaatgttacaaaacattcattaaagctcatatttaaagtagagcatcyagtttgagaaatagaaatcaattattaaagatgtcttttttctacccatttaactagttaaaaccatgacatgtaaatgtagaagtagaataatcataga

SEQ ID NO: 31154 - DNA, 201 bp, Homo sapiens
atgtttcattctgatatattcagtttcccactttaggcaaaagtagattaatagaatgacgaattcaaagtagatgaggaaaatcaggcacagagaagtaraggtagggatagacccaaatttacacaacaagataatgacatctccagcttttaagttgatcatcaaaggctgggctggatttgtcttgctgtatgtgtc

SEQ ID NO: 31155 - DNA, 201 bp, Homo sapiens
ttctctacctaattgttcatttaaatttcagccttattccttgataagggattttaccacatgaagtcatccagtgaccctagctcttattgtgaagttastggagtatacttagaaatgttacaactttaaaatgttacaaaacattcattaaagctcatatttaaagtagagcatctagtttgagaaatagaaatcaat

SEQ ID NO: 31156 - DNA, 201 bp, Homo sapiens
caggaactggctgtctttttttttttttttgagatggagtttagctcttgttgcccaggctggagtgtaatggcatgatcttggcttactgcaacttccayctccctagttcaagcgattcttctgcctcagactcccgagtagctgggattacaggtgtgtgccaccatgcccagctaatttttgtgtttttagtagaga

SEQ ID NO: 31157 - DNA, 201 bp, Homo sapiens
gagcttgtaagactgaaaatgatagtatacccaaagatgatgctaccagcaaaagaaatacttggagcttttaaaaaggctatcaccatagcattcagctrtccatactcttctctgttttgattccatttatcacaaacagtatgtctttgcttttgttgctctggtcacagtgagcttgttagggaattgggctaatga

SEQ ID NO: 31158 - DNA, 201 bp, Homo sapiens
atttagtgtgaaataatatttacagactacaatctgggtgctacaggaattcatcactactggtttgtcatagtttttagattttttagattttttcagtsgaaagagctaggacatgttttgtggtttgagatataatactatcttttaaaaatacaaattcatactgatattttcagtttaaaattagggctataggtt

SEQ ID NO: 31159 - DNA, 201 bp, Homo sapiens
ccttttcccaaaactctctggtttcatttagtgtgaaataatatttacagactacaatctgggtgctacaggaattcatcactactggtttgtcatagttwttagattttttagattttttcagtcgaaagagctaggacatgttttgtggtttgagatataatactatcttttaaaaatacaaattcatactgatatttt

SEQ ID NO: 31160 - DNA, 201 bp, Homo sapiens
ttcagttagtgttgatttcccctattgtctcatgaatatgcctatatgtataattttttttacatttgtttcagtcaagattcgaataagctccatacttygtgaatttatgtcttgtctcttaaattataggttctatttgttcttttttcttacatttcagttgttaaactgttatacattgtacattgtttaacatat

SEQ ID NO: 31161 - DNA, 201 bp, Homo sapiens
ttaacttgactttttcattatggaaaaacatgcttaatctgctattcttgctttagggaacttagcagagagcaaatgctatttgataacagttactccartatatgctgatggaccaggaagccctgaatccataaaggcataccttaaacaagctcgtaagtccaaactcacttctttgaaaaaaaaagtttagggctt

SEQ ID NO: 31162 - DNA, 201 bp, Homo sapiens
caggcgtgagccactgtgcctggccttggagtaacaaagtaaacaaaataaacttactatgatccaaaagtgggttatctaatttgtggatcacccagackttactgttttggcatttgcttttcttccaacgagtttgggaaagcaataagaagagaaatataaatgaatcattttggcttctacttagttgcctcttac

SEQ ID NO: 31163 - DNA, 201 bp, Homo sapiens
gctagcacagtctcctgagtctccttgttctttggtgttttcttcttcttctcctttttttgctttttttttttttttttttttttttgagacagagtctmgctctgtcacccaggctggagtgcagtggtgcgatctcagctcactgcaacctccacctcccaggttcaagtgattctcctacctcagcctcccacgtag

SEQ ID NO: 31164 - DNA, 201 bp, Homo sapiens
tggttactttcatggatttattgaaaaagtattgtgttgtgctttagaacataaaattatgtcagaacattataaaagttgttttccaacaaaaatacttygcttcttttttaacactttcacaatgccaaatataggccaaataagcaaaagcattgaatagttgaatgaagcacagttcttatttcttccagctgtgaa

SEQ ID NO: 31165 - DNA, 201 bp, Homo sapiens
ccatcttgttctattcttcctgttttgtattggtcccttgctgtttcctttgttgtctgagttttgatgtgtggacaatgtatactgtctgtgaccccaaytgtactccacaacagcattcaggactgtagaggagaccaccactgcctgttttctggagagtttagtttagacctgggatctaaatggagggacaggata

SEQ ID NO: 31166 - DNA, 201 bp, Homo sapiens
aatacaggttatttctgtaccactgagagttactgggaagtttcagagatgcattagctctgtggctttaactaatacttgccatatacaattttttctcytccttagcacaattttaattcaaaagatcaaatgtattcagatggcaatttcactgatgtaagtgttgtggaaatagaagcaaatgacaaaaagcctttt

SEQ ID NO: 31167 - DNA, 201 bp, Homo sapiens
cacaatctcagctcactgcaacctctgccccccaggttcaagcaattctcctgcctcagcctcctgagtagctggaattacaggtgcaggtcaccacgccygggtaatttttgtatttttagtagagacgggatttcaccatgttggtcaggctggtctagaactcctcatctcaggtgatccatccacctcggcctccca

SEQ ID NO: 31168 - DNA, 201 bp, Homo sapiens
tcttctctacctaattgttcatttaaatttcagccttattccttgataagggattttaccacatgaagtcatccagtgaccctagctcttattgtgaagtragtggagtatacttagaaatgttacaactttaaaatgttacaaaacattcattaaagctcatatttaaagtagagcatctagtttgagaaatagaaatca

SEQ ID NO: 31169 - DNA, 201 bp, Homo sapiens
atttatcactgtccagatcaagatacagaacatgctcagcacccagaatgtccccttttatacccttcctcacaaaaaacaactgctctgacctctgtcamcaaacaccgtagacttttgcctctttttgaacttctgtaaaataaatcatgcagagcgtactttcttgccttttttctcttttaaaatttttttgtagag

SEQ ID NO: 31170 - DNA, 201 bp, Homo sapiens
ctaatggaagagaacagagtggataatttaaaaactaatttaataattagttaattttgtgtaggtattaccaacttctggcagtttattcacagtaacaytgtactgtgaaagatatatagaaattttcttcatcttgatccccacgcaacttattaattcaacaagcattattttgccttctatttggcaattttagtt

SEQ ID NO: 31171 - DNA, 201 bp, Homo sapiens
gataagtctagaacattttattcaaggagacttgtccagagatactcctaactagagaatcatatcctgaatcattaaaaccacactgtctagcaaactahaccttagatccccactatcaaaaatatacttgtattataccttttattcattttttttctaatagcacttgataagcccctgggaagcggttgatcctgg

SEQ ID NO: 31172 - DNA, 201 bp, Homo sapiens
ctacaaaaaagactgatgtttattttgtatctaatactaaattatcagagtaatatgaccagttatttatctgtatttaatctcctctttttttctgaaarccaagtttaaaagccaggaaaacttttgtttttcttgattgggctggatatcttccttttgcctgtccacatctacgctctacccttctctttgttgtgt

SEQ ID NO: 31173 - DNA, 201 bp, Homo sapiens
aaactacaaggatgcaaagcagttttaattaaatgcagagtgatgcagaaaatcctgtagatattaaaattagggaatgatcgtttaaggattggagtgarcatttaaggattggaatgagcaaaggatttaccagaagttggccttgaaacctgggtaggatttggataaagggaaaaatgaagacagcccattaataat

SEQ ID NO: 31174 - DNA, 201 bp, Homo sapiens
accgaaagcatttgaagaatttagggaaagcaaatttttttttttctttttgagacagtcttgctctgtcgcctaggctggagtgcaatggcacgatctcrgcctctgcctcctggcttcaagcgattcttgtgcaccagcctcccaagtagctggaattaaaggcacgcaccacaatgcctggctaattttgtattttta

SEQ ID NO: 31175 - DNA, 201 bp, Homo sapiens
tgtcgcctaggctggagtgcaatggcacgatctcagcctctgcctcctggcttcaagcgattcttgtgcaccagcctcccaagtagctggaattaaaggcrcgcaccacaatgcctggctaattttgtatttttagtagagacggggtttcaccgtgttggccaggctggtttcgaactcctgatgtcaagtgatccacct

SEQ ID NO: 31176 - DNA, 201 bp, Homo sapiens
ccacatcattctaattttgctcagttgttattaagagcatattcctaaaccatacacttttgtttcaataaagttttattttgttgagatgaataaaatawcaaagttataagctgcataagacaaaagttcaattgttcaaaaaaaatttactgggatagctttctattacaggtattgttagattatattgtgctgata

SEQ ID NO: 31177 - DNA, 201 bp, Homo sapiens
tgagccaccgcacccggcctcttgaccctgttttcttacttgcctattcaaactctgtccatggctttagccatcttctctttccttcccaaatacatttyccctccctcgttctatgccaaagccataaatttaaatgtgattacaataaatgtatttgtatatttttctctcacataagctgagtgtcaagtcctgttg

SEQ ID NO: 31178 - DNA, 201 bp, Homo sapiens
tttcctaaaattaaattatacttagtattattttataacctaccttttttcaattctctatctgtagtctcatggatccattatggcttcttcacatggcwtgagtcttgccaacgaggaccttacagcttagttgaagaaattttgcataagtaaatcagaaaaaggagaacctgtggactatgtagacagtaaatagag

SEQ ID NO: 31179 - DNA, 201 bp, Homo sapiens
ctgcctcagcctcctgagtagctgggattacaggcatgtgccaccatgcccagctaatttttttctatttttaatagagagggtttcaccatgttggtcakgctggtcttgaactcctgacctcgtgatctggctgcctctgcctcccagagtgcttagatgatagacgtggccaccgcgcctggcccccttgtctttttc

SEQ ID NO: 31180 - DNA, 201 bp, Homo sapiens
tccttcttttgatcttttctattaataattatcattcctaacgaattccacatctcactgtatcccaaggagaacaaatcagtttttaaaattttacctcytccgacctaaacttttgaagatagtgcaggaagcaagggtctgttcttcagtggatgaacagcattttatttcataatccgaaactgaaaaaaaaaaaaa

SEQ ID NO: 31181 - DNA, 201 bp, Homo sapiens
atcagaaaaccttgtctggacaaaactagttcactcactgcttctgcacctgcagttgctccctttagggttataaaataatgacccaaatgttacatgtrttgatattataacttgtcagttactgatgtctgtggtatcctaccctcatctctgaaagggataatactgaataattattagaaaactataaaacttcac

SEQ ID NO: 31182 - DNA, 201 bp, Homo sapiens
tgaccaagtacatcaagcaggagagatcttccttcattctgttatagtccacatcattctaattttgctcagttgttattaagagcatattcctaaaccayacacttttgtttcaataaagttttattttgttgagatgaataaaataacaaagttataagctgcataagacaaaagttcaattgttcaaaaaaaatttac

SEQ ID NO: 31183 - DNA, 201 bp, Homo sapiens
cattctgttatagtccacatcattctaattttgctcagttgttattaagagcatattcctaaaccatacacttttgtttcaataaagttttattttgttgrgatgaataaaataacaaagttataagctgcataagacaaaagttcaattgttcaaaaaaaatttactgggatagctttctattacaggtattgttagatt

SEQ ID NO: 31184 - DNA, 201 bp, Homo sapiens
tattgatttagactacttagactcattttatagtatctgcattttgggtagttgacagtgacttagtgacataatacaggttatttctgtaccactgagarttactgggaagtttcagagatgcattagctctgtggctttaactaatacttgccatatacaattttttctcttccttagcacaattttaattcaaaagat

SEQ ID NO: 31185 - DNA, 201 bp, Homo sapiens
ctccctttagggttataaaataatgacccaaatgttacatgtgttgatattataacttgtcagttactgatgtctgtggtatcctaccctcatctctgaargggataatactgaataattattagaaaactataaaacttcacactttgtaccattaaaacctaaaattttaatcttgtccttttttactatggatcagtc

SEQ ID NO: 31186 - DNA, 201 bp, Homo sapiens
gagtgaatatacccccatccccaagaacactttatacatattaaatggatatatgattactgtgcaaaaattcattctggaaatgaacatatatttgagcmctaatatgtaatgtacacctgccctaaggagaaaataaattataaaactttttacattcaaaattactttcccaagcatgtcttagaataatctatgtgt

SEQ ID NO: 31187 - DNA, 201 bp, Homo sapiens
tcaaaggcttaatgtgtatgaaacaataatggaagattcaactccttgcctaagtttgaagttacttgttgtatttcaaagaggagcactagtacttaagytagaatttaagtgaacaaatcttaaaatggatttttatctctggttacatagaatagttgttagcaggcttaatttagtgctagtagaagaagaaatatg

SEQ ID NO: 31188 - DNA, 201 bp, Homo sapiens
aaaaaaaaaaaatcagtaaaggggtataagaaacacagggtggttagggaagatctctatgaggaggtgaatttgagcaaaggctacaaggaattactctmtatatattaacttatgaagatgtccactatgtagtgttaagtgaaaaaggttataaaacatttctcacttacatgatcccatctttgtaaaatagaaaag

SEQ ID NO: 31189 - DNA, 201 bp, Homo sapiens
caaaaaaaaaaatctgagcttggtagcacatgcctgaaagtctcagctacttgggaggctgaggtgggagagtcacttgaacccgggaggcaaaggttgcrgtgtgtggagattgtgccactgcactccagcctagggtggcagactgagaccctatctcaaaaaacaaccaaaaataagttaatatagaggaaatatttg

SEQ ID NO: 31190 - DNA, 201 bp, Homo sapiens
ttgacttaggcagttgaagaggatgagttgtttgtagatagggaaaaatggtaagtccttgtgactttttaaaaagtgtgtgggcattcatcccattactkggcatatacccaaaggattataaatcatgctgctataaagacatacatgcacacgtatgtttattgcagcactattcacaatagcaaagacttggaacca

SEQ ID NO: 31191 - DNA, 201 bp, Homo sapiens
gttctcacagcttctccgtttctttgattgcaaaggcagaatgatcagagttgaggttcctattgtgctttattattttacacagcaaatactaagcaatyactacctgctgtacgaactcacaaaggtgcaggagatgtaatcaggaccttcaaagagtttataataattggattgacaaacttatacgaaaaaaactac

SEQ ID NO: 31192 - DNA, 201 bp, Homo sapiens
tggcaaggctcgtttacgtaagtcttggagagaagccgccgccacaatctgccgcagtctcgtgcggagtcacggccaccgagctcttcactttccccaakaggctcccacgccttccccatccccaagggagctaggcggtccctcgcggctctgagtccctcggggaaggccgcgaagagaggccgcaggcgccctggc

SEQ ID NO: 31193 - DNA, 201 bp, Homo sapiens
ttctttcacatattatatgatcttctttatgaaaaaaatagatgtttcattctgatatattcagtttcccactttaggcaaaagtagattaatagaatgaygaattcaaagtagatgaggaaaatcaggcacagagaagtaaaggtagggatagacccaaatttacacaacaagataatgacatctccagcttttaagttg

SEQ ID NO: 31194 - DNA, 201 bp, Homo sapiens
ataatttaagttcattaaaccattatttccttcctatatcctctcattcttccacaaaaacctctacctttgggtgtttacttttacagacacccacgcamacaccccacacgcacgcacgcacatgccttatcttttaactcaagattctcatcttcctttggggagaaacaaacatcatgagccttgaggtccattttc

SEQ ID NO: 31195 - DNA, 201 bp, Homo sapiens
aaaggaaggacaatataaagagtatatttgagtttgtatatgaaattggaaaacataataaaccttaggatttattttatttttcagtgaagcccaatccrccacataatttatcagtgatcaactcagaggaactgtctagtatcttaaaattgacatggaccaacccaagtattaagagtgttataatactaaaatata

SEQ ID NO: 31196 - DNA, 201 bp, Homo sapiens
ctcatcctttcaaagttctttcacatattatatgatcttctttatgaaaaaaatagatgtttcattctgatatattcagtttcccactttaggcaaaagtrgattaatagaatgacgaattcaaagtagatgaggaaaatcaggcacagagaagtaaaggtagggatagacccaaatttacacaacaagataatgacatct

SEQ ID NO: 31197 - DNA, 201 bp, Homo sapiens
tgcagtggcaggatctcagctcactgcaacctctgcctcctgggttcaagtgattctcgtgcctcagcctcccaagtaactgggattacaggcacccaccrccatgcctggctaatctttgtatttttaatagagttggggtttcaccaggctggtcttgaattcctggcctcaagtgatccgcctgcctcagcctcccaa

SEQ ID NO: 31198 - DNA, 201 bp, Homo sapiens
ttttttttgagaaggagttttgctctgtcacccaggctggagtgcagtggcaggatctcagctcactgcaacctctgcctcctgggttcaagtgattctcrtgcctcagcctcccaagtaactgggattacaggcacccaccaccatgcctggctaatctttgtatttttaatagagttggggtttcaccaggctggtctt

SEQ ID NO: 31199 - DNA, 201 bp, Homo sapiens
taatttcaggctgtaagttttgtttttgtcttatttcagactttgtcatgactattgaactgcatttttaatgttgtcctttcatctttataaaatgtagyaacttgtggacttagtgacttggacatgtttggtttttaaaaaataagcttagaagtaggaaccacaagtctcctgtctttcctgaaagtcaagcagttt

SEQ ID NO: 31200 - DNA, 201 bp, Homo sapiens
cctccccagtagctgggattacaggaatgcaccaccaagcccagctaatttttgtatttttagtagagatgaggtttcaccacgttggccaggctggtctygaactcctgacctcgtgatctgcccgccttggcctccggaagtgctgggattactggtgtgagccaccgtgccaggccttctgtttcttgatatagatga

SEQ ID NO: 31201 - DNA, 201 bp, Homo sapiens
aaagttataagctgcataagacaaaagttcaattgttcaaaaaaaatttactgggatagctttctattacaggtattgttagattatattgtgctgataakattactttctaaaaaatttgtacttttctgtaaattaaaagaatatggagtcataaaatggcaagtgttttaggattagcctaaaattggacattgtcat

SEQ ID NO: 31202 - DNA, 201 bp, Homo sapiens
tgcactctatcctgggtaacagagcaagaccctgtctcgtaaaaatatttatgtgtacgtgtgtgtgtgtgtgtgtgtgtgtgtatgtgtgtgtgtgtgtrtgtatgaataatactatcccagctgtcccccttactagctgtaggaccttggtcagtcattttctgtacctcaatttcctgatctatgaaatggtgataa

SEQ ID NO: 31203 - DNA, 201 bp, Homo sapiens
gtctccatcaagggaggaaaatgtacctttcaactcaaaattcaatatttgtttttaaatatagctattttccccaaccgctaaagattttcaacagatamgaagccagagcttagttttagaaacctgtggacattcaaacctgattctttattccctgtgactatggttatgtcattttacatgtcaaaaaagtgtatc

SEQ ID NO: 31204 - DNA, 201 bp, Homo sapiens
ttccttcttttgatcttttctattaataattatcattcctaacgaattccacatctcactgtatcccaaggagaacaaatcagtttttaaaattttacctyctccgacctaaacttttgaagatagtgcaggaagcaagggtctgttcttcagtggatgaacagcattttatttcataatccgaaactgaaaaaaaaaaaa

SEQ ID NO: 31205 - DNA, 201 bp, Homo sapiens
cagtcattaatatacctcattcttaatcacttcagtatttacatgaactagagttcagtattatgtttttaaataaaatttacatatagtgaaaacacaartcttagtgtatcattcagtgagttttgacaagtacagacacctgtgtaactcaatcagtatcaagacatagaacatgactaacacacctaaaaagttcct

SEQ ID NO: 31206 - DNA, 201 bp, Homo sapiens
atgatgttcttttatctcttgaacacaagctttgaatgataactacaggttttaagtgctgttacattaataccataatgtgatgtgttagaaacaaaggratatttcaaaggtagatatttgaaaattctctagtctcaatatgtatgtgtattgaatatactctaaaaataaatgtgcaatttgctagtaggacaatgc

SEQ ID NO: 31207 - DNA, 201 bp, Homo sapiens
tttaaagctactcaccctgtaatggatcttaaagcattccccaaagataacatgctttgggtggaatggactactccaagggaatctgtaaagaaatatayacttgagtggtgtgtgttatcagataaagcaccctgtatcacagactggcaacaagaagatggtaccgtgcatcgcacctatttaagaggtatacctggc

SEQ ID NO: 31208 - DNA, 201 bp, Homo sapiens
agtttgtggtagagagtaaaaagaagagatgggtgggaaagatattatgggagagaagacaggataagatttgtaactgagaaaagctaaaatgtactgcrtagatgagagaaacgatggactccattgacttaggcagttgaagaggatgagttgtttgtagatagggaaaaatggtaagtccttgtgactttttaaaaa

SEQ ID NO: 31209 - DNA, 201 bp, Homo sapiens
gtaaataactcttaaaacttctgagagttgcatttttattttttagaaggttaaatgtgtagttcaattatgtttttatagcttttccattttacccagtrtttatatttgttctgacataatttctctgttatacagtattagaactcagagataaacttttactaagattctaccaaatgcagatcataaatgttacaa

SEQ ID NO: 31210 - DNA, 201 bp, Homo sapiens
gaggcggaggttgcagtgagccaagatcatgccattgcactccagcctgaacaacaagaacgaaactccatctcaaaaaaaatagaagctagcataagttstggagacattaagtttgggtaggtagtcgtatgttgctcagtaaccctgaaagcatcacattagagtagaatataaaaattgttcattttttggtaatat

SEQ ID NO: 31211 - DNA, 201 bp, Homo sapiens
cgtgtgatgagatgcatttaaggccgatagtgatagatgttttttttatttcttgaacacaggctttgtctgaatgatgttcttttatctcttgaacacargctttgaatgataactacaggttttaagtgctgttacattaataccataatgtgatgtgttagaaacaaagggatatttcaaaggtagatatttgaaaat

SEQ ID NO: 31212 - DNA, 201 bp, Homo sapiens
gggaacagcagcaaggaaaaaaagcaaatttcattcacatgttctgtgttcatacctcttctctacctaattgttcatttaaatttcagccttattccttsataagggattttaccacatgaagtcatccagtgaccctagctcttattgtgaagttagtggagtatacttagaaatgttacaactttaaaatgttacaaa

SEQ ID NO: 31213 - DNA, 201 bp, Homo sapiens
gagtatatggtggagcgtctccctaccaccctgatctctcaaataccctgtcacagccagtatttgaacttttatcctcctagagatactgtgcatatatwaaaaaacgaatgtgtgttttgttttcttgtatattgttttgcccacaaataatagcaaatgcgttgttctgtaccttaacaatgtaacaatgtattttag

SEQ ID NO: 31214 - DNA, 201 bp, Homo sapiens
cggagtttcactctgtcgcccagcctggagtgcagtggcgccatctccgttcactgcaacctccgcctcccgggttcaagtgattctcctgcctcagcctmccaagtagctgggattacaggtgcccaccaccacgcccagctactttttgtatttttagtatggacggggtttcaccatgtaggccaggctggtctggaa

SEQ ID NO: 31215 - DNA, 201 bp, Homo sapiens
ttctgatatattcagtttcccactttaggcaaaagtagattaatagaatgacgaattcaaagtagatgaggaaaatcaggcacagagaagtaaaggtaggkatagacccaaatttacacaacaagataatgacatctccagcttttaagttgatcatcaaaggctgggctggatttgtcttgctgtatgtgtcaggaaatt

SEQ ID NO: 31216 - DNA, 201 bp, Homo sapiens
ctgaggtgggcagatccctttgagctcagcctgggcaacatggcaaaacactatctgtactaaaaataaaaaaattagctaggcatgatggtgccatctcyagtcccagctactcgggaggctgaggtgggagaattacctgagcctgggaagttcaagctgcagtgagctgtaattgtgctactgcactgcagcctggtg

SEQ ID NO: 31217 - DNA, 201 bp, Homo sapiens
tgtgaagttttaatatatgcaaaagtaaaatatatgctaaaatagcacaaaggtctggggggagaaatggaagtatactattatatactatgcctgaggtracataatattacttgaagatagattgtgaaaagttaaagatgtacactataaacctaaagcaaccaataagaaaacaaagaattatagcttattagctaa

SEQ ID NO: 31218 - DNA, 201 bp, Homo sapiens
ttcaggtgggagctaccaatgtgaagttttaatatatgcaaaagtaaaatatatgctaaaatagcacaaaggtctggggggagaaatggaagtatactatwatatactatgcctgaggtgacataatattacttgaagatagattgtgaaaagttaaagatgtacactataaacctaaagcaaccaataagaaaacaaaga

SEQ ID NO: 31219 - DNA, 201 bp, Homo sapiens
aagaagatggtaccgtgcatcgcacctatttaagaggtatacctggctagaaacatctaaattgatatcctttttctaactctttaggcagctttttcttytgcttatagtgttttggtccgttgaaacgacttccaatttatcatagcctcactacttactagatgtgtgactttcagcaagtcatacttaacctctctg

SEQ ID NO: 31220 - DNA, 201 bp, Homo sapiens
ccaaaggattataaatcatgctgctataaagacatacatgcacacgtatgtttattgcagcactattcacaatagcaaagacttggaaccaattcaaatgyccatcaatgatagactggattaagaaaatgtggcacatatacaccatggaatactatgcagccgtaaaaaaggatgagttcatgtcctttgtagggacat

SEQ ID NO: 31221 - DNA, 201 bp, Homo sapiens
ggcccttttggggtactggtcattttctgtttctttttttttttaagacagagtctcactttgtcaccaggctggagtgcagtggcgtgatctcagctcaytgcaacctctgcctcccgggttcaagcgattctcatatctcaacctcccgagtggctgagactacaggcgtgtgccaccacgcctggctaatttttgtat

SEQ ID NO: 31222 - DNA, 201 bp, Homo sapiens
catatacccaaaggattataaatcatgctgctataaagacatacatgcacacgtatgtttattgcagcactattcacaatagcaaagacttggaaccaatycaaatgtccatcaatgatagactggattaagaaaatgtggcacatatacaccatggaatactatgcagccgtaaaaaaggatgagttcatgtcctttgta

SEQ ID NO: 31223 - DNA, 201 bp, Homo sapiens
caggcgtgagccactacgcccggccacagagcagtacttatttcattttaaactctcttggtttagtatattcattaaaataaaataagtaaatatattasgttggtgtaaaattgtggttttcaccattaaaagtaatggcagaaattacttttgcaccaacctaatattaagcctaagaagtttcagattcttttgtag

SEQ ID NO: 31224 - DNA, 103 bp, Homo sapiens
ggrtctcggcctcccaaagtgctgggattacaggcgtgagccactacgcccggccacagagcagtacttatttcattttaaactctcttggtttagtatattc

SEQ ID NO: 31225 - DNA, 201 bp, Homo sapiens
tcccacaacttgtaccagcatccccagcgtctggcattccatgtttctgctcctgtggcctccacggtgcaacaagctagcggtttacttggacctctgcytcatctttcttcttttgcgcttcagcctgcgcattcgcttcttcctccacttggctctcatggcgccgaggtttccaaaaaaatggcgctaaggccgaga

SEQ ID NO: 31226 - DNA, 201 bp, Homo sapiens
gtgtcatgaagaatgttgtagtgtgaagtttgtacatttcagggtcagatatacaatatgaactcttaatctacaggaatgagaatggaggatcattgaargccatgatataaacaaatttgcatgttgaagcctgtataaaacatggtacagtgagtgaatatacccccatccccaagaacactttatacatattaaatg

SEQ ID NO: 31227 - DNA, 201 bp, Homo sapiens
atgactaatatttagctgcaactttcctcataacaaatagtgtcatgaagaatgttgtagtgtgaagtttgtacatttcagggtcagatatacaatatgamctcttaatctacaggaatgagaatggaggatcattgaaggccatgatataaacaaatttgcatgttgaagcctgtataaaacatggtacagtgagtgaat

SEQ ID NO: 31228 - DNA, 201 bp, Homo sapiens
acctattacattttccattttctcaaaatttaagtcacatgactaatatttagctgcaactttcctcataacaaatagtgtcatgaagaatgttgtagtgygaagtttgtacatttcagggtcagatatacaatatgaactcttaatctacaggaatgagaatggaggatcattgaaggccatgatataaacaaatttgca

SEQ ID NO: 31229 - DNA, 201 bp, Homo sapiens
cgggaggctgaggcaggagaattgcttgaacccaggaggcatgggttgcagtgagccaagatcacatcactgcactccaacctgggtgacagagtgtctgraaaaaaaaaaaaaaaaaaaaaaaaaaagcataagttttttattttgatgaagttcattttatcagttttttttctgtggttcctgagttttgtgtcctgc

SEQ ID NO: 31230 - DNA, 201 bp, Homo sapiens
tcctatctgagtagttctaatttatatctctcattttgagtgaggttgaaagtatcttttcacatgcttgatttacttgtatttccttttctataaactaytcaaatatgtttgcctgttctattaggtgttagaattttttagtgatttgtaggcattctttatatatcgggaaaatttttggccatgctatgaattaca

SEQ ID NO: 31231 - DNA, 201 bp, Homo sapiens
ttgtgacctacccgctttagcctctggcctcccaaagtgctgggattacaggtatgagccaccgcacccagactattttctatttctttcttttttttttmtttttgagaccaagtcttgctctgtcacccaggctggagtgtagtggctcactatacaaccttggctcactacaatcttggctcactacaacctccgcct

SEQ ID NO: 31232 - DNA, 201 bp, Homo sapiens
tattatcttttgcattaacctatttttttccatcatacatgctactagtatgtgcattagcatgatattctcatatacattgcattaaaaattaaaaggtrgcagctcagggtgagctcttctgttgctcatttgttcctaaatttttaagggctttttctcagtcaatagtttgtacaaactggttagtttaacttcatt

SEQ ID NO: 31233 - DNA, 201 bp, Homo sapiens
tgaactagcagtcttacagcctaattcttctttggactggtccttggcagcagttccttttcagactcgataaacagaattcagatgatgtaagtcaaaayaaaactttacaaagccaagcgtattatcttttgcattaacctatttttttccatcatacatgctactagtatgtgcattagcatgatattctcatataca

SEQ ID NO: 31234 - DNA, 201 bp, Homo sapiens
acatttacaatggaaatataattacactttttactctcagaatattgttcacattagacttcctgtttatcttttatattcttgcatttatataatgcctsatcctttcaaagttctttcacatattatatgatcttctttatgaaaaaaatagatgtttcattctgatatattcagtttcccactttaggcaaaagtaga

SEQ ID NO: 31235 - DNA, 201 bp, Homo sapiens
tggtggcacatgcctgtaatcccagccatttgggaggctgaggctggagaatctcttgaacccgggaggcggaggttgcagtgagccaagatcatgccatygcactccagcctgaacaacaagaacgaaactccatctcaaaaaaaatagaagctagcataagttgtggagacattaagtttgggtaggtagtcgtatgtt

SEQ ID NO: 31236 - DNA, 201 bp, Homo sapiens
gttgaaacgacttccaatttatcatagcctcactacttactagatgtgtgactttcagcaagtcatacttaacctctctgaattacagtctctttatgaayagagtggggttaatactttcttctttttgtaccccaatatgattttatcgtcaagggaaaactcctaaaactatagagtatagagaaatataagagtcca

SEQ ID NO: 31237 - DNA, 201 bp, Homo sapiens
tcagagaaattagttcatttggtaaggataaattattgtaaaataaaggaaggacaatataaagagtatatttgagtttgtatatgaaattggaaaacatrataaaccttaggatttattttatttttcagtgaagcccaatccgccacataatttatcagtgatcaactcagaggaactgtctagtatcttaaaattgac

SEQ ID NO: 31238 - DNA, 201 bp, Homo sapiens
atccccagcgtctggcattccatgtttctgctcctgtggcctccacggtgcaacaagctagcggtttacttggacctctgcctcatctttcttcttttgcrcttcagcctgcgcattcgcttcttcctccacttggctctcatggcgccgaggtttccaaaaaaatggcgctaaggccgagagagaactgcagtcttaacg

SEQ ID NO: 31239 - DNA, 201 bp, Homo sapiens
aatttgtacttttctgtaaattaaaagaatatggagtcataaaatggcaagtgttttaggattagcctaaaattggacattgtcattgatttcaaagaagrtatgaactagcagtcttacagcctaattcttctttggactggtccttggcagcagttccttttcagactcgataaacagaattcagatgatgtaagtcaa

SEQ ID NO: 31240 - DNA, 201 bp, Homo sapiens
gaataaatgttacggtggggctgatagctcaaggaaaaaggaaatagttaggaaatagcctgataaggtaaacatagctgaaggtcaagggaactgaagakaatagtgcagttaaaatggttgataaaagggttcttggggggcggtggctcacccctgtaatcccatcacttttaggagttgagatcagcctggccaact

SEQ ID NO: 31241 - DNA, 201 bp, Homo sapiens
gcatatacccaaaggattataaatcatgctgctataaagacatacatgcacacgtatgtttattgcagcactattcacaatagcaaagacttggaaccaaytcaaatgtccatcaatgatagactggattaagaaaatgtggcacatatacaccatggaatactatgcagccgtaaaaaaggatgagttcatgtcctttgt

SEQ ID NO: 31242 - DNA, 201 bp, Homo sapiens
aaaatttgtacttttctgtaaattaaaagaatatggagtcataaaatggcaagtgttttaggattagcctaaaattggacattgtcattgatttcaaagayggtatgaactagcagtcttacagcctaattcttctttggactggtccttggcagcagttccttttcagactcgataaacagaattcagatgatgtaagtc

SEQ ID NO: 31243 - DNA, 201 bp, Homo sapiens
atctggcactcgaggagacctcccttccccctgagagcagcgcccggaacttgtcagcccagcctggaaatccccacattccttccccttcctgctcccgsacctccgaattctacttccacaactttgtcacctcgattatcgcagccctgagtacaaacttcacccaggcgcacgcacgcacccctcttaacgcccgcc

SEQ ID NO: 31244 - DNA, 201 bp, Homo sapiens
tccctcctttcagagctgctcattttaatgggagtcagaattctctggccctaatacatttgcagcttggctcctagagaagcatggaatgttctcacagyttctccgtttctttgattgcaaaggcagaatgatcagagttgaggttcctattgtgctttattattttacacagcaaatactaagcaattactacctgct

SEQ ID NO: 31245 - DNA, 201 bp, Homo sapiens
tttatccactagttttccagatttactatttaatagctgaggtctgaaatcgtagcatcctccctcctagtggacattaaaaaaaaaaaaaaaaaaaaaamcctacttggttgtcaagagcccaagtatggaggtgctgcgccatcttgtggcctgtctgtgcccaccctgcactctgctggagtctccatccttgttgca

SEQ ID NO: 31246 - DNA, 201 bp, Homo sapiens
ctttgcacttcagttcagtgttagggcgaaagttaaatacatgtgaagtaggtgttaaaatgtcccctttatagagaaggaaacaggagtctcgctgaaamctagatctgtgtgactccaaatcctgtgctctgaatcattttgtcatgttgacacgtttctcataaaaaccccagtgccacaatttggtttgggaactta

SEQ ID NO: 31247 - DNA, 201 bp, Homo sapiens
tccaaggctttgcacttcagttcagtgttagggcgaaagttaaatacatgtgaagtaggtgttaaaatgtcccctttatagagaaggaaacaggagtctckctgaaaactagatctgtgtgactccaaatcctgtgctctgaatcattttgtcatgttgacacgtttctcataaaaaccccagtgccacaatttggtttgg

SEQ ID NO: 31248 - DNA, 201 bp, Homo sapiens
cagtttaattttctcacaggcaatttagattattataaatactgctgccacctaatttaatataatatagtcttacgtaactaaaaatgttgttctcactyttatttgtgaattgcagtattttcaatttatttaaatttgtttccaaggctttgcacttcagttcagtgttagggcgaaagttaaatacatgtgaagtag

SEQ ID NO: 31249 - DNA, 201 bp, Homo sapiens
tacaggtatgagccaccgcacccagactattttctatttctttcttttttttttctttttgagaccaagtcttgctctgtcacccaggctggagtgtagtkgctcactatacaaccttggctcactacaatcttggctcactacaacctccgcctcctaggttcaagccattctcctgcctcagcctccccagtagctggg

SEQ ID NO: 31250 - DNA, 201 bp, Homo sapiens
ttggtcccatgtggtggtatgttaataggtatgttatttaaaataaaactttataccataatcttgagaaaaattaaaaaataaacttaaaaatgtatatyttatgtatttctgtggagaccagccatctctacagagctttgtatatatgtatgtgtgtgtgtacacacacacataaaagcccatatgtatattttttgt

SEQ ID NO: 31251 - DNA, 201 bp, Homo sapiens; identical to SEQ ID NO: 6027

SEQ ID NO: 31252 - DNA, 201 bp, Homo sapiens
ctcagtctttttttgtttggatgttctgttttatgtattacccccaaccccaccccctagtgcaaagtgagttaatcagagctatgtttcagatagcatarctctggttagactggcatgctctgggattttgtcattggtaatcttcacttgacaattagagtcaaagatgatgtagagttcatatgtgtgctattttct

SEQ ID NO: 31253 - DNA, 201 bp, Homo sapiens
gattatattgtgctgataagattactttctaaaaaatttgtacttttctgtaaattaaaagaatatggagtcataaaatggcaagtgttttaggattagcstaaaattggacattgtcattgatttcaaagaaggtatgaactagcagtcttacagcctaattcttctttggactggtccttggcagcagttccttttcag

SEQ ID NO: 31254 - DNA, 201 bp, Homo sapiens
gatcatcaaaggctgggctggatttgtcttgctgtatgtgtcaggaaatttatacctattacattttccattttctcaaaatttaagtcacatgactaatrtttagctgcaactttcctcataacaaatagtgtcatgaagaatgttgtagtgtgaagtttgtacatttcagggtcagatatacaatatgaactcttaatc

SEQ ID NO: 31255 - DNA, 201 bp, Homo sapiens
gtcttaaattatgtgtatataagagaaaaaatattaaaagtaatattacatgtgtctgttgcagaaatatccgcgcaagatgttgacgttgcagacttggstagtgcaagccttgtttattttcctcaccactgaatctacaggtaaggttcatgaaataccctatcttctaacttcacaaattaggtttatatattttta

SEQ ID NO: 31256 - DNA, 201 bp, Homo sapiens
gctggatttgtcttgctgtatgtgtcaggaaatttatacctattacattttccattttctcaaaatttaagtcacatgactaatatttagctgcaactttyctcataacaaatagtgtcatgaagaatgttgtagtgtgaagtttgtacatttcagggtcagatatacaatatgaactcttaatctacaggaatgagaatg

SEQ ID NO: 31257 - DNA, 201 bp, Homo sapiens
gatttgtcttgctgtatgtgtcaggaaatttatacctattacattttccattttctcaaaatttaagtcacatgactaatatttagctgcaactttcctcmtaacaaatagtgtcatgaagaatgttgtagtgtgaagtttgtacatttcagggtcagatatacaatatgaactcttaatctacaggaatgagaatggagg

SEQ ID NO: 31258 - DNA, 201 bp, Homo sapiens
atgaaagttgattttacatagaaaattaatgtgaaacaaaccagttgatgacagttaggatggatgtatatatattacttcctgaaaagaagtgtaagagytgggatagaaaagaaattgtcatcagcctttcattgtgtccatactttttgcttgggtttgatttttttcatctaatttagatcgcaaatgccttgggta

SEQ ID NO: 31259 - DNA, 201 bp, Homo sapiens
tttgtttcaataaagttttattttgttgagatgaataaaataacaaagttataagctgcataagacaaaagttcaattgttcaaaaaaaatttactgggayagctttctattacaggtattgttagattatattgtgctgataagattactttctaaaaaatttgtacttttctgtaaattaaaagaatatggagtcataa

SEQ ID NO: 31260 - DNA, 201 bp, Homo sapiens
tagcattaggtatgtttcttttatatcctagctatgtcccactttcttctaagtgcaatcctttcatgttcacttgctgttttaccccatctactctaacwtcatttggaaggcttgtctagagtatagcatgtatttttacctttgcagtgaattgcatgtgctaattgtaaccacagctatttttatgttgacataact

SEQ ID NO: 31261 - DNA, 201 bp, Homo sapiens
tgaggcacactaagacaacttgggcaatatttgccaaaacaaaacagaaccccaaaaaatgtacatcttgttcttagcaaatatcattattgtagagacayttaataaagagatggtattttaatgtctgcagttctgaggtagggtggaacttagttctacattgtgatttaggaatttttaaaaccttttttcttcaag

SEQ ID NO: 31262 - DNA, 201 bp, Homo sapiens
cagtgactgactagcattaggtatgtttcttttatatcctagctatgtcccactttcttctaagtgcaatcctttcatgttcacttgctgttttaccccayctactctaacttcatttggaaggcttgtctagagtatagcatgtatttttacctttgcagtgaattgcatgtgctaattgtaaccacagctatttttatg

SEQ ID NO: 31263 - DNA, 201 bp, Homo sapiens
aaaacttggtatacatttacaatggaaatataattacactttttactctcagaatattgttcacattagacttcctgtttatcttttatattcttgcattkatataatgcctcatcctttcaaagttctttcacatattatatgatcttctttatgaaaaaaatagatgtttcattctgatatattcagtttcccacttta

SEQ ID NO: 31264 - DNA, 201 bp, Homo sapiens
atagtttctagaggttattggagaatagaaagctaagaaaacttggtatacatttacaatggaaatataattacactttttactctcagaatattgttcasattagacttcctgtttatcttttatattcttgcatttatataatgcctcatcctttcaaagttctttcacatattatatgatcttctttatgaaaaaaat

SEQ ID NO: 31265 - DNA, 201 bp, Homo sapiens
ttagaatagtttctagaggttattggagaatagaaagctaagaaaacttggtatacatttacaatggaaatataattacactttttactctcagaatattrttcacattagacttcctgtttatcttttatattcttgcatttatataatgcctcatcctttcaaagttctttcacatattatatgatcttctttatgaaa

SEQ ID NO: 31266 - DNA, 201 bp, Homo sapiens
gcctcccaagtagctgagattacaggtgtgcgccaccactcccggctaattttgtattgttattagagacagggtttctctatgttggtcaggctggtctsgaactcccaacctcaggtgatctgcctatctcggcctcccaaagtgctgggattataggcgtgagccaccgcgccagctggagagctattttttgatgat

SEQ ID NO: 31267 - DNA, 201 bp, Homo sapiens
attttaaaaaaaagcataacaacataccactgttacactcagatataaaatattacattttcagttagtgttgatttcccctattgtctcatgaatatgcmtatatgtataattttttttacatttgtttcagtcaagattcgaataagctccatactttgtgaatttatgtcttgtctcttaaattataggttctatttg

SEQ ID NO: 31268 - DNA, 201 bp, Homo sapiens
tgtctattcatttgccaatcagtgctatgtttactttacctttagactgccctttttttttttttctgcgagactttttttttttttgagacagagcctcrcactgttacccaggctggagtacaatggcaagatcttggcttcttagcttgctgcagcctctataagcccaggctcaagtggttgtcccacctcagcttc

SEQ ID NO: 31269 - DNA, 201 bp, Homo sapiens
tggaagcagatgctaaatataggggttttcttagaaagtaagaggaaattagcaagcgttattagtgattgactactgctatcaagtgaattcaaaggaarcaggtttttatgccatatttaagttacagaaaccaggcatgcttagaatagtttctagaggttattggagaatagaaagctaagaaaacttggtatacat

SEQ ID NO: 31270 - DNA, 201 bp, Homo sapiens
gagtgatgtgtacttctgtcaggaaagaccagataatgtttcactgtttttcttttttctgatactaagattgagcagtggtttcgggtgttgtcagcctyattcctttatttactaagtttcccatttgttttttccaaacagaaaagttgaaagagttttacagtgaacactcttgcataccctagattctacaattaa

SEQ ID NO: 31271 - DNA, 201 bp, Homo sapiens
taatgctttatatgtattaatattatatagaagtcaggttcataaactacaaataataccttataggtatttaagtacagttctgtgaaagtataagttcyataagaagaggaatgttgtttttgtactttggaattttccagagtaactcagaaaataataaaagtttgtgataatcaaaatgtatgctggtaagtgcat

SEQ ID NO: 31272 - DNA, 201 bp, Homo sapiens
tctaattttgctcagttgttattaagagcatattcctaaaccatacacttttgtttcaataaagttttattttgttgagatgaataaaataacaaagttawaagctgcataagacaaaagttcaattgttcaaaaaaaatttactgggatagctttctattacaggtattgttagattatattgtgctgataagattactt

SEQ ID NO: 31273 - DNA, 201 bp, Homo sapiens
aagtcatccagtgaccctagctcttattgtgaagttagtggagtatacttagaaatgttacaactttaaaatgttacaaaacattcattaaagctcatatwtaaagtagagcatctagtttgagaaatagaaatcaattattaaagatgtcttttttctacccatttaactagttaaaaccatgacatgtaaatgtagaag

SEQ ID NO: 31274 - DNA, 201 bp, Homo sapiens
aattactttcccaagcatgtcttagaataatctatgtgttgatgcatgtaaattgtactttaggtaggcaaagaaatctggttatttatgtaaaaactagyctaataaagttagttagtggctttatcactttaaatctttagtgtccaaaagtggtgtttaaagtaatagcacatcagaaaaccttgtctggacaaaact

SEQ ID NO: 31275 - DNA, 201 bp, Homo sapiens
gaaagtaagaggaaattagcaagcgttattagtgattgactactgctatcaagtgaattcaaaggaaacaggtttttatgccatatttaagttacagaaaycaggcatgcttagaatagtttctagaggttattggagaatagaaagctaagaaaacttggtatacatttacaatggaaatataattacactttttactct

SEQ ID NO: 31276 - DNA, 201 bp, Homo sapiens
atatcagtacttaaatttttttttttttttttttggaaatagtgcctcactctattgcccaggctggagtgcagtggcatgaacacggctcgctgcagcckctacctccaaggctgaagcgatcctcatgcctcagcccccaacatagctgggactataggcacgtgtcaccatgcccagcaaatttttgtatttttttgt

SEQ ID NO: 31277 - DNA, 201 bp, Homo sapiens
agtagtaaaggggaaaacaggaagtagtagtaaaggggaaaaaaaaccaataaagcatctaaaaaattggcatgttaaaaggcttaaattgctaatgtgtrtatatatatatatatatatacacacacatatacacacacatatcattgacttttcttaagacttcagagtactgggtagatgaacactttatacagtata

SEQ ID NO: 31278 - DNA, 201 bp, Homo sapiens
tgagttgcattgtgaacgaggggaagaaaatgaggtgtgagtgggatggtggaagggaaacacacttggagacaaacttcactttaaaatctgaatggtaygttattttaaatttgtttcatgttagatttattaaagttagtcatttttgctggaatttttattttaccaagtaataatattaaatgctattttaaaaca

SEQ ID NO: 31279 - DNA, 201 bp, Homo sapiens
tgggaggctgaggcgggcaaatcacctgaggtcgggagttcgagaccagcctgaccaatgtggataaactccgtctctactaaaacaaaatcagctaggcrtggtggcacatgcctgtaatcccagccatttgggaggctgaggctggagaatctcttgaacccgggaggcggaggttgcagtgagccaagatcatgccat

SEQ ID NO: 31280 - DNA, 201 bp, Homo sapiens
ggttactttcatggatttattgaaaaagtattgtgttgtgctttagaacataaaattatgtcagaacattataaaagttgttttccaacaaaaatacttcrcttcttttttaacactttcacaatgccaaatataggccaaataagcaaaagcattgaatagttgaatgaagcacagttcttatttcttccagctgtgaat

SEQ ID NO: 31281 - DNA, 201 bp, Homo sapiens
ctgtaaacattcttgtagatgtctttggaggtattaagcactcgtttcttttggttataccttatctgggcagattttgtttgtttttaaggtctaatttrtaaacaataaaattcaccattttttagttacaacttgataggaaacccatgagtctaacatttctgcgtttcttatcagcaaaaaccctgatggctgcct

SEQ ID NO: 31282 - DNA, 201 bp, Homo sapiens
tcgaaagcagggtgaacagcttgagtcctgttgctgctgatcggggttggctcttggacaacttagtaagatcatggaaaggctgcttgggttctccatabaaaagttctgtctccatcaagggaggaaaatgtacctttcaactcaaaattcaatatttgtttttaaatatagctattttccccaaccgctaaagatttt

SEQ ID NO: 31283 - DNA, 201 bp, Homo sapiens
taacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctg

SEQ ID NO: 31284 - DNA, 201 bp, Homo sapiens
acaactttaaaatgttacaaaacattcattaaagctcatatttaaagtagagcatctagtttgagaaatagaaatcaattattaaagatgtcttttttctmcccatttaactagttaaaaccatgacatgtaaatgtagaagtagaataatcatagaattccctaaaatatttctgtttactaacatatattgaccaagta

SEQ ID NO: 31285 - DNA, 201 bp, Homo sapiens
tgtcttgctgtatgtgtcaggaaatttatacctattacattttccattttctcaaaatttaagtcacatgactaatatttagctgcaactttcctcataayaaatagtgtcatgaagaatgttgtagtgtgaagtttgtacatttcagggtcagatatacaatatgaactcttaatctacaggaatgagaatggaggatca

SEQ ID NO: 31286 - DNA, 201 bp, Homo sapiens
gaagtagtagtaaaggggaaaaaaaaccaataaagcatctaaaaaattggcatgttaaaaggcttaaattgctaatgtgtgtatatatatatatatatatwcacacacatatacacacacatatcattgacttttcttaagacttcagagtactgggtagatgaacactttatacagtatatatcttcagcttaaatttgt

SEQ ID NO: 31287 - DNA, 201 bp, Homo sapiens
ggaagtagtagtaaaggggaaaaaaaaccaataaagcatctaaaaaattggcatgttaaaaggcttaaattgctaatgtgtgtatatatatatatatatayacacacacatatacacacacatatcattgacttttcttaagacttcagagtactgggtagatgaacactttatacagtatatatcttcagcttaaatttg

SEQ ID NO: 31288 - DNA, 201 bp, Homo sapiens
gaccatcatctacttctgctaaaataacttaaaaagaggtccataggccataactacatgagcccagcttttgtaatctgacaaaaaaatgaggagcagcytcgtgtatatcagtgtacacggtattccttaggtcccttccattggtagtgatgctgcgagttattactggagaaaaggaattctagagctttaacttgg

SEQ ID NO: 31289 - DNA, 201 bp, Homo sapiens; identical to SEQ ID NO: 6023

SEQ ID NO: 31290 - DNA, 201 bp, Homo sapiens
gccatttttaaaggcttaaattgtagtagtaaaggggaaaacaggaagtagtagtaaaggggaaaaaaaaccaataaagcatctaaaaaattggcatgttraaaggcttaaattgctaatgtgtgtatatatatatatatatatacacacacatatacacacacatatcattgacttttcttaagacttcagagtactggg

SEQ ID NO: 31291 - DNA, 201 bp, Homo sapiens
ctgtttactaacatatattgaccaagtacatcaagcaggagagatcttccttcattctgttatagtccacatcattctaattttgctcagttgttattaaragcatattcctaaaccatacacttttgtttcaataaagttttattttgttgagatgaataaaataacaaagttataagctgcataagacaaaagttcaat

SEQ ID NO: 31292 - DNA, 201 bp, Homo sapiens
atctacttctgctaaaataacttaaaaagaggtccataggccataactacatgagcccagcttttgtaatctgacaaaaaaatgaggagcagcttcgtgtrtatcagtgtacacggtattccttaggtcccttccattggtagtgatgctgcgagttattactggagaaaaggaattctagagctttaacttggcagatta

SEQ ID NO: 31293 - DNA, 201 bp, Homo sapiens
aaaaccatgacatgtaaatgtagaagtagaataatcatagaattccctaaaatatttctgtttactaacatatattgaccaagtacatcaagcaggagagmtcttccttcattctgttatagtccacatcattctaattttgctcagttgttattaagagcatattcctaaaccatacacttttgtttcaataaagtttta

SEQ ID NO: 31294 - DNA, 201 bp, Homo sapiens
agagcatattcctaaaccatacacttttgtttcaataaagttttattttgttgagatgaataaaataacaaagttataagctgcataagacaaaagttcarttgttcaaaaaaaatttactgggatagctttctattacaggtattgttagattatattgtgctgataagattactttctaaaaaatttgtacttttctgt

SEQ ID NO: 31295 - DNA, 201 bp, Homo sapiens
attaaagctcatatttaaagtagagcatctagtttgagaaatagaaatcaattattaaagatgtcttttttctacccatttaactagttaaaaccatgacrtgtaaatgtagaagtagaataatcatagaattccctaaaatatttctgtttactaacatatattgaccaagtacatcaagcaggagagatcttccttcat

SEQ ID NO: 31296 - DNA, 201 bp, Homo sapiens
acagtgacttagtgacataatacaggttatttctgtaccactgagagttactgggaagtttcagagatgcattagctctgtggctttaactaatacttgcyatatacaattttttctcttccttagcacaattttaattcaaaagatcaaatgtattcagatggcaatttcactgatgtaagtgttgtggaaatagaagca

SEQ ID NO: 31297 - DNA, 201 bp, Homo sapiens
tttatattaacagattaaaatgtattatgtatttttatattctacaaaatctctgtcattcaggtttgattttccttaatgttttctagttttctgtccasttaatcctaggctgcctagtctaggcatgaaatattaaatactacttgtagaccattagcttatcaaaatgtaacaccaacaatattgatttagactact

SEQ ID NO: 31298 - DNA, 201 bp, Homo sapiens
atagttttgattgggattttattgaatctataggtcagatttaattgaatctataggagagaactgcagtctttttttttttttttttttgatttaattcytcagctaaaacagcggaagaggtgatttattatatggttgttacactcggccacaaataaacacagaaatagtccagaatgtcacaggtccagggcagag

SEQ ID NO: 31299 - DNA, 201 bp, Homo sapiens
aatttttatttatctatctattttgagacagagtttcactcttgttgcccaggatggagtgcagtggtgcgatctcagttcactacaacctctgcctcccyggttcagactcctgcctcagccttcaaagtagctaggattacaggcgcccaccaccacacccagctaattttttgtatttttagtagagatggggtatca

SEQ ID NO: 31300 - DNA, 201 bp, Homo sapiens
taaaaaatctccaatgttaattatcccaattagtgattaatttgatgaacaagtcctcttttaaatgcagatgaggatttgtgtggtatttagggatcttrggcttgtttactttttagtttattcctactcgtgccactcctcatgcccattgagcagctcctaaagttcttagccctgtaccagctatatcctcctttt

SEQ ID NO: 31301 - DNA, 201 bp, Homo sapiens; identical to SEQ ID NO: 6018

SEQ ID NO: 31302 - DNA, 201 bp, Homo sapiens
gtatatggctgcaatattactttcatacattttttactgtaaaagactaagtaaaattcaaaattaatcaggacagtcatttaaaaaatctccaatgttarttatcccaattagtgattaatttgatgaacaagtcctcttttaaatgcagatgaggatttgtgtggtatttagggatcttaggcttgtttactttttagt

SEQ ID NO: 31303 - DNA, 201 bp, Homo sapiens
ctcctcccttgggttttctaaccatactttttctgctagcacagtctcctgagtctccttgttctttggtgttttcttcttcttctcctttttttgctttktttttttttttttttttttttgagacagagtctcgctctgtcacccaggctggagtgcagtggtgcgatctcagctcactgcaacctccacctcccaggt

SEQ ID NO: 31304 - DNA, 201 bp, Homo sapiens
ggcagattttgtttgtttttaaggtctaatttataaacaataaaattcaccattttttagttacaacttgataggaaacccatgagtctaacatttctgcrtttcttatcagcaaaaaccctgatggctgccttttttctgaactttgttttgagacggagtctcgctctgtcacctaggctggagtgcagtggtgtgacc

SEQ ID NO: 31305 - DNA, 201 bp, Homo sapiens
agcccaggctcaagtggttgtcccacctcagcttcctgagtagctgggattacaggcatggtccaccatgcccggctgatttttttttttatttttttttwattttttatagagatggggttttgccatgttgcttaggctggtcttgaactcctgggctcaagcaatctacctacctcggcctcccaaagtgctgggatt

SEQ ID NO: 31306 - DNA, 201 bp, Homo sapiens
catgacactgtggtaggctgacttgttagcttgaaagtaaggtaaaatctcagtgcctttgaaacagttgacacagaattcagtgaattttgacaaatgtrgtctttttttttttttaaatagaatttcgctttgttgcccaggctggagtgcagtggtgccatctcagctcactgcagcccctgccttccgggttcaaac

SEQ ID NO: 31307 - DNA, 201 bp, Homo sapiens
gctggagtccagtggcatgatctgggcttactgcaacctctgtttcacgggttcaaacagttctcctgcctcagcctcccgagtagctggcatcacagacrcccgccaccacgccaagctactttttgtatttttaatagagatggggtttcaccatgttggccaggctcgtctcgaactcctgacctcaagtgatctgcc

SEQ ID NO: 31308 - DNA, 201 bp, Homo sapiens
cacccgccaccacgccaagctactttttgtatttttaatagagatggggtttcaccatgttggccaggctcgtctcgaactcctgacctcaagtgatctgyccacctcggcctcccaaagtgctgggattacaggcgtgagccatcgcgtcctgccaaatgtatagagtcttatagtcaccaccacaatcaagtcatagag

SEQ ID NO: 31309 - DNA, 201 bp, Homo sapiens
tgaataggagaaaatttgttaaatcttgttaaattttacgtcattcatactacatgctcttcaggtattgaagggctgctttcctgtgtctgtaagtcctygtccccaaattacagttacccagatatctaatcattctataggatctggtttttaaccctgtgcatgctgattaccctactgattcttctcttagttgcc

SEQ ID NO: 31310 - DNA, 201 bp, Homo sapiens
tacaatttttttttttaattagccaagtattagtccattctcacactgctataaagaaatacctgagactgggtaatttataaagaaaaggtttaattgaytcacagttctgtaggctgtgcggaagcatggtggcatctgcttctggggaggctttgggaagtttccagtcatggcagaagacaaagggggagtgaggca

SEQ ID NO: 31311 - DNA, 201 bp, Homo sapiens
agagaaagggaaggtgctacaaacttttaaatgaccagagctcacaataactcattcctcatccaccatctcgaggcagtaccaagtgagaaatccacccytatgatttaatcacctctccaccaggccccacctccaacactggggattatgatacgacatgagatttgggtggggacacagattcaaaccatatcatgc

SEQ ID NO: 31312 - DNA, 201 bp, Homo sapiens
ttataaaaatgatagttactgcatatttattataaaggttattgttgtctttgaataaaagtttctttatgaaaaaaataaacgtaatataccaaaaccartctgactacagtggcactcatacttactttgatctgaacatcatttttataaagttacgtaactatgtggtagctgagatatacccttgtttcatgttga

SEQ ID NO: 31313 - DNA, 201 bp, Homo sapiens
gttgttctaatctttatgcttttagttctttttattgtcttaatgcactggctaagacctctagtacatatagtacatctagaccatataagagcattgcwttgttcctaattttagaggtgaaagtatttagtctttcaccatcacatgtgatgttagctgtaggttgaagtttttgctttgtggggtttttttgttttg

SEQ ID NO: 31314 - DNA, 201 bp, Homo sapiens
atgatagttactgcatatttattataaaggttattgttgtctttgaataaaagtttctttatgaaaaaaataaacgtaatataccaaaaccaatctgactrcagtggcactcatacttactttgatctgaacatcatttttataaagttacgtaactatgtggtagctgagatatacccttgtttcatgttgagctagtga

SEQ ID NO: 31315 - DNA, 201 bp, Homo sapiens
gaatctataggtcagatttaattgaatctataggagagaactgcagtctttttttttttttttttttgatttaattcctcagctaaaacagcggaagaggkgatttattatatggttgttacactcggccacaaataaacacagaaatagtccagaatgtcacaggtccagggcagaggaccaacatgggcattttgtttt

SEQ ID NO: 31316 - DNA, 201 bp, Homo sapiens
tcaacagtaagtctggttgggaagttgtattatgtcttcttagttcatatgtcaacattatttcccatcacacctctttttttttttttttttttttttttaagctcaaggagaaattgaagccatagtcgtgcctgtttgcttagcattcctattgacaactcttctgggagtgctgttctgctttaataagcgagacct

SEQ ID NO: 31317 - DNA, 201 bp, Homo sapiens
gctgttttaccccatctactctaacttcatttggaaggcttgtctagagtatagcatgtatttttacctttgcagtgaattgcatgtgctaattgtaaccmcagctatttttatgttgacataactccaaatgttatattaaatgttctattatatattagctctaatcccttaagtaaattttaagaaataaatacttgt

SEQ ID NO: 31318 - DNA, 201 bp, Homo sapiens
tagacgtggccaccgcgcctggcccccttgtctttttctttccaaaaaattgcttttagatctacagatttcatcagatttgggtttgattttttttttttccccaaaaaaatattttgtaggagtgatgtgtacttctgtcaggaaagaccagataatgtttcactgtttttcttttttctgatactaagattgagcagt

SEQ ID NO: 31319 - DNA, 201 bp, Homo sapiens
gtgatgagatgcatttaaggccgatagtgatagatgttttttttatttcttgaacacaggctttgtctgaatgatgttcttttatctcttgaacacaagckttgaatgataactacaggttttaagtgctgttacattaataccataatgtgatgtgttagaaacaaagggatatttcaaaggtagatatttgaaaattct

SEQ ID NO: 31320 - DNA, 201 bp, Homo sapiens
aaaggacctactgttcggacaaaaaaagtagggaaaaacgaagctgtcttagagtgggaccaacttcctgttgatgttcagaatggatttatcagaaattwtactatattttatagaaccatcattggaaatgaaactggtaataaaactgtatcagttattaagaatcagttattttttccttaagcttttaagtactaa

SEQ ID NO: 31321 - DNA, 201 bp, Homo sapiens
catacccagggccatgcatttattcttaaaactaaactatttggccatcttgttctattcttcctgttttgtattggtcccttgctgtttcctttgttgtstgagttttgatgtgtggacaatgtatactgtctgtgaccccaactgtactccacaacagcattcaggactgtagaggagaccaccactgcctgttttctg

SEQ ID NO: 31322 - DNA, 201 bp, Homo sapiens
gcaaccctaacagtaagaaatcttgttggcaaatcagatgcagctgttttaactatccctgcctgtgactttcaaggtttgtatctgtgagatggagcctractcttgggtggaaaaatggtggttaggtatggacagggctcccataaaaaacacaagttatctaagactgtctcctcagtatcagggataatcacttgt

SEQ ID NO: 31323 - DNA, 201 bp, Homo sapiens
aatcgcttgagcctgggaggcggaggttgcagtgagccaagattgcaccactgcactccagtctgggtgacagagtgaaaccctgtttccaaaaaaaaaaatctgagcttggtagcacatgcctgaaagtctcagctacttgggaggctgaggtgggagagtcacttgaacccgggaggcaaaggttgcggtgtgtggaga

SEQ ID NO: 31324 - DNA, 201 bp, Homo sapiens
aacatggtaaaaccccgtatctactaaaaatacaaaaattagccaggcggtagtgccgcacgcctgtaatccccactactcaggaggctgaggcaggagamtcgcttgagcctgggaggcggaggttgcagtgagccaagattgcaccactgcactccagtctgggtgacagagtgaaaccctgtttccaaaaaaaaaaat

SEQ ID NO: 31325 - DNA, 201 bp, Homo sapiens
tggccaacatggtaaaaccccgtatctactaaaaatacaaaaattagccaggcggtagtgccgcacgcctgtaatccccactactcaggaggctgaggcakgagaatcgcttgagcctgggaggcggaggttgcagtgagccaagattgcaccactgcactccagtctgggtgacagagtgaaaccctgtttccaaaaaaa

SEQ ID NO: 31326 - DNA, 201 bp, Homo sapiens
ctggccaacatggtaaaaccccgtatctactaaaaatacaaaaattagccaggcggtagtgccgcacgcctgtaatccccactactcaggaggctgaggcwggagaatcgcttgagcctgggaggcggaggttgcagtgagccaagattgcaccactgcactccagtctgggtgacagagtgaaaccctgtttccaaaaaa

SEQ ID NO: 31327 - DNA, 201 bp, Homo sapiens
ttgaataaaacttctgtaaacattcttgtagatgtctttggaggtattaagcactcgtttcttttggttataccttatctgggcagattttgtttgtttttaaggtctaatttataaacaataaaattcaccattttttagttacaacttgataggaaacccatgagtctaacatttctgcgtttcttatcagcaaaaacc

SEQ ID NO: 31328 - DNA, 201 bp, Homo sapiens
cattaaagctcatatttaaagtagagcatctagtttgagaaatagaaatcaattattaaagatgtcttttttctacccatttaactagttaaaaccatgayatgtaaatgtagaagtagaataatcatagaattccctaaaatatttctgtttactaacatatattgaccaagtacatcaagcaggagagatcttccttca

SEQ ID NO: 31329 - DNA, 201 bp, Homo sapiens
tcatcatatgtactgcatgctttttagttttcatcttttttctactttttttttttggaggcagggtcttactctgttgcccaggctacagtggagtgcartggcatgaacatggcacactgcagccttgacctcctgggctcaagtgatcctcctacctcagtttctcaagtagctgggaccagtgccaccacatccagc

SEQ ID NO: 31330 - DNA, 201 bp, Homo sapiens
tacaaaacattcattaaagctcatatttaaagtagagcatctagtttgagaaatagaaatcaattattaaagatgtcttttttctacccatttaactagtwaaaaccatgacatgtaaatgtagaagtagaataatcatagaattccctaaaatatttctgtttactaacatatattgaccaagtacatcaagcaggagag

SEQ ID NO: 31331 - DNA, 201 bp, Homo sapiens
ctaattaatcccttttagtgcctccagaaaaacctaaaaatttgagttgcattgtgaacgaggggaagaaaatgaggtgtgagtgggatggtggaagggaracacacttggagacaaacttcactttaaaatctgaatggtacgttattttaaatttgtttcatgttagatttattaaagttagtcatttttgctggaatt

SEQ ID NO: 31332 - DNA, 201 bp, Homo sapiens
tggcttatttctagaagacgctaaggtggaaaagagactgtccatctcccaaccaggtttctgccaggacactcgtgtcctcccatcctttctgtctcccyaggggaacacattatcttcattaccgtttctctcaacctaggtgctggacatcccgagagtgctggacatgctgaggcaacagagaatgatgctggtgca

SEQ ID NO: 31333 - DNA, 201 bp, Homo sapiens
tatgagacttctggaagttaatcatgttataggtcaacagagcaaacagtacaataaatagaagtatgtatatatgtgtgtatacacacacatatgtacartcatatgccgaatgacattttgttcaacaaaagacctcatataggacagtggtcccataaaattataacactatttttagcgtaccttttctgtgtttag

SEQ ID NO: 31334 - DNA, 201 bp, Homo sapiens
tgtcctgctcatggaaattatcaaaaataatgaatttagaaattgtaatcttgagtatactgtatcatcaagaaagacattttatcagttgacatcttttyttgatcctatagctgttttcctattttagctttggaccaacttgtaataactacattgtatacctctaagatttatttcaactagttacaagaaccattg

SEQ ID NO: 31335 - DNA, 201 bp, Homo sapiens
catagacaaaaactacttaacaaaaaaagtaccacagatttaaatttgctttttttttttttttttttttttttagaacagtcttgccctgttgcccaggytggagtgcagtggtgtgatctcagttcactgcaacctctgcctcctgggttcaagcgattcccctgccttgtgatctggctgcctcagcctcccaaagtg

SEQ ID NO: 31336 - DNA, 201 bp, Homo sapiens
gtcctgttagtgccttttttccagtggagagggacggcttgttctttggccacagcttgactggcttttctttatataagcaaagcccagcgttacgtttrcttaactaacggcgttcctctttccccagcgctggcgtcaatgctcccttcctcgggccattggagactccgttgctttttaatggcggcagcggctgct

SEQ ID NO: 31337 - DNA, 201 bp, Homo sapiens
tgctagctgattaaaaccactgtttttttttttcttttttctgttttggttttttttgagacagagtctcgttctgttgcccagactggcatgcagtggcrcaatcttggttcactgcaacttctgcctcccaggttcagacaattcttctgcctcagcctcccaagtagctgggattacaggtgcctgccacctcgcctg

SEQ ID NO: 31338 - DNA, 201 bp, Homo sapiens
gattttgtcggagatcatgatcgcctgcctggaacacaatgaggtgatggcgcttatgatcacctggcctttttgggtggaaatgaggctggggaagagarggacatagtgacttaatagctctttttgcgcacatttccttggactgtggtggcctcaagatgttactaatgttccctgcaaaaggctgtgtcttcttgg

SEQ ID NO: 31339 - DNA, 201 bp, Homo sapiens
aaatttccattttctaatatacccccaaaggtcatcctgatctctagtacagtttactgacttcattctttcttttttgttcattttaatttttttagagwcaaggtaggtctagctatgttgcccaggttggtctcaaattcctaggctcaagcgatcctcccgcgataggcatgtgccaccatgtccggctcttgactt

SEQ ID NO: 31340 - DNA, 201 bp, Homo sapiens; identical to SEQ ID NO: 6044

SEQ ID NO: 31341 - DNA, 201 bp, Homo sapiens
ggttacaggcatgagtcaccatgcccagccctgatatttgggataataagcaattacttggtggtttaagaaaagttcaagatttcaccctaagatttttyagggagttgttttatcccccaccttcccactcatctgccttaagtatggagagcaggatctcatgtgataccctcagcattcagcacatactggttttca

SEQ ID NO: 31342 - DNA, 201 bp, Homo sapiens; identical to SEQ ID NO: 6047

SEQ ID NO: 31343 - DNA, 201 bp, Homo sapiens
ggattcgcttgaacctgggaggtggaggttgcagtgagctgagatcgtgccactgcactccagcctggtgacagagcaaaaaaaaaaaaaagaaaaagatytagttacctctacgtgtggtagaggtggaaattgaaagcagatcagtttcattagaacctattgcttatccccttccaaataaaataaacttttgcctct

SEQ ID NO: 31344 - DNA, 201 bp, Homo sapiens
tgtatcattcttcttgtcagatacacactttatgtgaatatggcattttcttttctattaacaaggattcatcattcttttaacagtatgccaatttagcraatattttcctattcagttctctgagcaatttgttcataaacaaatgtcacttagatttcctttatcttttaatgaattgacagaacatacagaggcaat

SEQ ID NO: 31345 - DNA, 201 bp, Homo sapiens
ctgaggtgggcagatcacgaggtcaggagatcgagaccatcctggcaaacatgttgaaaccctgtctccactaaaatacaaaaaattagccaggtgtggtrgcatgcaccggtagtctcagctactcagaaggctgaggcaggggattcgcttgaacctgggaggtggaggttgcagtgagctgagatcgtgccactgcac

SEQ ID NO: 31346 - DNA, 201 bp, Homo sapiens
ggctcttgtgagaagccagttaattccttagaaagatgattacctatgtaaacaaagctcccatatagtaacaatagtcataattttgcctgatagtgacragagtcattaacagtcaatggccatgattccttctaagaaattggggtgaattgtcacatacttaccactgtgtgttttcttcagggatggttacaagat

SEQ ID NO: 31347 - DNA, 201 bp, Homo sapiens
agttttttaatatttgcttaggatttttgcatctatatttacaagggatgtcggtctatagttttcttgtggttatcttttgtctggctttggtattgggrtaatgctggcctatagattgagttagaaagtattctctccttttccttgattttcgtgctcactccccaccttgtttgttttttgaatggattttaaatt

SEQ ID NO: 31348 - DNA, 201 bp, Homo sapiens
taaagaacatctaaacaccttccaacattttatgggttactaaagggatagtaaccatatacttttgagttatgctttaatattataaatagggacaaacrgatgacaagaaaggaatcattgtgtttgaacttctgtagaacttcagaaatagtatggcttgcgtactgttccaaatttctgaaaattacttattaacta

SEQ ID NO: 31349 - DNA, 201 bp, Homo sapiens
tccttttgccttagcctgccaagagctgggactacaggtacactccaccacacccagctaattttttttttaacttgtgtttttgagatggagtcttgctrtgtcgcccaggctggtctgggagttgtttcctctagttatcttcctgcctcaactttgtgagtaggtgggattacaggcgtgtgccaccttgcctggctt

SEQ ID NO: 31350 - DNA, 201 bp, Homo sapiens; identical to SEQ ID NO: 6050

SEQ ID NO: 31351 - DNA, 201 bp, Homo sapiens
tgtttgtgtcggccctggtgtaaaagatgagggttttcatgcagtgaggtgggtagtagagagcagggctttgggtgtagagcctgagagcatccccctcrccatgttcttgtatttcctccctcttgcaccctgcccttgtctggtatttgcaatcccggcccctcccacttccaggacctggctgtcctctgcattgtt

SEQ ID NO: 31352 - DNA, 201 bp, Homo sapiens; identical to SEQ ID NO: 6060

SEQ ID NO: 31353 - DNA, 201 bp, Homo sapiens
tgtttggtttctttttatttatttcaataggtttttggggaacaggtggtgtttgcttacatgaataagttcttcttatttatttagttacttttttttttgagatggagtctcgctctatggaccaggctggagtgcagtggcacgatctcggctcactgcaacctcctccgcctcctgggttcaagcgattctcctgcc

SEQ ID NO: 31354 - DNA, 201 bp, Homo sapiens
gagagaaagattatgaggggtgcaaggaaacttttgcagttggtcagtatgttcctcattttatagtgatggtttcatggatatatatatgtgtctaaatkgtacacttgaaatttgaacagcttattcgtatgccaattatacctcaaaaattgtgttctaaaaaaacccactcaaagatattggaagaaaacaaagggg

SEQ ID NO: 31355 - DNA, 201 bp, Homo sapiens
tcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacagt

SEQ ID NO: 31356 - DNA, 201 bp, Homo sapiens
aaagggcatccaaatcggtaaagaggaagtcaaaccgtctctattcactgatgatatgaacgtatacctagaaaacccctaagactcatccaaaaagctcytagatcgataaatgaattcagtaaatgttttagtctgttttcatgctgctgatagtcatagctgagactgggcaacttacaaaaggaagatttaatggac

SEQ ID NO: 31357 - DNA, 201 bp, Homo sapiens
aacagcattaaaaacaatatgatcatctcaatagatgcagaaaaggcatttaacaaaatccagcattcctttatgattaaaaccctcagtaaaattggcayagaagggacataccttaaggtaataaaagccatctatgacaaacccagagctaacattatactgaatggggaagagttgaaagcattccccctgaaaact

SEQ ID NO: 31358 - DNA, 201 bp, Homo sapiens
aaaattttttgtaaagacagggtcttgctttgttgcccaggctggtcttgaactcttggcctcaagtttctcccactttggcctcctaaagtgctaggatyacaggcatcagccactgtgcctggcaagttttgtaattttgaaataagtttatctatttttttctttgttgctcatgtttttggtgttatactcaagcat

SEQ ID NO: 31359 - DNA, 201 bp, Homo sapiens
aaacaagaattcttggatctgcaaattccgacttgtgatttctgcaaatcctgattagattggccgctcttggcatgctcgtcctattttcttttttgctragaaagccttatactaatagcgtatgctcacaaacacattcagaacattcgtgtgctccaagtgacaactgctgtatgcctaatagttgctgacagttta

SEQ ID NO: 31360 - DNA, 201 bp, Homo sapiens
aggtcttacctcctttttttccttcagtttttgctgttgttcttctctgagaagaaaggcaataagagactgctgtcatttggtcacaggtcagggattaktgcgactgaagtcattgaaatccttttgtatgttattgcctccttcaatgaccttctgtctttccaggtcacttacttcagcctctggtactacaacaag

SEQ ID NO: 31361 - DNA, 201 bp, Homo sapiens
cctttcattacaacagaactttgtaaccaatagtgtttcaaaaccttctatctggaagactttatcagggctttggccttgaaaggaatgtcttcctactmatgtttgttaaacaagtggtgtgtgaaggagtgtaatctttctgggtttattggcaaaggagaacactccctctgtgtgttcctggtcttcagtgcattg

SEQ ID NO: 31362 - DNA, 201 bp, Homo sapiens
tctttttttctgctgggtttgggtttggttggttcttgtttctctagttccttgagttgtgagcatagattgtctgtgtgctctttcagactttttgatayaggcatttaatgctatgagttaatatatatttaatgtatatttaatgctcttagagctgcttttgctgtatcacagaggttttttgtttgtttgtttttt

SEQ ID NO: 31363 - DNA, 201 bp, Homo sapiens
ctgcagttttcacatgagaagtataaggaattgtatttataacaaacccccaagctgaagtttaagcagtcaattaacatttactctatactctctctgtrtggggctataccaaatgctaaggaggtttatgcagatgagtatttccacatcttaagaagtttatcttcagcctggaccacagggccagaccctgtctct

SEQ ID NO: 31364 - DNA, 201 bp, Homo sapiens
atagcacaagtgatccccaaagccccaaccctccgttgttggtccactgcagtgctggggtaggaaggactggcgtggtgattttgtcggagatcatgatygcctgcctggaacacaatgaggtgatggcgcttatgatcacctggcctttttgggtggaaatgaggctggggaagagagggacatagtgacttaatagct

SEQ ID NO: 31365 - DNA, 201 bp, Homo sapiens
gagatgtaaaaagtgaaactaaggttgaagtcagaagataagtttgaaactttgccctctcgccccacatttttagccacggtgttacaaagagattctcwtatgtggcatgtcagagtgttttactgcatgttgggtaacttatgggttcactaggcacaaaggaataattaaagggaaaaatgatggatttaccctctc

SEQ ID NO: 31366 - DNA, 201 bp, Homo sapiens
tgcgacaagtgtgtgggtgatgtagccttgtctctttccccactgcttatggctaatccagaggtttattggatgggcctgggaagtatgctctgatcccyttgtgggtccaggcgatgatgctgtgtggggagcctgaaaccacagggcaggttgacgggttggggcagcaggaaagggctgaggccccacgggccgaca

SEQ ID NO: 31367 - DNA, 201 bp, Homo sapiens
aaatatactttatatagctataacaaatttgacttctgaaatattagcataccatctagatatactgcgtattgaattttgttgtgcatattttgcaatgmaatttaaatataattaacgtgaatgtttgtcattctatatagcggattttggtgactttgatcagtatgaatcccaggactttcttcagaaatttgcctt

SEQ ID NO: 31368 - DNA, 201 bp, Homo sapiens
ttcccaagtcattttgaaactgtttaatatgagaatcacactgttagaacagattgttttgtcttcataaattaaatcctacttgtggtattcataccatrggcacagtgttggaaaatgaaaggcttatagtgttctgaaagtgactttgtcatatgatgtcacccattatgtctttagacaaactctgcattaaacgta

SEQ ID NO: 31369 - DNA, 201 bp, Homo sapiens
gatttatttcaactagttacaagaaccattgtaattcttgaaaggtaaaaagggaataatatcctttatttgtttaaatcaatcctctggtaagcattttkagtcattaaagattattcagcttttccagctatctgaagaatttttgcccctccttcctggtgtgcatttttcttagcccacatgggtttcttactgttt

SEQ ID NO: 31370 - DNA, 201 bp, Homo sapiens
tttgtaaccaatagtgtttcaaaaccttctatctggaagactttatcagggctttggccttgaaaggaatgtcttcctactaatgtttgttaaacaagtgktgtgtgaaggagtgtaatctttctgggtttattggcaaaggagaacactccctctgtgtgttcctggtcttcagtgcattgaaacttcttttcacagggg

SEQ ID NO: 31371 - DNA, 201 bp, Homo sapiens
ttagatcagaaatctgcttcaaacccactgtctctcactctaagccccagaactggtcatgctgtaagcaccctccctgatttatataaggaaaatgccgrgagagttggggagtcatgagaggccccttggtgtaggtggctcccctgctcttttctgtgaggaaaagggaggatggtatccttcaacctgcaaagccaa

SEQ ID NO: 31372 - DNA, 201 bp, Homo sapiens
atttatttcaataggtttttggggaacaggtggtgtttgcttacatgaataagttcttcttatttatttagttacttttttttttgagatggagtctcgcyctatggaccaggctggagtgcagtggcacgatctcggctcactgcaacctcctccgcctcctgggttcaagcgattctcctgcctcagcctcccgagtac

SEQ ID NO: 31373 - DNA, 201 bp, Homo sapiens
ctatgctatgtattcatctagttcaaagactttgtctgctaataggtcatattttaagaagaaagatatgccagtcagtgagtttgatgaggttatattcrcttacagtttaagtacacttcatatgtttggtttctttttatttatttcaataggtttttggggaacaggtggtgtttgcttacatgaataagttcttct

SEQ ID NO: 31374 - DNA, 201 bp, Homo sapiens
tttgcacagtgacaaaatctgatgatgcctttctcaacacattcccatccttgacacatgactatatacatatacatttattaatactatgctatgtattyatctagttcaaagactttgtctgctaataggtcatattttaagaagaaagatatgccagtcagtgagtttgatgaggttatattcgcttacagtttaagt

SEQ ID NO: 31375 - DNA, 201 bp, Homo sapiens
ccacgccctatctcatctgtatgcagtcagtcttctggatagataagcaaaatatgtagcactgctcttgaagttacatgtcaggaacaaatctgagcatrtgcctctcacccgccccgtcctgggtacaggattaagggcagactcctgaggtccttctctggacttagctgccccagcccagttggccttggagtctga

SEQ ID NO: 31376 - DNA, 201 bp, Homo sapiens
aggtgtgtagtaggctatacaatatagcctaggtgtggagtaggctgcaccacctaggtttgtgtaagtatactctgatgtttgcacagtgacaaaatctratgatgcctttctcaacacattcccatccttgacacatgactatatacatatacatttattaatactatgctatgtattcatctagttcaaagactttgt

SEQ ID NO: 31377 - DNA, 201 bp, Homo sapiens
tgatgatgcctttctcaacacattcccatccttgacacatgactatatacatatacatttattaatactatgctatgtattcatctagttcaaagactttrtctgctaataggtcatattttaagaagaaagatatgccagtcagtgagtttgatgaggttatattcgcttacagtttaagtacacttcatatgtttggtt

SEQ ID NO: 31378 - DNA, 201 bp, Homo sapiens
tctcattttgaactcattttttctagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaa

SEQ ID NO: 31379 - DNA, 201 bp, Homo sapiens
tcatgttataggtcaacagagcaaacagtacaataaatagaagtatgtatatatgtgtgtatacacacacatatgtacaatcatatgccgaatgacatttygttcaacaaaagacctcatataggacagtggtcccataaaattataacactatttttagcgtaccttttctgtgtttagatacacaaataccattgtgtt

SEQ ID NO: 31380 - DNA, 201 bp, Homo sapiens
aaaacattcttctaacagtatgatctaaggcaaaacattggcaaagaacaaattccaaaaactatataacaaattgtatattctagctataacacattctraaaacttccttgaaaggaaaatgacttgaagctctctattgaaaaggcatactgtgtacctggtatggtcagtccagagcaatcagcgccaacacattct

SEQ ID NO: 31381 - DNA, 201 bp, Homo sapiens
tgaccatttttaccactcgtgttaacagcttagtgctggctgccactacttctcatcagaatactgaggtagccttctgactttcctgtttctgtgccttygctgcctgtagcttattttccatatgtcagccagaatgatcttagtttaacctgaatcagatcctgacactgacactcttcttttttttttttttttttt

SEQ ID NO: 31382 - DNA, 201 bp, Homo sapiens
atcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacag

SEQ ID NO: 31383 - DNA, 201 bp, Homo sapiens
gacaatacctgggggaaacactggctttgaggttttacacagataaaaatacctacttcataaattagtgatggtgatttaatctatggtatctctacagytcttggaatacaacctggcacataggaaatgttcaaaatattccattcttgtgtgatgacttgggtggcaactaagaagcaagagaatattccttcttta

SEQ ID NO: 31384 - DNA, 201 bp, Homo sapiens
gccttcagtttctcagctgcagcaggagattaccaggtgagaaattacatgccgtttgtttttaggaaatagtctagtgagatgtaaaaagtgaaactaargttgaagtcagaagataagtttgaaactttgccctctcgccccacatttttagccacggtgttacaaagagattctcatatgtggcatgtcagagtgttt

SEQ ID NO: 31385 - DNA, 201 bp, Homo sapiens
tgaaataagatgataaagactcatatgaaatgattaaaggggtgggctgtcagaggaattcaaacatgaactgtaactgggttgcacttcacaggcaccaratacggaggacagtttggattccagatggctccatagactgcactggcagagtgtctgtgatttccatttagtacggtatccccagcatctagaataatg

SEQ ID NO: 31386 - DNA, 201 bp, Homo sapiens
ccccaacactgttaccaggactcagggcgcacttatttgcccggcttttttttttttcttttgccttttttgagatagagtcttgctctgtcgcccagacwggtggagtgcagtggtatgatcatggctccctacagccttgaccttgtgttgcctggctttagaactttgtccttctaaatctgaagacctctttttagc

SEQ ID NO: 31387 - DNA, 201 bp, Homo sapiens
cactaggattgcctgagcccaggagttagagaacagcctgggcaacatggtgaaactcccatctctgtaaaaaatagaaaaatttgtcaggcatagtggtrtgcacctgtagtcccagctactcaggaggctgaggtgggaggatcacctaagcttaggaaggttgacgctacagtgagcagtaatcatgccactgcactc

SEQ ID NO: 31388 - DNA, 201 bp, Homo sapiens
ggatcccagaactgccagcatcccattagctatagagggaaatccatgggtttggctgttagcaggtggaaggagaaaagctggatccaaattcttcttamttgaatggatggtgttttggtcaggttctttggtaataaagaacagaggtttacatgtctgtggctgaaataagatgataaagactcatatgaaatgatt

SEQ ID NO: 31389 - DNA, 201 bp, Homo sapiens
attcatgttattacacatattctgttttatagtgtaaaattctggaacaacgattagaacaaggaatggtattcacagaatatgaaagaattcttaagaamcggctagttgatggggagtgctcaacagcacgactccctgaaaatgcagaaagaaatcgattccaagatgttcttccttatgatgatgtgagagtggagt

SEQ ID NO: 31390 - DNA, 201 bp, Homo sapiens
acctctgcttcctgggttcaagcgattctcctgcctcagcctcccaagtagctgggactacaggcatgtgccaccacgcctggctaatttttgtatttttmgtagagatggggtttcaccatgttggccagtccggtctccaactcctgacctcaagtgatccgcccgccttggcttcccaaaatgctgggattacaggca

SEQ ID NO: 31391 - DNA, 201 bp, Homo sapiens
cataaaatctcatggaatcagatgttgtgacttgattatgtatgtgtagaaattctaagagagcattcaatccaggattataatgttacaataatttagtkacccatatgtatataaacatttctagcagcaattttagaaatataatacctccttggaggtatttaacaagatataaatttgatttttggctagctttca

SEQ ID NO: 31392 - DNA, 201 bp, Homo sapiens
tgtattcatgttattacacatattctgttttatagtgtaaaattctggaacaacgattagaacaaggaatggtattcacagaatatgaaagaattcttaaraaacggctagttgatggggagtgctcaacagcacgactccctgaaaatgcagaaagaaatcgattccaagatgttcttccttatgatgatgtgagagtgg

SEQ ID NO: 31393 - DNA, 201 bp, Homo sapiens
gcacctgacctttaagattctttcctctgtcttgactttagataatctgatgactgtgtgcctaggtgatgatctttttgtgatgtatctcctgggtgttstttgagcttcttgtgtttggatgtctaaatctctagcaagaccagggaagtttttcttgattattccctcaaataagtttccccaagttttagatttctc

SEQ ID NO: 31394 - DNA, 201 bp, Homo sapiens
cttttaagggaagcatttaggaccatttacattcaaggttagtactgaaatgtgaggtactgctctattcatcgtgctagttgttgcctgaataatttggktttttttcccccattgtgttactgttttataggccctgtgagatttatgctttaaggagtttctattttggtatattttgaggttttgtttcaagattaa

SEQ ID NO: 31395 - DNA, 201 bp, Homo sapiens
aaaaggtagccacgacgtgtggctgtattcatgttattacacatattctgttttatagtgtaaaattctggaacaacgattagaacaaggaatggtattcmcagaatatgaaagaattcttaagaaacggctagttgatggggagtgctcaacagcacgactccctgaaaatgcagaaagaaatcgattccaagatgttct

SEQ ID NO: 31396 - DNA, 201 bp, Homo sapiens
cttacactattgtaatagtggtagggtcacacagttttattcctcagcttaagtgctgcaatacagtaataatgcagtacaagaatactgtataataaacsttaaacgaaacacttcatatatactttacacaagttattggatattgcttagtatttatttcccccacccctgctgtgcaaagatattaatatccctctt

SEQ ID NO: 31397 - DNA, 201 bp, Homo sapiens
agagttaagtattcaaaagtttttgttaattgtttaagaaaatgagatttacatgaaacaatactttaaaaagctttccagaaacaacagcattaaaacaraatcactgaaattaaaatttacataaattaaaaggttctgtgttccacatgccaagaaaagatcttacactattgtaatagtggtagggtcacacagttt

SEQ ID NO: 31398 - DNA, 201 bp, Homo sapiens
ctgaaaatgcagaaagaaatcgattccaagatgttcttccttatgatgatgtgagagtggagttggtcccaactaaagaaaacaacactggttacatcaaygcatcacatattaaggtgagaggaacgcctcaagtaatcaacagcacatgcagtttcagttaagttacaagaatggtaagaattgtattcatgtctgttt

SEQ ID NO: 31399 - DNA, 201 bp, Homo sapiens
ctttctccttgcagcacctggcttctaaatatatgtgggctgaatggacaagtgttttccaatagtgattatcacatggcatagacatacttggatcaaargccctaagtgttgggaattacagtcacagcagccacttgctactgaggcagacatgcttctccatttcaacaaacacactgccaagataatcatttctct

SEQ ID NO: 31400 - DNA, 201 bp, Homo sapiens
ctggtctcaaactcctgacctcaggtgatccacctgcctcagccttccaaagtgccgggattatagatgtgagccaccgtggctggctatggttacatgartaagttctttagtggtgatttctgagatttggctgtacccatcacctgagcagtgtaccctgtaccccatgtatagacttttatccctcaccccactccc

SEQ ID NO: 31401 - DNA, 201 bp, Homo sapiens
cctgggtggcatagcgagacttcgctctataaaacacgttgtaaggagcgtattttgaggtcctgtggctccaaagcgggcatcctatggggcccgcccarcctctccaccgccagtagggcacgcgctggtccctttaaatgttcccttcgggagccgagggaccggtccttttagagcgcgtccgtccagaaacgcggc

SEQ ID NO: 31402 - DNA, 201 bp, Homo sapiens
aactcttgttgttgtggctttttaaaattttaacttcattttcacctagaattttgtttctgttttggttttggtttggtttttttgagataggttctcayggttcactgcagcctcaacctcctgggctcaagcaatcctcctgcctcatcctcccaagtagatgggaccacaggcatgcactaccacacctggctcgtt

SEQ ID NO: 31403 - DNA, 201 bp, Homo sapiens
ttctttagctttacttaatgatatcttacacagtgccttgcagatagtaagaacctggtactgtcccatgtttgtggagtgctgtttgagtctgccagttratgattaggagagaatggaaagtcaaagcagtaggatccagtggtaggataaacacaaactgactgtaaaagtctgagatagaaatattgaagagaaaag

SEQ ID NO: 31404 - DNA, 201 bp, Homo sapiens
gaaacagacttagatattaactaacttttccaaggtcacatgactagtgagtgactgaactggaattttaaacccatacttagaagcccattctgttatcrtctacactgtagatgtatgttctgcattgaagtatactgtatatgttctattaagtcataattgcttgttgaagccttgctagtctttcactgaaacttt

SEQ ID NO: 31405 - DNA, 201 bp, Homo sapiens
ttttttttttcttttgccttttttgagatagagtcttgctctgtcgcccagacaggtggagtgcagtggtatgatcatggctccctacagccttgaccttstgttgcctggctttagaactttgtccttctaaatctgaagacctctttttagctcataaattctgggagccactgaattgctagtttttcctcatcacat

SEQ ID NO: 31406 - DNA, 201 bp, Homo sapiens
tgagttgggggtcagggagaggagaggaaaatggatccgtggcttcacctgaagagcagggctctgatggtgcccaaagtgtcacatggaaacttgaggcwtctacctggcttcctttatcactggataggaattttcacagttgccttaatgtgatgctaataatctttagatttaacaaacaacggaatccgtactaag

SEQ ID NO: 31407 - DNA, 201 bp, Homo sapiens
tatcatcaagaaagacattttatcagttgacatcttttcttgatcctatagctgttttcctattttagctttggaccaacttgtaataactacattgtatrcctctaagatttatttcaactagttacaagaaccattgtaattcttgaaaggtaaaaagggaataatatcctttatttgtttaaatcaatcctctggtaa

SEQ ID NO: 31408 - DNA, 201 bp, Homo sapiens
cctggaggtagtttcgaatatttcctactgctttagtcttttatatatcgtatgacataaaatggaaacatttgttcatagctgttggaactcattatccrtcccctagatttacttactgttccccaggagaattccatctattaggggtcacaaaattgaccacagatctagagaaaatgaattcaacaaatttcttta

SEQ ID NO: 31409 - DNA, 201 bp, Homo sapiens
tgcaacctccgtctcccaggttcatgccattctcctgtctcagtctcccaggttcatgccattcttctgtctcagcctcccaagtaactgggactataggygcatgccaccacgcccggctaattttgtatttttagtagagatggggtttcaccgtgttagccaggatggtctcgatctcctgacctcatgatccgtctg

SEQ ID NO: 31410 - DNA, 201 bp, Homo sapiens
agggaccattacagaatacctgtcaagatttttggcagatggtatgggaacagggaattgcaattatagcaatggtgacagcagaagaggtaggtacttayttctcttaagtgattttctcagcctctgaagaacagttaatgttaatcatctggaatcctgacctgtggagaaaaaggcagggtagggttgtggttctgt

SEQ ID NO: 31411 - DNA, 201 bp, Homo sapiens
ctttaattccttaaaatctgttatctggaaaacccaaagttcatgtccaaccaaaagcttatattgtttttataaggcaggaaaacatattctatcacttytgttttttggttcctttgtgtctaccatttgttgagtgcttatcatgagtcagataaactatgctgagcattttttgtgaattttttttagtgtaatctt

SEQ ID NO: 31412 - DNA, 201 bp, Homo sapiens
acaacactgtcacctatggaaggtttaagatcacgacccggttccgcacagactctggctgctatgccaccacaggcctgaagatgaagcacctccttacygggcaagagaggaccgtctggcacctccaatacacagactggcctgaacatggctgtccagaagacctcaagggatttttatgtgagtgactttaacttt

SEQ ID NO: 31413 - DNA, 201 bp, Homo sapiens
tgaaatggtcttgaaatagagttcctaaggagggccaaactttttcaatttttatacttacctataagatcatagatctcattcagacttttgtcttcctkaatagttactctgtaggtcttcggaactttctacatctgggaaaccagtccagggaactctagcagcagttcctctgcatctgcttcctgggtgtttctt

SEQ ID NO: 31414 - DNA, 201 bp, Homo sapiens
agtgctaggagccagagcacaaagaggagcaagaccaactccctgctttcatgacactcacaatacaaaagacagatgaattacttttattcctttaccarccatttcagaactaagaacaaaaacatgttttaccattactgggtacccaattctcagtcaatattaacataatattgagaataacatttaataaaaagt

SEQ ID NO: 31415 - DNA, 201 bp, Homo sapiens
ctgcatggagctgcggcattggagaatcccagaaggtgatccagaggaaatgatgcatagacagagtcttgaaggatattagggattggccaggtccacargtgagtcacaggcacaccaagaagagggattctcatgtgcaaaagcccagaggggctagggaacatattctatctgaagagatgcagagtttgggatggc

SEQ ID NO: 31416 - DNA, 201 bp, Homo sapiens
acagcattttcattttaaagactttaataagttaagagtgttcataatattgagccattattacctcagtttgtttcttctctggaaaatagtggagagtytacattttgaataaaccataaaacataatccctttccatgaggcatccatattggttggtggttagtgcctgttttttgtttgtttgtttgttttgtttt

SEQ ID NO: 31417 - DNA, 201 bp, Homo sapiens
gaaataagttaatatttgtgaagtatattgaactgtgcctggcttatagcagtactatgcttgctgattaaaaattaagtacctgcactgggatacagtgstaggagccagagcacaaagaggagcaagaccaactccctgctttcatgacactcacaatacaaaagacagatgaattacttttattcctttaccaaccat

SEQ ID NO: 31418 - DNA, 201 bp, Homo sapiens
ttagctggattgagagagaatgggcctattagagtcaatcaataggattgctcatcgattaggtataggagcacctgatagagaagttgtatcggtaaggrttaagtatagctatatataacaaaaaccctaaatatcattgacttctgtgagagttcagaagtcagccttgcagagcttgtctgacagctccacagagtc

SEQ ID NO: 31419 - DNA, 201 bp, Homo sapiens
cccatagacaccaccaaacattcagtttgcttagtccttgacaccactctgaaagttgttttttctacctcttttataacaatgacctgaataattcatamcaataatttagtaaatgcttgctctgtgtcaagcattatactgagagcttttattttctttaatccttacagtaaccctgttgggcacaattattactat

SEQ ID NO: 31420 - DNA, 201 bp, Homo sapiens
aagctctttctattaaaccagatttttgttttctataagttgcagtttaaaaaaagaaaagaacagtacttgttttctataaatgtatgatacatattctrtgcttacagataataagcaattcattttaaaatgtcataacctcagaatataattaacaatgggacttggcctttcagatatattacaatgtgcttggat

SEQ ID NO: 31421 - DNA, 201 bp, Homo sapiens
gttcagtatatgccttttcaccttcttggtcaaatttattcctacatattttgttcttttggatattactgtaaatggaattgttttctttttttgacatrtacattgctggtatatagcagctgatttttgcatgttgatcttgtaccctgcaaacttcactgaatgtattacctcgagtagggcaggggtgtgtgtgtg

SEQ ID NO: 31422 - DNA, 201 bp, Homo sapiens
gattaatctccctagaatatcagtttcctcttacctctctccttctccttccacgtgctcatgggtattttcatgctttctactagcccaagttcattacyctgggattaaaggcctcctacaagttggttaaatcctgccttcccagctttaccttctgctggacagcagaaccacatgaaccatttcttttctagctta

SEQ ID NO: 31423 - DNA, 201 bp, Homo sapiens
ttatttctttgggaaatgaagcgcttcataactaactttgcctgataaacaaggttgactcctttgtccaaactatttggagtgctaagttttggaaacartttataaatttctatctgtcgtaaataaaggatactacctctgcttttaggaacagtgattgttgttgaatacatgactaattaatgtttggagttattt

SEQ ID NO: 31424 - DNA, 201 bp, Homo sapiens
tttgagatggagtctcgctctatggaccaggctggagtgcagtggcacgatctcggctcactgcaacctcctccgcctcctgggttcaagcgattctcctrcctcagcctcccgagtacctgggattacagatacctgccaccacacagacccaactaatttttgtatttttagtaaagatggggtttcaccatgttggcc

SEQ ID NO: 31425 - DNA, 201 bp, Homo sapiens
attcttaagaaacggctagttgatggggagtgctcaacagcacgactccctgaaaatgcagaaagaaatcgattccaagatgttcttccttatgatgatgygagagtggagttggtcccaactaaagaaaacaacactggttacatcaacgcatcacatattaaggtgagaggaacgcctcaagtaatcaacagcacatgc

SEQ ID NO: 31426 - DNA, 201 bp, Homo sapiens
ttatctcatataagcttcggacttgttttaacataaagaatacaagtgttttggggagggttaacgaggtttataaattatgatttggtagtgagtagaaygccacagctgactcagtatctccgtcatttcattttgtagatcagaaagtggacagaggtagtgacttgctcagggtcacactgtccctttgtggttggg

SEQ ID NO: 31427 - DNA, 201 bp, Homo sapiens
tcttacctcctttttttccttcagtttttgctgttgttcttctctgagaagaaaggcaataagagactgctgtcatttggtcacaggtcagggattattgygactgaagtcattgaaatccttttgtatgttattgcctccttcaatgaccttctgtctttccaggtcacttacttcagcctctggtactacaacaagcaa

SEQ ID NO: 31428 - DNA, 201 bp, Homo sapiens
ataattaacaatgggacttggcctttcagatatattacaatgtgcttggattttcaaaaattttatttgcatgcagcttgtcaaggattttttttttttttaaggcagagtctcactttgttacccaggctggagtgcagtggtgcagtcttagctgactgcagcctctgtctacctcctgggttcaagtgatcagcctgc

SEQ ID NO: 31429 - DNA, 201 bp, Homo sapiens
gtaaactaaagcgtgataggcatttaacaaaactgcccctggcctggaactggacggtggcttctggacatctgctttgggctggggtgactggtggcccmggagatagactcgacttgcacagaaaggggaactgtaatcccagggtgtcccctttacccccagtcctgatctattgtagtttattgctgcttgggatgg

SEQ ID NO: 31430 - DNA, 201 bp, Homo sapiens
atacatgtatccaatgtagttaacttaggttgctaactttcttttaaattcaccatatttgaactacagaaagtaacttctttttttttttttttttttttatttgagacagagtctcgctctatcgcccaggctggagtgcagtggcgtgatctcggctcactgcaacctccgtctcccaggttcatgccattctcctgt

SEQ ID NO: 31431 - DNA, 201 bp, Homo sapiens
ttatgttttttactgtatgttagacactgtcccaagtactttattaatttaattctcataacaaatcctgtgatgtaggtgctattatctctattttgtabatgaggaaaccaagacacagaagggttgaacaccttgcccaaggtcacactgctagtatatactggaactgggactcaagcaggctggctcctgggtcct

SEQ ID NO: 31432 - DNA, 201 bp, Homo sapiens
aaagaaattgtggggactgttttacagggcatgaagcagatgactaattgtcttataggatcgttttaattttgaaataactataatctgggataagtaaytcatcacatatactttaatatgtgtaagtgtcatgtggttgaggactttctcatccttgtttgaaactgtctaggggctctgtgtggtggttcatgtccg

SEQ ID NO: 31433 - DNA, 201 bp, Homo sapiens
gggagtggttcaggtacagatggtagccacctggagttggatagggttggagagaggtggttggaatctggatcaggacctaccgagtaatagagaagggwtagcatgggtcctggttgatattcaggttttcagtagatggtggggctataacagagaggaaatgtgaaaggaagtgcagatctattaggggcaaggagg

SEQ ID NO: 31434 - DNA, 201 bp, Homo sapiens
ttttgtattttttgttgtgatggggtctcactatgttgcccaggctgttcttgaactccttggctcaagtgatcctctggcctcagtctcccaaagcactrggattacagatgggagctactgcacctggcctacagttaacttttttataaataggagtacactctaaataaaaagtataataaatgcataaatcagtaa

SEQ ID NO: 31435 - DNA, 201 bp, Homo sapiens
tcaggtgatcctcccacctcggcctcctaaagtgctgggattacaggcatgagccaccacacctggccttcgataataaattaacctcagcttactataaygtttttgctttacaaacttttaaatttttaaaacttttgactcttgtaataacataggttaaaacacagacacattgtacagctatacaaaaatatctat

SEQ ID NO: 31436 - DNA, 201 bp, Homo sapiens
attttgaaataactataatctgggataagtaattcatcacatatactttaatatgtgtaagtgtcatgtggttgaggactttctcatccttgtttgaaacygtctaggggctctgtgtggtggttcatgtccgtagtcccaacattttgaatccaagcactaggattgcctgagcccaggagttagagaacagcctgggca

SEQ ID NO: 31437 - DNA, 201 bp, Homo sapiens
tgtgctgtacaggtttgtagcctagcagcagtaggctatatcacatgccctaaatgtgtaggaggctataccatttaggtttgtgtaagtacactccatamtgttcacacaatgaaatagcctaatgatgcattcccacatcgttaagggacacgtgactactaaaatttcccctttaatcctagtttactctttaaaaac

SEQ ID NO: 31438 - DNA, 201 bp, Homo sapiens; identical to SEQ ID NO: 6048

SEQ ID NO: 31439 - DNA, 201 bp, Homo sapiens
ataaaattccaccctgccttccgggtcctgttagtgccttttttccagtggagagggacggcttgttctttggccacagcttgactggcttttctttatayaagcaaagcccagcgttacgtttgcttaactaacggcgttcctctttccccagcgctggcgtcaatgctcccttcctcgggccattggagactccgttgc

SEQ ID NO: 31440 - DNA, 201 bp, Homo sapiens
gtaggatacagtgaagggtggagtctgaccctgagcctagcacaactctgagataaaattccaccctgccttccgggtcctgttagtgccttttttccagyggagagggacggcttgttctttggccacagcttgactggcttttctttatataagcaaagcccagcgttacgtttgcttaactaacggcgttcctctttc

SEQ ID NO: 31441 - DNA, 201 bp, Homo sapiens
ctatgaaaaaacaacaccttatccaaaataggaagaggatcacaattactaactacaaaatttgggattatagtagtgctggctattatctcatttaatcytgaggatggcccagtttgctatccctatttgtaggatacagtgaagggtggagtctgaccctgagcctagcacaactctgagataaaattccaccctgcc

SEQ ID NO: 31442 - DNA, 201 bp, Homo sapiens
ttatagcatggttgtaatctctttaaagacagcgacggtttagggattcgtcttagatttctcacgatgctcattacgctgtcttgttcccagagacgcartacacatttgtggaatggaatttcaaaatgttaagtttggcaaagccgagggtagtagcggaacccttttctccaggtctgccattccctaaccctaagt

SEQ ID NO: 31443 - DNA, 201 bp, Homo sapiens
ctctgacatttggagtattacaacctgaaagagttacctatgaaaaaacaacaccttatccaaaataggaagaggatcacaattactaactacaaaatttrggattatagtagtgctggctattatctcatttaatcctgaggatggcccagtttgctatccctatttgtaggatacagtgaagggtggagtctgaccctg

SEQ ID NO: 31444 - DNA, 201 bp, Homo sapiens
ttcaggttcgctctcatatacttgagtaatttctaaaaggagtcttgaacttctattccgaacgccctggccgattgttgcgggttaattctggatcaggsttttaaatgtgttaggcatatttgtgcctctcagaatatataaacgtgaaattcgccagataactttggcgagaaggggcgcagggaaggactgtttggt

SEQ ID NO: 31445 - DNA, 201 bp, Homo sapiens
atcacttgaaattaatggaccattgaatgagacaaatattttgttacttacagtgattaatatttattgaaatgtaatttaatcttagagttaagtgtccygaaaggattttggtaaggttttgtagttttactgaaataataccagtgcaacactggttcagaccaacaaacaggttgaaaaaactgaatattctccaga

SEQ ID NO: 31446 - DNA, 201 bp, Homo sapiens
ttcttccttacccttactatagtgagctcaaaaggtgtaagtcattgagacaaacatttgctaggtatttccaccatctaacacttttatttatttatttwtttaaagagacggggtcttgctctgtcttccaggctggagtgtggtggtgtgatcatagctcactgtaacctcagactcccgggcttaagggatccactg

SEQ ID NO: 31447 - DNA, 201 bp, Homo sapiens
agccaattgatgtgacattaacagtttgaaattggctgtgatgggagtatttacaccatggatatgggcaaacaccgatcaaaacttccttccaagagccwgttgttaaatattaccagcacatcactgttttctgcacgttagaatcattaaatttcagcctaagcaggaagtgtttagtctgtatgcctgtgtctggat

SEQ ID NO: 31448 - DNA, 201 bp, Homo sapiens
tgtgattttggctcactgctacctccacctcctgggttcaagcaattctctggcctcagccttccaagtagctgggattacaggttcctgccaccatgccyggctgatttttatatttttggtagagatggggcttcaccatgttggccagactggtctcaaactccttgcctcaagtggtctgcccaccttggcctccta

SEQ ID NO: 31449 - DNA, 201 bp, Homo sapiens
aaccaagacacagaagggttgaacaccttgcccaaggtcacactgctagtatatactggaactgggactcaagcaggctggctcctgggtccttgctctcraccattgtgttttgtggactgtcatgtaacatactaaatgaataaaaatactagaaatatctataactgtagatttgtcgtggttaagaacaagaccttt

SEQ ID NO: 31450 - DNA, 201 bp, Homo sapiens
atccatccatccattcatccatccttagttgcttccattaaagtatttgagggataatacaataacatataataacaaccacttatgttttttactgtatrttagacactgtcccaagtactttattaatttaattctcataacaaatcctgtgatgtaggtgctattatctctattttgtagatgaggaaaccaagacac

SEQ ID NO: 31451 - DNA, 201 bp, Homo sapiens
gctatagagcaagaccctgtctcaaaaaaaaaaaaaaatctatctgtctgtgtatccatccatccatccattcatccatccttagttgcttccattaaagkatttgagggataatacaataacatataataacaaccacttatgttttttactgtatgttagacactgtcccaagtactttattaatttaattctcataac

SEQ ID NO: 31452 - DNA, 201 bp, Homo sapiens
ttacgccattgcactccagcctgggctatagagcaagaccctgtctcaaaaaaaaaaaaaaatctatctgtctgtgtatccatccatccatccattcatcyatccttagttgcttccattaaagtatttgagggataatacaataacatataataacaaccacttatgttttttactgtatgttagacactgtcccaagta

SEQ ID NO: 31453 - DNA, 201 bp, Homo sapiens
  misc_feature (1)...(201): n = A,T,C or G, or insertion/deletion polymorphism (see Tables 1-2)
gtggtcccaactactcaggaggctgaggctcaaggatcacttgagtccaggaggttgaggctgtagtgagccctgattacgccattgcactccagcctggnctatagagcaagaccctgtctcaaaaaaaaaaaaaaatctatctgtctgtgtatccatccatccatccattcatccatccttagttgcttccattaaagt

SEQ ID NO: 31454 - DNA, 201 bp, Homo sapiens
ggccgaagtgggaggatcgcttgagctcaggagtttgagaccagcccaggcaacatagagagaccctgtttctacaaaaaattaaaaaaaatttagccagstgtggtggtgtacacctgtggtcccaactactcaggaggctgaggctcaaggatcacttgagtccaggaggttgaggctgtagtgagccctgattacgcc

SEQ ID NO: 31455 - DNA, 201 bp, Homo sapiens
tactgctttgtttttttcctgttatttcattcttcttgttgcttggttgccaggctggagtgcagtggcgctatcttggctcactgcaacatccgactccygggttcaagcaattctgcctcagcctccaaagtagctgggattacaggtgcccacgaccatgcccggctaatttttgtattttttagtggagatggggtt

SEQ ID NO: 31456 - DNA, 201 bp, Homo sapiens
aggttgatgggtgaggcaccatgataaggagatggggtgactatacttaatgtctctacatatgtttcagaatttccaaaataaaacttaaaaaataaaawtgccgatgcctacacattgccttctattactagtctaagaaaaacagatgaagaaaaaaggctgcctcttcatacattatttggaatttctgttgtgcaa

SEQ ID NO: 31457 - DNA, 201 bp, Homo sapiens
cagcgtgtcccagtgtgggatattttgagtcattttcaggcagagaagtgccagagctagttcatattgactagcaagagccgacttaaatgttcaggaaycttgtgagccaattgatgtgacattaacagtttgaaattggctgtgatgggagtatttacaccatggatatgggcaaacaccgatcaaaacttccttcca

SEQ ID NO: 31458 - DNA, 201 bp, Homo sapiens
attcagatattttaaaatttatttttattgtattgttttagataaacaccctagttttaaacatttgtgacaaactgtactgcaagctgggaaatccacayaccagtgctagataaaaagcgtctatcagacagagccaaagtcatgtctactctccatgtgcgaaaccactctgcccccaacactgttaccaggactcag

SEQ ID NO: 31459 - DNA, 201 bp, Homo sapiens
tcccttatgggtttggtgttcacattccacgagataatcatgtacagtccttagcacagtttcaataaataatattgattttacttgggctggtagacttktttcttttttttaaagacaccaggtcctagtatcccagtttcccaggtagaatatggtgggaattcgcagatgggatcgtagtgcactacagccatgaac

SEQ ID NO: 31460 - DNA, 201 bp, Homo sapiens
agcactttggatggccgaagtgggaggatcgcttgagctcaggagtttgagaccagcccaggcaacatagagagaccctgtttctacaaaaaattaaaaakaatttagccagctgtggtggtgtacacctgtggtcccaactactcaggaggctgaggctcaaggatcacttgagtccaggaggttgaggctgtagtgagc

SEQ ID NO: 31461 - DNA, 201 bp, Homo sapiens
gcacgccaccacgcctggctaatttttgtattttttagtagacatggggtttcaccatgttggccagactggtctcaaactcctgacctcagatgatccasgtatatttgggttcttgaatgtatgtaaaaacatgcagtatcaaattttgatgctccactggtctcaaatttggccaatgggaaactatcaagctggttc

SEQ ID NO: 31462 - DNA, 201 bp, Homo sapiens
aaaaacatttttttactgagatgaaattcacataatgtacaactaaccttttttttttttttttttttttttttttgagatcatctcgctctattgcccargctgaagggcagtggtgtgatcctggctcactgcaacctctgcctcccaggttcaagcgattctcctgcctcagcctccggagtagctgagattacaggt

SEQ ID NO: 31463 - DNA, 201 bp, Homo sapiens
tggagccatgagtcttctaacattgccccccaaccacgtctgcaatctcttctcaggttgtatttcagctggatgttgcacatcctttgcacgtgtgtgcrtgtgtgagtgtgtagaagcactaggggatgggggaaggtggggtgggagtgggggtgtcttcctgcttgaaaagcttttctttctttttttttttttttt

SEQ ID NO: 31464 - DNA, 201 bp, Homo sapiens
cccagagcccttgagggaaatagctagatactgatagcacttagcacactatgtttttgtataattttggtatttagtgagacatggtaattatgtccaaycatacaaagtcagtgagctacacctggggaatgttgaagaaatagtctgcatggacattctatttatagctaaaactaatcagaaaatcagaagtaggca

SEQ ID NO: 31465 - DNA, 201 bp, Homo sapiens
atcagttttcctgattagtggggtcttttgatgaaatagtttagcttagttggtagttttgagcacagaaagtactcattttattttttatttttgagacrgagtcttgctctattgcccaggctacagtgcagtggcatgatctcggctcactgcaacctctgcctcctgggttcgagtgattctcctgcctcagcctcc

SEQ ID NO: 31466 - DNA, 201 bp, Homo sapiens
atctacctggcttcctttatcactggataggaattttcacagttgccttaatgtgatgctaataatctttagatttaacaaacaacggaatccgtactaarttgattttattttaatacatttaaaataaatctaatggagaaggataaaattttttcttccataattttttctttttataaaattctgtgattaataaaa

SEQ ID NO: 31467 - DNA, 201 bp, Homo sapiens
atataccattatatatagtgtatatacactagtatatacacacgtgtatatatagtatatatacacatacacacatatatacacatacgcacacatatgtrtatatacatatgtgtgtgtatgtgtatatatacatatatatgataaatttagtgttttagtaattgaaaaaccaaggataaattcttctgtatttttgtt

SEQ ID NO: 31468 - DNA, 201 bp, Homo sapiens
taagtcaaacaaaaaggtaaaggaaaaaatgtaagaaaaacatactgtttgcggttccaagatagccaaataggaacagctccagtctacagctcccagcrcgagtgacgcagaagacaggtgatttctgcatttccaactgaggtaccgggttcatctcacggggcttgtcggacagtgggggcaggacagtgggtgcag

SEQ ID NO: 31469 - DNA, 201 bp, Homo sapiens
tacacatgtacacatatatatataccattatatatagtgtatatacactagtatatacacacgtgtatatatagtatatatacacatacacacatatatayacatacgcacacatatgtatatatacatatgtgtgtgtatgtgtatatatacatatatatgataaatttagtgttttagtaattgaaaaaccaaggataa

SEQ ID NO: 31470 - DNA, 201 bp, Homo sapiens
taatcccagcactttgggaagctgagacgggaagatcacttgaagccagtttaagatcagcctgggcaacatagtgagaccctctcttgaccaaaaaaaawatatatatatagcctggtgtggtggcatgcacctgttgtctagctacttaggaggttggggcagaaggatcacttgagcctgggagtttgaagttgcagt

SEQ ID NO: 31471 - DNA, 201 bp, Homo sapiens
aagggtatttttaagaccttttcattttggttaaaaatgatgacatacagccaggcgtggtggctcacgcctgtaatctcagcactttgggaggccgaggmgggcagatcatgaagtcaggagttcaagaccagcctggccaacatggtgaaaccccgtttctactaaaaaatgcaaaaaaaaaaaaaaaaaagttgggcg

SEQ ID NO: 31472 - DNA, 201 bp, Homo sapiens
gcctcagcctcccaaagtgctgggattacaggcacaatccaccacgcccggcctaagcccaccattcttttcagctgtttgtacctttagataaagttctygctactctcttctatggtctataatttgtgaaaaactaattatgatgcaatttcaacaaatgtatttgttcagttctatttgattttctaattcatgttg

SEQ ID NO: 31473 - DNA, 201 bp, Homo sapiens
agtaagtaactccagactcccatatatttgtaattctttgtaaattctatttaaggggtttttgtttgttatgtacgtgttctcctttgctaaaaagaatrttgcccatcacttccctctactgccaacttgctattattaaataagcccttttcctttaatttgtcatcttttaatctgctttggattggattaccaaat

SEQ ID NO: 31474 - DNA, 201 bp, Homo sapiens; identical to SEQ ID NO: 6055

SEQ ID NO: 31475 - DNA, 201 bp, Homo sapiens
acaagctacaaagtcaatattcagatgtcccaaatcttagactcctttatttaaaagagctaaccaacaaagaatttactaagcccacctttctttttttyttttttttttttttttgagacagtcttgctctgtcgcccaggctggagtgcagtggtacagtggcatgctctcagctcacttccacctcctgggttcaag

SEQ ID NO: 31476 - DNA, 201 bp, Homo sapiens
gacattctatttatagctaaaactaatcagaaaatcagaagtaggcaatcatggcttatttctagaagacgctaaggtggaaaagagactgtccatctccyaaccaggtttctgccaggacactcgtgtcctcccatcctttctgtctccctaggggaacacattatcttcattaccgtttctctcaacctaggtgctgga

SEQ ID NO: 31477 - DNA, 201 bp, Homo sapiens
gcatgagaatgatgtaatggactttggggtttccaggggaaggatgggaatggggtgaatgataaaagactacagattgggtacagtgtacactactcacrtgataggtgcaccaaaatcttagaaatcaccactaaagaatgtattcatgtaaccaaacaccacctgttccccaaaaattattgtaataaaaataaaatt

SEQ ID NO: 31478 - DNA, 201 bp, Homo sapiens
tgagcatgttgcttaatctctgagctccagctcttcatcacttaaaggtaactattattaaatagtggagaaagcaattaagagggatagtaatgagtgcrattatgcctggattttagctgtgagcttaatggcagccaaagcaaaagaagaaatacgagttccatcattcattatgtaacacaaagaagcatacctgtt

SEQ ID NO: 31479 - DNA, 201 bp, Homo sapiens
gtatagcatttaaacagaaactttgaggtgtgattttttatataagacattgaaccagaaatgaataagttagagcaaatatggaagagtcaattctcatracagtataatgtaaggcaaaaatatttttgtggaaggctacattaattgggtccaagtatgttgctttttcatgttttttgttttttgttttgagacaga

SEQ ID NO: 31480 - DNA, 201 bp, Homo sapiens
gaaatgaataagttagagcaaatatggaagagtcaattctcataacagtataatgtaaggcaaaaatatttttgtggaaggctacattaattgggtccaartatgttgctttttcatgttttttgttttttgttttgagacagactctctctgtgatgcccaggctggagtgcaatggcaccatcttagctcactgcaacc

SEQ ID NO: 31481 - DNA, 201 bp, Homo sapiens
acagtataatgtaaggcaaaaatatttttgtggaaggctacattaattgggtccaagtatgttgctttttcatgttttttgttttttgttttgagacagastctctctgtgatgcccaggctggagtgcaatggcaccatcttagctcactgcaacctctgcttcctgggttcaagcgattctcctgcctcagcctcccaa

SEQ ID NO: 31482 - DNA, 201 bp, Homo sapiens
cagttctctatttgctgttctttaggtggcatgacattgccaacatgtcccacaacaagtccttttttgcattagagctggcaaataaagaggagaccatycaatttcaaactgtgagtaaacattaggggtctgcatggaatgtttttcctaaaagttaacaagttctacttctgcgtgcctgtatgtgtttggaggcag

SEQ ID NO: 31483 - DNA, 201 bp, Homo sapiens
attattcctcccatttgccttcagggttaattttctaaagggattgggactgaaacctagctcttttggggccatttggcacttttctcacttaaggactraagaactctgacatttggagtattacaacctgaaagagttacctatgaaaaaacaacaccttatccaaaataggaagaggatcacaattactaactacaa

SEQ ID NO: 31484 - DNA, 201 bp, Homo sapiens
ggtatctactaggaggaaaagaagccactgtatgaaaaagacatttgcacacacatgtttatagtagcacaattcacaattgcaaaaatatggaaccagcytaaatgtccatcaaccaactagtggataagggaaaatgtgacacacacaaacacgcacacaccatggaatactactcaggaatgaaataatggcatttgc

SEQ ID NO: 31485 - DNA, 201 bp, Homo sapiens
agccaccgcaccctgcccagatcctttcactcttcttaaccctcctttggcattccacttctttttttaagtaatttttttagtttgtttttgagacagcyctgtcacccaggctgagtacagtggcatgatcatggctcacagcagcctctcaacctccctgggctcaggtgatcctcccacctcagcctcctgagtagc

SEQ ID NO: 31486 - DNA, 201 bp, Homo sapiens; identical to SEQ ID NO: 6057

SEQ ID NO: 31487 - DNA, 201 bp, Homo sapiens
tctttcttttttgttcattttaatttttttagagacaaggtaggtctagctatgttgcccaggttggtctcaaattcctaggctcaagcgatcctcccgcrataggcatgtgccaccatgtccggctcttgacttcgttctttcaacattcattgagtaaaattcattgactatattcttacaggccagatcgaggttcta

SEQ ID NO: 31488 - DNA, 201 bp, Homo sapiens
attcgcagatgggatcgtagtgcactacagccatgaactcctggattcaagggatcctcctgcctcagccttccaagtcgctggcactacacgggcatgtkccaccacgcctggctcagcctttttaatttttattttgtcttctttggcacacagattctagtgatttcttctcagttatttagcagcacccatcaacat

SEQ ID NO: 31489 - DNA, 201 bp, Homo sapiens
tcttgcctttatttgaaaacaatagttacaaatgggcttttctgtgtctgtttcctttttttaccttattgtttttttaaagatagaacttgctgtgtgartagttgaaaatctcacattatcacattagtgtttgtcagcactccctaatacgtttaggtacttttttttttttttttttttgaggctagaatctcgctc

SEQ ID NO: 31490 - DNA, 201 bp, Homo sapiens; identical to SEQ ID NO: 6042

SEQ ID NO: 31491 - DNA, 201 bp, Homo sapiens
tgcccacccggacggggagctggccagtggtttgcatgtatggcccagtccctgtctcttctctgccttcccctgcaccatgtttgcatccgagtccccaycgctggtctggtgatgggattttcgtaagcactgacagggaggaggaacctgctttctttgtaaatatgggaagcggtttctgctaggggcctgggtgta

SEQ ID NO: 31492 - DNA, 201 bp, Homo sapiens
gttgattcaaaattattcaggagcatattatttaatttccatttatttatatagttttgagggttacttttggagttaatttccagttttattccattgtsgtctgagagagtacttgatgtaattttgatttttttaaaatttgttgagccttgttttgtggcctatcatatggtctatcttggagaatgttccatgttt

SEQ ID NO: 31493 - DNA, 201 bp, Homo sapiens
gagtgagccactgcacctgacctttaagattctttcctctgtcttgactttagataatctgatgactgtgtgcctaggtgatgatctttttgtgatgtatytcctgggtgttctttgagcttcttgtgtttggatgtctaaatctctagcaagaccagggaagtttttcttgattattccctcaaataagtttccccaagt

SEQ ID NO: 31494 - DNA, 201 bp, Homo sapiens
catccttgtttgaaactgtctaggggctctgtgtggtggttcatgtccgtagtcccaacattttgaatccaagcactaggattgcctgagcccaggagttmgagaacagcctgggcaacatggtgaaactcccatctctgtaaaaaatagaaaaatttgtcaggcatagtggtatgcacctgtagtcccagctactcagga

SEQ ID NO: 31495 - DNA, 201 bp, Homo sapiens
atttcttggaaataagttatttctttgggaaatgaagcgcttcataactaactttgcctgataaacaaggttgactcctttgtccaaactatttggagtgmtaagttttggaaacaatttataaatttctatctgtcgtaaataaaggatactacctctgcttttaggaacagtgattgttgttgaatacatgactaatta

SEQ ID NO: 31496 - DNA, 201 bp, Homo sapiens
tactaaaaatacaatattgctggccatggtggtgcatgcctgtaatcccagctagtcaggaggctgaggcaggagaatcgcttgaacctgagaggtggagsttacattgagtcaagatcatgccattgcactccagcctgggcaacaagagcaaaactatgtctcaaaaaaaaaaaaaaaattaaccgggcgtggtggcag

SEQ ID NO: 31497 - DNA, 201 bp, Homo sapiens; identical to SEQ ID NO: 6052

SEQ ID NO: 31498 - DNA, 201 bp, Homo sapiens
tagtagaaataacttcctatcaagggtttgtaccactttctatagtagattacccaaatatgatcattaaaaggtgtatagtgttgagatttatatatggkgcagagtagttttgttattttaaataagttttgacttattttgcctactcaggctaagaaaatatacgggtaatctcatgctgagtggcaagctcatgtg

SEQ ID NO: 31499 - DNA, 201 bp, Homo sapiens
gctacattaattgggtccaagtatgttgctttttcatgttttttgttttttgttttgagacagactctctctgtgatgcccaggctggagtgcaatggcaycatcttagctcactgcaacctctgcttcctgggttcaagcgattctcctgcctcagcctcccaagtagctgggactacaggcatgtgccaccacgcctgg

SEQ ID NO: 31500 - DNA, 201 bp, Homo sapiens
atagtacttatgaaagagattaatgtacatagacaaaaactacttaacaaaaaaagtaccacagatttaaatttgcttttttttttttttttttttttttkagaacagtcttgccctgttgcccaggctggagtgcagtggtgtgatctcagttcactgcaacctctgcctcctgggttcaagcgattcccctgccttgtg

SEQ ID NO: 31501 - DNA, 201 bp, Homo sapiens
tgtcacttagatttcctttatcttttaatgaattgacagaacatacagaggcaatttaagtttttgcctaagatgctaacattactagaagaaactgtgtrtgtcacaaatccttcatgaggattggtagcatgtagtagaaataacttcctatcaagggtttgtaccactttctatagtagattacccaaatatgatcat

SEQ ID NO: 31502 - DNA, 201 bp, Homo sapiens; identical to SEQ ID NO: 6058

SEQ ID NO: 31503 - DNA, 201 bp, Homo sapiens
gcacatgggaaccagaacaaaccagaagtttcttggtgaacatggaatcagaagaatgttaccttgaaaaagtagatattttcataagtcggccaggcgcrgtggctcacgcgtgtaatcccagcactttgggaggccgaggtgggcagatcacctgaggtcaggagttcaagaccagcctggcctggccaacatggtgaa

SEQ ID NO: 31504 - DNA, 201 bp, Homo sapiens
cagaacaaaccagaagtttcttggtgaacatggaatcagaagaatgttaccttgaaaaagtagatattttcataagtcggccaggcgcagtggctcacgcrtgtaatcccagcactttgggaggccgaggtgggcagatcacctgaggtcaggagttcaagaccagcctggcctggccaacatggtgaaaccccatctcta

SEQ ID NO: 31505 - DNA, 201 bp, Homo sapiens
tgcgagccccatgagcgcgccgcggcccgggctggcgtgcgggtgcggctgcggcggccgcgcggcggggccccgggaggcgggtcgctgagcggggcgckcggccccgaggatgcgggagcgggagcgggagcaggtgagggcgcggtccccggccggcgggaggggcgggcggctggcccgagcggtggggtgtgtcca

SEQ ID NO: 31506 - DNA, 201 bp, Homo sapiens
tcaccatatttgaactacagaaagtaacttctttttttttttttttttttttatttgagacagagtctcgctctatcgcccaggctggagtgcagtggcgygatctcggctcactgcaacctccgtctcccaggttcatgccattctcctgtctcagtctcccaggttcatgccattcttctgtctcagcctcccaagtaa

SEQ ID NO: 31507 - DNA, 201 bp, Homo sapiens
ttaattgggtccaagtatgttgctttttcatgttttttgttttttgttttgagacagactctctctgtgatgcccaggctggagtgcaatggcaccatctyagctcactgcaacctctgcttcctgggttcaagcgattctcctgcctcagcctcccaagtagctgggactacaggcatgtgccaccacgcctggctaatt

SEQ ID NO: 31508 - DNA, 201 bp, Homo sapiens
ctctcaaagtgctggaattacaggcgtgagtcaccgtgccgggcgtaatttttgtatttttttagtagagacggggtttcaccatattggccaggctggtyccgaactcctgacctcgtgatccacccgcctcggcctcccaaagtgctgggattacaggcgtgagccaccgcgcccagacaggaatcattatctttgcgt

SEQ ID NO: 31509 - DNA, 201 bp, Homo sapiens
cagcctcctgagtagctgggactacaggcgtgtgccacctgcccggctaattttttttttgagacggagtctcgctctgtcgcccaggctggagtgcagtkatgcgatctcggctcactgcaagctccgcctcccgggttcacgccattctcttgcctcagcctcccaagtagctgggactacaggtgcccaccaccatgc

SEQ ID NO: 31510 - DNA, 201 bp, Homo sapiens
gtatgttcagtcctgtgaaggggtgatggtaccctcattttactggtgatagaatttaaattcaccagattatgacttgcccaagttcgtgcagaatactratttggagagttcaggtctacttgactctaaaccttgttctggtaactgatgccctatatattgaaagtacaaacagggtggtaaacagaagtaaaccca

SEQ ID NO: 31511 - DNA, 201 bp, Homo sapiens
tgtgggctgaatggacaagtgttttccaatagtgattatcacatggcatagacatacttggatcaaaggccctaagtgttgggaattacagtcacagcagycacttgctactgaggcagacatgcttctccatttcaacaaacacactgccaagataatcatttctctgatgtccaggggaatctatccataaaatggttg

SEQ ID NO: 31512 - DNA, 201 bp, Homo sapiens
attgagacaaacatttgctaggtatttccaccatctaacacttttatttatttatttatttaaagagacggggtcttgctctgtcttccaggctggagtgyggtggtgtgatcatagctcactgtaacctcagactcccgggcttaagggatccactggcctcagccctcagcttctgaagtagccaggattataagcgtg

SEQ ID NO: 31513 - DNA, 201 bp, Homo sapiens
tttttattttttaaaacccagacacgccatgcagacttgtgtcaccaaaataaatactggaagaatggaatatcttttggaaaagagacatttatttttcmttaacagcctgaatactttccagtaacaaagaaatgaaattatttataaaagctagtaaaagcagttgtaatcacctgatgttaaaactagtatgtacta

SEQ ID NO: 31514 - DNA, 201 bp, Homo sapiens
ctgggaagatttctgatggggcattatttcaaacaataactggcatttagccttgggagtgaaatttaatcagaataattattaataaaactccttcagcyataagaaggcatggagacatgtatcatttttaaacaaatgcctgatgcacatggagccacattccttttcaaggtactttagattttcttaagtatcact

SEQ ID NO: 31515 - DNA, 201 bp, Homo sapiens
agaagtccttaaatgacctgatggagctgaaaaacatggcaagagaactacgtgatgaatgcacaagcttcagtagccgattcgatcaactggaagaaagsgtatcagtgattgaagatcaaatgaatgaaatgaagcaagaagagaagtttagagaaaaaagagtaaaaggaaatgaacaaagcctccaagaaatatggg

SEQ ID NO: 31516 - DNA, 201 bp, Homo sapiens
atttttattgtattgttttagataaacaccctagttttaaacatttgtgacaaactgtactgcaagctgggaaatccacataccagtgctagataaaaagygtctatcagacagagccaaagtcatgtctactctccatgtgcgaaaccactctgcccccaacactgttaccaggactcagggcgcacttatttgcccggc

SEQ ID NO: 31517 - DNA, 201 bp, Homo sapiens
ccaatggtcttagcaaacggcacaccaggagattatatcccacacctggctcggagggtcccacgcccacagatactcactcactgctagcacagcggtcygagatctatctgcaagatggcagcgaggctgggggaggggcatccaccattgctgaggcttgagtaggtaaacaaagcagccaggaagctcgaactgggt

SEQ ID NO: 31518 - DNA, 201 bp, Homo sapiens
aggtaccgggttcatctcacggggcttgtcggacagtgggggcaggacagtgggtgcagcccaccgagcgtaagccaaagcagggtgaggcatcgcctcasccgggaagtgcaaggggtcagggaattccctttcctagccaagggaagtggtaacagatggcacctggaaaatcaggtaattcccacccaaatactgagc

SEQ ID NO: 31519 - DNA, 201 bp, Homo sapiens
ccctgcctcctgggttcacgccattctcctgcctcagcctcctgagtagctgggactacaggcacccgccaccacgcccggctaattttttgtatttttartagagacggggtttcaccgtgttagccaggatggtcttgatctcctgacctcgtaatccgcctgccttggccttccaaagtggggattacaggtgtgagc

SEQ ID NO: 31520 - DNA, 201 bp, Homo sapiens
gagaattgcttgaacccaggaggcagaggttgcagtgagccgagatctcgcctctgcactccagcttgggtgacagagcaagactctgtctcaaaaaaaaacaaaacaaaaacagaaaaataaggaaatgtcaggaaattcagatcaaagtttgcatgtctacttgggtagagagagttttagaaaacatttgaagtcctt

SEQ ID NO: 31521 - DNA, 201 bp, Homo sapiens
ttggactctaaaaatagctgatatatatgtaaagtaaaagtctagtacccagaaacttttttaccttttgggccaagtagttattcatttaggtatgtacrttataaaacaagtaagaccgaggtagagacaagaatctgtgaatattttcagttagagctattggaccgtctgaagcaaatataatgttaggttggttgg

SEQ ID NO: 31522 - DNA, 201 bp, Homo sapiens; identical to SEQ ID NO: 6054

SEQ ID NO: 31523 - DNA, 201 bp, Homo sapiens
tgaggcatctacctggcttcctttatcactggataggaattttcacagttgccttaatgtgatgctaataatctttagatttaacaaacaacggaatccgwactaagttgattttattttaatacatttaaaataaatctaatggagaaggataaaattttttcttccataattttttctttttataaaattctgtgatta

SEQ ID NO: 31524 - DNA, 201 bp, Homo sapiens
tttgagataggttctcatggttcactgcagcctcaacctcctgggctcaagcaatcctcctgcctcatcctcccaagtagatgggaccacaggcatgcacyaccacacctggctcgttttttaattttttgcagagacggggtctcactgtgtttctcaggctggtcctgaactcctaggctcaagtgatcctccctcctt

SEQ ID NO: 31525 - DNA, 201 bp, Homo sapiens
ttttgttgcagtgctcaggcttccagctcttcctggcccacatctccactcctcatgccctgcacttgagccaggctaacttgattagggcctccatcctwtctcctgttggcttccagtgtcctggcaactagggttctcctccccccatcgctgctaaactgcaaactccgacaggacggctcatctcaagtgtggttc

SEQ ID NO: 31526 - DNA, 201 bp, Homo sapiens
ggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcaga

SEQ ID NO: 31527 - DNA, 201 bp, Homo sapiens
actggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaatt

SEQ ID NO: 31528 - DNA, 201 bp, Homo sapiens
tgagcggggcgcgcggccccgaggatgcgggagcgggagcgggagcaggtgagggcgcggtccccggccggcgggaggggcgggcggctggcccgagcggyggggtgtgtccactcgcccggaccccggagcgcgcccgcggccccggaatcccggagaatggggcgcggcggccagacccgtagcgggagcgtaacaaag

SEQ ID NO: 31529 - DNA, 201 bp, Homo sapiens
atggtcttgatctcctgacctcgtaatccgcctgccttggccttccaaagtggggattacaggtgtgagccactgtgcccagccctttctcactgacttayaagagtactctctgtgtgctgcttctgcttgctggttacccgcccactcctctgtctttgccactctgttaaagcggccctctgggagcctcccagcacc

SEQ ID NO: 31530 - DNA, 201 bp, Homo sapiens
catggaaattatcaaaaataatgaatttagaaattgtaatcttgagtatactgtatcatcaagaaagacattttatcagttgacatcttttcttgatcctrtagctgttttcctattttagctttggaccaacttgtaataactacattgtatacctctaagatttatttcaactagttacaagaaccattgtaattcttg

SEQ ID NO: 31531 - DNA, 201 bp, Homo sapiens
gaaggactggcgtggtgattttgtcggagatcatgatcgcctgcctggaacacaatgaggtgatggcgcttatgatcacctggcctttttgggtggaaatraggctggggaagagagggacatagtgacttaatagctctttttgcgcacatttccttggactgtggtggcctcaagatgttactaatgttccctgcaaaa

SEQ ID NO: 31532 - DNA, 201 bp, Homo sapiens
ctaatttttttttttagttttttagagatggggtcttgctgtgttgcccaggctggtcttaaacccctggcctcaagtgatcctcacatctcagcctcctragtacctgggattacaggaaggaatctattccttgaactatctattagtgcatgagctttcaatggcatctttttgtttatcaaaatcttaactccctta

SEQ ID NO: 31533 - DNA, 201 bp, Homo sapiens
tgatccttgagtacttttctatttcattgattttccacagcatatcttgaagagatccagtctgttcgacgccatacaaatagcacaagtgatccccaaarccccaaccctccgttgttggtccactgcagtgctggggtaggaaggactggcgtggtgattttgtcggagatcatgatcgcctgcctggaacacaatgag

SEQ ID NO: 31534 - DNA, 201 bp, Homo sapiens
ctgggcccggccgccccgctgctccggccgcgcgtcccgcgtcggtccgacggtctgtccgtcctcctgccaccccccgcccccacggggcttctttgtgyggcgctcctcgccggccggtcccacctccaggcctcgcccctcgccgtcgccaccgccggactctgcccaggggaatggtctgcgagccgggtttttgga

SEQ ID NO: 31535 - DNA, 201 bp, Homo sapiens
ctatctaaaaaaaaaaaaaaaaacacacacaaccatgtgggattaaggttttatttcactggtttatgcttctctaccaaattatggttaaatgcattgtrtctcaatgagataatattgacattgaccttatacaactgacattttttataggtatcagtattatctgcaactgaagaaagatatcttggaaggaagtat

SEQ ID NO: 31536 - DNA, 201 bp, Homo sapiens
attactatcccattattgatgaaggtatggagacttacagaagtgaaatgtcttgccctgccacacaactagtaagtggagcagcaagactcgagcctgtkctcttagccgctgtgctagcctgttagagtagttcctgcctgcttttttcatattgacagatatcaactgacagatcattttcatttgatctgtctctct

SEQ ID NO: 31537 - DNA, 201 bp, Homo sapiens
tgagggcagggtctcctcttcctcatcttcgtgtcccctgtctggcaaggtgcccggtgcataagggcttagtgaacaatgggagccggagtgtggcagtkatgggagtcacaggggagaagagcacttttgctcctttgtctcttccttttattacagattgtaaatgaggcatggggtggaggcaaagtctaacaaggg

SEQ ID NO: 31538 - DNA, 201 bp, Homo sapiens
cactggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaat

SEQ ID NO: 31539 - DNA, 201 bp, Homo sapiens
tcttccttttattacagattgtaaatgaggcatggggtggaggcaaagtctaacaagggcattttgtcccttagcaccaggaaggaaggagaaaggctgtkgaagtgccttctgtcttgcagggtgtgagagaaactctgggcaggagcagcagtgtaaagataacatgcggggatgcccacccggacggggagctggcca

SEQ ID NO: 31540 - DNA, 201 bp, Homo sapiens
taatcccagctgctcggaaggctgaggcaggagaatcccttgagcctgggaggtggaggttgcagtgagccaggatcgcaccactgcatttcagcctgggmgacagagcaagactccatctccaaaaaaaaaaaaagaaaaccacacatttcatggggctggagtgacactagggcctctccctccatcagtattccttcc

SEQ ID NO: 31541 - DNA, 201 bp, Homo sapiens
ttttattacagattgtaaatgaggcatggggtggaggcaaagtctaacaagggcattttgtcccttagcaccaggaaggaaggagaaaggctgtggaagtkccttctgtcttgcagggtgtgagagaaactctgggcaggagcagcagtgtaaagataacatgcggggatgcccacccggacggggagctggccagtggtt

SEQ ID NO: 31542 - DNA, 201 bp, Homo sapiens
ctgaggcaggggattcgcttgaacctgggaggtggaggttgcagtgagctgagatcgtgccactgcactccagcctggtgacagagcaaaaaaaaaaaaaagaaaaagatttagttacctctacgtgtggtagaggtggaaattgaaagcagatcagtttcattagaacctattgcttatccccttccaaataaaataaac

SEQ ID NO: 31543 - DNA, 201 bp, Homo sapiens
catatcgccagggccaggtaatgtttttgggagagacggggtctcgctgtgttgcccaggctggtctcgaactcctggactcaggtgattctcccacctcrgcctctcgaagtgctgtgattacaggcgtgagccactgtgcctggaacaaattgttaagtacaatgcttttcattgtagaaaacatctcggaaacttttg

SEQ ID NO: 31544 - DNA, 201 bp, Homo sapiens
ccagccttgtaagtgcttgctaaataggaattccaccatatgaaaatacattcttttcaagtaactatcattcagacttttgtcccccacttttttttttwaaagaaaaataaaaggctgggcacggtggcttacgtctgtaatcccaccattttaggaggccaaggcaggtggatcacctgaggtcaggaattcaagacc

SEQ ID NO: 31545 - DNA, 201 bp, Homo sapiens
acagagctgaccccataagtggtgcatgaggccatcttgtggcacagcatcactaagctgctgcagagacgttcatatggttgtgtgatcttttaaaaacrtcagtgacacttaactataaatataatcttaaattatcacaaattttatataatatttgccagtagacaacataaatatgaattcaatatttcaagttaa

SEQ ID NO: 31546 - DNA, 201 bp, Homo sapiens
agaatattcttaaagagaaaacgttttaaaggcttactcaaatgagtataaacaaacatattgttgcttgaattggtaaatacagtgattggtttttgttstgttgtgttttgttttcaggtagttccagaaacatatctcaagatatgacacagacatcaggtacaaatcttacttcagaagagcttcggaagagacgag

SEQ ID NO: 31547 - DNA, 201 bp, Homo sapiens
agtggtgcatgaggccatcttgtggcacagcatcactaagctgctgcagagacgttcatatggttgtgtgatcttttaaaaacatcagtgacacttaactrtaaatataatcttaaattatcacaaattttatataatatttgccagtagacaacataaatatgaattcaatatttcaagttaatattgtctgttttcttt

SEQ ID NO: 31548 - DNA, 201 bp, Homo sapiens
aataattaccaaacttttatctttagtcttgacatctaccctgaacacctagctttgactaactcctagctttggcatctccacttggaaatccaaaaagygtttcaaactgaacatgtctatgaaagacttatttttttctctctatccatgctatccatcaggttttccatttccataagggtgactcttgtactctgg

SEQ ID NO: 31549 - DNA, 201 bp, Homo sapiens
tctatgtgtcaataattaccaaacttttatctttagtcttgacatctaccctgaacacctagctttgactaactcctagctttggcatctccacttggaartccaaaaagtgtttcaaactgaacatgtctatgaaagacttatttttttctctctatccatgctatccatcaggttttccatttccataagggtgactct

SEQ ID NO: 31550 - DNA, 201 bp, Homo sapiens
actttcctatttcacctttgtgatgtccatgagcatctgccctgtagccttcctggcaccccagtgtctgtggcagcacagagctgaccccataagtggtrcatgaggccatcttgtggcacagcatcactaagctgctgcagagacgttcatatggttgtgtgatcttttaaaaacatcagtgacacttaactataaata

SEQ ID NO: 31551 - DNA, 201 bp, Homo sapiens
acattacaaatgcctttatgttatgtctaaaatagaagattggttgcagttattaccagtgcttttgttctttagagtccataaaacagacctggaacgartgttagaagcaaatgatggctcaggaatgttagacgaagatgaggaggatttgcagagggctctggcactaagtcgccaagaaattgacatggaagatga

SEQ ID NO: 31552 - DNA, 201 bp, Homo sapiens
agaaggaaggggtacatacaacattttttctagtgctgaaagacaaaaactctaggctgggcacggtggcacacacctgtaatcccagcacttttggaggytgaggcaggcagatcacctgaagtcaggagttcgagaccagcctggccaacatggggaaaccctgtctctactaaaaatacaaaaattagccaggtgtgg

SEQ ID NO: 31553 - DNA, 201 bp, Homo sapiens
tgtactcttagaggtgttttgacaattactgcagaagcaatagctatatagtgggctttccctttagatttcttataatggaaatcactttttacaacctrtattttattaggagtagttatatttttactcctggttattttatttggtttcaacactgtactaacacaatagtaaattgtggttttaatctttgtgggt

SEQ ID NO: 31554 - DNA, 201 bp, Homo sapiens
aaaatcataaagtaattgcataaatgcataaagtaatcatagttttcatgcattaaaaaaactagttttggctgggcgctatggctcacgcttgtaatccsagcactttcggaggccaaggcaggcgaatcatctgaggtcaggagttcgagactagcctggccaacatggcgaaacctcttctctactaaaaatacaaaa

SEQ ID NO: 31555 - DNA, 201 bp, Homo sapiens
ttttccagcagtagtctctaaatctgttttaccatcataaaaccccaagcaaaactctactacatcagctgtgtcactgtaaaacctgccttaactcacakaagcatgaaattaagcaatgtgtgtgaaactattttataaactgtaaagtattccatacatacatgttggcagttattaatgtcttctctaggtgtggct

SEQ ID NO: 31556 - DNA, 201 bp, Homo sapiens
aaggattgtagaatcttcatattagagtggggcatttaaaaattccttcttgagaaagattaatttgcatctggatgctaataataaccttaattctggcygggcgcggtggctcacacctgtaatcccagcactttgggaggccgaggtgggcggatcacgaggtcaggagattgagaccatcctggctaacatggtgaa

SEQ ID NO: 31557 - DNA, 201 bp, Homo sapiens
ttagtgatatatctatacacacacactttttaaaacctatagccggctgggcgtggtggctcatgcctgtaatcccagtactttgggaggcccaggcgggyggatcacaaggtcaggagattgagaccagcctggccaacaaggtgaaaccctgtctctactaaaaatacaaaaatagctgggtgtggtggcgtgtgcttg

SEQ ID NO: 31558 - DNA, 201 bp, Homo sapiens
atttttcataaactaaaagtagaataaaggctattcctctaaaattgctatctcacctgtcactcccttgcattctcacataccttcttgagtggaggggmagagggcatggagtgatagcagatgtgccaggaattctccataactcagtccgtccctcttgtgctatgttgcagcatcaggatttgctaatgggaggat

SEQ ID NO: 31559 - DNA, 201 bp, Homo sapiens
ggaggctgaggcaggagaatggcatgaacccgggtggcggagcttgcagtgagccaagatagcgccactgcactccggcctgggtgaaagagtgagactcygtctcaaaaaaaaaaaaaaaattatttaggggaagatactatacaattctgtttaacaagtcacattttaattttttcttttggaaatattagcaagaag

SEQ ID NO: 31560 - DNA, 201 bp, Homo sapiens
ttatggatttagtgatatatctatacacacacactttttaaaacctatagccggctgggcgtggtggctcatgcctgtaatcccagtactttgggaggccsaggcgggtggatcacaaggtcaggagattgagaccagcctggccaacaaggtgaaaccctgtctctactaaaaatacaaaaatagctgggtgtggtggcg

SEQ ID NO: 31561 - DNA, 201 bp, Homo sapiens
tttgattgcctaatacttgagccaccacttcagtgatatggtataatttatcaaacagtgttgagaaacagaaactactggggatgttttaaagaggaaartacttaatatagaaattaggggtttacataatcttaagaaaggatgaaggtgcagctcttagccaggcctccacagtaccacaaaccaacttgcaggaag

SEQ ID NO: 31562 - DNA, 201 bp, Homo sapiens
tgcaaatgttctataacaaggagagacacaaatatcttcatggacatggattgctatgagtgtttgattgcctaatacttgagccaccacttcagtgatayggtataatttatcaaacagtgttgagaaacagaaactactggggatgttttaaagaggaaaatacttaatatagaaattaggggtttacataatcttaag

SEQ ID NO: 31563 - DNA, 201 bp, Homo sapiens
taccagactggatttccttattatggtttgtggcttttgattttttttttttaatgtatagctctctttgaattctttggtggttatatatatatgtactygcaagattcttttatctgtgggtctttcattctttttctaacactgtgagttgtatccagagtactttcggaacctctcctgagcgacctatctctgcag

SEQ ID NO: 31564 - DNA, 201 bp, Homo sapiens
atgtgtgtgaaactattttataaactgtaaagtattccatacatacatgttggcagttattaatgtcttctctaggtgtggctttgaaatggatgcagatkctttctgttacaaaaaacataagttgcaaatgttctataacaaggagagacacaaatatcttcatggacatggattgctatgagtgtttgattgcctaat

SEQ ID NO: 31565 - DNA, 201 bp, Homo sapiens
atttccttagatatctaaataaaattgaaatttcattaatgggaagattatttttatcctgaacttttcttgcctctatgcatgcctctgagtactccatrtggtgtgcaatcccatttttgattaatagagtcctgctggattagcagggacagaaatcagctttagatttctttcttttttttttttctttcttttttt

SEQ ID NO: 31566 - DNA, 201 bp, Homo sapiens
caagtacaatgtcagcaataactagtgctttttagtaaacagggtcaggcaaccttgtacccttttaaaaatgttcgaatatcgatatacctccttcctamttggtggaggattgattgaggaggaaagtgtgcagtgatggttaccagcttcagcctcttggcttgactttgcaaatactggtgagaatttggaaagagc

SEQ ID NO: 31567 - DNA, 201 bp, Homo sapiens
gctgggattacaggcgcatgccaccacgtcgggctaatttttttgtatttttagtagagagggggtttcaccatgttggccagactggtctcgaactcctratctcaggcaatctgccagcctgggtctcccaacatgctgggattacaggcatgagccactgcacccggcctgaactttttatagtagtaacgataattc

SEQ ID NO: 31568 - DNA, 201 bp, Homo sapiens
gacagagagagggccgtctcaaaaaaaaaaaaaaaaaaagtacaccttaatctggtttcaaggtgcaagatctgcacctatccttccatttaagtttcatsaaaccgctgctacctccccgtctcccacacaatttatgggacttctaagttccctctaaagggtccgaacacctacactggtaacaagccacctggattt

SEQ ID NO: 31569 - DNA, 201 bp, Homo sapiens
cacctcaaatgtcttatcatttcttctagtttttctgaggatgtcagattattgggttaaaggatatgaacatttttaaggccttggaacagatttctaawttgctttccagaataattcccatgtgatactttcaccatgtttatttcagacttttttttttttttttttttgagacgaaatctcactctgtcacccagg

SEQ ID NO: 31570 - DNA, 201 bp, Homo sapiens
aatcacaaaattcagatgagcctttagtgctgtctgatatttctactatgttttcttagtgatgtaccaccctccaaggtgtttataaaaaattatgtacyactctccaagatgtttataaaaaataatgtgccaccctccaaggtgactaatttcacagcttatgtctttaaacctttaagcactttcctctcccttaca

SEQ ID NO: 31571 - DNA, 201 bp, Homo sapiens
tctctactaaaaatacaaaaatagctgggtgtggtggcgtgtgcttgtaatcccagctactcgggagcctcaggaggagaatcgcttgaacctgggaggcrgaggttgcagcgagccgagatcgtgccactatactccagcctgggcgacagagcaagactctgtcacaaaaaaaaaaaaaaaaacctatagccttctaga

SEQ ID NO: 31572 - DNA, 201 bp, Homo sapiens
ccagaatccaaatgtagtgattggaatccacctagactgattgaggaatatattgtcctcaaattttatgagggttgactattcattttaactttaattargattgggcacaaattttgaaacataataacattacaggaccggggcccgatccagaccccaagagagggttcttggatcttgtgcaagaatgaattcagg

SEQ ID NO: 31573 - DNA, 201 bp, Homo sapiens
tctattaaaaaaaaatagagacaatgctgccttaaaaaagtcaaataaatgtttgctcaactgatttttaatactgagggccaaacaaagcacatcaaatytttaagtgctgcttttcctcattttatccaactctggacaccagaatccaaatgtagtgattggaatccacctagactgattgaggaatatattgtcctc

SEQ ID NO: 31574 - DNA, 201 bp, Homo sapiens
ggctcaggatcgatcctatgtaagattctgttttgcatttcatacatttcttttcccaaatttgatttttaaagttgtaatttcttaaagaagagaaatayattttgaatacttttgttttgatgttccctgtttcattcactcagactttcctatttcacctttgtgatgtccatgagcatctgccctgtagccttcctg

SEQ ID NO: 31575 - DNA, 201 bp, Homo sapiens
tggatcctcagtcttttccaagagaagctaagaattccaaatttttatttgaaatatattttttaaatgtttgttcaactggcccagtgccagtggctcaygcctttaatcctagcactttgagaggccgaggtggaaggatcacttgaccccaggagtttgagaccagcctgggcaacataaagagaccccatctctatt

SEQ ID NO: 31576 - DNA, 201 bp, Homo sapiens
ctggctcctatatgggtgatgttggagaagaggccgagtagagaatccagactgttgctgacacccagcagtaacaaggacacctccacaatgtccgtggrggccatgtggagatcagtaacaaggcactgctctccctcccagtcagagagatgtcagtggaggactagggggctagaactcccatgtgcgttcagcagt

SEQ ID NO: 31577 - DNA, 201 bp, Homo sapiens
gcacttttggaggccaaggcaggaggattgcttgagctcaaggagttcaggaccagcctgggcaatggcacaagaccccatctctaaaaaaaaaatgaaaraaaaaaaaattggctaggcgtggtgatgcatggccgtagtcccaggtgctagggaggctgaggagggagcacagaggtcaagcctgcagtgaatcatgat

SEQ ID NO: 31578 - DNA, 201 bp, Homo sapiens
gcatgagcctaggaggcagaggttgcagagtgccaagggctcaccactgcattccagcctgcccaacagagtgagacactgtttctgaaaaaaaaaaaaawatatatatatatatatatgtgtgtatatatatatgtatatatatatgacttcctattaaaaactttatcccagtcgggggcagtggctcacgcctgtaat

SEQ ID NO: 31579 - DNA, 201 bp, Homo sapiens
tccacacaaaaaaattagaaaatttgtcaagcatcttggtgcacacctgtagtcccagctgcttgggaggatgaagcgagagaatcacttaagcccaggtrttcgaggctgcagtgagctatgattgcaccactgcactccagactagatgaccatctcttttaaaaaaatgtgtttatatgttatatgtgatagtgcttt

SEQ ID NO: 31580 - DNA, 201 bp, Homo sapiens
cgcatgagcctaggaggcagaggttgcagagtgccaagggctcaccactgcattccagcctgcccaacagagtgagacactgtttctgaaaaaaaaaaaaatatatatatatatatatatgtgtgtatatatatatgtatatatatatgacttcctattaaaaactttatcccagtcgggggcagtggctcacgcctgtaa

SEQ ID NO: 31581 - DNA, 201 bp, Homo sapiens
catccttttaaatcagcctaccagactggatttccttattatggtttgtggcttttgattttttttttttaatgtatagctctctttgaattctttggtgkttatatatatatgtactcgcaagattcttttatctgtgggtctttcattctttttctaacactgtgagttgtatccagagtactttcggaacctctcctg

SEQ ID NO: 31582 - DNA, 201 bp, Homo sapiens
gcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataatttta

SEQ ID NO: 31583 - DNA, 201 bp, Homo sapiens
aggctgaggcaggagaatcgcttgaaccagggagtcgtaggttgcagtgagccaagatcgcgccactgcactctagcctggtgacagagcgagactccatytcaaagaaaaaaagaaatccttaattctaataagtcacaatgtctcaaacttaccatctgttgggtaaatttgagaaaatgcaataccttgctaccatcc

SEQ ID NO: 31584 - DNA, 201 bp, Homo sapiens
agttcatatataccctagttaaagcacttaagaaaatatggcatgtttgacttttagttcctagagagtttttgtttttgtttttgtttttttttgagacrgagtcttgctatgtctcccaggctggagggcagtggcatgatctcggctcactacaacttccacctcccgggttcaagcaattctcctgcctcagcctcc

SEQ ID NO: 31585 - DNA, 201 bp, Homo sapiens
agattgagaccatcctggctaacatggtgaaaccccgtctctactaaaaatacaaaaattagctggacgtggtgacacgtgcctgtaatcccagctactcrggaggctgaggcaggagaatcgcttgaaccagggagtcgtaggttgcagtgagccaagatcgcgccactgcactctagcctggtgacagagcgagactcc

SEQ ID NO: 31586 - DNA, 201 bp, Homo sapiens
agtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaattt

SEQ ID NO: 31587 - DNA, 201 bp, Homo sapiens
aaagattaatttgcatctggatgctaataataaccttaattctggccgggcgcggtggctcacacctgtaatcccagcactttgggaggccgaggtgggcrgatcacgaggtcaggagattgagaccatcctggctaacatggtgaaaccccgtctctactaaaaatacaaaaattagctggacgtggtgacacgtgcctg

SEQ ID NO: 31588 - DNA, 201 bp, Homo sapiens
cagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaatt

SEQ ID NO: 31589 - DNA, 201 bp, Homo sapiens
tagaggtgttttgacaattactgcagaagcaatagctatatagtgggctttccctttagatttcttataatggaaatcactttttacaacctatattttaytaggagtagttatatttttactcctggttattttatttggtttcaacactgtactaacacaatagtaaattgtggttttaatctttgtgggtatcagttg

SEQ ID NO: 31590 - DNA, 201 bp, Homo sapiens
acccaggaggtggaggttgcagtgagccaagctcatgccactgtactccagcctgggtgacagagcgagaccttgtctcaaaaaaaaaaaaaaaaaaaaaaacaagaaaaaaactctaaacccagagttacatatccagtgaaatatccttcaggagtgaagggaaaattaacgatttgtcttcaggagacctaccctaaa

SEQ ID NO: 31591 - DNA, 201 bp, Homo sapiens
gacatttaaactactgactatgcatttttattcttttgggagggtttaatgtttatagtttaaagcaaactgttgtttttaaaaaagtatctaacagggcygggcgcggtggctcacacctgtaatcccagcactttgggaggcctaggcgggcggatcacaaggtcaagagatcaagaccatcctggctaacatggtgaa

SEQ ID NO: 31592 - DNA, 201 bp, Homo sapiens
gcaagagaattggttgaacccaggaggtggaggttgcagtgagccaagctcatgccactgtactccagcctgggtgacagagcgagaccttgtctcaaaawaaaaaaaaaaaaaaaaaacaagaaaaaaactctaaacccagagttacatatccagtgaaatatccttcaggagtgaagggaaaattaacgatttgtcttc

SEQ ID NO: 31593 - DNA, 201 bp, Homo sapiens; identical to SEQ ID NO: 6089

SEQ ID NO: 31594 - DNA, 201 bp, Homo sapiens
ggcaagagaattggttgaacccaggaggtggaggttgcagtgagccaagctcatgccactgtactccagcctgggtgacagagcgagaccttgtctcaaawaaaaaaaaaaaaaaaaaaacaagaaaaaaactctaaacccagagttacatatccagtgaaatatccttcaggagtgaagggaaaattaacgatttgtctt

SEQ ID NO: 31595 - DNA, 201 bp, Homo sapiens
atcgcttgaacctgggaggcgacggttgcagtgagccaaggtcgcgccactgcactccagcctgggcagttgagcgagactccatctcaaaaaaaaaaaaattatccaggcttggtggtgggcgcctatagtcccagctacttgggaggctgaggcaagagaattggttgaacccaggaggtggaggttgcagtgagccaa

SEQ ID NO: 31596 - DNA, 201 bp, Homo sapiens
cctatatgggtgatgttggagaagaggccgagtagagaatccagactgttgctgacacccagcagtaacaaggacacctccacaatgtccgtggaggccaygtggagatcagtaacaaggcactgctctccctcccagtcagagagatgtcagtggaggactagggggctagaactcccatgtgcgttcagcagtaatccc

SEQ ID NO: 31597 - DNA, 201 bp, Homo sapiens
cgcgatctcggctcactgcaacctctgcctcccgggttcaagcgattctcctgcctcagcctcccaagtagctgggattacaggcacacggcactatgccyggctaattttttgtatctttgttagagatggggtttcaccatgttggtcaggttggtctcaaactcctgaccttatgatccacctgtcttggcctcccaa

SEQ ID NO: 31598 - DNA, 201 bp, Homo sapiens
ccaggctggtcttgaactcctgacctcaggtgatctgcccgcctcagcctcccaaagtgttgtgattacaggtatgagccaccatgcctggcccatttctsccttttttttttttttttttttttgaggtggagtctcactctgttgcccagactggagtgcagtggtgcaatcttggcgcattgcaacctctgcctccca

SEQ ID NO: 31599 - DNA, 201 bp, Homo sapiens
cccctttataaccagcatctttttgctttaaaaaatgacctggctttgtatttttttagtcttaaacataataaaaatatttttgttctaatttgctttcrtgagtgaagattattgacatcgttggtaaattctagaattttgattttgttttttaatttgaagaaaatctttgctattattattttttccaagtggtct

SEQ ID NO: 31600 - DNA, 201 bp, Homo sapiens
tcgcatgagcctaggaggcagaggttgcagagtgccaagggctcaccactgcattccagcctgcccaacagagtgagacactgtttctgaaaaaaaaaaawatatatatatatatatatatgtgtgtatatatatatgtatatatatatgacttcctattaaaaactttatcccagtcgggggcagtggctcacgcctgta

SEQ ID NO: 31601 - DNA, 201 bp, Homo sapiens
ttgtaaaataatctaagacatgtagcttttagctttgtaacctctataatattgatggcacagtgggagtggatgctgagtaccacttgaacatgttccayctcagtgtcttcacagctggaaggtgtctacattgtttcaaggtggacaattgatttacttctcatttttcataaactaaaagtagaataaaggctattc

SEQ ID NO: 31602 - DNA, 201 bp, Homo sapiens
aagctatagtttatacatcaggtactgccatttactgtaaaccacctgcaagaaagtcaggaacaactaaattcacaagaactgtcctgctaagaagtgtrttaaagatttccattttgttttactaattgggaacatcttaatgtttaatatttaaactattggtatcatttttctaatgtataatttgtattactggga

SEQ ID NO: 31603 - DNA, 201 bp, Homo sapiens
ttacactgtatgattccacttgttcaactaaaaatgacagctgtatagagatagagaacatattagtggtttccactagttagagaaagtgggtaaaagakaggtgggtgggaatataaatcgatagcagggagatctttgtggtattataacacttctatgtcttgattgtagtggtggtggttacatgaatacacgtgt

SEQ ID NO: 31604 - DNA, 201 bp, Homo sapiens
tgctttctttgcagcccttctaagtaatggctttttcttttatacatcacatatcacacggctgagaggagggatagatgtttttcttctttgcctcttcyaggccactgttcttccttataaactccagtttctttgaaatacatgcccctaacggctgggcacggtggctcacgcctgtaatcccagcactttgggagg

SEQ ID NO: 31605 - DNA, 201 bp, Homo sapiens
aaagcctcaaagggtcttacactgtatgattccacttgttcaactaaaaatgacagctgtatagagatagagaacatattagtggtttccactagttagasaaagtgggtaaaagataggtgggtgggaatataaatcgatagcagggagatctttgtggtattataacacttctatgtcttgattgtagtggtggtggtt

SEQ ID NO: 31606 - DNA, 201 bp, Homo sapiens
cacatatcacacggctgagaggagggatagatgtttttcttctttgcctcttctaggccactgttcttccttataaactccagtttctttgaaatacatgyccctaacggctgggcacggtggctcacgcctgtaatcccagcactttgggaggctgaggcaggcggatcacgatgtcaggagatcgagaccatcctggct

SEQ ID NO: 31607 - DNA, 201 bp, Homo sapiens
tggtgaaaccctgtctctactaaaaatacaaaaattagctgggcgtggtggcacatgcctgtaatcccagctactgggaaggctaaggcaggaaaatcacyggaacctgggagacggaggttgcagtgatccaagatcgcactagtgtactgcagcctgggcaacagagcaagactccatctaaatttgtgtcaggattcc

SEQ ID NO: 31608 - DNA, 201 bp, Homo sapiens
gagcttgcagtgagccgagatcgcgccactgcactccagcctgggcgacagagcaatactctgtctaaaaaaaaaaaaaaaaaaaaaaaaagagtatttarcagaggccaggtgcagtggctcatgtttgtaatcccagaactttgggaggctgaggcgggcggatcatttgaggtcaggagtttgagaccagcctggcca

SEQ ID NO: 31609 - DNA, 201 bp, Homo sapiens
tgcaacctccgcctcctgagtttaagcgattattctgcctcagcctcccaagtagctgcggttacaggcaagtgcctccatgcctggctaatttttgtgtyttttgtagacatggggtttcaccatgttgcccaggctggtttcgaactcctgagctcaggcaatctgcctacctcggcctcccaaagttctgggattaca

SEQ ID NO: 31610 - DNA, 201 bp, Homo sapiens
taatccgtcatcataatcactccattgcattcttcaacgtgtttcccctctctccctccatcatacttgaatgacaaaaatctcaaccctggttaaaccamatcttggccttgtccattcctgtaccagagtagctggacgtggctaaaaaataacataaaacatgatgattggttttacttttttcttaaatgatctatc

SEQ ID NO: 31611 - DNA, 201 bp, Homo sapiens
tgtaccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctctt

SEQ ID NO: 31612 - DNA, 201 bp, Homo sapiens
gtaatccccatgaccgccactccttgacatcacaggccttgaagaaacctggactttcactcccctctggttgtagcgaggtggcactcccttttccctgytgccagtgctgtgtcagtggaggcttgctaaattggaagatgtaaataagattcacattctcataacataataccccaaattttcaggatttaattgaaa

SEQ ID NO: 31613 - DNA, 201 bp, Homo sapiens
ttggaggtatgggagcgcattcccaaatagacgtggtagttcatttagctgctcatggccgcttcaggcagtcctgtaagcctgttagcatcaggggaatrgatgcaaaccataaatctggatcaactcctaaaaccttaccttgtgcccagccttgtaagtgcttgctaaataggaattccaccatatgaaaatacattc

SEQ ID NO: 31614 - DNA, 201 bp, Homo sapiens
aggctgaggcaggagaatcacttgaacccgggaggcggagattgcagtgagccaagattgtgccattgaactccagcctgggtgacaagaccaaaactccwtctcaaaaaaaaaaaagattatagcatctttattcatcattgcccaaaattacaaactgcctaaatgtagaccttcatttagttaatgaatgcacaaact

SEQ ID NO: 31615 - DNA, 201 bp, Homo sapiens
tgggtgacagagcaaaactctgtctcaaaaaaaaaaaaaaaaaaaagggctggacacggtggcttacgcctgttatcccggcactttgggaggccaaggcygatggatcacctgaggtcaggagttcaagaccagcctggccaacatggtgaaaccccatctctactaaaaatacaaaaatttgctgggcatggtggtggg

SEQ ID NO: 31616 - DNA, 201 bp, Homo sapiens
atggcgtgatctcggctcaccgtaacttctgcctcctgggttcaagcgattttcttgcctcagcctcccgagtagctggatttacaggcatgtgccaccaygcctggctaattttgtattttagtagagatggaaggggtttctccatgtttgttaggctggtctccaactcctgacctcaggtgagccgcccacctcggc

SEQ ID NO: 31617 - DNA, 201 bp, Homo sapiens
taagcactgaatttttaaggttgtattaatttgcaaataaatgtctatcttattattttgagagatttaaaaaattttagttcttcaaaattgcattttcrcattttgaattacgttatctttgacaaatacagaagatgtcaaattttggtttattttctttggttctaatttatatttttgtttaaaactatatttttc

SEQ ID NO: 31618 - DNA, 201 bp, Homo sapiens
acacttaactataaatataatcttaaattatcacaaattttatataatatttgccagtagacaacataaatatgaattcaatatttcaagttaatattgtstgttttcttttttagaaatgaaagatcatttatatgcaattataaggaacactggtttacagttagaaaattaggaaaacaggtaacatttcttaccctt

SEQ ID NO: 31619 - DNA, 201 bp, Homo sapiens
gaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggctgatggatcacctgaggtcaggagttcaagaccagcctggccaaca

SEQ ID NO: 31620 - DNA, 201 bp, Homo sapiens
cggctaattttttttttttttttttgagatggagtttccctcttgttgctccggctggagtgcaatggcgtgatctcggctcaccgtaacttctgcctccygggttcaagcgattttcttgcctcagcctcccgagtagctggatttacaggcatgtgccaccatgcctggctaattttgtattttagtagagatggaagg

SEQ ID NO: 31621 - DNA, 201 bp, Homo sapiens
caaaaaaaaaaaaaaaaacctatagccttctagagaaatttatatatgaagtacacaactaacatagctacacttcctaaatttggaatggagtggtttarcttatgaaaagttgctatttttcttaacaggttataagcaatgccttgaaagtttggggtttagaactaatcctgttcaacagtccagagtatcagaggc

SEQ ID NO: 31622 - DNA, 201 bp, Homo sapiens
attctcttacctctcactgccccctctacttctctgaacctgcagtccccaaagtcaccaatggtctccatagcaacaaaatttagtgggctcttatacgwccttatattgcttgacttcttggcagcaactgacactgactaccccttgaagcatcccctgcccaggccttccacaatgtcacactctcttgcttctcct

SEQ ID NO: 31623 - DNA, 201 bp, Homo sapiens
cactgcaagctctgcttcctgggttcatggcattctcctgcctcagcctcctgagtagctgggactacaggcgcccgccacatcgcctggctaattttttrtatttttagtagagacagggtttcaccatgttagccaggatggtctcaatctcctgacctcatgatccgcccgcctcggcctcccaaagtgctgggatta

SEQ ID NO: 31624 - DNA, 201 bp, Homo sapiens
ctgcctcaacctcccgagtagctgggattacaggcgtgcaccaccatgaccggctaattttttttttttttttttgagatggagtttccctcttgttgctycggctggagtgcaatggcgtgatctcggctcaccgtaacttctgcctcctgggttcaagcgattttcttgcctcagcctcccgagtagctggatttacag

SEQ ID NO: 31625 - DNA, 201 bp, Homo sapiens
ctactggggatgttttaaagaggaaaatacttaatatagaaattaggggtttacataatcttaagaaaggatgaaggtgcagctcttagccaggcctccasagtaccacaaaccaacttgcaggaagagctgtaaccactgccccagttgggacaatgggtaatgaggatattaaatttaagaacatactgctatagcaat

SEQ ID NO: 31626 - DNA, 201 bp, Homo sapiens
gtctgcgtgcggcacgtgggcggggtaccggggcgggccggggaggggcggggtgggcggaggagaggggcagggggcggagctggagggggtggttcggygtgggggccgttggctccagacaaataaacatggagtccatcttccacgagaaagtgagtgtccgcgttcggtggggagctgtctgccgcgcggtggcgg

SEQ ID NO: 31627 - DNA, 201 bp, Homo sapiens
ggctggagtgcagtgtcgcgatctcggctcactgcaagctctgcttcctgggttcatggcattctcctgcctcagcctcctgagtagctgggactacaggygcccgccacatcgcctggctaattttttgtatttttagtagagacagggtttcaccatgttagccaggatggtctcaatctcctgacctcatgatccgcc

SEQ ID NO: 31628 - DNA, 201 bp, Homo sapiens
tgatgtcagataggttgggttaaggaatagaccttattggggaaagagagaacttggagggccaaggttagcaggagaaggaaatgttctctcatctgccrtcaattcagggaggggcaaacctggtgtctgtgttcacagggagggatccatccatctgtgattctcccttcttatcaggtagcatgggaaagctacact

SEQ ID NO: 31629 - DNA, 201 bp, Homo sapiens
aaagaaacggaaaaaaaaaacttagttggattcaaattgcaacacaatcattatattactagagcttatttgccagaaaacattttaagttttgacttacktaaagcctttacattacaaatgcctttatgttatgtctaaaatagaagattggttgcagttattaccagtgcttttgttctttagagtccataaaacaga

SEQ ID NO: 31630 - DNA, 201 bp, Homo sapiens
caatgatccttggcatagaaagctgccaccacaattgcctagagatgggaacatgaagtctggcccccattgcaacagcagtgaagcagaattttgggackggcatctcccaaatggctttgcttgccaccagagaacaaccaaagtggagggagatggctaggcctcatttctgcctattttattttattttttgagacg

SEQ ID NO: 31631 - DNA, 201 bp, Homo sapiens
gtactgtctctccactgcattcccaccaaatataaccactatgctgaattctgacatcataaatgagttttgcctgattttgagcttttgtgactggaagygtacagtgtatataccctttcgattctgtcctctttagtttaccattgtttgagaaatttatccatactgttccagaattaactactgttaattattgtt

SEQ ID NO: 31632 - DNA, 201 bp, Homo sapiens
tttaatgaatactttaacataataatttaaacttcacagtaatttgtacagtctccaaaaattccttagacatcatggatatttttctttttttgagatgragtcttgctctgtcacccaggctggagtgcagtgtcgcgatctcggctcactgcaagctctgcttcctgggttcatggcattctcctgcctcagcctcct

SEQ ID NO: 31633 - DNA, 201 bp, Homo sapiens
tttgggaataatatgcagatatgattttccattatgtctcagttgttcagtgtatattttctaagtacaagaatatattcctacatatttacatgataacygtcatgtttaaacattttaaaatggggatttgtattacattgtttctctttttgaaaaaattacagaggagcttaatgcaatcagtattacttaaaatct

SEQ ID NO: 31634 - DNA, 201 bp, Homo sapiens
ggcaggagaggattgctagaacatttaatgaatactttaacataataatttaaacttcacagtaatttgtacagtctccaaaaattccttagacatcatgratatttttctttttttgagatggagtcttgctctgtcacccaggctggagtgcagtgtcgcgatctcggctcactgcaagctctgcttcctgggttcatg

SEQ ID NO: 31635 - DNA, 201 bp, Homo sapiens
agaaggagatcctgtctcaaaaaaaaagtttcaaattatacactttaaatatgtgcagtttattatatgtcacttataccccaataaatctgttttttttwaaatgtaaatacaagccaaaaaaggtataagtcaagaaaatatattgaattaaatctgtaagagataattcaaaaacaaaaaccctattgttatctttta

SEQ ID NO: 31636 - DNA, 201 bp, Homo sapiens
gaataaaggctattcctctaaaattgctatctcacctgtcactcccttgcattctcacataccttcttgagtggaggggcagagggcatggagtgatagcrgatgtgccaggaattctccataactcagtccgtccctcttgtgctatgttgcagcatcaggatttgctaatgggaggatactgcccttacgtgcatcatt

SEQ ID NO: 31637 - DNA, 201 bp, Homo sapiens
ccagcactttgggaaaccaaggcaggagaggattgctagaacatttaatgaatactttaacataataatttaaacttcacagtaatttgtacagtctccaraaattccttagacatcatggatatttttctttttttgagatggagtcttgctctgtcacccaggctggagtgcagtgtcgcgatctcggctcactgcaag

SEQ ID NO: 31638 - DNA, 201 bp, Homo sapiens
aagaccccatctctaaaaaaaaaatgaaagaaaaaaaaattggctaggcgtggtgatgcatggccgtagtcccaggtgctagggaggctgaggagggagcmcagaggtcaagcctgcagtgaatcatgatcgtgctactgcactccagcttgggtgacagaaggagatcctgtctcaaaaaaaaagtttcaaattatacac

SEQ ID NO: 31639 - DNA, 201 bp, Homo sapiens
ttagtagagacagttttgccatgttggccaggctggtcttgaactcctcacctcaggtgatccgcctgccttggcctcccaaagtgctgggattacaggcrcaagccactgtgcctgacccgtttctgctttttaaagctcatgtgagcacttaatttgtaaccagaatcctacttgtaaaataatctaagacatgtagct

SEQ ID NO: 31640 - DNA, 201 bp, Homo sapiens
tgctttacattattcttcattccctctttaatcatattaagaatcttaagtaaatttgtaatctactaaatttccctggattaaggagcagttaccaaaaraaaaaaaaaaaaaaaagctagatgtggtggctcacatctgtaatcccagcactttgggaaaccaaggcaggagaggattgctagaacatttaatgaatac

SEQ ID NO: 31641 - DNA, 201 bp, Homo sapiens
cattcatcatgttcgctaccttcacactttatctgacatacgagctccatgtgatttttgctttacattattcttcattccctctttaatcatattaagamtcttaagtaaatttgtaatctactaaatttccctggattaaggagcagttaccaaaagaaaaaaaaaaaaaaaagctagatgtggtggctcacatctgta

SEQ ID NO: 31642 - DNA, 201 bp, Homo sapiens
tttccaaaattcatttgttgaaatgtagtctccagtgtgttggtttaacagatggggcctttgggagatgattagatcataaggccaagccttgtgactgrgattagtgcccttatgcagagaggaagcttgtttgccccttttccccttccaccatgtgaggacaaaaaaatgcaccatctatgaggaatgggccctcac

SEQ ID NO: 31643 - DNA, 201 bp, Homo sapiens
attacaggcatgagccattgcacccggccatcactgaaggattttgaagtcagagttgtgtaatcatttaagaatccctgccaatgtaagtcccctgaagrtgggactgtttgtgtttttcatggttatagtcccagggcctgatatgcagttattcttgttaaacaaaagaaaatcttgtgagatttgcatttttggaag

SEQ ID NO: 31644 - DNA, 201 bp, Homo sapiens
agtgggagaactgggatcagatgcaggcagtctgattctaaatcagttgctgttacccactctgacaacagtaagtgagtagcctgctcagtcaagtactrtattagtagggccctttacagacatatttatttctcacagtcactcaatgagacggctcttccagtcttacaatggagaaagtgaggctcagagacttta

SEQ ID NO: 31645 - DNA, 201 bp, Homo sapiens
atggtgaaaccccatctctactaaaaatacaaaaatttgctgggcatggtggtgggcacctgtaatcccaggaggctgaggcaggagaatcacttgaaccygggaggcggagattgcagtgagccaagattgtgccattgaactccagcctgggtgacaagaccaaaactccttctcaaaaaaaaaaaagattatagcatc

SEQ ID NO: 31646 - DNA, 201 bp, Homo sapiens
cccgccacatcgcctggctaattttttgtatttttagtagagacagggtttcaccatgttagccaggatggtctcaatctcctgacctcatgatccgccckcctcggcctcccaaagtgctgggattacaggcgtgagccatcacgtccggccagaaatcatgaatattagtaggtgaaaaataaacacattttaccacct

SEQ ID NO: 31647 - DNA, 201 bp, Homo sapiens
tgtatttattcttttaagttttgttttttaaatatacttcacttttgaatgtttcagacagcagcaaaagcagcaacagcagcagcagcagcagcagcagsgggacctatcaggacagagttcacatccatgtgaaaggccagccaccagttcaggagcacttgggagtgatctaggtaaggcctgctcaccattcatcat

SEQ ID NO: 31648 - DNA, 201 bp, Homo sapiens
tccttatgaatagtttttctcatggtgtatttattcttttaagttttgttttttaaatatacttcacttttgaatgtttcagacagcagcaaaagcagcarcagcagcagcagcagcagcagcagggggacctatcaggacagagttcacatccatgtgaaaggccagccaccagttcaggagcacttgggagtgatctag

SEQ ID NO: 31649 - DNA, 201 bp, Homo sapiens
ctttttacaagatccccaggacactaaagtatagagtgaagcttgagaagcgctgttgtgtggattgttcttaaccagctgcagtgatgaatatgaataaygcaggccagcacagtccattgatattctattccagcttactgcctgccaaaaggtccattattactggatcctcagtcttttccaagagaagctaagaat

SEQ ID NO: 31650 - DNA, 201 bp, Homo sapiens
atgtattttccttatgaatagtttttctcatggtgtatttattcttttaagttttgttttttaaatatacttcacttttgaatgtttcagacagcagcaamagcagcaacagcagcagcagcagcagcagcagggggacctatcaggacagagttcacatccatgtgaaaggccagccaccagttcaggagcacttgggag

SEQ ID NO: 31651 - DNA, 201 bp, Homo sapiens
aatgtattttccttatgaatagtttttctcatggtgtatttattcttttaagttttgttttttaaatatacttcacttttgaatgtttcagacagcagcaraagcagcaacagcagcagcagcagcagcagcagggggacctatcaggacagagttcacatccatgtgaaaggccagccaccagttcaggagcacttggga

SEQ ID NO: 31652 - DNA, 201 bp, Homo sapiens
ggggatttgtattacattgtttctctttttgaaaaaattacagaggagcttaatgcaatcagtattacttaaaatctgataatgtgtgttaaatagtagtyttcatttatttcatttatcaggtgttcagtgaatgcttactatgtaacagcacagttatcagcactggggaaatagatgagtaagataagatttgcactt

SEQ ID NO: 31653 - DNA, 201 bp, Homo sapiens
taatttatgagtcattaaataatattttcaagccatgacattttttccagcagtagtctctaaatctgttttaccatcataaaaccccaagcaaaactctrctacatcagctgtgtcactgtaaaacctgccttaactcacagaagcatgaaattaagcaatgtgtgtgaaactattttataaactgtaaagtattccata

SEQ ID NO: 31654 - DNA, 201 bp, Homo sapiens
taaactgctcttttacttaaaattttttaaaaactggattaaaaatatgaaacttccaacaaattgagcttttttttttttttttttcttttttgagacgrggtctcgcttttgtcacccagtctggagtgcagtggcgcgatctcggctcactgcaacctccacctccctggttcaagcaattcccctgcctcagcctcc

SEQ ID NO: 31655 - DNA, 201 bp, Homo sapiens
caggagatggagaccatcctggctaatacagtgaaaccccgtctctactaaaaaatacacaaaaattagctgggtgtggtggcaggcacctgtagtcccakctactctggaggctgaggcaggagaatggcatgaacccgggaggtggagcttgcagtgagcagagatcacaccactgcactccagtctgggcgacagagc

SEQ ID NO: 31656 - DNA, 201 bp, Homo sapiens
gctgaggcaggcagatcacttgaggccatgagttcaagaccaacctggccaacatggcgaaagcctgtctctactaaaaatacaaaaaaattagttgggcrtggtggtgcacacctgtaatcacagctactttggaggctgaggcaggagaatcgtttgaacccagaggtggaggttgcagtgagccgagattgtgccact

SEQ ID NO: 31657 - DNA, 201 bp, Homo sapiens
ggttgcagtgagccgagattgtgccactgcactctatcctgggtgacagagcgagatactgtctcaaaaagaaaaaaaaaaggctgggcgcggtagttcaygcctgcaatcccagcactttgggaggccgaggcaggcagattacgaagtcaggagatggagaccatcctggctaatacagtgaaaccccgtctctactaa

SEQ ID NO: 31658 - DNA, 201 bp, Homo sapiens
tgttgttgttgtttaagacagagcttcgctgtgtcatcaggctggagtgcagtggcatgatagctcactgcaacctctgcctcccgcgttcaagcaattcycctgcctcagcctcctgagtagctgggactacaggcgtgcaccaccacgcccagctaatttttgtatttttagtagagatgcggtttcaccatgttggcc

SEQ ID NO: 31659 - DNA, 201 bp, Homo sapiens
taactactgttaattattgttaattaactactgttgtagttaattcatcctcattgttatctagtattcttttgtgagtaaacacaatttccattctactrtgatcccagctatccatttgggtcgtttccagtttggggtccattacaaatagtaatgctatctgtaatgctattttgtattactacaaatagtaatgct

SEQ ID NO: 31660 - DNA, 201 bp, Homo sapiens
cagatgagcctttagtgctgtctgatatttctactatgttttcttagtgatgtaccaccctccaaggtgtttataaaaaattatgtaccactctccaagawgtttataaaaaataatgtgccaccctccaaggtgactaatttcacagcttatgtctttaaacctttaagcactttcctctcccttacacaccttccttgt

SEQ ID NO: 31661 - DNA, 201 bp, Homo sapiens
atgtaccaccctccaaggtgtttataaaaaattatgtaccactctccaagatgtttataaaaaataatgtgccaccctccaaggtgactaatttcacagcytatgtctttaaacctttaagcactttcctctcccttacacaccttccttgtggctttccgttacattctgctgagaacatagaagcaattaaaattatgt

SEQ ID NO: 31662 - DNA, 201 bp, Homo sapiens
gcctgggcaacataaagagaccccatctctattaaaaaaaaatagagacaatgctgccttaaaaaagtcaaataaatgtttgctcaactgatttttaatastgagggccaaacaaagcacatcaaatttttaagtgctgcttttcctcattttatccaactctggacaccagaatccaaatgtagtgattggaatccacct

SEQ ID NO: 31663 - DNA, 201 bp, Homo sapiens
ggccttgaagaaacctggactttcactcccctctggttgtagcgaggtggcactcccttttccctgttgccagtgctgtgtcagtggaggcttgctaaatyggaagatgtaaataagattcacattctcataacataataccccaaattttcaggatttaattgaaaatcactaagctgggcatggtggctcacacctgta

SEQ ID NO: 31664 - DNA, 201 bp, Homo sapiens
atgtttataaaaaataatgtgccaccctccaaggtgactaatttcacagcttatgtctttaaacctttaagcactttcctctcccttacacaccttccttrtggctttccgttacattctgctgagaacatagaagcaattaaaattatgttctttctaccagcaaatttatcaatttgcttatatcttcacctgtgcttt

SEQ ID NO: 31665 - DNA, 201 bp, Homo sapiens
aaaagagctcaacttgaaatatttccagagtttaaacaatcttactaagctttgatgggttgtatctattcttaacatgtgaaacttccttattacctatratatacactaacttaaatattgacaatttttttccagtggtttaacttgaattctctcttgacgggtccagaattaatatcagatacatatcttgcactt

SEQ ID NO: 31666 - DNA, 201 bp, Homo sapiens
gaggcgggcggatcatttgaggtcaggagtttgagaccagcctggccaatgtggcaaatgtgctgtctctaactaaaaatacaaaaattagctgggtgtgrtggtgcagacctgtagtcccagctacttgggaggctgaggcaggagaatcacttgaacctgggaggcagaggttgcagtgatccgagatcatgccactgc

SEQ ID NO: 31667 - DNA, 201 bp, Homo sapiens
tcaagcaattctcttgtctcagcctcccaaatagctgtgtctacagccacgcaccaccacacccagctaatttttgtatttttagtagagacggggtttcrccatgttggtcaggctggtcttgaactcctgacctcaggtgatccgtccgtctctgcctctcaaagtgctggggttacaggcgtgagccaccatgccgag

SEQ ID NO: 31668 - DNA, 201 bp, Homo sapiens
caggagaatcgtttgaacccagaggtggaggttgcagtgagccgagattgtgccactgcactctatcctgggtgacagagcgagatactgtctcaaaaagraaaaaaaaaggctgggcgcggtagttcatgcctgcaatcccagcactttgggaggccgaggcaggcagattacgaagtcaggagatggagaccatcctgg

SEQ ID NO: 31669 - DNA, 201 bp, Homo sapiens
aaaactaacattctaaaaattttattttaagaaatatcaaaattggctgggcacggtggctcacgcctctaatccctgcactttggaaggctgaggtgggyggatcacctgaggtcaggagggtcaggagtacaagaccagcctggccaacatggcgaaaccctgtctccactaaaaatacaaaaattagccaggcatgat

SEQ ID NO: 31670 - DNA, 201 bp, Homo sapiens
gtgaaaggccagccaccagttcaggagcacttgggagtgatctaggtaaggcctgctcaccattcatcatgttcgctaccttcacactttatctgacatamgagctccatgtgatttttgctttacattattcttcattccctctttaatcatattaagaatcttaagtaaatttgtaatctactaaatttccctggatta

SEQ ID NO: 31671 - DNA, 201 bp, Homo sapiens
aaaaaattagccaggcgtggtggcgcatgcttgtaatcccagctacttgagaggctgaggcaggagaatcacttgaacccgggaggcgaggttgcggtgarccgagatcgtgccattgcactctagcctgggcaaaaagagtgaaactccatctcaaataaataaataaataaataaataataaaaaataacttaaatcta

SEQ ID NO: 31672 - DNA, 201 bp, Homo sapiens
cactgcaacctctacctccccggttcaagtgattctcctgcctcagcctcccaaagtagctgggattacaggtgcctgccaccacgcctggctaatttttrtatttttagtagagatggggtttcaccgtgttgtccaggctcgtgtcaaacttctgacctcaagccatccacccgcctcggcctcccaaagtgctgggat

SEQ ID NO: 31673 - DNA, 201 bp, Homo sapiens
atggagaaaccccatctctactaaaaatacaaaaaattagccaggcgtggtggcgcatgcttgtaatcccagctacttgagaggctgaggcaggagaatcrcttgaacccgggaggcgaggttgcggtgagccgagatcgtgccattgcactctagcctgggcaaaaagagtgaaactccatctcaaataaataaataaat

SEQ ID NO: 31674 - DNA, 201 bp, Homo sapiens
atccttgttccttttcaaattcttatataccttttttttttaaacacttgatcttagccaaaagaccgagaagcaatctttttttttttttttttttttttaacctatagcttctcactgagattgtcagctgtttgtaagttttggtttttggttttctgtgtttgtatttacatatatgaaatacagattgagtatccc

SEQ ID NO: 31675 - DNA, 201 bp, Homo sapiens
tctatatcatcaattatctagttaatgtaaaaaataaatctaaggccaggcgcggtggctcacacctgtaatcccagcactttgggaggctgaggtgggcrgatcacctgagatcaggagttcaagaccagcctgaccaacatggagaaaccccatctctactaaaaatacaaaaaattagccaggcgtggtggcgcatgc

SEQ ID NO: 31676 - DNA, 201 bp, Homo sapiens
aatccttgttccttttcaaattcttatataccttttttttttaaacacttgatcttagccaaaagaccgagaagcaatctttttttttttttttttttttttaacctatagcttctcactgagattgtcagctgtttgtaagttttggtttttggttttctgtgtttgtatttacatatatgaaatacagattgagtatcc

SEQ ID NO: 31677 - DNA, 201 bp, Homo sapiens
cacacggccaatcttgcttttttttttttttttttttgagatggagtcttgctctgttgcccaggctggagtgcaatggcacaatttctgctcactgcaayctctgcctcctgagttcaagcgattctcccacttcagcctcccaagtagctgggattacaggtacacaccaccatgcctggctaattcttgtatttttag

SEQ ID NO: 31678 - DNA, 201 bp, Homo sapiens
aaatccttgttccttttcaaattcttatataccttttttttttaaacacttgatcttagccaaaagaccgagaagcaatctttttttttttttttttttttttaacctatagcttctcactgagattgtcagctgtttgtaagttttggtttttggttttctgtgtttgtatttacatatatgaaatacagattgagtatc

SEQ ID NO: 31679 - DNA, 201 bp, Homo sapiens
gatcctcccacctcagcccctcaaacagttgagattatagtatgaaccactgtgcctagccttaagtgatttttaaatttgtactgaacagtttgtccttyccttccattaaatcatattagaagtacagaacttgatatttcctgtagcaatacagtttttctttgatgaagtttgatttcaagtacttatttttcataa

SEQ ID NO: 31680 - DNA, 201 bp, Homo sapiens
aagtctttctgaatcctcagcttgtatttttttccagtgttctgtgctgcctttttatctactagtgttttacatcaattttgaatctctttactaactgkttaggttgatttttgccttttttttttaggttattctatatttgtcgttaagggtgatctgccagattgcgaagctgaccaactcctgcagatgattagg

SEQ ID NO: 31681 - DNA, 201 bp, Homo sapiens
tgagaggaactctataaaaaatgtgccattctattaataattgttgctggtaatttaaaaatccttgttccttttcaaattcttatataccttttttttttaaacacttgatcttagccaaaagaccgagaagcaatctttttttttttttttttttttttaacctatagcttctcactgagattgtcagctgtttgtaag

SEQ ID NO: 31682 - DNA, 201 bp, Homo sapiens
tttttttttttttttaacctatagcttctcactgagattgtcagctgtttgtaagttttggtttttggttttctgtgtttgtatttacatatatgaaatayagattgagtatcccttatccaaaatgcttaagactggaagtgttttagatttggggttttttaggatttgtgaatatttgcactatacttaccagttaag

SEQ ID NO: 31683 - DNA, 201 bp, Homo sapiens
gtgcctagccttaagtgatttttaaatttgtactgaacagtttgtcctttccttccattaaatcatattagaagtacagaacttgatatttcctgtagcartacagtttttctttgatgaagtttgatttcaagtacttatttttcataatttaaagctattttttatagagagaattttaatcaaatatttggatgtcac

SEQ ID NO: 31684 - DNA, 201 bp, Homo sapiens
ttttaattctttgattttagatacttgtatcttttttcttttatatttaaaaccttggttcctgatgatatcccttcttagaaaccctgtctacctttggycttcagcccaccatgctgtggttttcctaacttgctgcctgcacttttcagattcctttcatggatcttaaatatcatctgtaaataagatctatgtgtc

SEQ ID NO: 31685 - DNA, 201 bp, Homo sapiens
ttacaggcacatgccaccacacccagctaattttgtatttttagtagagacgggtttttgccatgttggctagtctggtcttgaactcctgacctcaggtsatctgcctgccttggcctcccaaagtgctaggagttgagctgccatgcccggccaacacaagatttcaatgaagaagattacagaaaaggtgagtagcct

SEQ ID NO: 31686 - DNA, 201 bp, Homo sapiens
tatttggcaggctgaggcaggagaatcacttgaacctgggaggcagaggttgcagtgagccgaggttgtgccattgcactacagcctaggcgacaagagcragactccatctcaaaaaaaaaaaaaaaaaaaaaaaaactccctattacagattcataatttatgagtcattaaataatattttcaagccatgacattttt

SEQ ID NO: 31687 - DNA, 201 bp, Homo sapiens
tctcaattgcaagcatattactctttaactaccacctcctatctttaaaccatgttttgtctgtttttttattccagccattctttaaaccctactgtggrgcccaagcatttcctttatacgcattcttcctttcttctactgcttattttctgtaatccgtcatcataatcactccattgcattcttcaacgtgtttcc

SEQ ID NO: 31688 - DNA, 201 bp, Homo sapiens
atgaggaggagaggatgagaatggcagaaggaggagttactagtgaagattatcgcacgtttttacaggtactgattttaaactcactaagtcacatttcwtttttttttttttttttgagacggagtctcgccctgttgcccatgctggagtgcaatggcgcgatctcggctcactgcaacctctgcctcccgggttcaa

SEQ ID NO: 31689 - DNA, 201 bp, Homo sapiens
gtaattgcataaatgcataaagtaatcatagttttcatgcattaaaaaaactagttttggctgggcgctatggctcacgcttgtaatcccagcactttcgraggccaaggcaggcgaatcatctgaggtcaggagttcgagactagcctggccaacatggcgaaacctcttctctactaaaaatacaaaaaaattagccga

SEQ ID NO: 31690 - DNA, 201 bp, Homo sapiens
acatgcccctagattaaactatcccttgtccttttgcactcatccacaagtctcttttcatcagtgattttaggatctgactcgttgtctttttctctacytcaactacttttatcattcttaattatttctgtatcgtcaatcaatccagtacctgcctcttagtttcaaaatcacttactcttgcttagctattaccag

SEQ ID NO: 31691 - DNA, 201 bp, Homo sapiens
agtttttcttttccctttttgagtatttgaagcttcatactgaatatagtaatcatagtattcatgcataaagaaaatcataaagtaattgcataaatgcrtaaagtaatcatagttttcatgcattaaaaaaactagttttggctgggcgctatggctcacgcttgtaatcccagcactttcggaggccaaggcaggcga

SEQ ID NO: 31692 - DNA, 201 bp, Homo sapiens
tcagcctcccaaagtagctgggattacaggtgcctgccaccacgcctggctaatttttgtatttttagtagagatggggtttcaccgtgttgtccaggctsgtgtcaaacttctgacctcaagccatccacccgcctcggcctcccaaagtgctgggattacaggtgtgagccaccactcctggccatgataggttatttt

SEQ ID NO: 31693 - DNA, 201 bp, Homo sapiens
ctgaaagttcagttcaactatgttaaaacatagtaggggcctggcagggtggctcttgcctgtaatcccagaacttagggaggccaaggtgggcagatcaygaggtcaggagatcgagaccatcctggctaacattgtgaaaccgtatcgctactaaaaatacaaaaaattagccgggcatggcggtgggcacctgtagtc

SEQ ID NO: 31694 - DNA, 201 bp, Homo sapiens
cgtttgaacccagaggtggaggttgcagtgagccgagattgtgccactgcactctatcctgggtgacagagcgagatactgtctcaaaaagaaaaaaaaaaggctgggcgcggtagttcatgcctgcaatcccagcactttgggaggccgaggcaggcagattacgaagtcaggagatggagaccatcctggctaatacag

SEQ ID NO: 31695 - DNA, 201 bp, Homo sapiens
aagtagctgggattacaggtgcctgccaccacgcctggctaatttttgtatttttagtagagatggggtttcaccgtgttgtccaggctcgtgtcaaactyctgacctcaagccatccacccgcctcggcctcccaaagtgctgggattacaggtgtgagccaccactcctggccatgataggttattttgtgatgaaaat

SEQ ID NO: 31696 - DNA, 201 bp, Homo sapiens
gcaggcagatcacctgaagtcaggagttcgagaccagcctggccaacatggggaaaccctgtctctactaaaaatacaaaaattagccaggtgtggtggcrcgcacctataatcctagctacttgggaggctgaggcaggggaatcgcttgaacctgggaggcgacggttgcagtgagccaaggtcgcgccactgcactcc

SEQ ID NO: 31697 - DNA, 201 bp, Homo sapiens
gtggataccatttagaaaaggatgggccattcttcctatagggatctgactggtgaattataactgtgctgttaactttggaaatgggaatgcacaagatrttgttttaaatatgcacgctaatgacagtttgtatccttctttccccacccccacccttgcttcaactacctgtcaaaattaacagcagccttctggaaa

SEQ ID NO: 31698 - DNA, 201 bp, Homo sapiens
tcccgggttcaagcaattctcctgcctcagcctccagagtagctgggattacaggcgcccaccaccacacccggcagatttttgtatttttggtagagacrcggtttcatcatgtttggccaggctggtctcgaactcctgacctcaggtgatccgcctgccttggcctcccaaagtgttgggattacaggcatgagccac

SEQ ID NO: 31699 - DNA, 201 bp, Homo sapiens
atcttcacctgtgctttgagcctatttaaatagatgaatggtcccctacctctaaccaaaaccagtccctcacttgtgggctggatcccagctcttctcayctactcaagatgttcctgctttcatctctccactctcttatataatcagttccccccccctttttttgtaatattcctataagcagtaaaataagctttt

SEQ ID NO: 31700 - DNA, 201 bp, Homo sapiens
ggggttacaggcgtgagccaccatgccgagccctaagttggttctttcttaaagttcttcctgaggagccaagagcaagttaaggagatgtaacctagaarcttacagtggaggctagctgggtgcagtggttcacgcctgtaatcccagcactttaggaggctgaggcagggagatcactgaggccaggagcttgagagc

SEQ ID NO: 31701 - DNA, 201 bp, Homo sapiens
cttcttttgagacggattcttgctctatcgcccaggctggattgcagtggcgggatcttggctccctgcaacctccgccacctgggttcaagcaattctcytgtctcagcctcccaaatagctgtgtctacagccacgcaccaccacacccagctaatttttgtatttttagtagagacggggtttcgccatgttggtcag

SEQ ID NO: 31702 - DNA, 201 bp, Homo sapiens
ctccactgcactccagcctggacaacagagcaagactctgtctcaaaaaaaaaaaaaattaatgattaaattatttaggggagccgggcgcagtggctcaygcctgtaatcccagcactttgggaggccaaggcgggcggatcacgaggtcaggagatcaagaccatcctggctaacacaggatgaaaccccgtctctact

SEQ ID NO: 31703 - DNA, 201 bp, Homo sapiens
gtcaggagatcgagaccatcctggctaacacggtgaaatcctgtctctactaaaaataacaaaaaattagccggggtgtggtggcggacgcctgtagtccsagctactcgggaggctgaggcaggagaatggcgtgaacccaggaggcggagcttgcagtgagctgagatcgcgccactgccctccagcctgggcgacaga

SEQ ID NO: 31704 - DNA, 201 bp, Homo sapiens
ttctttttttttttttttttttttgagtcagagtctcactgtcgcccagcctggagtgcagtgatcttggctcactgcaacccctgcctccgaggttcaarcgattctcctgcctcagcctcctgagtagctgggactacaggcgcctaccaccacgcccagctaattttttgtacttttagtagagatagggttttgccc

SEQ ID NO: 31705 - DNA, 201 bp, Homo sapiens
gctcaaggagttcaggaccagcctgggcaatggcacaagaccccatctctaaaaaaaaaatgaaagaaaaaaaaattggctaggcgtggtgatgcatggcygtagtcccaggtgctagggaggctgaggagggagcacagaggtcaagcctgcagtgaatcatgatcgtgctactgcactccagcttgggtgacagaagga

SEQ ID NO: 31706 - DNA, 201 bp, Homo sapiens
caccccactgcactccagcctgggtgacagagtgaaactccgcctcaaaaaaaaaaaaaagagaaaagaaatatagaaattaaagcatacatggccaggcrtagtggctcatgtctgtaatcccagcactttgggaggctgaggcaggcagatcacttgaggccatgagttcaagaccaacctggccaacatggcgaaagc

SEQ ID NO: 31707 - DNA, 201 bp, Homo sapiens
aacaaaatactacctgctgtatggtatcatttattaaaagtctagaaaagtgcagattcatctgtagtgatggaaagcagattgaccagcggttgcctggkgacgagaaggctatggaggagtgagaggggagggttacagagaggcacgggaaacatggcaatgaggaatgtgttcactatcttggttgtagtaatggtt

SEQ ID NO: 31708 - DNA, 201 bp, Homo sapiens
gggaggcgaggttgcggtgagccgagatcgtgccattgcactctagcctgggcaaaaagagtgaaactccatctcaaataaataaataaataaataaataataaaaaataacttaaatctacttaattagaaaaactaacattctaaaaattttattttaagaaatatcaaaattggctgggcacggtggctcacgcctct

SEQ ID NO: 31709 - DNA, 201 bp, Homo sapiens
cgggaggcgaggttgcggtgagccgagatcgtgccattgcactctagcctgggcaaaaagagtgaaactccatctcaaataaataaataaataaataaataataaaaaataacttaaatctacttaattagaaaaactaacattctaaaaattttattttaagaaatatcaaaattggctgggcacggtggctcacgcctc

SEQ ID NO: 31710 - DNA, 201 bp, Homo sapiens
tttcttaaagaagagaaatacattttgaatacttttgttttgatgttccctgtttcattcactcagactttcctatttcacctttgtgatgtccatgagcrtctgccctgtagccttcctggcaccccagtgtctgtggcagcacagagctgaccccataagtggtgcatgaggccatcttgtggcacagcatcactaagc

SEQ ID NO: 31711 - DNA, 201 bp, Homo sapiens
ccgggaggcgaggttgcggtgagccgagatcgtgccattgcactctagcctgggcaaaaagagtgaaactccatctcaaataaataaataaataaataaataataaaaaataacttaaatctacttaattagaaaaactaacattctaaaaattttattttaagaaatatcaaaattggctgggcacggtggctcacgcct

SEQ ID NO: 31712 - DNA, 201 bp, Homo sapiens
tcctcattgttatctagtattcttttgtgagtaaacacaatttccattctactgtgatcccagctatccatttgggtcgtttccagtttggggtccattasaaatagtaatgctatctgtaatgctattttgtattactacaaatagtaatgctatttgtggcacaaaaatactgcttttgtgaacattcttatacatgtc

SEQ ID NO: 31713 - DNA, 201 bp, Homo sapiens
cccgggaggcgaggttgcggtgagccgagatcgtgccattgcactctagcctgggcaaaaagagtgaaactccatctcaaataaataaataaataaataaataataaaaaataacttaaatctacttaattagaaaaactaacattctaaaaattttattttaagaaatatcaaaattggctgggcacggtggctcacgcc

SEQ ID NO: 31714 - DNA, 201 bp, Homo sapiens
cccgacctcaggtgatccgcccgcctcggcctcccaaagtgctgggattacaagcgtgaagcacctcgcccggcctagctatcatttttatacaagtgctrggttttgggagaatgtaatgatggcttttttcttactaaactttcagtgcaggaggaggagaaagaaagtaaatagttatatgaacacagtagaaagtca

SEQ ID NO: 31715 - DNA, 201 bp, Homo sapiens
cccaggaggtggaggttgcagtgagccaagctcatgccactgtactccagcctgggtgacagagcgagaccttgtctcaaaaaaaaaaaaaaaaaaaaaamcaagaaaaaaactctaaacccagagttacatatccagtgaaatatccttcaggagtgaagggaaaattaacgatttgtcttcaggagacctaccctaaaa

SEQ ID NO: 31716 - DNA, 201 bp, Homo sapiens
tatttttcataatttaaagctattttttatagagagaattttaatcaaatatttggatgtcactattgctatatatggtattaagtatggtgaccatagtytgtaaactccaaactgacagcaagacaggaaatttgtgttagcaaaggcttttttcttactgtttgaattttttaaaaattagatacaatacagagagga

SEQ ID NO: 31717 - DNA, 201 bp, Homo sapiens
gtaattttgtatttttagtggagacggggtttctccatgttggtcaggctgatctcaaactcccgacctcaggtgatccgcccgcctcggcctcccaaagkgctgggattacaagcgtgaagcacctcgcccggcctagctatcatttttatacaagtgctaggttttgggagaatgtaatgatggcttttttcttactaa

SEQ ID NO: 31718 - DNA, 201 bp, Homo sapiens
tccagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaa

SEQ ID NO: 31719 - DNA, 201 bp, Homo sapiens
ccgggcatggtggtgggtgcctgtaatcccagctacttgggaggctcagacaggagaatcgcttgaatctgggaggcagaagttgcagtgagctgagatarcgccattgcactccagcctgggggacaagagcgagacttcgtctcaaaaaaaaagagaaagaaaacttcatgttaaagattacaagataaataatcagac

SEQ ID NO: 31720 - DNA, 201 bp, Homo sapiens
ggtaattttgtatttttagtggagacggggtttctccatgttggtcaggctgatctcaaactcccgacctcaggtgatccgcccgcctcggcctcccaaartgctgggattacaagcgtgaagcacctcgcccggcctagctatcatttttatacaagtgctaggttttgggagaatgtaatgatggcttttttcttacta

SEQ ID NO: 31721 - DNA, 201 bp, Homo sapiens
accagcctgaccaacatggtgaaacctcatctctactaaaaatacaaaaattagccgggcatggtggtgggtgcctgtaatcccagctacttgggaggctsagacaggagaatcgcttgaatctgggaggcagaagttgcagtgagctgagataacgccattgcactccagcctgggggacaagagcgagacttcgtctca

SEQ ID NO: 31722 - DNA, 201 bp, Homo sapiens
cctcctgggaggcagaggttgcagtgagctaatattgcaccactgcactccagcctgggtgacagagtgagactccatctcaaattaaaaaaaaaaaaaaattaatgatagagaaacttaaatcagttagattgttttaggtatagcccatccttggtttttgtgtgtagcatctagcttggggaaaccctggatttctgg

SEQ ID NO: 31723 - DNA, 201 bp, Homo sapiens
aggggagctgcttctttctttcttctcccttccttcttgcttattaaactctccgctccttaaaaccactccacgtttgtccatgtcgttttatgtaattygactcaagacgaaaaaggctagtattcctccactcggtatcatcaccacattctgttgagtctctttacgtccaaagaatctctcaaaatgggctatttc

SEQ ID NO: 31724 - DNA, 201 bp, Homo sapiens
tggctaattttgtattttagtagagatggaaggggtttctccatgtttgttaggctggtctccaactcctgacctcaggtgagccgcccacctcggccccctaaagtgctgggattacaggcatgagccactgcgcctggccccggctaaattttttttttttttttttgtatttttagtagagacagggtttcaccatat

SEQ ID NO: 31725 - DNA, 201 bp, Homo sapiens
gcattttgttttttctacaagcggcaagcccatgaccctagaagtctgacatctatggaaccttcagtttaaatgcccagggagaacttattttggtagayatgatttctgacattgcaggtagcaagttgaatataatttttctaaagtagcacccacagcagccaaattatcagatgtatatagtagactagttttaag

SEQ ID NO: 31726 - DNA, 201 bp, Homo sapiens
tttgttttttaatttgaagaaaatctttgctattattattttttccaagtggtctggcattttaagaattagtgctaataacgtaacttctaaatttgtcrtaattggcatgtttaatagcatatcaaaaaacattttaagcctgtggattcatagacaaagcaatgagaaacattagtaaaatataaatggatattcctg

SEQ ID NO: 31727 - DNA, 201 bp, Homo sapiens
aattagctgggcgcggtggcaggtgcctgtaatcccagctacctgggagtctgaggcaggagaattgcttgaaccctggcgacagaggatgcagtgagccragatggtgccactgtactccagactgggcgacagagtgagactctgtctcaaaaaaaaaaaaaaaatcatgctagtgccaagagctactaaattcttaaa

SEQ ID NO: 31728 - DNA, 201 bp, Homo sapiens
ctgtactaaaaactacaaaaattagctgggcgcggtggcaggtgcctgtaatcccagctacctgggagtctgaggcaggagaattgcttgaaccctggcgrcagaggatgcagtgagccaagatggtgccactgtactccagactgggcgacagagtgagactctgtctcaaaaaaaaaaaaaaaatcatgctagtgccaa

SEQ ID NO: 31729 - DNA, 201 bp, Homo sapiens
ttttgtatttttggtagagacgcggtttcatcatgtttggccaggctggtctcgaactcctgacctcaggtgatccgcctgccttggcctcccaaagtgtkgggattacaggcatgagccactgcgcctggccagctagagagtttttaaagcagagctgagcacacactggatgcgtttgaatgtgtttgtgtagtttgt

SEQ ID NO: 31730 - DNA, 201 bp, Homo sapiens
tgctgagtgcaaaaaagcctcaaagggtcttacactgtatgattccacttgttcaactaaaaatgacagctgtatagagatagagaacatattagtggttkccactagttagagaaagtgggtaaaagataggtgggtgggaatataaatcgatagcagggagatctttgtggtattataacacttctatgtcttgattgt

SEQ ID NO: 31731 - DNA, 201 bp, Homo sapiens
cactttttacaacctatattttattaggagtagttatatttttactcctggttattttatttggtttcaacactgtactaacacaatagtaaattgtggtkttaatctttgtgggtatcagttgacccttatccaaatcagctgttacataaatatgtgccattagacactatggaagggcctggacagggaatataaact

SEQ ID NO: 31732 - DNA, 201 bp, Homo sapiens
gtgcccagccaaaaatagaaatttatattctcacaaaaacatgtacatgaatgtttatagcagctttacttgtcataatcaaaaactggaaacaaccaaartgtcctacagtgaaacaaactgtagtacatccatagcatgtaatactctactgtcaggattaaaaagaaacccactgttggcacaggcagcaccgtggct

SEQ ID NO: 31733 - DNA, 201 bp, Homo sapiens
aataaaatggtctaaagacatacatcatagagaaactataatacaaaatttacaggtatatctaagaaaagaaaagtatatttaaagcataaaaataaacygctcttttacttaaaattttttaaaaactggattaaaaatatgaaacttccaacaaattgagcttttttttttttttttttcttttttgagacgaggtct

SEQ ID NO: 31734 - DNA, 201 bp, Homo sapiens
gctgagctggcagctgattagatggtgaccacccagtttgagggtgggtctacctctcccagttcactggcttaaatgttaatctcctttggcaacacccycgcagacacacccagaaacaataatttgtagccttcaatccaatcaagttgataatattaaccatcacaggaaggtactagtatcatatgtttaacagta

SEQ ID NO: 31735 - DNA, 201 bp, Homo sapiens
gcagtaatccccatgaccgccactccttgacatcacaggccttgaagaaacctggactttcactcccctctggttgtagcgaggtggcactcccttttccytgttgccagtgctgtgtcagtggaggcttgctaaattggaagatgtaaataagattcacattctcataacataataccccaaattttcaggatttaattg

SEQ ID NO: 31736 - DNA, 201 bp, Homo sapiens
cacgaggtcgggagttcgagaccagcttggccaaaatggtgaaaccccatctgtactaaaaactacaaaaattagctgggcgcggtggcaggtgcctgtartcccagctacctgggagtctgaggcaggagaattgcttgaaccctggcgacagaggatgcagtgagccaagatggtgccactgtactccagactgggcga

SEQ ID NO: 31737 - DNA, 201 bp, Homo sapiens
ctccatagcaacaaaatttagtgggctcttatacgaccttatattgcttgacttcttggcagcaactgacactgactaccccttgaagcatcccctgcccmggccttccacaatgtcacactctcttgcttctcctccctcctccttggttattgcttctcctatcctcacggctcagctctagccctcttctcaatcact

SEQ ID NO: 31738 - DNA, 201 bp, Homo sapiens
gttggctaccttggagggcagatagtgaattttcagaaatttccctttttttgtcagacagattgaaataaacaggtttgcattttgttttttctacaagyggcaagcccatgaccctagaagtctgacatctatggaaccttcagtttaaatgcccagggagaacttattttggtagatatgatttctgacattgcaggt

SEQ ID NO: 31739 - DNA, 201 bp, Homo sapiens
ttcctgcactttgggaggccgaggcaggccgatcacgaggtcaggagatcgagaccatcctggctaacatggtgaaaccctgtctctactaaaaatacaaraaaattagccgggcatggtggagggcgcctgtagtcccagctacttgggaggctgaggcaggagaatggcgtgaaccctggatgcggaggttgcagtgag

SEQ ID NO: 31740 - DNA, 201 bp, Homo sapiens
ctgcctcctgggttcaagcgattctcctgcctcaacctcccgagtagctgggattacaggcgtgcaccaccatgaccggctaattttttttttttttttttgagatggagtttccctcttgttgctccggctggagtgcaatggcgtgatctcggctcaccgtaacttctgcctcctgggttcaagcgattttcttgcctc

SEQ ID NO: 31741 - DNA, 201 bp, Homo sapiens
tagctgggactacaggcttgtgctaccacacctagctaaggttttactttaaatttattataatcacaaaattcagatgagcctttagtgctgtctgatayttctactatgttttcttagtgatgtaccaccctccaaggtgtttataaaaaattatgtaccactctccaagatgtttataaaaaataatgtgccaccctc

SEQ ID NO: 31742 - DNA, 201 bp, Homo sapiens
tggcaaatgtgctgtctctaactaaaaatacaaaaattagctgggtgtggtggtgcagacctgtagtcccagctacttgggaggctgaggcaggagaatcrcttgaacctgggaggcagaggttgcagtgatccgagatcatgccactgcactccagcctgggttacagagtgagactcttctcaaaaaaaaaaaaaagta

SEQ ID NO: 31743 - DNA, 201 bp, Homo sapiens
ccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgcct

SEQ ID NO: 31744 - DNA, 201 bp, Homo sapiens
accagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgcc

SEQ ID NO: 31745 - DNA, 201 bp, Homo sapiens
taccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgc

SEQ ID NO: 31746 - DNA, 201 bp, Homo sapiens
gaggctgaggcaggagaatggcgtgaacccaggaggcggagcttgcagtgagctgagatcgcgccactgccctccagcctgggcgacagagcgagactccrtctcaaaaaaaaaaagaaaagaaaaaaaaaagaaatacatgcccctagattaaactatcccttgtccttttgcactcatccacaagtctcttttcatcag

SEQ ID NO: 31747 - DNA, 201 bp, Homo sapiens
agatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaa

SEQ ID NO: 31748 - DNA, 201 bp, Homo sapiens
tagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagcta

SEQ ID NO: 31749 - DNA, 201 bp, Homo sapiens
ctagatgaccatctcttttaaaaaaatgtgtttatatgttatatgtgatagtgctttttaaaaacatttttaaattatagagacagggtctcactatgttrcagcccaggctggtctcaaattcctgggctcaagcaatcctcccaccttagctaacctcccaaagtgctcggattataggcatgagctgcatgcccagct

SEQ ID NO: 31750 - DNA, 201 bp, Homo sapiens
tttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttattt

SEQ ID NO: 31751 - DNA, 201 bp, Homo sapiens
acaacactgggctattaggaataactttttaaaaattactgttctgtataaatatttgaaattcaagtacagaaaatatctgaaacaaaaagcattgttgyttggccatgatacaagtgcactgtggcagtgccgcttgctcaggacccagccctgcagcccttctgtgtgtgctccctcgttaagttcatttgctgttat

SEQ ID NO: 31752 - DNA, 201 bp, Homo sapiens
aactaccagtagtccatattgtttaatattaagttgaataaaataaattttatttcagtcagagcctaaatcacattttgattgtctgaatttttgatacyatttttaaaatcatgctagtggcggctgggcgtggtagctcacgcctgtaatcccagcattttgggaggccgaagtgggtggatcacgaggtcgggagtt

SEQ ID NO: 31753 - DNA, 201 bp, Homo sapiens
tttttgcctcatttatcctggacttggtgctggagaagctatgggttcagaccaagagaaaaccccatgaaaagcctgctctctctagccaaaagaggcarcctagcaagataaaaacctttagataataagcacttgactccagtcaaacaaaacagaataaactggccccattcacccctgtcagcaaaggccaagtgg

SEQ ID NO: 31754 - DNA, 201 bp, Homo sapiens
ttgcagtaagctgagattgcaccattgcactccagcctgggcaacaagagcaaaactctgtctcaaaaagaaaaaaaaaaccattcagctgaatctcaaargcagagagaagacagactggctagggaccttggaaccagaggagcagtgtggtggggagtggactggattttctttttgcctcatttatcctggacttgg

SEQ ID NO: 31755 - DNA, 201 bp, Homo sapiens
tacaagattagtcgggcatggtggcgcatgcctgtaatcccagcttcttgggaggctgaggcaggagaattgcttgatcccgggaagcgaaggttgcagtragctgagattgcaccattgcactccagcctgggcaacaagagcaaaactctgtctcaaaaagaaaaaaaaaaccattcagctgaatctcaaaggcagaga

SEQ ID NO: 31756 - DNA, 201 bp, Homo sapiens
aagagcttgagaatatcttacatagtcacatgttgctgagaagagttaagaactaacttcttgatgttcatttttaacaatggcttgcattcaaaaccttrtagagctcattagtaggagctaagaagctaatatttgcctttcactaaaattcctgattacttagcctaggtagttcgttgtctctctaggttctgtctt

SEQ ID NO: 31757 - DNA, 201 bp, Homo sapiens
ttgggaggccgaggtgggcagatcacctgaggtcaggagttcgagaccagcccagccaacatggtgaaaccctgcctctcctaaaaatacaaacattaacygggtgtggtggtgggtgcctgtaatcccagctactcaggaggctgaggcaggagaatcgcttgaacctcctgggaggcagaggttgcagtgagctaatat

SEQ ID NO: 31758 - DNA, 201 bp, Homo sapiens
caccaaagtttaagaaaaatgtgctaggcgcggtggctcacacctgtaatcccagcactttgggaggccgaggtgggcagatcacctgaggtcaggagttmgagaccagcccagccaacatggtgaaaccctgcctctcctaaaaatacaaacattaactgggtgtggtggtgggtgcctgtaatcccagctactcaggag

SEQ ID NO: 31759 - DNA, 201 bp, Homo sapiens
attaggagtggactgggatgattttgttgtagtctgcctagcctgctgtccctttaactcttccgtgaccatgcacttgaagatactgtttgtgatatgtraagaaactcctcgtttctctcatactattatccagccatttgtgtgtgagtgaagccttccccaggacagctttggcacatggtatcatgtttcataata

SEQ ID NO: 31760 - DNA, 201 bp, Homo sapiens
tggcatatttattatacaatacagaaacaattttactggcagaaaacacattaaaccgtctaaactctgaatacagttgtcctcataaaaaatgttcaacrtactattttgaggttttccattaatagttcttataatctttgtcccattatgtgttaatccaacaaaggatatccaataacaaacaccaaagtttaagaa

SEQ ID NO: 31761 - DNA, 201 bp, Homo sapiens
atactgtttgtgatatgtaaagaaactcctcgtttctctcatactattatccagccatttgtgtgtgagtgaagccttccccaggacagctttggcacatrgtatcatgtttcataatagtttcgtgtttggaaagagttgctggtaaggctgttatttaataggaggagcaaagggtttttgttttattaaatacttata

SEQ ID NO: 31762 - DNA, 201 bp, Homo sapiens
gaacccgggaggcagaggttacagcgagccaagatcataccactgcactccagcctgggtgacagaacgagactctcaaaaaaaaattaaaaaaaaaaaawatgtgaagtcttgaataaaacccaagatctttaccatggcccctgaacagggcagagtatccattcttcagacactcttcatagaataccatggtgagct

SEQ ID NO: 31763 - DNA, 201 bp, Homo sapiens
atcacaaggtgaagtcccacaataggctctctgcaggctgaggaaccaggaagccagtccaagtcccaaaacctcaaaagtagggaagctgacagtgcagmcttcagtctgtggcaaaaggcctgagagcccctggcaaaccactggtgtaagttcaagagtccaaaagatgaagaacttggagtctgatgtttgagggca

SEQ ID NO: 31764 - DNA, 201 bp, Homo sapiens
ccatctatcaaagtgactaggcctatttctgaagcccaggctggagtgcagcagcataatcacagctcattgcagctccaaactcctgggctcaagtgatyctcttgccttagcctgttgagtagctgggactacaggcttgtgctaccacacctagctaaggttttactttaaatttattataatcacaaaattcagatg

SEQ ID NO: 31765 - DNA, 201 bp, Homo sapiens
acagcagccctgtgagtaagtgtattagggttctctagagggacagaactaataaggtagatgtatatatgaagggtaatgtattaaggagtatcgactcrtatgatcacaaggtgaagtcccacaataggctctctgcaggctgaggaaccaggaagccagtccaagtcccaaaacctcaaaagtagggaagctgacagt

SEQ ID NO: 31766 - DNA, 201 bp, Homo sapiens
tttgacaccttaaatagcttttaggtatttggcttcccagcccctatttttagttacaaggggtgtacatgtgtgggtcagggtgggggtagctctttccrcagatgattagttttagccatgttactagttattgcacacattatctgtgtcctcacagcagccctgtgagtaagtgtattagggttctctagagggaca

SEQ ID NO: 31767 - DNA, 201 bp, Homo sapiens
aggctgaggagggagcacagaggtcaagcctgcagtgaatcatgatcgtgctactgcactccagcttgggtgacagaaggagatcctgtctcaaaaaaaaagtttcaaattatacactttaaatatgtgcagtttattatatgtcacttataccccaataaatctgttttttttaaaatgtaaatacaagccaaaaaaggt

SEQ ID NO: 31768 - DNA, 201 bp, Homo sapiens
gaggccaaggcaggaggattgcttgagctcaaggagttcaggaccagcctgggcaatggcacaagaccccatctctaaaaaaaaaatgaaagaaaaaaaaattggctaggcgtggtgatgcatggccgtagtcccaggtgctagggaggctgaggagggagcacagaggtcaagcctgcagtgaatcatgatcgtgctact

SEQ ID NO: 31769 - DNA, 201 bp, Homo sapiens
gggagcctcaggaggagaatcgcttgaacctgggaggcggaggttgcagcgagccgagatcgtgccactatactccagcctgggcgacagagcaagactcygtcacaaaaaaaaaaaaaaaaacctatagccttctagagaaatttatatatgaagtacacaactaacatagctacacttcctaaatttggaatggagtgg

SEQ ID NO: 31770 - DNA, 201 bp, Homo sapiens
ggatttttgaggcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggccca

SEQ ID NO: 31771 - DNA, 201 bp, Homo sapiens
gtaaatttgagaaaatgcaataccttgctaccatccttttaaatcagcctaccagactggatttccttattatggtttgtggcttttgattttttttttttaatgtatagctctctttgaattctttggtggttatatatatatgtactcgcaagattcttttatctgtgggtctttcattctttttctaacactgtgagt

SEQ ID NO: 31772 - DNA, 201 bp, Homo sapiens
gcatgaacccgggtggcggagcttgcagtgagccaagatagcgccactgcactccggcctgggtgaaagagtgagactccgtctcaaaaaaaaaaaaaaaattatttaggggaagatactatacaattctgtttaacaagtcacattttaattttttcttttggaaatattagcaagaaggctcactttgtgctcaacatt

SEQ ID NO: 31773 - DNA, 201 bp, Homo sapiens
tttttttttttgagacgaaatctcactctgtcacccaggctggagtgtagtggcatgatctcggctcactgcaacctccgcctcctgagtttaagcgattmttctgcctcagcctcccaagtagctgcggttacaggcaagtgcctccatgcctggctaatttttgtgtcttttgtagacatggggtttcaccatgttgcc

SEQ ID NO: 31774 - DNA, 201 bp, Homo sapiens
tcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggc

SEQ ID NO: 31775 - DNA, 201 bp, Homo sapiens; identical to SEQ ID NO: 6080

SEQ ID NO: 31776 - DNA, 201 bp, Homo sapiens
gcagtgagccgagatcgcgccactgcactccagcctgggcgacagagcaatactctgtctaaaaaaaaaaaaaaaaaaaaaaaaagagtatttagcagagrccaggtgcagtggctcatgtttgtaatcccagaactttgggaggctgaggcgggcggatcatttgaggtcaggagtttgagaccagcctggccaatgtgg

SEQ ID NO: 31777 - DNA, 201 bp, Homo sapiens
ttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccagg

SEQ ID NO: 31778 - DNA, 201 bp, Homo sapiens; identical to SEQ ID NO: 6082

SEQ ID NO: 31779 - DNA, 201 bp, Homo sapiens
tttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccag

SEQ ID NO: 31780 - DNA, 201 bp, Homo sapiens
tgtaaatggttactgcctgaatcctgtgaatatttgaatgtattttttaaaaatttacagcaaataggacgggcacggtggcttacgcctgtgatgctagmagtttgggaggccaaggcgggcagattgcctgaggtcaggagttcgagaccagcctgggcaacacagtgaaaccccatctctactaaaaatacaaaagaa

SEQ ID NO: 31781 - DNA, 201 bp, Homo sapiens; identical to SEQ ID NO: 6087

SEQ ID NO: 31782 - DNA, 201 bp, Homo sapiens
tttaatatttgctttggctattttgtctatttgtaaatggttactgcctgaatcctgtgaatatttgaatgtattttttaaaaatttacagcaaataggaygggcacggtggcttacgcctgtgatgctagcagtttgggaggccaaggcgggcagattgcctgaggtcaggagttcgagaccagcctgggcaacacagtg

SEQ ID NO: 31783 - DNA, 201 bp, Homo sapiens
ggatttgctaatgggaggatactgcccttacgtgcatcattagccatgcacactaaggtcttacacctacacacaggtcagtattctggctcagagaccarcagggagaaattgcagttctcattagttgaactttctttattgttcacagttttaaaacacaaaattgagaggaactctataaaaaatgtgccattctat

SEQ ID NO: 31784 - DNA, 201 bp, Homo sapiens
gtttgacaccttaaatagcttttaggtatttggcttcccagcccctatttttagttacaaggggtgtacatgtgtgggtcagggtgggggtagctctttcygcagatgattagttttagccatgttactagttattgcacacattatctgtgtcctcacagcagccctgtgagtaagtgtattagggttctctagagggac

SEQ ID NO: 31785 - DNA, 201 bp, Homo sapiens
cctcttgtgctatgttgcagcatcaggatttgctaatgggaggatactgcccttacgtgcatcattagccatgcacactaaggtcttacacctacacacargtcagtattctggctcagagaccaacagggagaaattgcagttctcattagttgaactttctttattgttcacagttttaaaacacaaaattgagaggaa

SEQ ID NO: 31786 - DNA, 201 bp, Homo sapiens
tttataaccagcatctttttgctttaaaaaatgacctggctttgtatttttttagtcttaaacataataaaaatatttttgttctaatttgctttcatgartgaagattattgacatcgttggtaaattctagaattttgattttgttttttaatttgaagaaaatctttgctattattattttttccaagtggtctggca

SEQ ID NO: 31787 - DNA, 201 bp, Homo sapiens
tacaacatagtgtaagaccccttctccacacaaaaaaattagaaaatttgtcaagcatcttggtgcacacctgtagtcccagctgcttgggaggatgaagygagagaatcacttaagcccaggtgttcgaggctgcagtgagctatgattgcaccactgcactccagactagatgaccatctcttttaaaaaaatgtgttt

SEQ ID NO: 31788 - DNA, 201 bp, Homo sapiens
gggaggctgaggtgggaggatgtcttgaatccaggagtttgagaccagcctgtacaacatagtgtaagaccccttctccacacaaaaaaattagaaaattygtcaagcatcttggtgcacacctgtagtcccagctgcttgggaggatgaagcgagagaatcacttaagcccaggtgttcgaggctgcagtgagctatgat

SEQ ID NO: 31789 - DNA, 201 bp, Homo sapiens
caaaagaaaatcttgtgagatttgcatttttggaagatcactgacagcaccatgaattagacatattgagactggaatcagaagaccaattcaaagatccytggactagagtacacaagataccaagagggcttgaactaagtagtagcaatgaagacaagggcaagagagagttaggagtggatttatagcatttgagga

SEQ ID NO: 31790 - DNA, 201 bp, Homo sapiens
tacaggtactgattttaaactcactaagtcacatttcttttttttttttttttttgagacggagtctcgccctgttgcccatgctggagtgcaatggcgcratctcggctcactgcaacctctgcctcccgggttcaagcgattctcctgcctcagcctcccaagtagctgggattacaggcacacggcactatgcccggc

SEQ ID NO: 31791 - DNA, 201 bp, Homo sapiens
gcccctagattaaactatcccttgtccttttgcactcatccacaagtctcttttcatcagtgattttaggatctgactcgttgtctttttctctacttcarctacttttatcattcttaattatttctgtatcgtcaatcaatccagtacctgcctcttagtttcaaaatcacttactcttgcttagctattaccagtaat

SEQ ID NO: 31792 - DNA, 201 bp, Homo sapiens
ttggcctcccaaagtgctggaattacagccatgagccaccatgcccagccaaatcatgagatttcaataccgctgaactttgattatggcaaagtgaactyctgctttgattaaagcttgatgagagaggtggctggggatagtttgagataagggcaaggcaggaaaatgcataatcttacgtgggctcattgtcattgt

SEQ ID NO: 31793 - DNA, 201 bp, Homo sapiens
gaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcac

SEQ ID NO: 31794 - DNA, 201 bp, Homo sapiens
cttgaaggacacagccccaaagatactggcaggtgaggtagtgtccctaagatcaacaggcatcatcatgaatcctatttcagaatgccacaaagaatacrttttagagaagattctaagagaaaaagctaaggtgattttttttttcagtcgttttttgttctcagacagtgtctcactctgtcgcccaggccagagtgc

SEQ ID NO: 31795 - DNA, 201 bp, Homo sapiens
gtccacagcatggaggggagggcacaggatggggaagtcacagccccgcagcctggcctgcagctggggtcaggccaggggcaggggatgaaccagggtcyccactccagcatcactcactttgtgaccattccggtttggttctcccgagaggtaaagaacaaagacttcaaagacactttcttcactggtcagctcctc

SEQ ID NO: 31796 - DNA, 201 bp, Homo sapiens
aatttctttcataattctctctacccaaaggcatcggtcagtccctctccagaccagaagcagttagttctgacaccaacaagtggtgataagaggttgayagcctagcaagggggaagaagccaccaccaaaccaaacacaaaaaatgacactgcacagcagtctggggacatgtccttgaaggacacagccccaaagat

SEQ ID NO: 31797 - DNA, 201 bp, Homo sapiens
cacgtgaggaaagtgggttcagggaagttgagcacgttggctactctgacagtaaacagtagagctggtccttaaactcaggtctttctgctccagggccygtgggccttagatcagaacataatgttaactccagcagccctgggagaaaggtgtcaactcaggatagtaacagcagctgcctttcagggagtgcttcct

SEQ ID NO: 31798 - DNA, 201 bp, Homo sapiens
gtgctatgaatgagcaaatgaatagacctcagctgtgaaatttccgagagggacagtgactctgcagagtgcctcaccaccccccataccctcccatcccstagcaaattctggtgatgagacccccacagggcacacccaggagtcaggtggcagagcagaacctgggggcttggactctgtagtcttgagtttgaatcc

SEQ ID NO: 31799 - DNA, 201 bp, Homo sapiens
gccactgccctcacctggggtcctcagtccacatccccaggcgcttcagcacctctgtggtagccatctcgcggttgagggtgtagaagtggaggcctggyaccaagccactggccagaagctcctggcacaggctcacggccagctcgatgccatagttgcggatggcagcatcgttgtctttgattggctcaatcacgt

SEQ ID NO: 31800 - DNA, 201 bp, Homo sapiens
tcctcccaggtcaaccacaagcatgcaaacttcttctgccctcccgctcccaagaacaaagatatatttgcaaggaaggtctgcaggccctcaccagcggycgttagggaactcgtcccactcctgggtacggtagatgtaactctttggtctggaggcccagaagatgggacgtacatcttcctctcggcgcttggggtg

SEQ ID NO: 31801 - DNA, 201 bp, Homo sapiens
gctggggtcaggccaggggcaggggatgaaccagggtccccactccagcatcactcactttgtgaccattccggtttggttctcccgagaggtaaagaacraagacttcaaagacactttcttcactggtcagctcctccccccacatcttcagcagctcctccttgggggacttgctcttcaggtagaagaggtagtagt

SEQ ID NO: 31802 - DNA, 201 bp, Homo sapiens
caggggatgaaccagggtccccactccagcatcactcactttgtgaccattccggtttggttctcccgagaggtaaagaacaaagacttcaaagacacttkcttcactggtcagctcctccccccacatcttcagcagctcctccttgggggacttgctcttcaggtagaagaggtagtagtccttcagctccccaaaggc

SEQ ID NO: 31803 - DNA, 201 bp, Homo sapiens
tccccactccagcatcactcactttgtgaccattccggtttggttctcccgagaggtaaagaacaaagacttcaaagacactttcttcactggtcagctcmtccccccacatcttcagcagctcctccttgggggacttgctcttcaggtagaagaggtagtagtccttcagctccccaaaggcaggggaagaggaattgc

SEQ ID NO: 31804 - DNA, 201 bp, Homo sapiens
agccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctgg

SEQ ID NO: 31805 - DNA, 201 bp, Homo sapiens
gccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctggc

SEQ ID NO: 31806 - DNA, 201 bp, Homo sapiens
ccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctggct

SEQ ID NO: 31807 - DNA, 201 bp, Homo sapiens
gatgggaaagatcccggggacgatggggcaagtgatgcccatgtcggtgcatgccttcacaaagcggaagaatgtgtcagcctcaaagaaaagctgcgtgrtgatgaaatcggctcccgcagacaccttctccttcaagtgcttcaggtcagcctcaaagctccctgcttcggggtggcctttggggtaacctgccaatag

SEQ ID NO: 31808 - DNA, 201 bp, Homo sapiens
agccaccaagcccagccaatcttttttttttttttttgagacagggtctcactttgtgggccaggctggagtgcagaggcacaaatatggcttactggagsctcaacctctcggactcaagcgatcctctcaccccagccccctaagtacctgggactacaggtgtacaccaccatgcctcggtcatttttgtattttttg

SEQ ID NO: 31809 - DNA, 201 bp, Homo sapiens
tgcccaggaggccattcctgtaaattctgcccctgactcctcccaggtcaaccacaagcatgcaaacttcttctgccctcccgctcccaagaacaaagatrtatttgcaaggaaggtctgcaggccctcaccagcggccgttagggaactcgtcccactcctgggtacggtagatgtaactctttggtctggaggcccaga

SEQ ID NO: 31810 - DNA, 201 bp, Homo sapiens
tagggaactcgtcccactcctgggtacggtagatgtaactctttggtctggaggcccagaagatgggacgtacatcttcctctcggcgcttggggtgggcrctgagagcccagggtaggggacgcctgggtgaggatggggacagagaattgagacaagggattggctagagggagccggaagcaggggagcacccctgag

SEQ ID NO: 31811 - DNA, 201 bp, Homo sapiens
agatgtaactctttggtctggaggcccagaagatgggacgtacatcttcctctcggcgcttggggtgggcgctgagagcccagggtaggggacgcctgggygaggatggggacagagaattgagacaagggattggctagagggagccggaagcaggggagcacccctgaggctgagttcttccatctgatgccctctgag

SEQ ID NO: 31812 - DNA, 201 bp, Homo sapiens
cctgggccaagaacaactggagtcccactgcctggacagccttgactcaatgaggctgtctgggctcaataccctctgcctgcgcctccactcccggcctmcactctccctgcgcctccactcccctctccctgtgcctccgctcctggcctcctctgcctgcatctgtgaatgatatctctccccacacaagcctgaacc

SEQ ID NO: 31813 - DNA, 201 bp, Homo sapiens
cagagaattgagacaagggattggctagagggagccggaagcaggggagcacccctgaggctgagttcttccatctgatgccctctgagactggagccttygatgtgcccagctagccatggcacagacatccatctgtaccaccgtggggagccagcactgcagccggggctgctcttggaccctcctctggggatctct

SEQ ID NO: 31814 - DNA, 201 bp, Homo sapiens
cccggggacgatggggcaagtgatgcccatgtcggtgcatgccttcacaaagcggaagaatgtgtcagcctcaaagaaaagctgcgtgatgatgaaatcgrctcccgcagacaccttctccttcaagtgcttcaggtcagcctcaaagctccctgcttcggggtggcctttggggtaacctgccaatagggatgacagtca

SEQ ID NO: 31815 - DNA, 201 bp, Homo sapiens
tgggaagtcattgtccaccaggttgaccaggaagtagttgtcgtggatgtactggatgatggtgcgggacggggactcctcctcatacagctttccccacygctcaatccacagggcaaaggcctcgtcctacacacacatacccccgcacacacgcacacatgcacacacacacagaggcaagattaacagggctctcca

SEQ ID NO: 31816 - DNA, 201 bp, Homo sapiens
cgtcagcagtgacatgggtgagtcagagctgggtgtgccctgaaggctgggtccagtgtggccttcagcacacgcttgggacttggtcccaatccctcccsacggttttccaggtgggcggggcaagcttgcccccggctcctttaccttccagaacatgaagctgacgggatccactacggtgggctggatgatctctcg

SEQ ID NO: 31817 - DNA, 201 bp, Homo sapiens
atgtgtcagcctcaaagaaaagctgcgtgatgatgaaatcggctcccgcagacaccttctccttcaagtgcttcaggtcagcctcaaagctccctgcttcrgggtggcctttggggtaacctgccaatagggatgacagtcaggagaggctggcctccacctgttcaaggcgagggatgaagagaccacagggactgggca

SEQ ID NO: 31818 - DNA, 201 bp, Homo sapiens
cggttttccaggtgggcggggcaagcttgcccccggctcctttaccttccagaacatgaagctgacgggatccactacggtgggctggatgatctctcgcycagggaagatgccccaagtgacagcattcggctgcagttcaggggcattggtgatgttttcaccctgaggggatgtggggtgggggtaagacctgggcca

SEQ ID NO: 31819 - DNA, 201 bp, Homo sapiens
ctcctgttggccaactcctctttgtcctcagtgattcccacagatgaccctctgagaagccttccctggcctcccaggtgagatatccctcctctggaccygacagcatcctctcctgaacttgattttcccacttacactggctggtggtcacacattgatctgcctccctcactctaggctgggagctccttaagagca

SEQ ID NO: 31820 - DNA, 201 bp, Homo sapiens
tgtgtctgttggtaacatggtgtcatctaacccagctgttcccatgctgcactgatcatccgaatcacctgccaagctcaagaagtaaaacacacattccraggacctccctcagatttactgagtgagaacctccaggggtgggacctggagatccactttttgaaaaagcttatcaagtggttctgatgacagccacct

SEQ ID NO: 31821 - DNA, 201 bp, Homo sapiens
ctggatgggaaagatcccggggacgatggggcaagtgatgcccatgtcggtgcatgccttcacaaagcggaagaatgtgtcagcctcaaagaaaagctgcrtgatgatgaaatcggctcccgcagacaccttctccttcaagtgcttcaggtcagcctcaaagctccctgcttcggggtggcctttggggtaacctgccaa

SEQ ID NO: 31822 - DNA, 201 bp, Homo sapiens
gtgtcctgccagctagagcagcgaagaaatcccagcggggccccaggaagtccaagcccatggggttcaggtgctcctctctggctattccttcagacccrcagctgctggacacaggccacagagctggtgcctcccgcgccatcactgcagtgcagcctgggtggacggaggaagccaaggggaacggcctgggctcag

SEQ ID NO: 31823 - DNA, 201 bp, Homo sapiens
aaagtagaaaaataccaaaatttctttcataattctctctacccaaaggcatcggtcagtccctctccagaccagaagcagttagttctgacaccaacaartggtgataagaggttgatagcctagcaagggggaagaagccaccaccaaaccaaacacaaaaaatgacactgcacagcagtctggggacatgtccttgaa

SEQ ID NO: 31824 - DNA, 201 bp, Homo sapiens
cacagccatagctaacaaatgcagttgatcagagaggtccgctgagctgtgacactgacctagctgggttcaaagaaaacaggctgaccaactcttacacrttgtgctatgaatgagcaaatgaatagacctcagctgtgaaatttccgagagggacagtgactctgcagagtgcctcaccaccccccataccctcccatc

SEQ ID NO: 31825 - DNA, 201 bp, Homo sapiens
gctacttccaggcctggtgtgaggttgtaagagacacgggggtgctccgggcccagcatcaagcctttcaggatggcctgaggagaagagcactgggggcygtgtttgccacatggcgggaagcccaggaagtggcagccggggcacaggagcagcgtgtggcccaggcctcccttgcccgctggagaagctgcgggcagc

SEQ ID NO: 31826 - DNA, 201 bp, Homo sapiens
actctaagtaggcctgtgggagagacaggtgcctgtcaccaaccccagccctgccagacgccctttcgcagacacctaaggtatcaggactactggcagcmatgtgggcggaataatgaactgtggcgttggcacgtccataagcaaagggtgaggggagtggggacgtgagtttctcagtctggacaggtctgagggcta

SEQ ID NO: 31827 - DNA, 201 bp, Homo sapiens
ttggaccctcctctggggatctctgggccactgccctcacctggggtcctcagtccacatccccaggcgcttcagcacctctgtggtagccatctcgcggytgagggtgtagaagtggaggcctggcaccaagccactggccagaagctcctggcacaggctcacggccagctcgatgccatagttgcggatggcagcatc

SEQ ID NO: 31828 - DNA, 201 bp, Homo sapiens
gtattgaccattctccccatccattccctcttcggaatgtttcagctgttctgagaaaacactttgcattcctgccccgcccctgtgatttctctttgggyggcaggcagccgggagaggctggaggcctggggagatgggggcagggcacaaggctaagctcagcaccttcctccaccctcctcactgtactcaactcct

SEQ ID NO: 31829 - DNA, 201 bp, Homo sapiens
gacctcaggtgatccgcccgcctctgcctcccaaaatgctgggattacaggtgtgagccactgtgcctggccgtagatggttttttttcttggcttctcastgagtgagagatggtgttcctctccctcaccaaccacctgggcatgtgatgggaggcagggcatggctgatgtgggacttgaacccatactgctggttcc

SEQ ID NO: 31830 - DNA, 201 bp, Homo sapiens
ggtccagtgtggccttcagcacacgcttgggacttggtcccaatccctccccacggttttccaggtgggcggggcaagcttgcccccggctcctttacctwccagaacatgaagctgacgggatccactacggtgggctggatgatctctcgcccagggaagatgccccaagtgacagcattcggctgcagttcaggggca

SEQ ID NO: 31831 - DNA, 201 bp, Homo sapiens
tgtgccaccacacccggctaattttttttttttttttgtagaaatgggatctcactatgttgccagggcttgtctcaaactcctgggctcaagcgatctayctgccttggcctcccaaagcattgggcaggcccattacgccatgagccaccacacctgctggtttttgttttttaaatggaattgaaaggaactagcctt

SEQ ID NO: 31832 - DNA, 201 bp, Homo sapiens
ccctcccgctcccaagaacaaagatatatttgcaaggaaggtctgcaggccctcaccagcggccgttagggaactcgtcccactcctgggtacggtagatstaactctttggtctggaggcccagaagatgggacgtacatcttcctctcggcgcttggggtgggcgctgagagcccagggtaggggacgcctgggtgagg

SEQ ID NO: 31833 - DNA, 201 bp, Homo sapiens
gaccctcctctggggatctctgggccactgccctcacctggggtcctcagtccacatccccaggcgcttcagcacctctgtggtagccatctcgcggttgrgggtgtagaagtggaggcctggcaccaagccactggccagaagctcctggcacaggctcacggccagctcgatgccatagttgcggatggcagcatcgtt

SEQ ID NO: 31834 - DNA, 201 bp, Homo sapiens
cgccccagccccttggaaacaggtgaagggagcctaggcagggcgggaggtccaaaaatgaccctcggaccaccggccttagaatcagcttgattcagccsgtggtggcagcatggctggatgcctccccaggggcccagcaacctcgtatgcaccacctctccccagttctcagtcagcctctgacaagcaactctgaat

SEQ ID NO: 31835 - DNA, 201 bp, Homo sapiens
agctgcttatgcagcccaatcattccccggcaggaacactgagccagtgtttccagaacttctagtttttacagaaaaattgaaaattagatttttgggcygggcgcagtggctcacgcctgtaatcccagcaatttgggaggcccggactggcggatcacgaggtcaggagatcgagaccatcttggctaacatggtgaa

SEQ ID NO: 31836 - DNA, 201 bp, Homo sapiens
attttcccacttacactggctggtggtcacacattgatctgcctccctcactctaggctgggagctccttaagagcagggccccagttctgcctgtatctstctgtcttgcacaatgcctagcccaggctaggtgctgggtgtttgctcaacgaagggcctggtactctgtgggaaccctggggcctggcctaccttcaca

SEQ ID NO: 31837 - DNA, 201 bp, Homo sapiens
tacacaaaattagccaggcgtggtagtgtgcgcctgtagtcccagctactcgggaggctgaggcaggagaatggcatgaatccaggaggcagaggttgcartgagctgagatcgggccactgcactccagcctgggcgacggagtaagactccgtctcaaaaaaaaaaaaaaatagaaaattagatttttacctgaattct

SEQ ID NO: 31838 - DNA, 201 bp, Homo sapiens
ccggaagcaggggagcacccctgaggctgagttcttccatctgatgccctctgagactggagccttcgatgtgcccagctagccatggcacagacatccayctgtaccaccgtggggagccagcactgcagccggggctgctcttggaccctcctctggggatctctgggccactgccctcacctggggtcctcagtccac

SEQ ID NO: 31839 - DNA, 201 bp, Homo sapiens
atctcctgtggcacctccagcttggacagcttcacaagctgccgaagggagtggtagccctgtccaagacatgaggggctgtggcggctgctggccagccygtctcccaccctaaatacttctcccccttccatcatccatgccaaccacagtgtcaggcagagggacccacgaaagtccgatcatattctaggagcacac

SEQ ID NO: 31840 - DNA, 201 bp, Homo sapiens
gggtgccggtcaagagaggggggcaccccgtgcctccctaccacaccttctggaagacatagcccccgctggggccccagcccacgatggggtcggaggayggcttcccgttgatgttgggctgtgagttgatggtgaggatgccctggcggttcacccgcagcagctcctccttcagcaggctggtctcagccgccaggg

SEQ ID NO: 31841 - DNA, 201 bp, Homo sapiens
tcttggaccctcctctggggatctctgggccactgccctcacctggggtcctcagtccacatccccaggcgcttcagcacctctgtggtagccatctcgcrgttgagggtgtagaagtggaggcctggcaccaagccactggccagaagctcctggcacaggctcacggccagctcgatgccatagttgcggatggcagca

SEQ ID NO: 31842 - DNA, 201 bp, Homo sapiens; identical to SEQ ID NO: 6111

SEQ ID NO: 31843 - DNA, 201 bp, Homo sapiens
tcatgttcccggtttccccagatggtgcagctcactgcctctgcctgtcctctgccctgtcccaggaatacccttctctcctgttggccaactcctctttstcctcagtgattcccacagatgaccctctgagaagccttccctggcctcccaggtgagatatccctcctctggacccgacagcatcctctcctgaacttg

SEQ ID NO: 31844 - DNA, 201 bp, Homo sapiens
cacgttggtcaggctggtctcaaactgacttcaggtgatccactcaccttggcttcccaaagtgctgggattacaagcatgagccaccacacctggcccawtgtgtctgttttgcagctacttccaggcctggtgtgaggttgtaagagacacgggggtgctccgggcccagcatcaagcctttcaggatggcctgaggag

SEQ ID NO: 31845 - DNA, 201 bp, Homo sapiens
gaagatgccccaagtgacagcattcggctgcagttcaggggcattggtgatgttttcaccctgaggggatgtggggtgggggtaagacctgggccaagaayaactggagtcccactgcctggacagccttgactcaatgaggctgtctgggctcaataccctctgcctgcgcctccactcccggcctccactctccctgcg

SEQ ID NO: 31846 - DNA, 201 bp, Homo sapiens
tagtcccagctactcgggaggctgaggcaggagaatggcatgaatccaggaggcagaggttgcagtgagctgagatcgggccactgcactccagcctgggygacggagtaagactccgtctcaaaaaaaaaaaaaaatagaaaattagatttttacctgaattctccagatttgaaaatactgtggcaaaattaacaaaca

SEQ ID NO: 31847 - DNA, 201 bp, Homo sapiens
cttcccacccctgcccagaaataaacaccctgcgtcagcagtgacatgggtgagtcagagctgggtgtgccctgaaggctgggtccagtgtggccttcagyacacgcttgggacttggtcccaatccctccccacggttttccaggtgggcggggcaagcttgcccccggctcctttaccttccagaacatgaagctgacg

SEQ ID NO: 31848 - DNA, 201 bp, Homo sapiens
gggctctccaagggctctgctcaacaggacatttcccggaatagaacaaggcccactgccagtatcacttcccacccctgcccagaaataaacaccctgcrtcagcagtgacatgggtgagtcagagctgggtgtgccctgaaggctgggtccagtgtggccttcagcacacgcttgggacttggtcccaatccctcccca

SEQ ID NO: 31849 - DNA, 201 bp, Homo sapiens
gccaggcgtggtagtgtgcgcctgtagtcccagctactcgggaggctgaggcaggagaatggcatgaatccaggaggcagaggttgcagtgagctgagatygggccactgcactccagcctgggcgacggagtaagactccgtctcaaaaaaaaaaaaaaatagaaaattagatttttacctgaattctccagatttgaaa

SEQ ID NO: 31850 - DNA, 201 bp, Homo sapiens
agcgtaattcatggctgggtggcagggcaaaggctcaagagggtggttgggggtgacagggagaggccgccctggccatctagtcctgggccacatcctgrcaccgcctcttgctgtgtgtcccctccttggggaagtctctaatggtcatgccttgcagtcaccagcacagccagccactcagcaagcgccataaacgcg

SEQ ID NO: 31851 - DNA, 201 bp, Homo sapiens
agccccttggaaacaggtgaagggagcctaggcagggcgggaggtccaaaaatgaccctcggaccaccggccttagaatcagcttgattcagcccgtggtrgcagcatggctggatgcctccccaggggcccagcaacctcgtatgcaccacctctccccagttctcagtcagcctctgacaagcaactctgaatccatca

SEQ ID NO: 31852 - DNA, 201 bp, Homo sapiens
caaaaacaaacccaacaactctatgagctgggctggcctggtcaccagcaggacacccataatagaggctttttaacccagacagtcagggtggcctcctstgttcccacctggtagggggcgaagggctggctgcgtagaggcccatggggagaggctggggtgagcacccagtggctcttcagcatctctctggcccca

SEQ ID NO: 31853 - DNA, 201 bp, Homo sapiens
tccccatccattccctcttcggaatgtttcagctgttctgagaaaacactttgcattcctgccccgcccctgtgatttctctttgggtggcaggcagccgkgagaggctggaggcctggggagatgggggcagggcacaaggctaagctcagcaccttcctccaccctcctcactgtactcaactcctaggcgggcactaa

SEQ ID NO: 31854 - DNA, 201 bp, Homo sapiens
gtgacactgacctagctgggttcaaagaaaacaggctgaccaactcttacacgttgtgctatgaatgagcaaatgaatagacctcagctgtgaaatttccragagggacagtgactctgcagagtgcctcaccaccccccataccctcccatcccctagcaaattctggtgatgagacccccacagggcacacccaggagt

SEQ ID NO: 31855 - DNA, 201 bp, Homo sapiens
accaggaagtagttgtcgtggatgtactggatgatggtgcgggacggggactcctcctcatacagctttccccaccgctcaatccacagggcaaaggcctygtcctacacacacatacccccgcacacacgcacacatgcacacacacacagaggcaagattaacagggctctccaagggctctgctcaacaggacatttc

SEQ ID NO: 31856 - DNA, 201 bp, Homo sapiens
cctcaccagcggccgttagggaactcgtcccactcctgggtacggtagatgtaactctttggtctggaggcccagaagatgggacgtacatcttcctctcrgcgcttggggtgggcgctgagagcccagggtaggggacgcctgggtgaggatggggacagagaattgagacaagggattggctagagggagccggaagca

SEQ ID NO: 31857 - DNA, 201 bp, Homo sapiens
cccttgcattgagggaaaactcaaattccagcaggacaaccatgatctctgcgggcctggcccctgcttaacactcccgcctcctcctgctcatgttcccsgtttccccagatggtgcagctcactgcctctgcctgtcctctgccctgtcccaggaatacccttctctcctgttggccaactcctctttgtcctcagtga

SEQ ID NO: 31858 - DNA, 201 bp, Homo sapiens
ctcagctggagccgctgggcaacagcccaatgggcctggagagagctggcttcccaccgggcctgggatcggacctgcagggctgtgctgggcctgtggcrtcagcggctgctgcagtcacggctggtggagcggtgggcccaggagcggggctggcggctggcacgagatgccctatgccactggcactcctgttggcag

SEQ ID NO: 31859 - DNA, 201 bp, Homo sapiens
gtttccagaacttctagtttttacagaaaaattgaaaattagatttttgggccgggcgcagtggctcacgcctgtaatcccagcaatttgggaggcccggwctggcggatcacgaggtcaggagatcgagaccatcttggctaacatggtgaaaccccgtctctactaaaaatacacaaaattagccaggcgtggtagtgt

SEQ ID NO: 31860 - DNA, 201 bp, Homo sapiens
aaaggcaggggaagaggaattgcccctggcagaggggtgcccagaggtcagggcacactcctgacagagggcagtgccaccacatgcccaggaggccattmctgtaaattctgcccctgactcctcccaggtcaaccacaagcatgcaaacttcttctgccctcccgctcccaagaacaaagatatatttgcaaggaaggt

SEQ ID NO: 31861 - DNA, 201 bp, Homo sapiens
tgtgagccactgtgcctggccgtagatggttttttttcttggcttctcactgagtgagagatggtgttcctctccctcaccaaccacctgggcatgtgatrggaggcagggcatggctgatgtgggacttgaacccatactgctggttcccatccccctcgcagggcagcccctgccctctgaggctgaggttgcaagatg

SEQ ID NO: 31862 - DNA, 201 bp, Homo sapiens
gcccaaccagtctttttttttttttttttttttttttgagacgatctcgctgtgttgcccaggcatgcagtggtgcgatcttagctcactgcaacctccaycccctgggttcaagcaattctcctgcctcagctcccctcgtagctgggattacaggcgcctgccaccacacctggctaatttttgtatttttagtggaga

SEQ ID NO: 31863 - DNA, 201 bp, Homo sapiens
agcttatgggctctcctgggcccctcacctggatgggaaagatcccggggacgatggggcaagtgatgcccatgtcggtgcatgccttcacaaagcggaaraatgtgtcagcctcaaagaaaagctgcgtgatgatgaaatcggctcccgcagacaccttctccttcaagtgcttcaggtcagcctcaaagctccctgctt

SEQ ID NO: 31864 - DNA, 201 bp, Homo sapiens
caccatgttggccaggctggtctcgaactcctgacctcaagtgatcaacccgcctcggccttccaaagtgctgggattacaagcgtgagccaccgcacccrgccccaaccagtctttttataacctgatatcagaagtgacatcccattgcttctgccaaattctgtctgttaaaagcaaattagtaaacccagcctgtat

SEQ ID NO: 31865 - DNA, 201 bp, Homo sapiens
attttctccttccaggtcgctctccatcctgtttacccagattctccctccagaaaagggagtgtgggaggtgggtgggccccagcctggggctgggcccrgaaggccccctcccgcagggcactgggggggctccctgcagagagtcctggccttgatggccctggctgcagactccttcctctcccgcagggtcctaga

SEQ ID NO: 31866 - DNA, 201 bp, Homo sapiens
tgcttggcccctccagtccccagcaacccaccctcccataatggaaacagaagagtcacccagagcctcctgctgctggggagaggaagagaaaggagggyggggcagggctggcctgggatttgggggacagtggccatcctcagggtggaccctccctttcccagcatcttcctcagctggagccgctgggcaacagcc

SEQ ID NO: 31867 - DNA, 201 bp, Homo sapiens
agggagtgtgggaggtgggtgggccccagcctggggctgggcccagaaggccccctcccgcagggcactgggggggctccctgcagagagtcctggccttkatggccctggctgcagactccttcctctcccgcagggtcctagaggcctcggtgcagtcggcggtgcgcggcggtgtccagcgagccatcctcacccagc

SEQ ID NO: 31868 - DNA, 201 bp, Homo sapiens
gctggtctcgaactcctgacctcaagtgatcaacccgcctcggccttccaaagtgctgggattacaagcgtgagccaccgcacccagccccaaccagtctytttataacctgatatcagaagtgacatcccattgcttctgccaaattctgtctgttaaaagcaaattagtaaacccagcctgtattcaaggcggggcatt

SEQ ID NO: 31869 - DNA, 201 bp, Homo sapiens
cacggttttccaggtgggcggggcaagcttgcccccggctcctttaccttccagaacatgaagctgacgggatccactacggtgggctggatgatctctcrcccagggaagatgccccaagtgacagcattcggctgcagttcaggggcattggtgatgttttcaccctgaggggatgtggggtgggggtaagacctgggc

SEQ ID NO: 31870 - DNA, 201 bp, Homo sapiens
agtggccatcctcagggtggaccctccctttcccagcatcttcctcagctggagccgctgggcaacagcccaatgggcctggagagagctggcttcccacygggcctgggatcggacctgcagggctgtgctgggcctgtggcatcagcggctgctgcagtcacggctggtggagcggtgggcccaggagcggggctggcg

SEQ ID NO: 31871 - DNA, 201 bp, Homo sapiens
aaaagcaaattagtaaacccagcctgtattcaaggcggggcattgcccaggacacgaacacaggatgctgtcttggaggctgcccactacaccgacatatygcattaatgagctggcaggcagggctgtggtggttctagaaagtcatgtcctgtccgctggagacagctgcttatgcagcccaatcattccccggcagga

SEQ ID NO: 31872 - DNA, 201 bp, Homo sapiens
cccttctctcctgttggccaactcctctttgtcctcagtgattcccacagatgaccctctgagaagccttccctggcctcccaggtgagatatccctcctytggacccgacagcatcctctcctgaacttgattttcccacttacactggctggtggtcacacattgatctgcctccctcactctaggctgggagctcctt

SEQ ID NO: 31873 - DNA, 201 bp, Homo sapiens
aagaggccgggatgtgtcctgccagctagagcagcgaagaaatcccagcggggccccaggaagtccaagcccatggggttcaggtgctcctctctggctaytccttcagacccgcagctgctggacacaggccacagagctggtgcctcccgcgccatcactgcagtgcagcctgggtggacggaggaagccaaggggaac

SEQ ID NO: 31874 - DNA, 201 bp, Homo sapiens
ccaactcttacacgttgtgctatgaatgagcaaatgaatagacctcagctgtgaaatttccgagagggacagtgactctgcagagtgcctcaccacccccyataccctcccatcccctagcaaattctggtgatgagacccccacagggcacacccaggagtcaggtggcagagcagaacctgggggcttggactctgtag

SEQ ID NO: 31875 - DNA, 201 bp, Homo sapiens
gtgggcagagtcatggtgcccttaggggccagcagagttagtcagggagggtcccaggaggaggtgaggagggctcagcgggcagagcagtggcgagagargttgaggcgtgggaaggggtcagcaaaatagggcagtgggaaggactggatttgcagaggctggctgagggtgcagtgtgctagaagccctgaggaatgt

SEQ ID NO: 31876 - DNA, 201 bp, Homo sapiens
gcagagcagtggcgagagaagttgaggcgtgggaaggggtcagcaaaatagggcagtgggaaggactggatttgcagaggctggctgagggtgcagtgtgytagaagccctgaggaatgtggccagtgaagggaggagggatggtcccaaggcaggcttgctctctgggtcttggcctctgggcaaaaagagctgttgcat

SEQ ID NO: 31877 - DNA, 201 bp, Homo sapiens
ttttttcttattggaaaagtgaaatatgcttattacagaaacctcagaaaatataaagtagaaaaataccaaaatttctttcataattctctctacccaarggcatcggtcagtccctctccagaccagaagcagttagttctgacaccaacaagtggtgataagaggttgatagcctagcaagggggaagaagccaccac

SEQ ID NO: 31878 - DNA, 201 bp, Homo sapiens
gggagctccttaagagcagggccccagttctgcctgtatctctctgtcttgcacaatgcctagcccaggctaggtgctgggtgtttgctcaacgaagggcytggtactctgtgggaaccctggggcctggcctaccttcacattgacaaggtggtaattaacccggagctcgtacttcttcagcacttgcagaagtgcttc

SEQ ID NO: 31879 - DNA, 201 bp, Homo sapiens
aggagaggagctgccagtagcccaagaccctggagcaagccaggccccaagggccccgagagtggacaggaagccgccggagcaccgcggggttgggggcytggggcagagcatggggcccagctgcagctgtgacttgttctcatagaataaaaaacagaactgaacttagccttcccagggaaggaaccatgccccaca

SEQ ID NO: 31880 - DNA, 201 bp, Homo sapiens
acgcctggcagccaggagcccaaggagaggagctgccagtagcccaagaccctggagcaagccaggccccaagggccccgagagtggacaggaagccgccrgagcaccgcggggttgggggcttggggcagagcatggggcccagctgcagctgtgacttgttctcatagaataaaaaacagaactgaacttagccttccc

SEQ ID NO: 31881 - DNA, 201 bp, Homo sapiens
tggccacagtggcctggacagagtagctgggtcccaggcctgcccctgtggacgagggaccagggaccaagagcgcactccagccctgagcccagagcctscaaagcccaaagcaaggcccataaacggaggctacggtaagaggagctgtgtgtgcagtttggtgggtccgagggatgggggcaagggctgaggggcttg

SEQ ID NO: 31882 - DNA, 201 bp, Homo sapiens
agctccttaagagcagggccccagttctgcctgtatctctctgtcttgcacaatgcctagcccaggctaggtgctgggtgtttgctcaacgaagggcctgrtactctgtgggaaccctggggcctggcctaccttcacattgacaaggtggtaattaacccggagctcgtacttcttcagcacttgcagaagtgcttccgc

SEQ ID NO: 31883 - DNA, 201 bp, Homo sapiens
cagggcacaaggctaagctcagcaccttcctccaccctcctcactgtactcaactcctaggcgggcactaagagcagctgccttcctggacccaccttaamctcttgtgactcaactcccctttccagggtgcagggaacattccctctgccctgccttccagctctggccacagtggcctggacagagtagctgggtccc

SEQ ID NO: 31884 - DNA, 201 bp, Homo sapiens
gcaggcagccgggagaggctggaggcctggggagatgggggcagggcacaaggctaagctcagcaccttcctccaccctcctcactgtactcaactcctargcgggcactaagagcagctgccttcctggacccaccttaacctcttgtgactcaactcccctttccagggtgcagggaacattccctctgccctgccttc

SEQ ID NO: 31885 - DNA, 201 bp, Homo sapiens
agcagttacagcagcaggaagatgggtgggtcctttcccaggtactgccctcttccctgcattccactcagccagccttccagaagtctgtgccacagccrcgcaccgtggagctttccctgcttgccagccccggggccccttcgttttcaggggagggggtcagttccattacagaacacacaggctggatgctggagc

SEQ ID NO: 31886 - DNA, 201 bp, Homo sapiens
ctcactgcagcctcaacctccagggctcaaacgatcctcccacctcagccacctgagtagctgagactacaggcgtgtgccaccacacccggctaattttttttttttttttgtagaaatgggatctcactatgttgccagggcttgtctcaaactcctgggctcaagcgatctacctgccttggcctcccaaagcattgg

SEQ ID NO: 31887 - DNA, 201 bp, Homo sapiens
ggagagtggagttcccaagagaagcagcactgtggaggaggaaggcgggacaggagtggctccaacgcagggcgtcaggacgcagggtcatggagcctccrtttctctcgcattctgggtgggcctgttgagaagctccaatgtgtcttccaccacctgccagaggcagttgtccagtgggaagtcattgtccaccaggtt

SEQ ID NO: 31888 - DNA, 201 bp, Homo sapiens
tcactgcagcctcaacctccagggctcaaacgatcctcccacctcagccacctgagtagctgagactacaggcgtgtgccaccacacccggctaattttttttttttttttgtagaaatgggatctcactatgttgccagggcttgtctcaaactcctgggctcaagcgatctacctgccttggcctcccaaagcattggg

SEQ ID NO: 31889 - DNA, 201 bp, Homo sapiens
ctgacttaaagcatgagctcccatccgctccaatccatgctcattcaaaatttaagagcccaggagaggcaggctgctctgccctaagctctggggaaccmacgggtgccggtcaagagaggggggcaccccgtgcctccctaccacaccttctggaagacatagcccccgctggggccccagcccacgatggggtcggag

SEQ ID NO: 31890 - DNA, 201 bp, Homo sapiens
gtacactgtcgctaagagaagagagtgaaatcttcatttaagtaaagatgttctggtggaacatgtatacagttcatgaatgcatattgtaaaaccaagcrgaggacacagaatggctcctcccacagttcagtacaaatttgcgaatgttcagtgtccccgtggggcagtgaactgttggctacagaatggctgacgtct

SEQ ID NO: 31891 - DNA, 201 bp, Homo sapiens
aaaaagagctgttgcatggcccaaccagtctttttttttttttttttttttttttgagacgatctcgctgtgttgcccaggcatgcagtggtgcgatcttrgctcactgcaacctccaccccctgggttcaagcaattctcctgcctcagctcccctcgtagctgggattacaggcgcctgccaccacacctggctaattt

SEQ ID NO: 31892 - DNA, 201 bp, Homo sapiens
ggcgcttcagcacctctgtggtagccatctcgcggttgagggtgtagaagtggaggcctggcaccaagccactggccagaagctcctggcacaggctcacrgccagctcgatgccatagttgcggatggcagcatcgttgtctttgattggctcaatcacgtccttgatctcctgtggcacctccagcttggacagcttca

SEQ ID NO: 31893 - DNA, 201 bp, Homo sapiens
gaggagtgatctcagctcactgcaacctctgcctcccgggttcaagtgattctcccgcctcagcttcctgagtagctgggactacaagtgcacgccaccaygcctggctaatttttgtatttttagtagagacggggtttcaccatattgcccaagctggtctcgaactcctgaactcaagtgatcctcccacctcgactt

SEQ ID NO: 31894 - DNA, 201 bp, Homo sapiens
ttttttgagacgatctcgctgtgttgcccaggcatgcagtggtgcgatcttagctcactgcaacctccaccccctgggttcaagcaattctcctgcctcarctcccctcgtagctgggattacaggcgcctgccaccacacctggctaatttttgtatttttagtggagatggggtttcaccatgttggccaggctggtct

SEQ ID NO: 31895 - DNA, 201 bp, Homo sapiens
accccctgggttcaagcaattctcctgcctcagctcccctcgtagctgggattacaggcgcctgccaccacacctggctaatttttgtatttttagtggaratggggtttcaccatgttggccaggctggtctcgaactcctgacctcaagtgatcaacccgcctcggccttccaaagtgctgggattacaagcgtgagcc

SEQ ID NO: 31896 - DNA, 201 bp, Homo sapiens
gggggctgtgtttgccacatggcgggaagcccaggaagtggcagccggggcacaggagcagcgtgtggcccaggcctcccttgcccgctggagaagctgcrggcagcaaggccaggaagatgggcagcagaagaaggcccgggccccacaggccttcccagcatggccagtggccccgggcatgcaccatgaggcccagca

SEQ ID NO: 31897 - DNA, 201 bp, Homo sapiens
tccagcatcactcactttgtgaccattccggtttggttctcccgagaggtaaagaacaaagacttcaaagacactttcttcactggtcagctcctcccccyacatcttcagcagctcctccttgggggacttgctcttcaggtagaagaggtagtagtccttcagctccccaaaggcaggggaagaggaattgcccctggc

SEQ ID NO: 31898 - DNA, 201 bp, Homo sapiens
ggcctggagagagctggcttcccaccgggcctgggatcggacctgcagggctgtgctgggcctgtggcatcagcggctgctgcagtcacggctggtggagyggtgggcccaggagcggggctggcggctggcacgagatgccctatgccactggcactcctgttggcagggtgagtggagacttggtcgggggcactgcgg

SEQ ID NO: 31899 - DNA, 201 bp, Homo sapiens
tcctcctcatacagctttccccaccgctcaatccacagggcaaaggcctcgtcctacacacacatacccccgcacacacgcacacatgcacacacacacasaggcaagattaacagggctctccaagggctctgctcaacaggacatttcccggaatagaacaaggcccactgccagtatcacttcccacccctgcccaga

SEQ ID NO: 31900 - DNA, 201 bp, Homo sapiens
agtgaaaaactctaagtaggcctgtgggagagacaggtgcctgtcaccaaccccagccctgccagacgccctttcgcagacacctaaggtatcaggactaytggcagccatgtgggcggaataatgaactgtggcgttggcacgtccataagcaaagggtgaggggagtggggacgtgagtttctcagtctggacaggtct

SEQ ID NO: 31901 - DNA, 201 bp, Homo sapiens
acactgtgcccatcccgggcactaaggcctctttaaagcacggcacctccacgagggagggccacagccacatacactccacctggcaggtggacagcgtkagcatgtggaccatagcagggacaaggtgccccggccagccccaacgccctctgccgctgacagggacagaagccctctccagctgcgtgtgctgcagag

SEQ ID NO: 31902 - DNA, 201 bp, Homo sapiens
tccccacttaattcacaaatttacagcaggaacaaggtcaggaggtgaacgtgcatgtcaggagatgtccttgacaagccaccttgaaaactgcaggctcrctgtgtgaacagacttgggggtgggacgggaggagacagagagaggtgaggagcggtggggaagaactgcctcccgcccaccactctgggccttggcttt

SEQ ID NO: 31903 - DNA, 201 bp, Homo sapiens
catggaggcctggtgggggaggggaggggaggcgtgtgtgtcggccggggccactaggcgctcactgttctctccctccgcgcagccgagccacatcgctsagacaccatggggaaggtgaaggtcggagtcaacgggtgagttcgcgggtggctggggggccctgggctgcgaccgcccccgaaccgcgtctacgagcct

SEQ ID NO: 31904 - DNA, 201 bp, Homo sapiens
gctggcaccactacttcagagaacaaggccttttcctctcctcgctccagtcctaggctatctgctgttggccaaacatggaagaagctattctgtgggcrgccccagggaggctgacaggtggaggaagtcagggctcgcactgggctctgacgctgactggttagtggagctcagcctggagctgagctgcagcgggca

SEQ ID NO: 31905 - DNA, 201 bp, Homo sapiens
cccgcagaggtgtggtggctgtggcatggtgccaagccgggagaagctgagtcatgggtagttggaaaaggacatttccaccgcaaaatggcccctctggyggtggccccttcctgcagcgccggctcacctcacggccccgcccttcccctgccagcctagcgttgacccgaccccaaaggccaggctgtaaatgtcacc

SEQ ID NO: 31906 - DNA, 201 bp, Homo sapiens
tgcaaaggcaggacccgggttcataactgtctgcttctctgctgtaggctcatttgcaggggggagccaaaagggtcatcatctctgccccctctgctgaygcccccatgttcgtcatgggtgtgaaccatgagaagtatgacaacagcctcaagatcatcaggtgaggaaggcagggcccgtggagaagcggccagcctg

SEQ ID NO: 31907 - DNA, 201 bp, Homo sapiens
ctacttgggaggctgaggcaggagaattgcttgagcccgggaggcggaggctgcagtgagccaagattgcgccattgcactccagcctgggcaacaagagyaaaactctgtctctaaaaataataataataatttttaaaaatagtaataaagtacacaataaatgtaatgtttgaatcatctcaaaatcatttcccccgg

SEQ ID NO: 31908 - DNA, 201 bp, Homo sapiens
gtggcctgttaggaaccaggccaaatagcaggaggtgagcagtgggcaagtgagtgaagcttcatctgtatttacagctgctccccatcactggcattacrgcctgagctccacctcctgtcagatccgcggcggcattagattctcacaggatcctgaaccctaccttacgtgaactgtgcatgcgagggatctaggctg

SEQ ID NO: 31909 - DNA, 201 bp, Homo sapiens
ctgaggtcagcaagtcctcctaacggttcccctaatgcagaagtccccaaaccccaggccacggaccagtacctgtctgtggcctgttaggaaccaggccraatagcaggaggtgagcagtgggcaagtgagtgaagcttcatctgtatttacagctgctccccatcactggcattacagcctgagctccacctcctgtca

SEQ ID NO: 31910 - DNA, 201 bp, Homo sapiens
tggaaatctttgcctatggaggaatgcaaaggtactgctgcaggctgtgttcttttaagactgataagagtggtgaggaaagtcagtgtgggcgggatggwgcagatccacaggctcccagggccacacaggttcctatggggcccggctcacccctcatcccctgtactgcgctggtcctgggctgtcccctcactgcac

SEQ ID NO: 31911 - DNA, 201 bp, Homo sapiens
ttggccgtggccaactccagctgtggtggggcaggcagggccatcggggttaacaggtggcgttcacagcgcctctgttgcccccgccaggaggccaacaygccaagagcagtggctgggccgggggcccaggcagccattactgaaggctcagattttaaaataaaccagaccaaggcagaaggcagcgaatacaccatt

SEQ ID NO: 31912 - DNA, 201 bp, Homo sapiens
ggcaggaatcctgaagacggacggcactcctcctcctgctgcctcaccctctggcagcccgtgagaagtaccggaagcgagggcggggccgcgggatggcsagggagcggcagggactgaactctctccaaacccaccctgacagggaaatgggccccgcctgtgtcttgggaactcagaggctgaggtcaggcatgatgg

SEQ ID NO: 31913 - DNA, 201 bp, Homo sapiens
cttgccctgtccagttaatttctgacctttactcctgccctttgagtttgatgatgctgagtgtacaagcgttttctccctaaagggtgcagctgagctargcagcagcaagcattcctggggtggcatagtggggtggtgaataccatgtacaaagcttgtgcccagactgtgggtggcagtgccccacatggccgcttc

SEQ ID NO: 31914 - DNA, 201 bp, Homo sapiens
tgcccggagcctccttcccctagtccccagaaacaggaggtccctactcccgcccgagatcccgacccggacccctaggtgggggacgctttctttccttycgcgctctgcggggtcacgtgtcgcagaggagcccctcccccacggcctccggcaccgcaggccccgggatgctagtgcgcagcgggtgcatccctgtcc

SEQ ID NO: 31915 - DNA, 201 bp, Homo sapiens
cggcgccatctgcccggagcctccttcccctagtccccagaaacaggaggtccctactcccgcccgagatcccgacccggacccctaggtgggggacgctktctttcctttcgcgctctgcggggtcacgtgtcgcagaggagcccctcccccacggcctccggcaccgcaggccccgggatgctagtgcgcagcgggtgc

SEQ ID NO: 31916 - DNA, 201 bp, Homo sapiens
ctgtttcatccaagcgtgtaagggtccccgtccttgactccctagtgtcctgctgcccacagtccagtcctgggaaccagcaccgatcacctcccatcggrccaatctcagtcccttcccccctacgtcggggcccacacgctcggtgcgtgcccagttgaaccaggcggctgcggaaaaaaaaaagcggggagaaagtag

SEQ ID NO: 31917 - DNA, 201 bp, Homo sapiens
tgatgatctgtcactatctcccatcacccccagatgggaccgtctagttgcggaaaacaagttcatggctcccactgattctacattatggtgagatgtawaattatttcattatatattataatgtaataataatagaaataaagtgcacaggccgggtgcggtggctcatgcctgtaatcccagcactttgggaggccg

SEQ ID NO: 31918 - DNA, 201 bp, Homo sapiens
tttgagaccagcctggccaacatggtgaaactccgtctctactaaaattacaaaaatcagccaggcttcatggcacatgcctatagtcccagctacaggcrtgctgaagcaggagaatcgcttgcaccccggaggcagaggctgcagtgagctgagaccacaccactgcactccagcctaggcaacagagtatgagactcc

SEQ ID NO: 31919 - DNA, 201 bp, Homo sapiens
cagggtctggcgccctctggtggctggctcagaaaaagggccctgacaactcttttcatcttctaggtatgacaacgaatttggctacagcaacagggtgrtggacctcatggcccacatggcctccaaggagtaagacccctggaccaccagccccagcaagagcacaagaggaagagagagaccctcactgctggggag

SEQ ID NO: 31920 - DNA, 201 bp, Homo sapiens
gtggtgaagcaggcgtcggagggccccctcaagggcatcctgggctacactgagcaccaggtggtctcctctgacttcaacagcgacacccactcctccayctttgacgctggggctggcattgccctcaacgaccactttgtcaagctcatttcctggtatgtggctggggccagagactggctcttaaaaagtgcaggg

SEQ ID NO: 31921 - DNA, 201 bp, Homo sapiens
ccacaaggtgagaggcagagaggcactgagggctggctgcagagggaatctgtaggtcacctcatctccttaacatggctctctctgtcttacagggcaaygcaatctataatctccttccagatatcatcagccgcctgtcagaccccgagctgggggtggaggaagagcctttccacaccatcatgaagtattgctccc

SEQ ID NO: 31922 - DNA, 201 bp, Homo sapiens
  misc_feature (1)...(201): n = A,T,C or G, or insertion/deletion polymorphism (see Tables 1-2)
gcttaggaatcagacacacctgtatttgaattccacctcggctactctttagctgtacagccttcggcaataacttagcctctctttgtgcctatttcctnttcttttgaggctgatgatacttaacccttagttcttgaaaatattaaatacgataaagttcctaacatggtggcagacatacagtagcactcactccct

SEQ ID NO: 31923 - DNA, 201 bp, Homo sapiens
ggcgggctgccccctgaagcctgcgcacccctctccagctcctcaagtcttctctgctgagtcaccttcgaaccggaggctgtgagctggctgtcgtgacyacactggtgcctctgctgtcatgacaacagcacactacgtcagtagtgctccctgggcactgagctccctctttgcggggagaagacagtaatgaaaaat

SEQ ID NO: 31924 - DNA, 201 bp, Homo sapiens
tgcttgacaattttgactgttttggagacaaactgtcagatgagtccatcttcagtgcttttttgtcagttgtgggcaagctgcgacgtggggccaagcckgagggcaaggtgagcagcacaggacacttcaatgcctgttgggttctgggctggctaagacatctgccggccctgggcagcatacggctcttgcagtcac

SEQ ID NO: 31925 - DNA, 201 bp, Homo sapiens
gtgcccatcccgggcactaaggcctctttaaagcacggcacctccacgagggagggccacagccacatacactccacctggcaggtggacagcgtgagcaygtggaccatagcagggacaaggtgccccggccagccccaacgccctctgccgctgacagggacagaagccctctccagctgcgtgtgctgcagaggccat

SEQ ID NO: 31926 - DNA, 201 bp, Homo sapiens
ctcatcttcccttcctgcagacagctcctctcctacatcaccaaggacaagcagacagagagcctggtggaaaagctgtgtcagcggttccgcacatccckgtatgctgccctccctgagggttctttgtgctgagcggggccctgcaggggagaaaggcccatccctcaccccttcaatgcccccactgtggcatccctg

SEQ ID NO: 31927 - DNA, 201 bp, Homo sapiens
cgtggcagagaacatcagagaagacgagtgctgggggagggtccagggttggtcttagtggatggcagagctggccctgggccatcgaacatcctcatctycccttcctgcagacagctcctctcctacatcaccaaggacaagcagacagagagcctggtggaaaagctgtgtcagcggttccgcacatcccggtatgct

SEQ ID NO: 31928 - DNA, 201 bp, Homo sapiens
ccctcacagagcgaggcctccgtaagatgcttgacaattttgactgttttggagacaaactgtcagatgagtccatcttcagtgcttttttgtcagttgtrggcaagctgcgacgtggggccaagcctgagggcaaggtgagcagcacaggacacttcaatgcctgttgggttctgggctggctaagacatctgccggccc

SEQ ID NO: 31929 - DNA, 201 bp, Homo sapiens
ccttcagttgcagccatgccttaagccaggccagcctggcagggaagctcaagggagataaaattcaacctcttgggccctcctgggggtaaggagatgcygcattcgccctcttaatggggaggtggcctagggctgctcacatattctggaggagcctcccctcctcatgccttcttgcctcttgtctcttagatttgg

SEQ ID NO: 31930 - DNA, 201 bp, Homo sapiens
gcctttgaaagaaagaaaggggagggggcaggccgcgtgcagccgcgagcggtgctgggctccggctccaattccccatctcagtcgttcccaaagtcctyctgtttcatccaagcgtgtaagggtccccgtccttgactccctagtgtcctgctgcccacagtccagtcctgggaaccagcaccgatcacctcccatcgg

SEQ ID NO: 31931 - DNA, 201 bp, Homo sapiens
atcctgtcctccgcctggggccccagcccggagagagccgctggtgcacacagggccgggattgtctgccctaattatcaggtccaggctacagggctgcrggacatcgtgaccttccgtgcagaaacctccccctccccctcaagccgcctcccgagcctccttcctctccaggcccccagtgcccagtgcccagtgccc

SEQ ID NO: 31932 - DNA, 201 bp, Homo sapiens
aggtcagcgctcggacctggcggagccccgcacccaggctgtggcgccctgtgcagctccgcccttgcggcgccatctgcccggagcctccttcccctagwccccagaaacaggaggtccctactcccgcccgagatcccgacccggacccctaggtgggggacgctttctttcctttcgcgctctgcggggtcacgtgtc

SEQ ID NO: 31933 - DNA, 201 bp, Homo sapiens
ctgccccactgccgcagaagggcctctcctgtacagcttggattttatttcttctgtgcggtgtgggattgtctcacttgttctctgatatctattttttyaccatctttgtgactcagctttttcttattcctttaattctttgcatagatctttcagcagagatgacagaagacgagacacccaagaaaacaactccca

SEQ ID NO: 31934 - DNA, 201 bp, Homo sapiens
ggacagtcgactgcctctctttgttttgggtacaaagggcaggggccgcaaggggaagcaaaatgaaacttcctggagatgacgttcgtgactgcctgagwgaagagaacggggaggataccagctgccataatgtggattggacagagagggtgggaacttagagaaagaaggaaacaggttacagggccagacagcaga

SEQ ID NO: 31935 - DNA, 201 bp, Homo sapiens
aggaaggtatgatgctcccgcctgttcccggccgagaaggcacacagctagggtgcagagggctggtttccataggacctgctgcgggggcctgagtgtasatgctctgccccactgccgcagaagggcctctcctgtacagcttggattttatttcttctgtgcggtgtgggattgtctcacttgttctctgatatctat

SEQ ID NO: 31936 - DNA, 201 bp, Homo sapiens
gcatacaagcctggctaactgctgaaaggggcccaatcctcttaccattctctccttatcactttattttctcacctaaaagccattttcagacactaaarggaagactcccatattggaggtgccattgattctgagacctgtcctgatttcagaaatgtcacacgtggaaaacacggggctcagaatcaaagaaatccg

SEQ ID NO: 31937 - DNA, 201 bp, Homo sapiens
aggcagacaggggccgtggcagagaacatcagagaagacgagtgctgggggagggtccagggttggtcttagtggatggcagagctggccctgggccatcraacatcctcatcttcccttcctgcagacagctcctctcctacatcaccaaggacaagcagacagagagcctggtggaaaagctgtgtcagcggttccgca

SEQ ID NO: 31938 - DNA, 201 bp, Homo sapiens
acctgccaaatatgatgacatcaagaaggtggtgaagcaggcgtcggagggccccctcaagggcatcctgggctacactgagcaccaggtggtctcctctkacttcaacagcgacacccactcctccacctttgacgctggggctggcattgccctcaacgaccactttgtcaagctcatttcctggtatgtggctggggc

SEQ ID NO: 31939 - DNA, 201 bp, Homo sapiens
gagagaagctgctgagcctccagcaccctgactctagggccttggctttatgtctatctgcagtatttttgtgatttttaaaaattcactttcttgttgcrgtgtaacttacacagggtcaaatgcacaaatcatggccctgactttagataaaaatctgcccccacaacccttctgttccttgccagtttttaaactgcc

SEQ ID NO: 31940 - DNA, 201 bp, Homo sapiens
ggtgggcccgggcggcctccgcattgcaggggcgggcggaggacgtgatgcggcgcgggctgggcatggaggcctggtgggggaggggaggggaggcgtgkgtgtcggccggggccactaggcgctcactgttctctccctccgcgcagccgagccacatcgctcagacaccatggggaaggtgaaggtcggagtcaacgg

SEQ ID NO: 31941 - DNA, 201 bp, Homo sapiens
agggtgtagcccggaggtctcggtccccatgacccgcaattccattcctagcctccgggaccctgctcagcaagtgcggaaaacagcggggctggtgatgmcccacctgatcctcaaggacatggtgaaggtgaaggggcaggtcagcgagatggcggtgctgctcatcgaccccgagcctcagattgctgccctggccaa

SEQ ID NO: 31942 - DNA, 201 bp, Homo sapiens
ggtggctggggggccctgggctgcgaccgcccccgaaccgcgtctacgagccttgcgggctccgggtctttgcagtcgtatgggggcagggtagctgttcyccgcaaggagagctcaaggtcagcgctcggacctggcggagccccgcacccaggctgtggcgccctgtgcagctccgcccttgcggcgccatctgcccgg

SEQ ID NO: 31943 - DNA, 201 bp, Homo sapiens
ccagtgggactgacacttctggttagaagcttcacctctttcccccactccagctttcaactctagacagctttctgactgcttctggagtggcagagcaygggataattgattcctgctgagggccttttctaccagtgttagggtgtagcccggaggtctcggtccccatgacccgcaattccattcctagcctccggg

SEQ ID NO: 31944 - DNA, 201 bp, Homo sapiens; identical to SEQ ID NO: 6124

SEQ ID NO: 31945 - DNA, 201 bp, Homo sapiens; identical to SEQ ID NO: 6125

SEQ ID NO: 31946 - DNA, 201 bp, Homo sapiens
agccgcctgtcagaccccgagctgggggtggaggaagagcctttccacaccatcatgaagtattgctccccgggccctggggcacattttccacatagcaygggcttaggaatcagacacacctgtatttgaattccacctcggctactctttagctgtacagccttcggcaataacttagcctctctttgtgcctatttc

SEQ ID NO: 31947 - DNA, 201 bp, Homo sapiens
cagaatggtagggccaagcctagctccagacaccccagagccctggagaagccaagactgagggagaaagcctgagggaggagcgccccagtccccagggrccggcctggtgcagagctgcagctgatgttcccctctgtgcagccccaccctctgcctcgctgagctccctgctgcgagggcctcgggtgcaagggggag

SEQ ID NO: 31948 - DNA, 201 bp, Homo sapiens
ttaggggaacttgggtaggggcaaggcgtgtagctgggacctaggtccagacccctggctctgccactgaacggctcagttgctttgggcagttactcccsggcctcactttgcacgtgtgcttacctagtggagacaaaagtacatacctcggtagagcgcgcacgcctgtaaccccagcactttgggaggccaaggtgg

SEQ ID NO: 31949 - DNA, 201 bp, Homo sapiens
ttgcacgtgtgcttacctagtggagacaaaagtacatacctcggtagagcgcgcacgcctgtaaccccagcactttgggaggccaaggtgggtgtatcacytgaggtcaggagtttgagaccagcctggccaacatggtgaaactccgtctctactaaaattacaaaaatcagccaggcttcatggcacatgcctatagtc

SEQ ID NO: 31950 - DNA, 201 bp, Homo sapiens; identical to SEQ ID NO: 6114

SEQ ID NO: 31951 - DNA, 201 bp, Homo sapiens; identical to SEQ ID NO: 6116

SEQ ID NO: 31952 - DNA, 201 bp, Homo sapiens
aggaagactcccatattggaggtgccattgattctgagacctgtcctgatttcagaaatgtcacacgtggaaaacacggggctcagaatcaaagaaatccrgtctccctccccgggcccattctgcagcccacactctgaggcaggcggagaggcagggcccaggcagcacaaactcagtgccagggacagtcgactgcct

SEQ ID NO: 31953 - DNA, 201 bp, Homo sapiens
cattctctccttatcactttattttctcacctaaaagccattttcagacactaaaaggaagactcccatattggaggtgccattgattctgagacctgtcytgatttcagaaatgtcacacgtggaaaacacggggctcagaatcaaagaaatccggtctccctccccgggcccattctgcagcccacactctgaggcagg

SEQ ID NO: 31954 - DNA, 201 bp, Homo sapiens
cttaccattctctccttatcactttattttctcacctaaaagccattttcagacactaaaaggaagactcccatattggaggtgccattgattctgagacstgtcctgatttcagaaatgtcacacgtggaaaacacggggctcagaatcaaagaaatccggtctccctccccgggcccattctgcagcccacactctgag

SEQ ID NO: 31955 - DNA, 201 bp, Homo sapiens
gaagtcagggctcgcactgggctctgacgctgactggttagtggagctcagcctggagctgagctgcagcgggcaattccagcttggcctccgcagctgtraggtcttgagcacgtgctctattgctttctgtgccctcgtgtcttatctgaggacatcgtggccagcccctaaggtcttcaagcaggattcatctaggta

SEQ ID NO: 31956 - DNA, 201 bp, Homo sapiens
cggaaaaaaaaaagcggggagaaagtagggcccggctactagcggttttacgggcgcacgtagctcaggcctcaagaccttgggctgggactggctgagcstggcgggaggcggggtccgagtcaccgcctgccgccgcgcccccggtttctataaattgagcccgcagcctcccgcttcgctctctgctcctcctgttcg

SEQ ID NO: 31957 - DNA, 201 bp, Homo sapiens
taggaagtctgttcctgtcctccctgtgcagggtatcctgtagggtgacctggaattcgaattctgtttcccttgtaaaatatttgtctgtctcttttttwaaaaaaaaaaaaaggccgggcactgtggctcacgcctgtaatcccagcactttgcgataccaaggcgggtggataacctgaggtagggagttcgagacca

SEQ ID NO: 31958 - DNA, 201 bp, Homo sapiens
aggaagtctgttcctgtcctccctgtgcagggtatcctgtagggtgacctggaattcgaattctgtttcccttgtaaaatatttgtctgtctctttttttwaaaaaaaaaaaaggccgggcactgtggctcacgcctgtaatcccagcactttgcgataccaaggcgggtggataacctgaggtagggagttcgagaccag

SEQ ID NO: 31959 - DNA, 201 bp, Homo sapiens
tcgtggagtccactggcgtcttcaccaccatggagaaggctggggtgagtgcaggagggcccgcgggaggggaagctgactcagccctgcaaaggcaggasccgggttcataactgtctgcttctctgctgtaggctcatttgcaggggggagccaaaagggtcatcatctctgccccctctgctgatgcccccatgttcg

SEQ ID NO: 31960 - DNA, 201 bp, Homo sapiens
cctgacaactcttttcatcttctaggtatgacaacgaatttggctacagcaacagggtggtggacctcatggcccacatggcctccaaggagtaagacccytggaccaccagccccagcaagagcacaagaggaagagagagaccctcactgctggggagtccctgccacactcagtcccccaccacactgaatctcccct

SEQ ID NO: 31961 - DNA, 201 bp, Homo sapiens
aggaagagagagaccctcactgctggggagtccctgccacactcagtcccccaccacactgaatctcccctcctcacagttgccatgtagaccccttgaaraggggaggggcctagggagccgcaccttgtcatgtaccatcaataaagtaccctgtgctcaaccagttacttgtcctgtcttattctagggtctggggca

SEQ ID NO: 31962 - DNA, 201 bp, Homo sapiens
gccctctggtggctggctcagaaaaagggccctgacaactcttttcatcttctaggtatgacaacgaatttggctacagcaacagggtggtggacctcatkgcccacatggcctccaaggagtaagacccctggaccaccagccccagcaagagcacaagaggaagagagagaccctcactgctggggagtccctgccaca

SEQ ID NO: 31963 - DNA, 201 bp, Homo sapiens
ctagcctccgggaccctgctcagcaagtgcggaaaacagcggggctggtgatgacccacctgatcctcaaggacatggtgaaggtgaaggggcaggtcagygagatggcggtgctgctcatcgaccccgagcctcagattgctgccctggccaagaacttcttcaatgagctctcccacaaggtgagaggcagagaggcac

SEQ ID NO: 31964 - DNA, 201 bp, Homo sapiens
agaggcagagaggcactgagggctggctgcagagggaatctgtaggtcacctcatctccttaacatggctctctctgtcttacagggcaatgcaatctatratctccttccagatatcatcagccgcctgtcagaccccgagctgggggtggaggaagagcctttccacaccatcatgaagtattgctccccgggccctgg

SEQ ID NO: 31965 - DNA, 201 bp, Homo sapiens
agaacttcttcaatgagctctcccacaaggtgagaggcagagaggcactgagggctggctgcagagggaatctgtaggtcacctcatctccttaacatggytctctctgtcttacagggcaatgcaatctataatctccttccagatatcatcagccgcctgtcagaccccgagctgggggtggaggaagagcctttccac

SEQ ID NO: 31966 - DNA, 201 bp, Homo sapiens
aatgtttaaaaatcggtaaaaatgcccacctcgcatagttttgaggaagatgaactgagatgtgtcagggtgacttatttccatcatcgtccttaggggarcttgggtaggggcaaggcgtgtagctgggacctaggtccagacccctggctctgccactgaacggctcagttgctttgggcagttactcccgggcctcac

SEQ ID NO: 31967 - DNA, 201 bp, Homo sapiens
cctcagcctcgcttggcggcggcggcgggtcgctaagcgggaccgcagtgaaagcaggagactttctagaaaaaaacaccagttgtcaaccttggggcagkcaggaatcctgaagacggacggcactcctcctcctgctgcctcaccctctggcagcccgtgagaagtaccggaagcgagggcggggccgcgggatggcga

SEQ ID NO: 31968 - DNA, 201 bp, Homo sapiens
gacttatttccatcatcgtccttaggggaacttgggtaggggcaaggcgtgtagctgggacctaggtccagacccctggctctgccactgaacggctcagktgctttgggcagttactcccgggcctcactttgcacgtgtgcttacctagtggagacaaaagtacatacctcggtagagcgcgcacgcctgtaaccccag

SEQ ID NO: 31969 - DNA, 201 bp, Homo sapiens
ttcccgcctctcagcctttgaaagaaagaaaggggagggggcaggccgcgtgcagccgcgagcggtgctgggctccggctccaattccccatctcagtcgytcccaaagtcctcctgtttcatccaagcgtgtaagggtccccgtccttgactccctagtgtcctgctgcccacagtccagtcctgggaaccagcaccgat

SEQ ID NO: 31970 - DNA, 201 bp, Homo sapiens
aagcttcgggcctgtcataccagaggtttggatggaatcaaggagcttgagattggccaagcaggtagccagagagcgccatcagccaagaaaccatccastggtacgtaaggcagcctgtgcgggcgagaccagactgggccctcccctcctgcagtgatttgtttcttcttcttttttaaatcacgttttcctgccttt

SEQ ID NO: 31971 - DNA, 201 bp, Homo sapiens
caggagaatcgcctgaacccagaggcggaggttgtagtgagccgaaatcacaccattgcactccagcttgggcaacaatagcgaacctccatctcaaattwaaaaaaaaatgcctacacgctctttaaaatgcaaggctttctcttaaattagcctaactgaactgcgttgagctgcttcaactttggaatatatgtttgc

SEQ ID NO: 31972 - DNA, 201 bp, Homo sapiens
atttctcctccgggtgatgcttttcctagattattctctggtaaatcaaagaagtgggtttatggaggtcctcttgtgtcccctccccgcagaggtgtggkggctgtggcatggtgccaagccgggagaagctgagtcatgggtagttggaaaaggacatttccaccgcaaaatggcccctctggtggtggccccttcctg

SEQ ID NO: 31973 - DNA, 201 bp, Homo sapiens
ggggagtccctgccacactcagtcccccaccacactgaatctcccctcctcacagttgccatgtagaccccttgaagaggggaggggcctagggagccgcmccttgtcatgtaccatcaataaagtaccctgtgctcaaccagttacttgtcctgtcttattctagggtctggggcagaggggagggaagctgggcttgtg

SEQ ID NO: 31974 - DNA, 201 bp, Homo sapiens
tagattattctctggtaaatcaaagaagtgggtttatggaggtcctcttgtgtcccctccccgcagaggtgtggtggctgtggcatggtgccaagccgggrgaagctgagtcatgggtagttggaaaaggacatttccaccgcaaaatggcccctctggtggtggccccttcctgcagcgccggctcacctcacggccccg

SEQ ID NO: 31975 - DNA, 201 bp, Homo sapiens
cagagcatgggataattgattcctgctgagggccttttctaccagtgttagggtgtagcccggaggtctcggtccccatgacccgcaattccattcctagyctccgggaccctgctcagcaagtgcggaaaacagcggggctggtgatgacccacctgatcctcaaggacatggtgaaggtgaaggggcaggtcagcgaga

SEQ ID NO: 31976 - DNA, 201 bp, Homo sapiens
ggtaccaaaaaggttggggactgctgcctaaagtcattgcactgggagagaggaggagtcagatgatttgaaaatacttttttttttttttttcctgagakggaatcttgctctgtcacccaggctgtggtgcagtggcacaatctcagctcactgcagcctccacctcccagattccagcaattctcctgcctcagcctc

SEQ ID NO: 31977 - DNA, 201 bp, Homo sapiens
tgaagcaggcgtcggagggccccctcaagggcatcctgggctacactgagcaccaggtggtctcctctgacttcaacagcgacacccactcctccaccttygacgctggggctggcattgccctcaacgaccactttgtcaagctcatttcctggtatgtggctggggccagagactggctcttaaaaagtgcagggtctg

SEQ ID NO: 31978 - DNA, 201 bp, Homo sapiens
gccccagcaagagcacaagaggaagagagagaccctcactgctggggagtccctgccacactcagtcccccaccacactgaatctcccctcctcacagttkccatgtagaccccttgaagaggggaggggcctagggagccgcaccttgtcatgtaccatcaataaagtaccctgtgctcaaccagttacttgtcctgtct

SEQ ID NO: 31979 - DNA, 201 bp, Homo sapiens
agcggggccctgcaggggagaaaggcccatccctcaccccttcaatgcccccactgtggcatccctgggactggggaggctgatggggaaggttgagcctytactagctggatctcccagttcctcacaaagcccttcctatctgcagaactgagcggcagcagcgagacctggcctactgtgtgtcacagctgcccctca

SEQ ID NO: 31980 - DNA, 201 bp, Homo sapiens
catccaaacacccagcagcgagcttccaaaaagaaacccaaagttgtcttctcaagtgatgagtccagtgaggaaggtatgatgctcccgcctgttcccgrccgagaaggcacacagctagggtgcagagggctggtttccataggacctgctgcgggggcctgagtgtagatgctctgccccactgccgcagaagggcct

SEQ ID NO: 31981 - DNA, 201 bp, Homo sapiens
cagtgacaccaaagtgcacaataaatactcgccagtttcattattattaaagaatccatttgaatgtcagctcaacacagcctcctataccgaggcattgkgaaccgcatctccccagcttctccaggcttttccaagaatcagggacactgtagcctgttggtctcagtgtatgacagacacggaggaagcacatcttta

SEQ ID NO: 31982 - DNA, 201 bp, Homo sapiens
cagcctagctaacatagtgaaaccccatctctactaaaaatacaaaattagctgggcgtagtggcgggtgcctgtaatcccagcccctcgggaggctgagrcaggagaatcgcttgaacctgggaggtggaggttgcagtgagccgaggtcacatcactgcactccagcctgggtgacagagtgagactctgtctcaaaaa

SEQ ID NO: 31983 - DNA, 201 bp, Homo sapiens
ttttttctttaaagagttctcttcttacccccagccatcaaaaaattaaaataccataagcaaatggacacatgctcctctggaatttatttttggaatcratggggcaaatagggaaaaggccttcctaccacttgccccaaaattggggaggagaggagtagggaaggcataagaaacatgggaatcgaaacaaggaca

SEQ ID NO: 31984 - DNA, 201 bp, Homo sapiens
gggtttaaagtgaattttaagcattttagcatccactttgaggttttcttttcatagaaggaactcgtgagaaataacttgttattagctaaaataaaagrggacagatttaaaaggagtagaaaatagaagattgtttaaagcttgttgggagcaaataaagattttggggaaaatcccaagggaaattctctgatattt

SEQ ID NO: 31985 - DNA, 201 bp, Homo sapiens
gctgaggtgcagtggtgcaatcatagctcacggcagcctcaaactcctgagcccaagtgagagatgagtcagagccaagcccttctgctaacagagctatktgttgctgaggaagttctcagtttctcctctgaatggtgccaatatcctccagttgcttaaggcagagtgagagaagctgactgtggatacccacatgaa

SEQ ID NO: 31986 - DNA, 201 bp, Homo sapiens
agttttaacaggggctagaacctaagttgtcagtgtgtgcaccacagaggtctgtggcaagaagaatgtgtgtgagtcattggcctgtcattattgtctaygttactttagacacactgaactgctctgaacctcggtttcctcatctgtgaaatatgcccacttttcaaggcaaatttgttgtaaaacagatgtaaagtg

SEQ ID NO: 31987 - DNA, 201 bp, Homo sapiens
ctctgttgacctccacaccatgtcctgtccatcatatttaggaatcctctgccttttccagttgtggttttttcctcctcactagttttaacaggggctaraacctaagttgtcagtgtgtgcaccacagaggtctgtggcaagaagaatgtgtgtgagtcattggcctgtcattattgtctacgttactttagacacact

SEQ ID NO: 31988 - DNA, 201 bp, Homo sapiens
gggggtcatttactcttcaaagatggtgaaatgccaccttctccaggacattctccctgactcacccaagtagggcttctggaacccctttgcgtacatartgatcatcgtgtgttgacattgtggtttacttgtgatgcaccagcactgtcacccggcatgtttctagaagggaaggattcaccctttctcatgttcata

SEQ ID NO: 31989 - DNA, 201 bp, Homo sapiens
taatagctttattgacatataattcacatgccatgcaaatcaccatttaaattgcagaattcagtggtttttaatatattcagagttgtgcagccatcgcygcagtcaattttagaacattttcatcaccgcccttcaaaaaaaactccatccatactcattagcagccaccccccattttcccaattctcctcccccagc

SEQ ID NO: 31990 - DNA, 201 bp, Homo sapiens
aatagctttattgacatataattcacatgccatgcaaatcaccatttaaattgcagaattcagtggtttttaatatattcagagttgtgcagccatcgctrcagtcaattttagaacattttcatcaccgcccttcaaaaaaaactccatccatactcattagcagccaccccccattttcccaattctcctcccccagcc

SEQ ID NO: 31991 - DNA, 201 bp, Homo sapiens
tttttaatatattcagagttgtgcagccatcgctgcagtcaattttagaacattttcatcaccgcccttcaaaaaaaactccatccatactcattagcagycaccccccattttcccaattctcctcccccagccctagataacctttaaagtactttctgcacaattactttttctcctccaaatgtaaacatagtaaat

SEQ ID NO: 31992 - DNA, 201 bp, Homo sapiens
actttctgcacaattactttttctcctccaaatgtaaacatagtaaatgctcataacagaaaattcagaaagaacaagaaaagataaagaagcaaataatsatcatccataattatccagccaatgagagataaccacttttgtctctctatgctgatatactcatagacacatagtttttgcgaacagtgacatcttaca

SEQ ID NO: 31993 - DNA, 201 bp, Homo sapiens
aatatagatttacatgatcatttttgctggccatggatagatcataatttatttgactggttcttttttaatggacatttaggttgtttctagtttttgcwtgtacatacttgtccaaatacttacttttgacaaattcccagaggtggaatttcagggacaaagggtgggcacattttcaagtgttgtacatattaccaa

SEQ ID NO: 31994 - DNA, 201 bp, Homo sapiens
gtttcacagtgacccctagagagggagccccagggaagagatcggatgcctcagcctccctctccctccctcctgtcttctgctggggctccctgttgctraaaccaccctgtagcagaggaggagcaagcccttgcactagtccctgaggtcaatttggggtgcagagtcagacggaaaagggaggaccagtggaggggg

SEQ ID NO: 31995 - DNA, 201 bp, Homo sapiens
tctcaaccaacccctttgatgggggaaaagttcccacatcagtgggtaagctgaccacaggagggctacatcaagaaatataaagcagttccccccatccyttgcttaactggcactaagaaggggtcagcttttcttgtcttgttgtcactgtcatagttgtgaacctacctgatgttccatggggtaggcaagtgctcg

SEQ ID NO: 31996 - DNA, 201 bp, Homo sapiens
ttctggacaaaagagaaagggctttctcagaaacctccagcctcatatcttattgaccccaattgggttacatattccttctaaagtaattagtggcagaygatggggatggttttaagccagtgaggcccacacctgggactgtgggcacatgtacttcatgggaagggagatcccagttgaaatcagcaatgaggagcg

SEQ ID NO: 31997 - DNA, 201 bp, Homo sapiens
tcagacacagacataagagagatattcattctttcaccttccatttgtttgcttgttcattcagtcagcttccactgagtgctctaataggtctgataccrtgctacctgttggggccttttagtctggatctgaagattacaacagggtgatctatacacccttgattcggccctccagccagatcagtgactaacacaa

SEQ ID NO: 31998 - DNA, 201 bp, Homo sapiens
taatgtgctgtttcctgatctgggtgatgtttcattagtgtaaaagttccttgcatgacacacttatgacatagataattttgtgtatgtatcttatatgkcaataaaaacatgtcatgtagctgaaaagtggtggaacatgagtgaaacctacactcgcctgattccaaagcctgtgctcttagctgtaacacaaggcca

SEQ ID NO: 31999 - DNA, 201 bp, Homo sapiens
tgaattgctttaaccagcttctctggaaagaatgtggcaatattaactaaaacttgaaatgtacacactatcccccagcagtcctgcttttgtgaagatayttttccagagataaagtaacagcgtgtaagagcttgtgtataagagtatttattgtagcattgtgttttgatggcaaaagctgcagaaaacctagtatcc

SEQ ID NO: 32000 - DNA, 201 bp, Homo sapiens
tggacagccactctgtggtgcaagaacattcctgacaaaggtgcagcctccatatgaaatccgatcttggtctgagacaatgtcttctgcccagtttcacyggatgactcttgtcccctttttgtcctgccccctatccaggtcgttttctgatgtgacggctgagacatgagatcttcagcctccaggctctccagtttt

SEQ ID NO: 32001 - DNA, 201 bp, Homo sapiens
tatagtataactcaatccacaaaatgtaatttaataaaagcttatatatatataaggatatatatatatatatatatatatatatatatatatatatatawgaatgtgtatattcaggaagaagattttgaattttctttatccttcctgacttcaagctatatttttctttaaatatgttctaaaatttactacatactt

SEQ ID NO: 32002 - DNA, 201 bp, Homo sapiens
taatggacatttaggttgtttctagtttttgcatgtacatacttgtccaaatacttacttttgacaaattcccagaggtggaatttcagggacaaagggtrggcacattttcaagtgttgtacatattaccaagccaccctccagaaaggtttaccaatctgtatttctatgagcaattttgcaagtatacatttcttgcc

SEQ ID NO: 32003 - DNA, 201 bp, Homo sapiens
gtagattgaggtgaggcagagaagggctttatgagccatggttgggggttccacttgattctgttttaaagtcagagagtggcatgactagacatatttaraaacactctgcaatggtgcggaagatggatgggtggaggatgaactgctagaggctgtggaagtacctggctggggcatgattaagtcctaaagtaagac

SEQ ID NO: 32004 - DNA, 201 bp, Homo sapiens
ttaattggggaaggggggcagtgaaactttcttattgggtgataaaacccaatctgaaaggttgaacaagagtttgtaaaattgttaagaagatgatggaraaaatggtgagaggcagaagtattgttcagaaaagagaaaattttagctactagaattagcatctccagagtcataaaggccagaaaggagcctggcatg

SEQ ID NO: 32005 - DNA, 201 bp, Homo sapiens
agcctcagtcctcagtctcccaggctcaggtgatcctcctgtcgcagccttgcaagtagctagtgctataagcacgcatcaccacgcccagctaattttcrtttctttttttttttttttttttttttttttcagtagccatgaggtcttgctgttgttacccaggctggcctcaaactcctgagctcaagccatcctccc

SEQ ID NO: 32006 - DNA, 201 bp, Homo sapiens
aaatgttccattagtttcctagggctgctgtgacaaagtaccacaaacttggtggcttaaaacaacagaaatatggccaggcgcggtggctcacacctatmatcccagcactttgggagacggaggcgggcggattacctaagatcaggagttcgagatcagcctagctaacatagtgaaaccccatctctactaaaaata

SEQ ID NO: 32007 - DNA, 201 bp, Homo sapiens
atgcagtagtttgagagtaacaaactaaggcagatcagtctgtgtcaagccagaccatggctgcctagacagctgtgaactcctgagaagcctttccagcrtcaccttctcctcttccaagaagccttcttttccgtgccacacaaaagagactatggtggtcgggcgtggtgtctcatgcctgtaatcccagcactgtgg

SEQ ID NO: 32008 - DNA, 201 bp, Homo sapiens
atggagctaaaagactagaaaatgttccattagtttcctagggctgctgtgacaaagtaccacaaacttggtggcttaaaacaacagaaatatggccaggygcggtggctcacacctataatcccagcactttgggagacggaggcgggcggattacctaagatcaggagttcgagatcagcctagctaacatagtgaaac

SEQ ID NO: 32009 - DNA, 201 bp, Homo sapiens
gtaaagaagaaggaagaagtacctcccactctcagggctccagggaaagaggacacagtataatgtgcccctggggccactagggagtattcctggaggarcaggaaagagaagtgctgttcacagcttcagagagaggattagggaagtcttcaatgcactcttccagttaggagcagaactcctcaaggataagggctg

SEQ ID NO: 32010 - DNA, 201 bp, Homo sapiens
agctgacgtgtgaaggacagactggcggggagtgtggcggggcctgggtgcctatgaaaacagacagaggagaagctgttagaatagatccactgagcgcygaaggtaaactggacaaaggtggtagcaatgaagataatgaaatgtggttgacttcccaatgtattttgaagggagagccaacaggatttgctgatcagt

SEQ ID NO: 32011 - DNA, 201 bp, Homo sapiens
tcaagggaaacaaaaacagcttctgctttgatggagctaaaagactagaaaatgttccattagtttcctagggctgctgtgacaaagtaccacaaacttgstggcttaaaacaacagaaatatggccaggcgcggtggctcacacctataatcccagcactttgggagacggaggcgggcggattacctaagatcaggagt

SEQ ID NO: 32012 - DNA, 201 bp, Homo sapiens
aaaaaacatggttcctccttttactacatgtatactttattttttgatcacttttctgacgacctactaagtgccagggtctgtgcaagctgccaggataycaagggaaacaaaaacagcttctgctttgatggagctaaaagactagaaaatgttccattagtttcctagggctgctgtgacaaagtaccacaaacttgg

SEQ ID NO: 32013 - DNA, 201 bp, Homo sapiens
atctaatttgctcaagtctcttagtagagataaaaaacatggttcctccttttactacatgtatactttattttttgatcacttttctgacgacctactawgtgccagggtctgtgcaagctgccaggatatcaagggaaacaaaaacagcttctgctttgatggagctaaaagactagaaaatgttccattagtttccta

SEQ ID NO: 32014 - DNA, 201 bp, Homo sapiens
ccctggccagtacttctagaagaaagtatgtgatttagctcttatttgaggatggtttatcaattagtagttaaattacctcctcagcaaggctagcattytgaatacagtatgttcaatttgcatttggttagatggtgtcagattcttacttccttctgtgaagcatgctttagaacaaactgtgcttctagtagttaa

SEQ ID NO: 32015 - DNA, 201 bp, Homo sapiens
aagtgatgatgctggtcttgtcttcctccctcccttcatttttccctccctgcctttaaaatttattaagcagcgactgtgtgccaggtcctacactcaarcctggggaaatacatgaataagactcatggcaaagccttcttgagcttatccttcatttgtttttagaaaacgtattcattctacaaatgtttcctgagc

SEQ ID NO: 32016 - DNA, 201 bp, Homo sapiens
aagtaaaactaatgagtaaagacttaataaaatggataaactgaggctttaaactattcctgaaggttgaatagtttgattggtggattgagtgtttgatrtttaggatgacactggttttggcttagtgtatacagggatgcctcacctatgttagcaggctcttgtgagagtaagatggatgcaaaactacttgcagag

SEQ ID NO: 32017 - DNA, 201 bp, Homo sapiens
aaaaacagtattcaagttctgctgcgaaaatcctttcaaaataattgagtctatttaaaattcaactggttgtttcacagcattgactatacttcagttaratacataaaggaaggaaggttatggctaaactgagagatgggaagtgatgatgctggtcttgtcttcctccctcccttcatttttccctccctgccttta

SEQ ID NO: 32018 - DNA, 201 bp, Homo sapiens
aattgcttgaacctgggaggcagaggttgcagtgagctgagatcgtgccattgcactccagtctgggcaacagaactagactctttcttaacaacaacaayaacaaaattctcataaatatgtgaatgaatgaatgaatgaataaaatcacagtccacagcaatgcggttgtcatccctgggaaaactcaagtccaaggga

SEQ ID NO: 32019 - DNA, 201 bp, Homo sapiens
cttgggaggctgaggcatgagaattgcttgaacctgggaggcagaggttgcagtgagctgagatcgtgccattgcactccagtctgggcaacagaactagwctctttcttaacaacaacaacaacaaaattctcataaatatgtgaatgaatgaatgaatgaataaaatcacagtccacagcaatgcggttgtcatccctg

SEQ ID NO: 32020 - DNA, 201 bp, Homo sapiens
ttctattataggattacccaaagtcatgtttattttgtttttttctttttttaagtcaagagtccagcacaaaatggcattcattttacaggtatcttttyaggtgatattaattataattgcaataactcagtgcattattagaattaggttttgctgacaatgacataaaatctaaaagaacattggcttagagaagtg

SEQ ID NO: 32021 - DNA, 201 bp, Homo sapiens
actggaaatttaaggcggatgtgatgatgatgagtctaacaaaaagctgtcctcatcacatacccagtcctccacaaggtttttgtggatacagtcagtgmaatacccactcttaggccatctagattagttcctcacagattctggggatttcctacatctgatgagtttctgattgcatgtcctgaaatggcaccattt

SEQ ID NO: 32022 - DNA, 201 bp, Homo sapiens
gaattccagttaacattcaaaggctactttcttcatacttgataattattttctacctcaagcattcacttgaggagagagtagtgaataaaccttctgtytaacctatctgaaattccacaggttctctctctctctctctctctctctctctctctctctctctttttttttttttttttttttttttgagatggagtc

SEQ ID NO: 32023 - DNA, 201 bp, Homo sapiens
ccctggtatgcagctcctgcgctgcccaggctgggagggccaccccaggctttttccctgccagaaccacaacatccacagtgcccaaaatagccccagcrttacattactgaagtcctgcttctgtgatgaatccagccatctgtctcaggagacttctaaggcaggcttttgatagcaaaacaaatagtcctgtggaca

SEQ ID NO: 32024 - DNA, 201 bp, Homo sapiens
attttttaaggtatatttatatctatttaggtataagtgaatgaatttccaggacattttttctgggctaagtggagagattgccttgctgagtactgttkggggagatattctcaaaccaccttcatagtttaagaatatatcgatttcccataagggagcttcagtgagaagagaatgtcagttcctgggagagtctca

SEQ ID NO: 32025 - DNA, 201 bp, Homo sapiens
ctgctcctaccagttctgggctggacacttcctgagtttctctctagagagagggcctcacccaacatccccttgtatagactacttacgggaagattttytcaaggagaaaatatatcagtcacaactaagttccctactcttgtgaaggaaaatattctacccaatgggcaaaggatattccaccctgaccacaatgct

SEQ ID NO: 32026 - DNA, 201 bp, Homo sapiens
ggaagtcaggtggttccacctcctaataatggcacagatagcaaagatgagcactaataacctggagttgcttgtgacttctgtggaagagtaaaaaattraaatgcttatacatgaaaacagactcatttgcaaacaatgaccactgatatgtcctgtgatttttctctgaagtattatttgcgttggtaatttttgacc

SEQ ID NO: 32027 - DNA, 201 bp, Homo sapiens
ttaaaagggatttgttctttagggcccccaaattttcaagacgccctacacattcggttggccattttaatctcttctcagggatgggttttgtccattaraacctctgtcctccgtgccagtgaactggaaatttaaggcggatgtgatgatgatgagtctaacaaaaagctgtcctcatcacatacccagtcctccaca

SEQ ID NO: 32028 - DNA, 201 bp, Homo sapiens
atgtttttgtttaatagtgttagtctgacgccttcttattcattataacatacccattttcccatgttatttacatagtcttggtaagtatagtttttttktttgtttgtttttgttttttgttttgagatggagtcttgctctgtcgcccaggctggagtgccgtggcaccaacttggctcactgcaacctatgcctccc

SEQ ID NO: 32029 - DNA, 201 bp, Homo sapiens
attatcctgtatgcaagctttacttagaattgcagaaagaatgagacatccttagtggtaaacattaatgaaatctacgaatagatactctcaacaacaaygcatatgcatatctgttgacatggaaagacagtcgtgttgtattaactggaaaacagcatgatataaaacaacacagaaaggatgatcccattttatgta

SEQ ID NO: 32030 - DNA, 201 bp, Homo sapiens
aggattatgtaacaatttttttctgttaattatcatggacatgttaggatttgattatttggagaggactagcatgcttaattagcgttcagaatttacartttataacagggctctctttgcagtgtactcatttttgttacactggagacttctaaaaaagcaaaaagttgccttgattatcaatgaggaatcaaatgc

SEQ ID NO: 32031 - DNA, 201 bp, Homo sapiens
gattagataagcaaatgtgtcctgaatgggtggatgaagtgagaggctggaggcggagaggccaacctgagaggcttttgatatgatcgagacatgatacygccttccagggtaaatgaagctttacttttattttcaaaatttttctattataggattacccaaagtcatgtttattttgtttttttctttttttaagtc

SEQ ID NO: 32032 - DNA, 201 bp, Homo sapiens
gacactgactttctctgtttcttctgttttcttatccatgaaaaaggggtaatatttatgtttcagattttttttgtgtagtttagaaaaaatgtaaagtrttttacataaagtaggcacatagggcattgtaattacttcaatttttaggttgaaaatagtttttaaaggatgattagataagcaaatgtgtcctgaatg

SEQ ID NO: 32033 - DNA, 201 bp, Homo sapiens
aattagctgggcatggtggcacatgcctgtaatcccagatacttgggaggctgaggcaggagaatctcttgaacccgcgaggcagaggttttggtgagccragattgcgccattgtactccagcctgggcaacaagagcgaaactctgtctcaaaaaaaaaaaaaaaaaagacactgactttctctgtttcttctgttttc

SEQ ID NO: 32034 - DNA, 201 bp, Homo sapiens
ccagctacccatctgatatcagaaatcctgtctacagacttggatctgtttgtaattatgattgaggctgtctaacagttattcatttcttcagcaatctttttttttttttttttttttttttttttttttttttgagactgagtctcgctctttcacccaggctggagtgcagtggtgcagtcttggctcactgtaacc

SEQ ID NO: 32035 - DNA, 201 bp, Homo sapiens
acgtgaatcacctagtgctggcccagagtatcatctgtgatttttgccctgaatagtgaccttgactgaggctctctagctaagtcacctgactgccaggktgtggaaagggaagcagaggaaatccttgttgtgcctctggcattcaggggtggatgagttaattgttaaagaatcagccctaagtctcttgaatcctgg

SEQ ID NO: 32036 - DNA, 201 bp, Homo sapiens
aacaaaccatgttcttctctttactgagaaaactctagtggttttgcttggagtatttaaattgaattaagtacatttgggactagaattggctttttttwattattattattacctgaaattgcacgagtgcaattgggaagcactcatacaaagaacatgaaaaaagcagtttatgtagactatgggaacatgagccta

SEQ ID NO: 32037 - DNA, 201 bp, Homo sapiens
tcaataaaagggagcgtgatatagtggaaaggaacaggttggtatcacatactcctgggttggagttttttgtttttttttttgtttgtttgtttgtttgtttttgagacggagtctcgctctgtcgcccaggccggactgcggactgcagtggcgcaatctcggctcactgcaagctccgcttcccgggttcacgccatt

SEQ ID NO: 32038 - DNA, 201 bp, Homo sapiens
cccttcaagtgatatgtaagtatttctgatatattgaacttttttaaaccattctataattgtttttctacccttccaaaaaacttctttttttttttttkgctgggtgcagtggctcacgcctgtaatcccagcactttgggaggctgaggcaaacggatcacgaggtcaggagatcaagaccatcctggctaacacggt

SEQ ID NO: 32039 - DNA, 201 bp, Homo sapiens
agagaacccaggagggggtccctctggcctgggattgtcacaggagctctctctaaaaaggtataatgtgctatctaagaatacattattacatttactgwattggactgaaatgacctgttagatatctattgccactgacatactctgagtgccttgaaggcgggaaccatgcatgcattggtcagccctgtgatagtg

SEQ ID NO: 32040 - DNA, 201 bp, Homo sapiens
ggggttctggtgatcagcctggtaggggaccatgtgtgaggactgtgagtgcttcctgtttgagagaacccaggagggggtccctctggcctgggattgtyacaggagctctctctaaaaaggtataatgtgctatctaagaatacattattacatttactgtattggactgaaatgacctgttagatatctattgccact

SEQ ID NO: 32041 - DNA, 201 bp, Homo sapiens
tcactccttcgacagatatttattgagcgtctatgtacagatgctgccgctcccctgctcatgtctttgagtgctccccggaaggcactgcagacagtgcycattcacacagagggcttcctgcatctcagcctgagactatgccctggttgtgtctgggcagttagggatggaaggtggcaggtaaatgccccagattcc

SEQ ID NO: 32042 - DNA, 201 bp, Homo sapiens
aatctcacccttttaccaacctgtggcattattttcttgctgttgatgcccaagcctttccttatttcctcatacaaactctgatgtgagtcctgactggsttagctatttgtgattgtccctattgtaaagatatgtaaagtatggtctggggttccctgtgggaagtcccaggatccttccaggggttctgagagatca

SEQ ID NO: 32043 - DNA, 201 bp, Homo sapiens
tgtggtgagtcccaggcatctgcagtcttaaaaactattccacaaatgattttgactctcaaggttgatatataagttacagtctttcccctcaagaagtytgcaaaccagatgagaagatgggacaagcagtggcatgaggcagaacgtaagtgctatagattaggcgctcccaggtctggctccccctgcacaactttg

SEQ ID NO: 32044 - DNA, 201 bp, Homo sapiens
ctttctgtcgctggtggcagcgggaaatgagaggttgtacagaagaccgtgggggttgacagacattgttcactcactccttcgacagatatttattgagmgtctatgtacagatgctgccgctcccctgctcatgtctttgagtgctccccggaaggcactgcagacagtgcccattcacacagagggcttcctgcatct

SEQ ID NO: 32045 - DNA, 201 bp, Homo sapiens
agcaggaatcattgccttgagttgattgatcactgaatttattcagcaaacatttatcttgggtgatatgattgttttcacagggctgtttctgaaacttygttttgcattatcttaatcccaggtgtctatctctggtaggctgatgagacagtttggagttgagtagtcttcattgcatgcagcctggtcttattctgg

SEQ ID NO: 32046 - DNA, 201 bp, Homo sapiens
atggcatcaggaattcctgtcctgactgacaaactgtaagtcgtagaacagaatttcagtggaaaagcagaaacgtgggtggtaacaaatctgatgcttgrtggtaatgaattctggttcactttagcaggcaggtgctttaaatctttctgtcgctggtggcagcgggaaatgagaggttgtacagaagaccgtgggggt

SEQ ID NO: 32047 - DNA, 201 bp, Homo sapiens
tgtacaaaaatggaacatcatggggaggtggtcaggccaggtaccgcctcctctgaggaggtgctgattgatgagagttctgcagggagtgagcagggagstctccgagggcctgcaggagtgtgtgagcagcaggagggaccagtgcccctcctcagccaaaggaacaactcagagtgacaggagctgagtgcgagaagg

SEQ ID NO: 32048 - DNA, 201 bp, Homo sapiens
gagtgcaatggcgtgactttggcttacagcagcctccacctgtcaggctcaagtgattctcctgccttagcctcctgagtagctgggattacaggcatgcrccgtcatgcttagctaagttttgtattttcagtagagacaacggggtttcgccacgttggccaggctggtcttgaaccccaggcctcaggtgatccgcct

SEQ ID NO: 32049 - DNA, 201 bp, Homo sapiens
atttttttttttttttaaccacagatggcataaaattcatctccagagagacttctaactaaacctgagtatgaatttttatctctcagtttcttatgcartttttcactgcatacctacatagccttcttttggaagttgttttattgacttttaaattttgcttttgtgtgttttacttgctgcttctcttgtcttctc

SEQ ID NO: 32050 - DNA, 201 bp, Homo sapiens
ttaatttccactgagcccacctgcagttgacaaggcatagcagtgtcagatctgaccagcaatagaatagaatctaggatttgtacattgaactaaaccartgcttgactgtgagtacacagctttatccccttggagagatgtttcttagtatattcccatttctgtcttagatctactgaattatagttgttggtatga

SEQ ID NO: 32051 - DNA, 201 bp, Homo sapiens
tttagtagagacgaggtttcaccatgttggtcaggctggtctcaaactcctgacctcatgatccgcccgcctggccctcccaaagtgctgggattacaggygtgtgcgaccgtgccgggcctgaattgtatactttaaattgtgattaattgtatgtgaattataagtcaagaaacctgttggaaaaaaacattaaagaaa

SEQ ID NO: 32052 - DNA, 201 bp, Homo sapiens
ggaggattggattggctccacttgggtcaggagaccacccttgctccagtcagctttggccaggatgagggggttatgtgatgggtggggctaagtcttcstcttcagcctgggggtgatggtggtcctcagaggagagtaggaggatagggaagcacaccgtttatacccagatcacacagcaaagctgggactagattc

SEQ ID NO: 32053 - DNA, 201 bp, Homo sapiens
atgtacttcaggtggtcctggtgtctaaaacctactctgccatttgatactgtgagaacttgagcagattactgtgccctgagccttcttttcttcatttrgaaaatagcaaataattctgcctggcaaatttgttgtgaggattgagggagataacacctgttattttctagtaccatacctggcacatagtaggttttc

SEQ ID NO: 32054 - DNA, 201 bp, Homo sapiens
catagagatacctacacacatttaaactgggaaaggaaacaatgatccatcgtaaagcttacccgtaagacaaattgcctttggcaatataaaccttaaaygctcatgaaggcctcacatgagttaagtacagtttaacatgattctgccatttgagcacctactatgtgcctggtttttggtagatgactgagggaaggg

SEQ ID NO: 32055 - DNA, 201 bp, Homo sapiens
ctggccagagctgaaacttggattgaggccagcagccgtttcacagtgacccctagagagggagccccagggaagagatcggatgcctcagcctccctctycctccctcctgtcttctgctggggctccctgttgctaaaaccaccctgtagcagaggaggagcaagcccttgcactagtccctgaggtcaatttggggtg

SEQ ID NO: 32056 - DNA, 201 bp, Homo sapiens
tggtgaccttcggcaccttttttctgagcctcagtttcctctcctttccacttgcgctgccaataccccctgcagagtatggtggagattaaattgggatyttataggccaagtatgtggcatctgagaggccctgaataaaagtcagttgttctacactgaaccctgtccacatgtgggattctcggcaagggcttattg

SEQ ID NO: 32057 - DNA, 201 bp, Homo sapiens
agaccgaggcaggtggatcactcgaggtcaggagttcaagaccagcctggccaacatggcgaaaccccatctccactaaaaatacaaaaattagccagacrtggtggcgcatgcctgtaatcctagctacttgggaggctgaggcaggagaatcagtgaacctaggaggcagaggttgcagtgagctgagacgatgccgtt

SEQ ID NO: 32058 - DNA, 201 bp, Homo sapiens
gtggtatctttctggcatattagttttactcagagattttgagtgggaggagtggaagaacttagacaatttaagtgactagtaatcattttatatttaarcaaccatggaaatacaaaggagtgcaaactatgcacaagtgttggtgataaaacagagtctttattaggtttatgtagttagagtagtgagtgctttagg

SEQ ID NO: 32059 - DNA, 201 bp, Homo sapiens
agtgtaagattataaacttgaatatcccttttcacacttaacactgttccctcctgctaattctccccacttgtttctgatcagtcaacctaagtgaaacrtattggcctccttaagaattactggcctggccgggcactgtgactcacgcctgtaatcccagtactttgggagtctgaggtgggtggatcacctgaggtc

SEQ ID NO: 32060 - DNA, 201 bp, Homo sapiens
tagcattttgtctttgacaatttttgtttcctagcagggaactgcatctgcatcagaaagtccctagatggcgataaagatgaaattgctagagaacctcrccattgtctattatctattatccatttatttccaaaaggaaagttacacttcctgatactgagcatttgttgttgttttcctcatatgccaagcacagga

SEQ ID NO: 32061 - DNA, 201 bp, Homo sapiens
actgccagggtgtggaaagggaagcagaggaaatccttgttgtgcctctggcattcaggggtggatgagttaattgttaaagaatcagccctaagtctctygaatcctggtactttcttcttaattatcagtgtcatagaaggaggtggaaggacagatggatagctaatgctgtttcctgtgtggaagtcagttgacaga

SEQ ID NO: 32062 - DNA, 201 bp, Homo sapiens
accatgcccggctaatttttgtatttttcgtagaaatggggtttcaccatgttggccaggctggtcttgaactcctgacctcaggtgatccaccagcctcrgcctcccaaagtgctgggattacaggcttgagccaccacacctggctgttttgttttgttttgttttgtttttttaagagacagggtcttgctgtcttgc

SEQ ID NO: 32063 - DNA, 201 bp, Homo sapiens
tggaagtcagttgacagagcaatgtggcacatatcatgcccgggcaccagcctgtcctgtaatcctggccagccctgctgacttacactagtgtcccagcrcactctactccaccatgcctgtttctccatctgaatgtggagataacagctcctccgttctacactgagtccttctttgtataaatatacggttaattac

SEQ ID NO: 32064 - DNA, 201 bp, Homo sapiens
cctttgtgttagagccctctcagaaggaagaaaacacttcttaggcactgtacatcctttaattcaaaatataccaatgtcttatccccattttcagattaaaaaaaaaaaactgaagctcatgacgattaagcagtttactatggtcacacagctggggtgctgtagaactaaaagatttaatccaaagttcatttactg

SEQ ID NO: 32065 - DNA, 201 bp, Homo sapiens
ggcaggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcata

SEQ ID NO: 32066 - DNA, 201 bp, Homo sapiens
gcaggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatat

SEQ ID NO: 32067 - DNA, 201 bp, Homo sapiens
caggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatatg

SEQ ID NO: 32068 - DNA, 201 bp, Homo sapiens
aggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatatgc

SEQ ID NO: 32069 - DNA, 201 bp, Homo sapiens
ggatttttttgggggggttggattttttggtttggggaagttattttgtaattattattatgtatcatactgtatcgtcgcatgtcccagagtgaatcagwtactatatctagttgtgtttgacttcctccttaggatccggaaagtatggcagaggaggaagtgttcagtcaagaatgggattctgaccatctcacatgc

SEQ ID NO: 32070 - DNA, 201 bp, Homo sapiens
ttattgttagttatttatcatgtggtctaaaccatgtgcagaatattcatagaaaaagattagaataagtaacacagatgaatgcacatcccttttccctrttagatgtcttattcaaagggacttccttttgtctgtcagcaaacattgcacagcttctctgtatcaagcactctgatagtctctaaggcagcaggtctc

SEQ ID NO: 32071 - DNA, 201 bp, Homo sapiens
ggcaggaggattgcttgagcccaggagtttgaggctgcagtgagctatgattgtactactgcactcttgacctgaatgacagagcaagaccctatatcttaaaaaaaaaaaaaaaaaaaattaaccttcaaaacaagtaattagtaagtaaataacagttgttatttattgaacataatcatgcactgtataataacattt

SEQ ID NO: 32072 - DNA, 201 bp, Homo sapiens
tctaaaaaccaggggaactgatggtgtaaatcccagtctatgtttgaagttctgagaaccaggagcgccagtgtccaaaaaagaagatgcatgtcccagcycaagcagagagcaaactcacccttcctgctactttctgttctattaatattatgccttcaatggattggatgatgcccactcacgttgggaagggtactc

SEQ ID NO: 32073 - DNA, 201 bp, Homo sapiens
tacaagtggttaaaaagttggttgggacttgggctttttttttttttttctgagatggagtctcgctctgtcatccaggctggagtgtagtggtacattaracaattttgatatatgtatacaagtagttaaaaaattggttgggacctgtgcttttttttttttttctttcttgatggagtctcactctgtcacccaggc

SEQ ID NO: 32074 - DNA, 201 bp, Homo sapiens
ttctctttactgagaaaactctagtggttttgcttggagtatttaaattgaattaagtacatttgggactagaattggcttttttttattattattattamctgaaattgcacgagtgcaattgggaagcactcatacaaagaacatgaaaaaagcagtttatgtagactatgggaacatgagcctaagtgtaaaagatgg

SEQ ID NO: 32075 - DNA, 201 bp, Homo sapiens
gcaggaggattgcttgagcccaggagtttgaggctgcagtgagctatgattgtactactgcactcttgacctgaatgacagagcaagaccctatatcttaaaaaaaaaaaaaaaaaaaattaaccttcaaaacaagtaattagtaagtaaataacagttgttatttattgaacataatcatgcactgtataataacatttc

SEQ ID NO: 32076 - DNA, 201 bp, Homo sapiens
ctcttatttaaaataaatatacgggctgggcatggtggctcatgcctgtaatcctagcactttgggaggcgaaggctggcggatcacctgaggccaggagkttgagaccagcctggccaacatggcgaaaccctgtctctactaaaaatacaaaaattagccaggtatggtggtgggcgcctgtagtcccagctgcttggg

SEQ ID NO: 32077 - DNA, 201 bp, Homo sapiens
gtgtgccaaactttatactgttacaatttttaaatagtaggcaattgtgcataggcattccttgattctgtgatgcaaagacaacataatctgttgtagaygggagtttctgaaggtctttaatcctatccttgaaatataactgggaaaggtggagtgggaaacccttgggaaccaggatacttggcatttggctcagtt

SEQ ID NO: 32078 - DNA, 201 bp, Homo sapiens
gagaaaacttacaaagagaatttagcaacttgtctaaagtctcccagctagtaaagacagtttggaggattaaacccagttctcactgagttttccttataagcagttaactacctctgaaagttcattcatgcattaattgattgcctatgtattggacatttcctgtatcacaggcaggatgtaaggaatggccaaaga

SEQ ID NO: 32079 - DNA, 201 bp, Homo sapiens
tattctataccccagcagccttaggtttctctggtaagtttgggataaatatacttactttataaagttgtcatgaggcttaaagaaggataaatgtattytaaattctatacttagcaaagtgtctggtacgtagcaggtcatggtgaatattttgtttttgcaagaatatcagaatttattttattttttattaaaaaa

SEQ ID NO: 32080 - DNA, 201 bp, Homo sapiens
cagtacaactaggtgagtactgtggggcacagtcctcttgccccaaattaggagtgtcagttaagtgatggtgtgccaaactttatactgttacaattttwaaatagtaggcaattgtgcataggcattccttgattctgtgatgcaaagacaacataatctgttgtagacgggagtttctgaaggtctttaatcctatcc

SEQ ID NO: 32081 - DNA, 201 bp, Homo sapiens
ccaagatggcaccactgcacttcagcccgggcgacagaatgagactctatctcaaaaatacatacatacatacatacatacatacatacatacattttttwaaaaaaaaaaaaaagagagactatgggccgggcatggtggctcacacctgtaatcccagcactttgggaggctgaggcgggcggatcacgaggtcaggag

SEQ ID NO: 32082 - DNA, 201 bp, Homo sapiens
atcactactaaaaatacaaaaaattagctgggcatggtggcacatgcctgtaatcccagctacttgggaggctgaggcaggagaatcgcttgaacctgggwgacggaggttgcagtgagcagagatcgcgccactgcactccagcactccagcctgggtgacacagcgagactctgtctcaaaaaaaaaaaaaaaagaact

SEQ ID NO: 32083 - DNA, 201 bp, Homo sapiens
atgatgaaaccccatcactactaaaaatacaaaaaattagctgggcatggtggcacatgcctgtaatcccagctacttgggaggctgaggcaggagaatcrcttgaacctgggtgacggaggttgcagtgagcagagatcgcgccactgcactccagcactccagcctgggtgacacagcgagactctgtctcaaaaaaaa

SEQ ID NO: 32084 - DNA, 201 bp, Homo sapiens
cttctcctgtagtagggcagtgttgcagtgatgagaccatcagctgaaggccccattgctttgtcctgctgatctttttttccattggccactccatttgrcatttccactgacaatgtcttatttctgagatgaggggaaacgcttttttaagtgtctagtctatatttgaagttagatgaacatggactgaaccccaac

SEQ ID NO: 32085 - DNA, 201 bp, Homo sapiens
cacttgaccattattgtaagaggagcaggtgagccaggccctgaaggaaggaaactgccatgtgcctttcactggggtgaacagagtcaataaaagggagygtgatatagtggaaaggaacaggttggtatcacatactcctgggttggagttttttgtttttttttttgtttgtttgtttgtttgtttttgagacggagt

SEQ ID NO: 32086 - DNA, 201 bp, Homo sapiens
cctgtcccatcagtggcacagaatacatgctatgttcctctcttatttctggagagccacagaattctgctcataccctttttgccttatactcacttctyttctctctcccactcgcttacttttgttattgctcacacacacaatcttctctggggaattttactcttttcccatttcaaaggagaaatgataaaggat

SEQ ID NO: 32087 - DNA, 201 bp, Homo sapiens
tttcccagaagataattctcactatgggaagctgtagccaatggaaaatagcatgcagtaggcacttaagagatgtttggaaggcaggtcctatgacattrtgttcacacccagatgatatcactgacaaccattcatcctgtctgtttctatacctgtccctgccccaccagactgtgagctctctatgggcaatgacct

SEQ ID NO: 32088 - DNA, 201 bp, Homo sapiens
tgtcctgctgatctttttttccattggccactccatttgacatttccactgacaatgtcttatttctgagatgaggggaaacgcttttttaagtgtctagkctatatttgaagttagatgaacatggactgaaccccaactctatcacgtagtagttttaaggccttgggaaagggacctaactgtaaaaggaggtgataa

SEQ ID NO: 32089 - DNA, 201 bp, Homo sapiens
gacagcataggctattgttattttagacgtaaatttctctacttttcaaaattaccacctatttggataccttttcttagttttataaaatatggccattrgggaaaacttgaaaattgagcaaaatacagagaagagaattttaaaatgacccatgattccaccactcagataactacagatggcattttggtgcattgc

SEQ ID NO: 32090 - DNA, 201 bp, Homo sapiens
tccgacagcacgaaggtcctcaggtaggttcatgcctgacacattcacgaaacaacaaaaggaggtcatgtggccaaggtgtagagcgtgtgaggaagaaraggttggaaaggtggcaggagccagattatgcatggcctgctgactgctgtcaagactttggcttttactctaaataatagggagtctttggagttttgt

SEQ ID NO: 32091 - DNA, 201 bp, Homo sapiens
aaatgcttatacatgaaaacagactcatttgcaaacaatgaccactgatatgtcctgtgatttttctctgaagtattatttgcgttggtaatttttgaccstagctttggaatgctctttattacttaaaggattataaaaataattttttaaaactttatggaccagaggcaattattgagagacaaaggagcaattgct

SEQ ID NO: 32092 - DNA, 201 bp, Homo sapiens
tagccagacgtggtggcgcatgcctgtaatcctagctacttgggaggctgaggcaggagaatcagtgaacctaggaggcagaggttgcagtgagctgagaygatgccgttgtactccagcctgggcaacaagagcaaaactccatctcagaaaaaataaaaataaaaataatggtgttaccaagacatagaaggtggggtc

SEQ ID NO: 32093 - DNA, 201 bp, Homo sapiens
ttgggaggctgaggcgggaggatcatttgagcccaggagtttaaggctgcagtgagctatgattatgccactgcactcccacctgggtgacagagcaagamcttgtctcttaaaaaaaaaaaaaaaaaaggccacgtgtggtggctcacacctgtaatcctaacactttgggaggccaaggtgggaggatcagttggtctc

SEQ ID NO: 32094 - DNA, 201 bp, Homo sapiens
acagtatgttgctcacagtaagtgctcagtaaacggtcgttgctgttaataatgttactatcagggcgtcttgatgggtaatgaagagcacattgatttgyggtcaggactcccaggtacaccatttccccacgggacctgcagccatttattcatttagtctcatttccttatcttatgatgccagtctcatgctgtgag

SEQ ID NO: 32095 - DNA, 201 bp, Homo sapiens
gttgtagaaagaaaaattctattatatgaatcatttcatgtttcagcttgtggcccagtgaaggcttagcctgtactctgttctttctctgttgattttgytggtagtggtgtgtgatttctccttcagtaggttctgtgatggttataaggagttattgttttaagatgtgtgtgtgtgtttgtttttcccattgtacct

SEQ ID NO: 32096 - DNA, 201 bp, Homo sapiens
cactagtgtcccagcacactctactccaccatgcctgtttctccatctgaatgtggagataacagctcctccgttctacactgagtccttctttgtataawtatacggttaattactttttaaagtaattaacttaagctttccactcttttaagctttatactatgaaaaccattagatcagttaggaggaataagttca

SEQ ID NO: 32097 - DNA, 201 bp, Homo sapiens
catacatacatacatacatacattttttaaaaaaaaaaaaaaagagagactatgggccgggcatggtggctcacacctgtaatcccagcactttgggaggytgaggcgggcggatcacgaggtcaggagatcgagaccatcctggctaacatggtaaaaccctgtctctactaaaaatacaaacaaaaattagccgggtgt

SEQ ID NO: 32098 - DNA, 201 bp, Homo sapiens
accatgcctgtttctccatctgaatgtggagataacagctcctccgttctacactgagtccttctttgtataaatatacggttaattactttttaaagtarttaacttaagctttccactcttttaagctttatactatgaaaaccattagatcagttaggaggaataagttcaagagatctgttgtacaacctggtgcct

SEQ ID NO: 32099 - DNA, 201 bp, Homo sapiens
tcagcgcaactttaacatctgtgctgcttccccatcgggaagcaagtgatgatgatgccagttcgctgagctgggcaaaacttgcattttattaaagtcgwcaagtatgtaagcttgttaaaaagcaattatacaaaataatatagccacctagaccaaagcttgaccctaactaaatgcctcggcctcccaaagtgctgg

SEQ ID NO: 32100 - DNA, 201 bp, Homo sapiens
aataagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatc

SEQ ID NO: 32101 - DNA, 201 bp, Homo sapiens
tataaaatggtgcagtatttgcatataacctacacgcattctcctgtgtactttaaatcacctctagattacttgttatacctactacaatgtaaatgctrtgtaaatggttgctatactatattgtttgtttgttgttattgttgttggattgttattttttattgtgagtttcttttttctgaatatatttaatccagg

SEQ ID NO: 32102 - DNA, 201 bp, Homo sapiens
ataagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatct

SEQ ID NO: 32103 - DNA, 201 bp, Homo sapiens
atgcagaaggctgacctctcaactctgcattgctaacatagttggaagggttaggaagccttgtgatttctggatgtaaaagaaaaagaaatgtgttttaraaaaacagtattcaagttctgctgcgaaaatcctttcaaaataattgagtctatttaaaattcaactggttgtttcacagcattgactatacttcagtta

SEQ ID NO: 32104 - DNA, 201 bp, Homo sapiens
taagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatctg

SEQ ID NO: 32105 - DNA, 201 bp, Homo sapiens
actgttccaaaaaaattgaagacaaaggaatttttcctaactcttccaatgaggccagcattgccctaataccaaaaccagacaaggacacaacaaaaaawgaaaactaccagccaatattcttgtggaacgtagatgcaaaaaatcctaaccaaatactaacaaactgaatccaacaacacatcaaaagataataaacca

SEQ ID NO: 32106 - DNA, 201 bp, Homo sapiens
gtactgtttggggagatattctcaaaccaccttcatagtttaagaatatatcgatttcccataagggagcttcagtgagaagagaatgtcagttcctgggrgagtctcaggagatcgctgccactttttgagagactaaattgttgggcccaggaatgtgggacaagagctttggcctgaaaactgcccgtgggcctgcca

SEQ ID NO: 32107 - DNA, 201 bp, Homo sapiens
cagatggtttggtttctagagcaaagggtttttggatttctcttttttctaggtaatgctttacgtccagttctttcttcattatttagaaaagccttaattttttttttttttttttttaagaaaagcgtcaggcagtttgctgactagaagaaaaagttgtagaaagaaaaattctattatatgaatcatttcatgttt

SEQ ID NO: 32108 - DNA, 201 bp, Homo sapiens
tttcatcaaaaaggcctttcccccaaataacattccatgaaagtcacaagtttcacatcagcgtttcatatcacaaattaacctcctttccaaatttctctttaagttttaatcctcttgtttaagtggctttatttcttaaggtttgaagtgcctttattcacattgtatagactcgaacattcctcaaataaatttacc

SEQ ID NO: 32109 - DNA, 201 bp, Homo sapiens
ggactgcaggcgcctgccaccacgcctggctaattttttgtatttttactagagacgagatttcaccatgttagccaggttggtctcgatcttctgacctygtgatctgcccacctcagcctcccaaagtgctgggattttaggtgtgagccaccgtgcccggcccctctacccttttattcactgcagttttctctgcct

SEQ ID NO: 32110 - DNA, 201 bp, Homo sapiens
aggcaggcttttgatagcaaaacaaatagtcctgtggacagatttgggttttgtagggaatttatgatttttgaagttgcatttcattgaacctctttccttttttttttttttttttttttaaagacaacgtcttgttctgtcgcttaggctggagtacagtggcacaatcatggcttattgtagcctcaacctcccggg

SEQ ID NO: 32111 - DNA, 201 bp, Homo sapiens
ggcaggcttttgatagcaaaacaaatagtcctgtggacagatttgggttttgtagggaatttatgatttttgaagttgcatttcattgaacctctttccttttttttttttttttttttttaaagacaacgtcttgttctgtcgcttaggctggagtacagtggcacaatcatggcttattgtagcctcaacctcccgggc

SEQ ID NO: 32112 - DNA, 201 bp, Homo sapiens
tttaatagttaagaggtgggggaaggtagcctaatgggttatgccagccacttatctttaggatagtctggataaaatataaagtactatttctcatgtcstctgcttatgctgggtccccatacaccatctgaactaatggactttttggcatcatctccttaaatgcatcatagggaatgaatttctccaccaagaagc

SEQ ID NO: 32113 - DNA, 201 bp, Homo sapiens
tctaataggtgggaactcttacctctctcatccacttagccccccaaaaaagacagttaaacttgaaagctaccagactgtgaaaaagtaaataagaaccmctggccagggagagggcttcagccttagatgtttacaagggcctgaagcagagaaagagatagaaaatatgtaaaagcaaattttacctgcttggaaagt

SEQ ID NO: 32114 - DNA, 201 bp, Homo sapiens
atattgctcttgtcctgcataatgtaagctaacattggcaaaattgatgggggaatgcttcaaggaaagaatttcgtttaacaaacagtagtataattttrtggagactgcaaatgattcttaaactggagtgctatcaaggagcctgaatgcctcccctctaaatgtagtatatcatgcaacaatataattttttaaata

SEQ ID NO: 32115 - DNA, 201 bp, Homo sapiens
gtctatttaaaattcaactggttgtttcacagcattgactatacttcagttaaatacataaaggaaggaaggttatggctaaactgagagatgggaagtgrtgatgctggtcttgtcttcctccctcccttcatttttccctccctgcctttaaaatttattaagcagcgactgtgtgccaggtcctacactcaaacctgg

SEQ ID NO: 32116 - DNA, 201 bp, Homo sapiens
gctaccggggaaaatgggcttgggcatggaagccagcggctttctatcgggatatttctgggaaaagctaacatagtgacctggataatccagggggaggygaagccagctttttatctgatgacaaaatgttctttcacatcggttgtatgtggttttaagcctggaacagtatctgtttggaactgacgtcccccttca

SEQ ID NO: 32117 - DNA, 201 bp, Homo sapiens
ctgtttctaatatttttttttttaggctaggctgacagcagtgttcttttcttcccttttttcactgaaattgtatacttgaggagatctcttacgggcartttttatccagccttaccctaaagtgttttctctggaggtgccatccaaggaaaggacagagagccacttccagacccaaacttcagggaaaaagagtca

SEQ ID NO: 32118 - DNA, 201 bp, Homo sapiens
aaacaaatagtcctgtggacagatttgggttttgtagggaatttatgatttttgaagttgcatttcattgaacctctttcctttttttttttttttttttyttaaagacaacgtcttgttctgtcgcttaggctggagtacagtggcacaatcatggcttattgtagcctcaacctcccgggcccaagtgatcctcccatc

SEQ ID NO: 32119 - DNA, 201 bp, Homo sapiens
tcatggtcacttttctccttaacacccttttgagatttccttttgagcttcagataaatgcaagctccctatatcaaggcccacagggccctgcatgatcrggctcttatctcctagaccctctcctgccactctatcttcagggctggccttctttcacttcttggatacaccatcctctgcctcctgagggccctccca

SEQ ID NO: 32120 - DNA, 201 bp, Homo sapiens
agtctcatgctgtgaggaaggaaggctggatgaatataaaagcatgtgggcaatcggtggtgctattgagcagatgtgcagtgtagtgaggatcagttagtttttttttcagccctgccctcttcatctgccctcctggtgctcagcctcctcagccagcccattcccagtgccacctaggcagtattatagtcttctagg

SEQ ID NO: 32121 - DNA, 201 bp, Homo sapiens
aataatgataggccagcaaattaggaaacctagaggaaatggacaaattcctggaaacaaccaccaagattgaaccaagaagaaatagaaaacctgagcarattaataataagtaacaacattgaatcagtaataaaaagcctcccaacaaagaaaactccaggaccagatggctttattacttgaattctgccaaatctt

SEQ ID NO: 32122 - DNA, 201 bp, Homo sapiens
cacttgaactctggagttcaaggctacagtgagccatgattgcaccactgcactctagcctgggtgacagagtgagactgtctcaaaaaaaaaaaaaaaaragagaatgaatgacgagtcagtaagtgcctgagggcctggcccaacagatgaccacttatccaccaccctgctaatggtgttcacatgcacattccactt

SEQ ID NO: 32123 - DNA, 201 bp, Homo sapiens
acgctcttatgttcccctaaacctctcatctctcctcagcccatgaggatcagggcctttgaactgtgagagatcaggactgggaggtagacaccaggcaygagcaggtagtaaaagaacagccccttagctctcaccaggccttacctctccacccccaaagctgaacatgtctgccatcttgaggtacaccacattccc

SEQ ID NO: 32124 - DNA, 201 bp, Homo sapiens
tatggtggcacatgcctgttgtaccagctccttgggaggctcaggcaggaggatcactgaagcccatgtggcagaggttgcaatgagccgagatcacaccmccgtaccccaccctgggcgacagagtgagaccccatctcaaaaaaaaaaaaaaaagttttactttgacctaatgttctgttgttaacagctgtgacctta

SEQ ID NO: 32125 - DNA, 201 bp, Homo sapiens
tcaggcaggaggatcactgaagcccatgtggcagaggttgcaatgagccgagatcacaccaccgtaccccaccctgggcgacagagtgagaccccatctcaaaaaaaaaaaaaaaagttttactttgacctaatgttctgttgttaacagctgtgaccttaaggctgagttaacttaaccttttggtgccttattttccac

SEQ ID NO: 32126 - DNA, 201 bp, Homo sapiens
tggccaagagccaggacagaaaggagcacacacctttcatcttctctctttgactactttttgttttgttggttggtttggctttttcttttcttttaaaygcagttagctgaggcacaagaatcgcttgatcccgggaagcagaggttgcagtgagctgagatcgtgccactgcactccagcctggtgacagagcaagac

SEQ ID NO: 32127 - DNA, 201 bp, Homo sapiens
gtcatggactgcttctgttctgcatcttcccttactccttaactcatccaaacagtcccacagctttacacccatctggaaagctccacatttgtatttgttttttttttttttgagacggagtttcactcttgttgcccaggctggagtgcaatggtgcgatctcagctccccgcaacctccgcctcccaggttcaagcg

SEQ ID NO: 32128 - DNA, 201 bp, Homo sapiens
gttattctgcctgctctaggtgctctggggaactgaagggaacaagctcccccatcacagttcctatttaaagctgccagcagccctttgttgccatgagwaaagggccacatccttggctcagttcacaatattctttgaaagatctttttcttttttaccacttccttgtacaccagtaattttagtcttcatagcttc

SEQ ID NO: 32129 - DNA, 201 bp, Homo sapiens
tgccagcagccctttgttgccatgagaaaagggccacatccttggctcagttcacaatattctttgaaagatctttttcttttttaccacttccttgtacmccagtaattttagtcttcatagcttctcctcccatactttgcctgtgttcctccctctttcttaagatgtttttcttttcctttgattcttgggggtcat

SEQ ID NO: 32130 - DNA, 201 bp, Homo sapiens
tctacacctagttgtagtttgtgttccttcagtaaaatttgtgcatggcccatcatggtctcttctctgtcaaattctcttctctagttcaaattcctgasagggtgggatctgactggcccagctcatctttttttcctccagccacatcttgggttgctgggaagcctttgggtcatgctaccttccctggttcagtta

SEQ ID NO: 32131 - DNA, 201 bp, Homo sapiens
gtctgggttttaattcttttaaggaactctcactgtgttgtaacatggaagtggtgttttcatgagtatttttttggtctttaaataccttgttgtacctrtaattattattttcccaagaatgggactgaaattgcatcaagatgaacaagccatggtgcttgtgggtgggtgtgctaactccgaactttaaaactacaa

SEQ ID NO: 32132 - DNA, 201 bp, Homo sapiens
acttaggatttatgtacttttctgtaggtatgtatattatataccaataaaaatatatttaaagtattatatacaaggaggttcactgaagccttgattgygatttggaagagcagaaaataaaagggatttattaaataaaccatagtatacatataatagactactacacacccctttgaaaaagagagaaactcaagt

SEQ ID NO: 32133 - DNA, 201 bp, Homo sapiens
aggcattttgcattcttgtgggtccacctccttgggaggtgaaaacaaattaaaataatgagttccttcattattttaataatgaagggtcaaggaagggrtttttttcccccaaagggaatatacttacccaggagagcattactccttaaattatgtggggataaactagagggattcaaaagaatgctgtttaaaaat

SEQ ID NO: 32134 - DNA, 201 bp, Homo sapiens
ggtggtgattagaaggctggctagggcctcatttcgtttcattggactgctgtgacacttgtttccttcatggtatttagacttcctgggttatttcccartccagactcatgttctgtttcatgagtgcccattgcacccatgcacttattgaggtgtgtttgaaagcagaatttaaaaatttgatctcagttattgaac

SEQ ID NO: 32135 - DNA, 201 bp, Homo sapiens
gcaccagatgctcatgcactgtgccactagctgaggatgcaagggtgtgcttttgcttttcaaaagaggtgctgtaaaaaatgagtgcatggttaagatgygggccatgtgaatgttcattacaagaaccttaactgtctgggtaaaacagatgaagttgtaagtaccactgaaatttcccagccctattcttgtatccat

SEQ ID NO: 32136 - DNA, 201 bp, Homo sapiens
attaaccaagccgcagctttgaaagtccagctcactgaaagaactacagcagtgtccattgggtagggatgcagaagtgaaccataggtaatccctgcctyttgcggtctggtggtaggaaaagatctgtgtgtgtgtgtgtgtgtgtgtgtgtgtgtacatatatacacacatatatacacatatatacacatataatat

SEQ ID NO: 32137 - DNA, 201 bp, Homo sapiens
tgaattcttttttcataggtctccaaaatcagaaaaggatatcagatgaggtaggagtcttggtggtaaggtgggacctctttggcctcagacagaaggtmtcaggagtagctccagcacatgagggagatgaaacctgtgtgtcttctcggttgagctcgtgtggcctttcttttctgtttttctgagccgctcctctga

SEQ ID NO: 32138 - DNA, 201 bp, Homo sapiens
gtgagttagaatatttagtgtactcctaacctaacctttgggacatgtgcaataaataattgatacagtttatgcttccattttgagaattcgtagtgatyggtgttcaaagtaacttttcattgtggcaaataatagttcagactcctttcttcttcttttttgtttttagatcatgtacaaaatgaagaaaactatgca

SEQ ID NO: 32139 - DNA, 201 bp, Homo sapiens
aagttttctactcttacaaaggaactgtccacactgctgaaaaatctggtaagacatttcatatgtgagtaaaaagaattacagcctttccaaaatattaygtcatatagagaacatttcaataatccttccccctcaatccttggtcctaggggtgagaaagaaaaaacaaaaagctttttagtcctaggtaacttccac

SEQ ID NO: 32140 - DNA, 201 bp, Homo sapiens
gcctcaagtcctgacccagcaccctcttttattttagccattatagacaacaataaccagggattaaatatttcacttttttcttagtttgcatttctttrtgcatccagtgccccaactcctggggagttggatccatctctgaattccactggtaacttttacctttagtaactgatctcagcacagctgtggcttcat

SEQ ID NO: 32141 - DNA, 201 bp, Homo sapiens
gaggcgaaagatcacttgagcccaggaggttgaggctgcaataagctcatgactgcacgtcagcctgcatgacacagtgagaccctgtctctaaaaaaatkaaattaatttcatgtgttccttttaacttttttcctgtggctgctgacaatttgaaactccatgcatgggttgcactgggttatatttctgttggccagc

SEQ ID NO: 32142 - DNA, 201 bp, Homo sapiens
aaagattagccagggcttttttagtattagtggtagaaacccaactcagactagcttacactaaaaaagaagtacagttgctcacattactaggaagtccragggttggactaacattaggcatgggatagatttttgtggatccagtggttcaaatgaggtcaccacgactctcccgcatctcttgccatcttttggtta

SEQ ID NO: 32143 - DNA, 201 bp, Homo sapiens
gaggttgcagtgagctgagatcgtgccactgcactccagcctggtgacagagcaagactgtgtctcaaaaaaaaaaaaaaaaaaaaaaaaagcagcagcarcagcaaccaactcttaggacatcaggggacagaaatggagagatgagataataaaggggttcttggcagatggggctcaggcacttggctactgctgctt

SEQ ID NO: 32144 - DNA, 201 bp, Homo sapiens
tgctcacattactaggaagtccaagggttggactaacattaggcatgggatagatttttgtggatccagtggttcaaatgaggtcaccacgactctcccgyatctcttgccatcttttggttatgatcattcttaggccagctctctgatgtgtggcaaagatggtcaccagtagctgaaggcctactaagtcttagagag

SEQ ID NO: 32145 - DNA, 201 bp, Homo sapiens
accaaaaccataggcagcacccaataaatgatagctactgttaccattattctcagcctagcattttgctggatagctagagatgggagaaacctgcattmgtttcctgaggctcctgtaacgcataccgcaaactggatgttgtaaaatgacaaatttattctttcagtattagaagctagaggtccaaaatccagcagg

SEQ ID NO: 32146 - DNA, 201 bp, Homo sapiens
aggctaagacaggagaatcgcttgaattcgggaggcggaggttgtggtgagccgagattgcaccattgcaccccagcctgtgcaacaagagcgaaactccdtctcaaaaaaaataatctccttgtctcaagatccttaacttaattatatttacaaagaccctttttcctagtcaggtcacatttacaaattccagggatc

SEQ ID NO: 32147 - DNA, 201 bp, Homo sapiens
tgatgattagccccgcccagtcccccatgctgacctttaagaaggaggtagaaggtggtttaagaaggaagtagatgttgcatttagccttggaagatgartggaataggcaggaggaaataagcaaggcagctgatgttgagtgttttgtgagaacgagggccagagatcataacctttaatgcatctacttcacagaag

SEQ ID NO: 32148 - DNA, 201 bp, Homo sapiens
ttacgtcatatagagaacatttcaataatccttccccctcaatccttggtcctaggggtgagaaagaaaaaacaaaaagctttttagtcctaggtaacttycacacctcaactaaaaagctttttagtcgcctaggatttgcttaaagaaaatcccattgtgaaattcctggaatttgtacctttggcccagctgatagag

SEQ ID NO: 32149 - DNA, 201 bp, Homo sapiens
tgcagtgaagattaaacaaggcagttcatgagagagcttagcactctgtacctggtgcatggtatatagtaggtcctctgcactgtgcctggttcatagtmgatcctctgggctctgctgtcctctcagatggcctcattttcaggcaggctttctccccttgatggtctctactggttctgtgcttacagactcctggct

SEQ ID NO: 32150 - DNA, 201 bp, Homo sapiens
tctctgatatggcctccttatttgttttaaaagcatttttatgtttatttggataatatttagaaaatataatagatttaaacataattttaaaagcatcraaatgcttacgtttctctaattgtgcaagaatctttatatacatagtttttttttttaactgaagttgcatcctgccagtaaaatttgaacgaattgctt

SEQ ID NO: 32151 - DNA, 201 bp, Homo sapiens
accccagcagcctctcatgaagacccactgaaggaatgggacaagagtggaggtaggttggtacatcacagactcatggggcagcatctgcaagacccttytatgatttatgcagaggaagcctggcttggagttttttagaccacccaggtcaggatcttagttctgccgcacactgtcttggacacgttatttcatatc

SEQ ID NO: 32152 - DNA, 201 bp, Homo sapiens
ggaggtaggttggtacatcacagactcatggggcagcatctgcaagacccttctatgatttatgcagaggaagcctggcttggagttttttagaccacccrggtcaggatcttagttctgccgcacactgtcttggacacgttatttcatatcttgtgagttatgatttttttcatctataaatctggcccagtgtctccc

SEQ ID NO: 32153 - DNA, 201 bp, Homo sapiens
gactcatggggcagcatctgcaagacccttctatgatttatgcagaggaagcctggcttggagttttttagaccacccaggtcaggatcttagttctgccrcacactgtcttggacacgttatttcatatcttgtgagttatgatttttttcatctataaatctggcccagtgtctcccttgcaggattgttgtgtgagtc

SEQ ID NO: 32154 - DNA, 201 bp, Homo sapiens
tttgcattctggaatatttccaaaagcattgctattgatgttgaattccactttggggttggagattaggaaatttttggaagtgttgaagtaaaattagwtgttctttgtattattttttatttgacagtgtacaaataatgaaactgtaaactaaagtacaatgacataatcacagaaatgatcataaaaatggttatt

SEQ ID NO: 32155 - DNA, 201 bp, Homo sapiens
atccttttacttgaagaaagtgataagagaagtagaaagaaaatcaggctgagattaactaaggaagcagcctttttattctactttcagccattcagaaragggaaaaaatccagagtttctaataagaaaacgaaaagttgttttgcattctggaatatttccaaaagcattgctattgatgttgaattccactttggg

SEQ ID NO: 32156 - DNA, 201 bp, Homo sapiens
tttttgagacggagtttcactcttgttgcccaggctggagtgcaatggtgcgatctcagctccccgcaacctccgcctcccaggttcaagcgattctcctrcctcggcctcccaagtagctgggattacaggcatgtaccaccacgcccatcaaattttgtatttttagtagagacaggggtttctccgtgttggtcaggc

SEQ ID NO: 32157 - DNA, 201 bp, Homo sapiens
ttctggctaaaattaccatttaggtgataaagtgtgtcctgttgcctgggtattgtgccattcatgtctatgcttgccttttctccttaccagattgtaartgcatgaaagaatccaagccttaagatttcttcagtgtcttgtactgtctttcttgtgcatagcttagcatgataattgactgactaaaatgctatccat

SEQ ID NO: 32158 - DNA, 201 bp, Homo sapiens
actgattgtctagtggcctgatgactgaatccttgttgttgtttttttttaagggtcctccatcttttgaaccccattgtgtcaggttgaagggttggagwgcaacatggttatgaatatagaccttgagatcaggaagacctgctttggaatcctggctctcttattagctgcatatcttagggccattctgatgttcaa

SEQ ID NO: 32159 - DNA, 201 bp, Homo sapiens
ctgacctgcttgggtggcacaaccccagtgacctgcaagttgactccttcccactttgctttttatctcaactactctttagctgttttacatagagcctsctggaatgggaagaaaaaggtctttgaaactgattgtctagtggcctgatgactgaatccttgttgttgtttttttttaagggtcctccatcttttgaac

SEQ ID NO: 32160 - DNA, 201 bp, Homo sapiens
aagggttggagagcaacatggttatgaatatagaccttgagatcaggaagacctgctttggaatcctggctctcttattagctgcatatcttagggccatkctgatgttcaattttcttatctgtcaaacataggtaatagaaaccttcttataagttactgtgttgattatataagatgatataagattaatggcaatgt

SEQ ID NO: 32161 - DNA, 201 bp, Homo sapiens
taagatgatataagattaatggcaatgtcacattgtcattttatcatcatcaatactggggagaaaagagacaagaatgaaccaaaatcagactctgaggmccattggggaaaggaggaaaagaagcaaacacatgtctgtgccaggtattatatgagaaaggtgttaacagtacctttagtatcagagagagtgactaac

SEQ ID NO: 32162 - DNA, 201 bp, Homo sapiens
ctttccccctctcaaattccatttcatgccttcataaactcctttttctttgtttttgagacagggtcttattctgtcacccaggctggagtgcagtggcktgatcatagctcactgcagcctccacctcacaggctcaagctatcttcccacctcagtctcctgagtagctgggactacaggtgtgcaccaccatgccca

SEQ ID NO: 32163 - DNA, 201 bp, Homo sapiens
ccttttccattggagagttacaacaaaaaagcaaaataaatctatcttttctctgatatggcctccttatttgttttaaaagcatttttatgtttatttgrataatatttagaaaatataatagatttaaacataattttaaaagcatcaaaatgcttacgtttctctaattgtgcaagaatctttatatacatagttttt

SEQ ID NO: 32164 - DNA, 201 bp, Homo sapiens
tgtgaaaatgtacttatgattcttccatgaaaacctaaagtattaaaaacccaacagttcacttgtgttctttcatgaacaggtatgtgcatgctatgatkgctttcatttgccaagtcattttttaatttaatgagctgtcactctgctgtcattggatcagttgtagatgaggggacaccttttggccttcatttgatg

SEQ ID NO: 32165 - DNA, 201 bp, Homo sapiens
ttctactttcagagtagcctgttagaaaggatgaaaagctctgaattttctccatttttttttaatgtgatactagagaggaatgatacttcttcctggtwgtgtggaaagctacatctaggttggttataattttcattttaactcttcctccttcatacagccctagacttctcagtgtttaaatctaggtgtcaggcc

SEQ ID NO: 32166 - DNA, 201 bp, Homo sapiens
cccaacccctgccatctgtagaaaaactgtcttccacaaaaccagcctctggtgccagaaaggttggggactgctaatataaaggattcctgaaagaactrtagaagtgaaaacacaggaaatttgtagaatcccatgactgtgaagtcatatactccatcttcgtggcacaataatcacctaaaataactgagagaatag

SEQ ID NO: 32167 - DNA, 201 bp, Homo sapiens
atgagacacagactcaggtttctaacctggcacatagttgatgtttataaaagttagttcccatctcctctttttagttgtaggttttatattgattattkgttcaagagaggcaaaaggttgtaaatagctcagggtcgctttagttatggacgcccctaactattttagtggaccggtttcctgcttaacgctctatgt

SEQ ID NO: 32168 - DNA, 201 bp, Homo sapiens
cattagaacctctgtcctccgtgccagtgaactggaaatttaaggcggatgtgatgatgatgagtctaacaaaaagctgtcctcatcacatacccagtccyccacaaggtttttgtggatacagtcagtgcaatacccactcttaggccatctagattagttcctcacagattctggggatttcctacatctgatgagttt

SEQ ID NO: 32169 - DNA, 201 bp, Homo sapiens
acacattcggttggccattttaatctcttctcagggatgggttttgtccattagaacctctgtcctccgtgccagtgaactggaaatttaaggcggatgtsatgatgatgagtctaacaaaaagctgtcctcatcacatacccagtcctccacaaggtttttgtggatacagtcagtgcaatacccactcttaggccatct

SEQ ID NO: 32170 - DNA, 201 bp, Homo sapiens
tttgagatcttggatcattattactaaatttccaggttttatggatagaattttgtttttaaaagggatttgttctttagggcccccaaattttcaagacrccctacacattcggttggccattttaatctcttctcagggatgggttttgtccattagaacctctgtcctccgtgccagtgaactggaaatttaaggcgg

SEQ ID NO: 32171 - DNA, 201 bp, Homo sapiens
ctaatttttgtattttgagtagggacgaggttttgccatgttacccagcctggtctcaaactcctgatctcaagtgatctgcccacctcggcctccccaamtgccgggattacaggtgtgagccaccactttcgccggacctgggttttttaatgggccttggtctccattttcacatttcttcttcctgggtcatccaga

SEQ ID NO: 32172 - DNA, 201 bp, Homo sapiens
acagcttcaccctctcaggcatgtggaatcattgagctaagaggcagtgtcatctcttgccctgagactcttttgagttgtctcatttgcccatttatttrtttactctcagctactatttctccttctctccattaatctccaaacttttttgaagggacattagaatcaccactgtgctggtctagattacaagcagca

SEQ ID NO: 32173 - DNA, 201 bp, Homo sapiens
ctcagaggtactttctgttgtccctgcgtaattttctcctttgtgggtaactttaaggctagtggactaagctcaggcagacccacatctgagcttagtcyagcctcaagtcctgacccagcaccctcttttattttagccattatagacaacaataaccagggattaaatatttcacttttttcttagtttgcatttctt

SEQ ID NO: 32174 - DNA, 201 bp, Homo sapiens
ccctcttttattttagccattatagacaacaataaccagggattaaatatttcacttttttcttagtttgcatttctttatgcatccagtgccccaactcmtggggagttggatccatctctgaattccactggtaacttttacctttagtaactgatctcagcacagctgtggcttcataccctgggtgaccacatggcc

SEQ ID NO: 32175 - DNA, 201 bp, Homo sapiens
tcattcttaaccatggttacacagagagaaaatgctattatctcaacttcggggcgcagaaaggttaagtgatttacactgtttctcacagctagtacgtsggggccaggattcacctgcagcctgtgtggctgagagccagccctcctcaccctctccacgcaccactctgtgctcgcaaaatgcaggcccactggccat

SEQ ID NO: 32176 - DNA, 201 bp, Homo sapiens
accatacctggcacatagtaggttttcagtaagtggctaaaaataatagatatatcagaaacttgttagcaggcagtgattttctaagttaagacaggtascaaattatttatgatatctgttccagtaaagccttggctcattattttgcttttatttatttttaatcagtattggaacattgttggtactcgctcagca

SEQ ID NO: 32177 - DNA, 201 bp, Homo sapiens
caccttatcacagaatgtaagccgccccactaaaatgtaagctccatgagagccagaaccttgtcttggtcttgttctcaccagtgtttactggaaccacrcctggcatacagtgaatattcaggaatcacttgagaatgaataaatttgcccagagtcagcttgttaatcatttcagtgacattgactgcacatgacaaa

SEQ ID NO: 32178 - DNA, 201 bp, Homo sapiens
ttaacagctgcattgctaaattacccctccctcccagtggctgcatcctacatcacagtctgcatgtggtctctgtggttcattgtcactggttcccaaaycaaaggaagccattggtcttgttgagtggtgacgcttatcttcataaatcctggctgtactgggcgcatcccttttagtttattttcagcccagccctca

SEQ ID NO: 32179 - DNA, 201 bp, Homo sapiens
agtttataaggaagagtttggcctacacaaacaagagtttttcaaaatagaagatgctttgtaaagtatacatatattagccttcgctagtaatggtgatkctaacttgtatagctaatgcatcctccctttattctcttattctttgctttttccctttccacaaatatgtattagtcttttaccaaagatcagctactg

SEQ ID NO: 32180 - DNA, 201 bp, Homo sapiens
ggttgggacttgggctttttttttttttttctgagatggagtctcgctctgtcatccaggctggagtgtagtggtacattagacaattttgatatatgtawacaagtagttaaaaaattggttgggacctgtgcttttttttttttttctttcttgatggagtctcactctgtcacccaggctggagtgcagtggtgtaat

SEQ ID NO: 32181 - DNA, 201 bp, Homo sapiens
gtagctgtattaccaagaaaaaaggaagctagcacttggaagttagggagaatgggaatgatggatgggcagaagtgttgtgaattggtttgggtgctcartgttgctttttttcttttgcattttccaatttcctctgtacgccatacactgtaatagtcattccatttaaaattgcagctgggtagaccagatattgct

SEQ ID NO: 32182 - DNA, 201 bp, Homo sapiens
tgttgttgaaataaaatcaatggctgctgctaagtcaaccatgagcataaaataccaattctaggcctgttatttgtagaatcctttcatggactagacarttttcatatatatatacaagtggttaaaaagttggttgggacttgggctttttttttttttttctgagatggagtctcgctctgtcatccaggctggagt

SEQ ID NO: 32183 - DNA, 201 bp, Homo sapiens
ttttaatgcctggtaatctattaggcagtaggataaaaagatgccctcaaggatgtctctcaaggctagaggggagatgcttattgtttatcaaagatctrctgagtgcctagcattgtgttatgggccttacatacatagtatgcctaattttaatatagtatgataaattctttgcaagtgatgtctgcaaaggactat

SEQ ID NO: 32184 - DNA, 201 bp, Homo sapiens
tgccacccccaccagactataagctcctaatggacaaggtcactgatggctgctcatctgctaaagttactccagtgccaggcacagagtctggtacatasatgttcagtaaatatgtattgttgttgaaataaaatcaatggctgctgctaagtcaaccatgagcataaaataccaattctaggcctgttatttgtagaa

SEQ ID NO: 32185 - DNA, 201 bp, Homo sapiens
ccaaacttcagggaaaaagagtcagctcttatccagagtttctgaaagatgagaaaacaaaatctctctttttttgagatagggcctttctctgtcacccrgactggagtgcagtggtatgagcacagctcactgtagcctcaacctcctgggctcaagagatggtcctgcctcagcctcccgagtagctggaaccagagg

SEQ ID NO: 32186 - DNA, 201 bp, Homo sapiens
ccagctgttcacatagtgccacaacactcaaatccaaggacaactcttagaggaactggagtgcagggagaattattcattacatctgctcagaaagataragtgccctaccaacacctttgcaaattgaaattcccttgctcttggcatgtgatcatcctgccaactctgtgaaagctcccttagctactcagatgctgc

SEQ ID NO: 32187 - DNA, 201 bp, Homo sapiens
gtatgttttcttcctagcagttgtaacaatctggaattgtttgttctcttgtgtatgtctgccacccccaccagactataagctcctaatggacaaggtcrctgatggctgctcatctgctaaagttactccagtgccaggcacagagtctggtacatagatgttcagtaaatatgtattgttgttgaaataaaatcaatg

SEQ ID NO: 32188 - DNA, 201 bp, Homo sapiens
atgtaatggcagcatacacaacatgccgcagtgtgctatgtacacttttatcaccgttccttttgtggatgaaaagctattaagcagaatacaggaaaacrctgggttcttaatgggattaaagcagtggggctgggcacggtggctcacacctgtaatccaagcactttgggaggcccaagctggaggatcacctgagtc

SEQ ID NO: 32189 - DNA, 201 bp, Homo sapiens
atgttttgttggggacgtgtgtgggagtgattcatttccagctgggtccagctgtaatgaaaatgtcctgtttgacaaattgaggaattagattacaactrtctctccctgaaagctgtgacactagctgtaacatcaaacatccctccctttgtggggcaggacaggagggaaatggtgattcagggctgctggatgtgt

SEQ ID NO: 32190 - DNA, 201 bp, Homo sapiens
tcagaaggatggatctaagagcaagatgacattgtgatgtcaactaaccttccagagaatggtctaaggggtaatagggccctactcgctctttccactcraaatagccatgccccctttccttaactttggagcccacaacacttaagattagctgacatttaatatgtgtgcctgctaggttccaggctctttttatat

SEQ ID NO: 32191 - DNA, 201 bp, Homo sapiens
gtcaggcccagaatctgcctcccaactctttttttccatctctttttccactagggtggttgtatgctctttaggcactgttgatttctggctttgaatcrtgatctcttcatatttcagtatgcatgaataataggacaatttcatgcattcattttgctatttctgagtagaagttagtgtgaccaaccaagttttaat

SEQ ID NO: 32192 - DNA, 201 bp, Homo sapiens
tagctatttgtgattgtccctattgtaaagatatgtaaagtatggtctggggttccctgtgggaagtcccaggatccttccaggggttctgagagatcaaractatttttatactaaggtcaagacattttttgcccttttctctcttattctttcataaatttatagtttatgagactggagctgtttgggagaagtagt

SEQ ID NO: 32193 - DNA, 201 bp, Homo sapiens
gcccagcctgtactgagtactttacataggctgtttcaaactctcacattaccctgctagtacctgagggaggtgggaatcaaatctgggtttgcctggcyccatagcccccacctccccactgccaccctgccttgctttggtattagtgatttagctgcaaagtgcaagtaaacggaagagaatctggttagcatttac

SEQ ID NO: 32194 - DNA, 201 bp, Homo sapiens
tcccagctacttgggaggctgagggaggagaatcaattgaacccaggaggtggaggttgcaatgagccaagatcgcgccactgcactccagtctgggcaaygagtgaaactgtctcacaaaaaaaaaaaaaaaaagaaaaagaaaaagaaaatgtcttatggctacagcattgtgcctggtagacaggataaggtcagaga

SEQ ID NO: 32195 - DNA, 201 bp, Homo sapiens
gtgtgtgtgtgtgtgtgtgtgtatgtatttctgtgtgtgtgggggggtgtctgtgtgtgcttatgtctgtgtctgtgtgtgggtctgtatgtgtgtatgtrtgtgtgtgtctgtgtgtatgtgtgtctgtgtctgtgtatgtctgtgcgtatgtgtgtatgtctgtgtgtgtatatgcctgtgtatttgtgtatgcgtgtg

SEQ ID NO: 32196 - DNA, 201 bp, Homo sapiens
gtgagagtagagggaaaagcacggttagaggagcaagttttccccacacagtgtctgacaggcttctctacttaaaactggaatacggactccggctccaytccagactgttccttcctcagtgtccccgtctgttaaaggcagtgtcattcttccaggtgttcaggccttaaagcctgagagaggtgcttagctcttccg

SEQ ID NO: 32197 - DNA, 201 bp, Homo sapiens
tccaccgttgtcagctaggatcaaatgagcatcatctcttgtctggacagttggagcctcctaccctgtctgcctggagccttctaacctggtcctgcagkctgttctcaacagaacactggagccttccacattcaatcatgtcactcctctgtcctgaaccatctggtggttcttctcgcaacccccaccagatatcag

SEQ ID NO: 32198 - DNA, 201 bp, Homo sapiens
ctccctcggtatcttggaagatggggatgatggtgatatccacatcgcggggctcttaggaagatgaagctacgtcatgcagcaggtctcaagaaggccartctcctctctttccctgccctgtagtcccatctctctcctgcccagagttgagtcacctgggccagtgtaccctgaggccctggccagccttgcctcttc

SEQ ID NO: 32199 - DNA, 201 bp, Homo sapiens
gccgggcacagtggcttacgcctgtaatcccagcactttgggaggccaaggtggggggatcacctgaggtcaggagttcgtgactagcctgaccaatatgrtgaaatcctgtctctactaaaagtacaaaaattagctgggctgtggtggcgtatgcccataatcctggctacttaggacgctgaggcaggaaaattgctt

SEQ ID NO: 32200 - DNA, 201 bp, Homo sapiens
tttttagagatgaagtctcactatattgcctaggctggtcttgaactcctagcctcaagctatccttctgcctcagcctgaattaccctgtagtttaaaargcatccccagtttcccattttgacaatgcatatagaagtcttcctgatgcttcccttatttgtttttatctaattctgttaatgtattcatcaacagata

SEQ ID NO: 32201 - DNA, 201 bp, Homo sapiens
aggcctggttgactctgttccactcttaaaaccaccttcctctctatcgatttggcattggaagccaatatgcacgattttgttttttctattgaaggccyattacatgattctctttagtgcaatcaatactaatctaattgaggtaattagaaaatttttacaggtaactggcttacaggccaatgcagcagacaataa

SEQ ID NO: 32202 - DNA, 201 bp, Homo sapiens
gctcagcgcaactttaacatctgtgctgcttccccatcgggaagcaagtgatgatgatgccagttcgctgagctgggcaaaacttgcattttattaaagtygacaagtatgtaagcttgttaaaaagcaattatacaaaataatatagccacctagaccaaagcttgaccctaactaaatgcctcggcctcccaaagtgct

SEQ ID NO: 32203 - DNA, 201 bp, Homo sapiens; identical to SEQ ID NO: 6127

SEQ ID NO: 32204 - DNA, 201 bp, Homo sapiens
agggtcagtgatgaggtcagatgacagagaaatgaagtcagatgtgtatacttcagggacccggactggggaggcacagatgggactaaggagaggactarggcaacaccaaacactttgaccattgtgggtcatggtcatagccaatttgatctgaagcagactgtcaactcagtgtaactgtataatcagcccttagtg

SEQ ID NO: 32205 - DNA, 201 bp, Homo sapiens
agcatttctcataacatgtcatggacagccactgtgcacttgggagctagaggtggagctggcacacagggtgacttggtgcacgtacaatgtgagtgacwgagaagaaagcagagtgtgcatgtctgtgtgtgagcacagcagcccgtacacaaacacttgagctcctgaacaccagaattaaagctcagataaacagct

SEQ ID NO: 32206 - DNA, 201 bp, Homo sapiens
tctccgtgaaacaggctctctcactctgtcgccgaggctgcagtgcagtggtgcgatctcagctcactgcaacctctgcctcccaggttcaagcaattctstcacctctgcctcctggggcagctgggactacaggtgcacaccgccatgcctggctaatttttgtatttctaatagagacgcagtttcatcatgttggcc

SEQ ID NO: 32207 - DNA, 201 bp, Homo sapiens; identical to SEQ ID NO: 6128

SEQ ID NO: 32208 - DNA, 201 bp, Homo sapiens
cccttctctccgtgaaacaggctctctcactctgtcgccgaggctgcagtgcagtggtgcgatctcagctcactgcaacctctgcctcccaggttcaagcrattctctcacctctgcctcctggggcagctgggactacaggtgcacaccgccatgcctggctaatttttgtatttctaatagagacgcagtttcatcatg

SEQ ID NO: 32209 - DNA, 201 bp, Homo sapiens; identical to SEQ ID NO: 6129

SEQ ID NO: 32210 - DNA, 201 bp, Homo sapiens
atgagtgtagttcagtgggaagccaatgatgggttttaagcaggagagtgatataatctggtaatcactttaaaagatcgctgtaacagcagagcacagasgaaatgagagtggcctttggagtcagtaaaaaccttaattaataacctgatcatctgctttactcactgtttgaccttgggcgagttacttaacctctct

SEQ ID NO: 32211 - DNA, 201 bp, Homo sapiens
gttcgagaccagcctggccagcatggtgaaaccccgtgtctactaaaaatacaaaaaattaactgggcatggtggcacgcacctgtagtcccagctactcrggaggccaaggcaggagaatcgcttgaacccgggaggcacaggttgcagtgagatgagatcacaccactacactccagcctgggcaacagagcgagactc

SEQ ID NO: 32212 - DNA, 201 bp, Homo sapiens
aaacctgagggctaaagaggctcgctgacaagggtgaagctctccataggggtggaattgggactggaacttttgatgttaggcccagtggccttcccccygaccccagcagcctctcatgaagacccactgaaggaatgggacaagagtggaggtaggttggtacatcacagactcatggggcagcatctgcaagaccct

SEQ ID NO: 32213 - DNA, 201 bp, Homo sapiens
gaaagtgacatggagacagaggaagagtgttccagacagagtaaagcacgtgcaaagtgggagagatctctgtgggttgagaagccaaaaggagttgtagygcagtgagaatgggtagagggactcaaaacaggttggcagggccagagctaaattgggagcttggatatgagtgtagttcagtgggaagccaatgatggg

SEQ ID NO: 32214 - DNA, 201 bp, Homo sapiens
cagcagacaataaaattgccattcgccaccatcagtctcaaactttcacagtattcttcctccacggtaaccagaaaacaagtgatagtacatagcagccttttttttttttttttactggctagaacaacactttactcacaaagagaagagacagaacaagattagctttgatttgagtatggtaccccgcagtgggtc

SEQ ID NO: 32215 - DNA, 201 bp, Homo sapiens
caaagcctaacagctgcaggatgggaggggtacccttggtttgtcactcccaaccatatcctgggagcagttctaactcttctgtccctctcctgaatctwgccccttcccccattctggtgctgagcactccaggacgaccaaaactggttcaggttctataacacttgatgtttcagagcagtccttctgatttggaga

SEQ ID NO: 32216 - DNA, 201 bp, Homo sapiens
catagcagccttttttttttttttttactggctagaacaacactttactcacaaagagaagagacagaacaagattagctttgatttgagtatggtacccygcagtgggtcttgccaggcagctgacacagcttaatggtctgtatgcatcctacctgggctgtgggcaaagaaaccccttccttcccaactaggaatagg

SEQ ID NO: 32217 - DNA, 201 bp, Homo sapiens
ttgcatccatttcaccttgagagcttgttaaaacttaggttgctgggacccactcttggagtttctgattaattaggtctgggatttcataaccaacaagyttccaggtgatattgacactactgatttgaggaccacacttttgagaaccactaggaaggattgtcactctggacagagatccagaatttcctagtgtta

SEQ ID NO: 32218 - DNA, 201 bp, Homo sapiens
gccatatagcacaccccctccttttactttctcctttgtcttggtcttataaatcctagctacttcccctttccatataattatcgtcaaatgaaatcagrtgctgcagataatgcacagggaaatggtactttcattttcacttgatgtaggagatgatgttaaatctaacccaccatttactaaattgaattagataaa

SEQ ID NO: 32219 - DNA, 201 bp, Homo sapiens
acatgaagaaatggcccgctgatgcagtcttgaactagtatctgactacatctttcagtaaaaatgagtggatcttttcattgacatattgccacagataygttaagcaactgaaaattcagaaaattggcagaaatagcttgactttgaagttggatataattgagttctatctctgctccaccacctcccaagctaggt

SEQ ID NO: 32220 - DNA, 201 bp, Homo sapiens
cctcagacaaggccaccactccagatctggactgttgggaggtcctacagcccagcctggtgcttttttcagggctgatgttagccagcaccgggaaacaygggttagtgaggggagcatggctggacttcaggcttcccttgtacaagccaggtgggtgctttgagccatgtacaccctgcacagccgtacacagtggcc

SEQ ID NO: 32221 - DNA, 201 bp, Homo sapiens
cagccttgcctcttcccctcaagggtctcagactggtgccaacagtcacattgtcacaccaaagccaggagtgcggagagaggatgtggaacagggtctaratacctgaagctggggacagcatggccctgcacgtctctactaaaaaattaaaaattagctgagtgcggtggtacatacctgtggtcctagctactcagg

SEQ ID NO: 32222 - DNA, 201 bp, Homo sapiens
ggaacgagattcatgtaaattaacttttagagccaagccacctcagcagaagcttagggaccagcctgtgagcagggtgccccttgattttgacttttttrgagatatgactagacaggtcatgagcagaaacagccctagtacagcctgtgacatttacaacatgaggtttatctgtttcttctccttctttaagaatgt

SEQ ID NO: 32223 - DNA, 201 bp, Homo sapiens
tacaaagagctatggaaatgggtcaacaaattgatacatttcctaagctgtgcatactgtgcagccattaaacagaataaaaaagaactgatttggagctytcctaaacatagtaagtgggagaaaagcaaagtttcagactatgtatcccttgtatggtttttaaaagacatagcacacgcgtgtgtatcaccaaaatgt

SEQ ID NO: 32224 - DNA, 201 bp, Homo sapiens
ggggcagctgcccagatggctctgcgctcagcatactcgctgagagtgaattcaagattgtttgaaatgaccttgaagatatgatcacacaatgggcagcmcagcagaccctaggctcccttggatttcacattccacacttgcacttcttcccaggggaaccctgaagaaaatgtataatttgtggtggcccagactggg

SEQ ID NO: 32225 - DNA, 201 bp, Homo sapiens
ttcagaggctgctgtgtaaggccttcgggatccccagatttcatcaaaaaggcctttcccccaaataacattccatgaaagtcacaagtttcacatcagcrtttcatatcacaaattaacctcctttccaaatttctctttaagttttaatcctcttgtttaagtggctttatttcttaaggtttgaagtgcctttattca

SEQ ID NO: 32226 - DNA, 201 bp, Homo sapiens
aaggataggatttggaatcaaatgaagtgggatctaatcctttcttcaccactgagtttcatttttcttatctataaagcaactgccttgagggagtatcrcatgagtttcaggatattcactgtgattgaatccctctacttagtcagtgcttaataagtagcagccataattagagtcgctgagaatcaaaggttaggt

SEQ ID NO: 32227 - DNA, 201 bp, Homo sapiens
ttgttcctggtatttgtcatcaagtctttcacatagtggattctgaatagatattgtggcacacaatattctagtatccacgatagtctttcctgagtgtrtcagtggagaaggataggatttggaatcaaatgaagtgggatctaatcctttcttcaccactgagtttcatttttcttatctataaagcaactgccttga

SEQ ID NO: 32228 - DNA, 201 bp, Homo sapiens
cctgacatggtagagtctggagctaagacctggattttcaggtttctcaatcacttggcatctggctaaagttaaaagacttctagaggctcctgcacttwaccaagtacactagttaggagcacaggctttggggtcagtgcctgtcactactgcttcttagctgtatgacattgagcaacttgcttaactactctaaac

SEQ ID NO: 32229 - DNA, 201 bp, Homo sapiens
ctggagaggtttctccaattaagcgtttagcaagaaagaataactatttactgattctgtgatgcctcatttgggtatgcaagtcaagcagattgttgctrattctgaactggttttcattgataatcagtgccataagacagaacatttagaggttgatagaggatgactttgctcggctagtttgtctgttgcattcac

SEQ ID NO: 32230 - DNA, 201 bp, Homo sapiens
tatgtctcatcaaagtaggattgtattttcctgtataaagctgttgcacttaaactgtagcaaagaatctgccctctgaaaacaaccatgccatgacaacytctaacaagcagtcatatgtgtgtgtttagttttatttctagttcacatgtcaatgtgaatttttaagtgtatttttatgactggagaggtttctccaat

SEQ ID NO: 32231 - DNA, 201 bp, Homo sapiens
tatgatgtggaagtcatattttcaaaacacagctaaattgttataaacagttttgcagctttttcattacaaggaagacagccattgattttctcatttcsttacatttttgtctcccattccttttcagttagaattaagtagtagatagttttataacacagggtttgtgttttttaaggcaaaaaatgtgtggtgttc

SEQ ID NO: 32232 - DNA, 201 bp, Homo sapiens
aataaatgttagcttattggtaacacatggtgccccttagaatctataacattgttggtctgaaagttgaggcttgtaaatcctttaatatttctgggcargaaaaaaatgacagtggtatataattttattaccagcatatgatgtggaagtcatattttcaaaacacagctaaattgttataaacagttttgcagcttt

SEQ ID NO: 32233 - DNA, 201 bp, Homo sapiens
aaacacagtgagacatactgcacttttagaaatggaagcatgtggttcataataagcgtgggtatactgagttggctattctaccaaatgaattaggttgraaatgttaatctttttgagcagatacattctcacacaacacaggtacaggtatacacttctttctgggactaggaactcaggatattcctgctactaggt

SEQ ID NO: 32234 - DNA, 201 bp, Homo sapiens
ggatgtgttactacctgggaagctctctgagaccagctattaatattcactaatcatgaatattcatgaatggatccatcaaatggaaaatcccagcattrtaacctgtgggatgactttggtgtttcccagatgagaccaccaatagtagtttccatggtcatgtctcagaaatatagggacaaactcagatccctctgg

SEQ ID NO: 32235 - DNA, 201 bp, Homo sapiens
gggggggcgaaggggagggaggtaggcaggcccttcaccgcaaatggcttccttttgcccgtgttacatgtaggactttgtaagacttcctttacaactckcagtgattaattgagaggagtgtgcttcatccaggtcgtaagccctcataaatgattataaaatgatttcattattgatacgtgatgtgactgacttttg

SEQ ID NO: 32236 - DNA, 201 bp, Homo sapiens
ttaatgtgtttactatagaaaattcagatgagctaaaagaaaaaaaaataatagccactggtctttttaaaggttttttcccattgtttatatatttttcmagttaaaggtttttttggtttttttcattatttagattctttttctttttttttttttttaagacagggtctcactctgttgcccaggctggagtgcgat

SEQ ID NO: 32237 - DNA, 201 bp, Homo sapiens
ggagtaagtgttcagaaatttgattttcactttaacttgaaaggattaattttttttttcctctttcaagatcatagtagtacttgtatttgaaagactcyttgaacattttcagcgttaaaaatgctcttggaaaatgatcattggaaaaaatgtgcctcttcacataatggtattgacagaggaatgagattaggcact

SEQ ID NO: 32238 - DNA, 201 bp, Homo sapiens
agttgaattttaatttttcccccatgcttacatatgtggaagtagtgcattattataaatatcttaggtgggtcacaattcagttctttaaaaatatgggrcttaacattaccacactcaatataagaaaaaatttgggggcataccacaaaatcttgttggcatatgcttcacaactgagatatttggaaactttaagaa

SEQ ID NO: 32239 - DNA, 201 bp, Homo sapiens
gtaaagtagacatgaattggggatggattggatatgggggtgagggagatggtggaactgagatgtctctcggtttttcgccctggatggagatgccacaytgagctaggaatcactggataaaagccaaggaggtcccttggctcaatttatttttatatccccacctctgtttccctctattctgcaaatattgaagct

SEQ ID NO: 32240 - DNA, 201 bp, Homo sapiens
taagtggagagatctttaggaagtaaagtagacatgaattggggatggattggatatgggggtgagggagatggtggaactgagatgtctctcggtttttygccctggatggagatgccacactgagctaggaatcactggataaaagccaaggaggtcccttggctcaatttatttttatatccccacctctgtttccct

SEQ ID NO: 32241 - DNA, 201 bp, Homo sapiens
gtccagcatctctggtgaagtagagtgtttccaggtgcaatgtcttctttctgacaccacttctgactccaaatgtttggggttttctctataccaagcarttctccaattttcctacccgaactacatgttcaacaactgaatttaattctgaccctaactgtctggaattagggcaacccccacaattctgtgggctca

SEQ ID NO: 32242 - DNA, 201 bp, Homo sapiens; identical to SEQ ID NO: 6135

SEQ ID NO: 32243 - DNA, 201 bp, Homo sapiens; identical to SEQ ID NO: 6136

SEQ ID NO: 32244 - DNA, 201 bp, Homo sapiens
ttaatatttaaaattgcttttaaataaacatattctcagttgatcccaaacttctgaaatcaggccattttgtgagttgttcactaccctgctgacaggaragaatcaaggcttcctctggctgtgctttcgggtatatagatgacacaggtcactccaacccttgtcagagatcactctggatacataaaaatatgtggc

SEQ ID NO: 32245 - DNA, 201 bp, Homo sapiens
acttctttgtcctcttaatgactactttttttttgagggggtgggtggcggcggtacctgtaggtttaggttaatattaagctttctcattctatcttctrtgtctcttatcctcacttattatcctactttttctttctctgtgcttcattttaaggataatttcatcagatatatcttccagttaactaattctctcat

SEQ ID NO: 32246 - DNA, 201 bp, Homo sapiens
cctagatcccttgcatatgcagttcacagtagggttccgtctcctatgagagtctgatgctgcccttgatctaacaggaggcggaactcagcttcgctcartagcccgcaactcactcctgctgtgtggcctggttcctaacaagccacagacctgtaccggttcgtggcctggggactggggacccgtgctctagagtat

SEQ ID NO: 32247 - DNA, 201 bp, Homo sapiens
agcaagactctgtctcaaaaaacagaaaaagaagatgacacaggttcccagaagtgatttttcatcactcaagatcagccagaaattaggtgggagagccygtgttggaatgtgtctttctgtcccaagggctctcctctttgctgtgcttgggaaattcccccagccctgggctgcagcatgagggggcagctgcccaga

SEQ ID NO: 32248 - DNA, 201 bp, Homo sapiens
gctgcaaaggcgagtctgtgaaagtagattgaggtgaggcagagaagggctttatgagccatggttgggggttccacttgattctgttttaaagtcagagrgtggcatgactagacatatttagaaacactctgcaatggtgcggaagatggatgggtggaggatgaactgctagaggctgtggaagtacctggctggggc

SEQ ID NO: 32249 - DNA, 201 bp, Homo sapiens
gccatgcatagcatattttgaatcatttaggtcaagacccagacaaataggtttattaggacattataggatcttagaactggtgggaagctaaaaggctyggtggtttccaaactgttccaatctgttgtcttttgaagtaggatcctgtaagttcttactgtcctgaaaagatgtgactcaggaaacttctttccagtc

SEQ ID NO: 32250 - DNA, 201 bp, Homo sapiens
tctggcccaggtcatgtaagtagtggagctaggatttgaccacaggcggtttggctctagattttgtgttccaaaccatgttatttaaattccagcatctrgttggtagctatgtgattctccatctcagacaaaaattgtgtaactaagcctgaatgactgtgagccatgcatagcatattttgaatcatttaggtcaag

SEQ ID NO: 32251 - DNA, 201 bp, Homo sapiens
ctagaaatgccagaaaactgaatgtcagactttagaggaaagccagggaaggtttagagaagaggagacattggagtttggtgttaatgaattagttcccmcaagccaggcaagaacaattgaggtgtgctagcacatatgtacataaagactaaggatgtccgtgacattttcagaggctgctgtgtaaggccttcggga

SEQ ID NO: 32252 - DNA, 201 bp, Homo sapiens
catatcattgttgtttgttggtttattgagacagagtctcactctgtcacccaggctggagtgcaatggcaccgtcatagttcactgtagccttggacccygggctcaagcaatcctccagtctcagtctcccgagtagctaggactgcaggcatgtaccaccacacctggctaatttttatttattgtccatacaatccc

SEQ ID NO: 32253 - DNA, 201 bp, Homo sapiens
gtgtgtccacctgcttgatgggctgatcattttgaacagggggagagtcagaccacatccttttgagtccatctgcagtaaatgcccattcaggatcttaytgtatgtgccttttattaagctacttaacttgtactaatctgtgaaacagaataacagtacctgtcttccatgttacgagaattaaataagatgatgcat

SEQ ID NO: 32254 - DNA, 201 bp, Homo sapiens
cagtcccccttctcagggtgaacagaccttacagtggcttttatctgttccaccaagctgccagttaccgcaggaatagcctcctgtgtgtctggatcatrtatacccatatgcagttgttcaatagtgagctgtgggtcccatcaatccaaacatgtacttctactctgtagtgtttaaaaccaaagatactgcccctaa

SEQ ID NO: 32255 - DNA, 201 bp, Homo sapiens
tctgtttcttttgcccttcctgatcgaagtctaggagagtaagtcaatactttttatgagaatatattgtcctacttgtatgtctaaagaccatgttctcrttctgcagttcaacgttgttgattttatttcttacattttcgtaatgtaatggctgtttctagtcatgtagtccttagaaactatggttaaatgtcagtg

SEQ ID NO: 32256 - DNA, 201 bp, Homo sapiens
tacatggtttttttttttttctggctcttgttttccagaaaagatgagactctgtgtgtgtgtgtgtgtgtgtgtgtgtgtatgtatttctgtgtgtgtgkgggggtgtctgtgtgtgcttatgtctgtgtctgtgtgtgggtctgtatgtgtgtatgtgtgtgtgtgtctgtgtgtatgtgtgtctgtgtctgtgtatgt

SEQ ID NO: 32257 - DNA, 201 bp, Homo sapiens
accagcctgattttataaagagcttaatgagaaccattgtttgtctcaggaagaatggtcagttctctgtaatgtgatgatggtttgtacctgaggctctrtgcttgtgagctgcaaaagggagacccttgctttacagccacgaggtgctgctgtatttaccgtgctgagggctccctccatgtgactcttttccaaatg

SEQ ID NO: 32258 - DNA, 201 bp, Homo sapiens
tttaggcccttacccttcattggacattatcatggcttttcaatttagacatctactgacagtgattctactttgcccatcaaccaaatctgattttctakacctggttttaaggcatcctattatctgacccttcctcatgtatccagtctcaactacaactttctgttcttatcaagttagtctctttccattctgaaa

SEQ ID NO: 32259 - DNA, 201 bp, Homo sapiens
tgctctgtagagctggatgaatggttaaaaagaaagggggaaaagccagaagaaattaattctgtggcacagagctgtgaattcttccttgatgcaggatytgaggttgaaggaggttaaatatgtgagggccagaaggaagtatcatgtaatgaatgataaatctctagctgctcctcagcagggcaaaacatgggctta

SEQ ID NO: 32260 - DNA, 201 bp, Homo sapiens
gattcatcatccaagaaatcatttaaaagcattaccagcatcatgatggcattttccaacctgtttttttaaattaaaagattgccaaaattcaactgccrtatgtcataactaatttttttttttaacactaaaagaaatcgcaaaacttaaaagcactgtgaaaagctcttcaggtcattcctactcattatacccctt

SEQ ID NO: 32261 - DNA, 201 bp, Homo sapiens
acagacatatcctccagttcacctgctccttttacctcctcacaagtgtcattatgacctgcagagttaacagcatttataaacattgctttattatctgkcattttacagataataagaataatagctaacatttaccgagagcttattttctgggacgaattatataggccctgcctctaagttccttacatgtgtttt

SEQ ID NO: 32262 - DNA, 201 bp, Homo sapiens
tttagctgtgggggtccgacagcacgaaggtcctcaggtaggttcatgcctgacacattcacgaaacaacaaaaggaggtcatgtggccaaggtgtagagygtgtgaggaagaagaggttggaaaggtggcaggagccagattatgcatggcctgctgactgctgtcaagactttggcttttactctaaataatagggagt

SEQ ID NO: 32263 - DNA, 201 bp, Homo sapiens
tcaaaagcaaaaattagcctgacatggtagcacacacctgtagtcccagctactcagaaggctgaggcgagagactcatttcagcttgggaggttcaggcygcagtgagctgtgatcacactattgcattcagcctgggcaacaaagcaagaccctgtctcaaaaataaatatatacatatgtattttttaaaaggaaata

SEQ ID NO: 32264 - DNA, 201 bp, Homo sapiens
tgtccctaatgcagaggacattcactatcaaaagggagagaaggccccctggagttgctacgggttgcagtattttttttaaaaccagaattcctaatggrttttttttcccctccttttagtgatattgtattttgcttaagtgtgttagatttagctctcgtctggtttgtgttcaagctccctttcaaaggtgccatc

SEQ ID NO: 32265 - DNA, 201 bp, Homo sapiens
ttagaaactatggttaaatgtcagtggaatgctaataataaatcaaccttttttacatctatgttgttggtttggcccttgtcaccctccacgacatcataacacttttcactgctgtagaattgtcttaatttaaaaaatgtggttataggtatattttacagagcactaattacaaaatgagagacataataattgtta

SEQ ID NO: 32266 - DNA, 201 bp, Homo sapiens
atttaagtgactagtaatcattttatatttaagcaaccatggaaatacaaaggagtgcaaactatgcacaagtgttggtgataaaacagagtctttattasgtttatgtagttagagtagtgagtgctttaggatgcaccccctgacttctaagggatactttgtggaaaagctggagatttccatctagtaagtacatct

SEQ ID NO: 32267 - DNA, 201 bp, Homo sapiens
tgtgaaaatgtgccagctacacatggagactctaccagaaaagtaaagtctgtattagtaaagtctgtattcgttgatggaagttataccgaaaataatgsaaggaccttccagaaatggaatggacagctctcataagcaaaataatgtaaaggtcgtttggactagataaaatactctcaaaaaagttaaattcataat

SEQ ID NO: 32268 - DNA, 201 bp, Homo sapiens
cccccagcgacaaaacaaaaacaaaaacaaaaacaaaaacaaaaaaaaacctagtattttattcccttgaagactttggaaagattttgtcattcatcgcratgattggtcagcctcaagaagcatgcaggagccatcataagagtcacaaggtattaagcttcctctttggagcctggtagtgtgctaagttctttatgt

SEQ ID NO: 32269 - DNA, 201 bp, Homo sapiens
gggtagctggctgtctcttcccatctctcggtccagtgaacccttagaaaacaatgccaagagtctcctagtttgactctcgtttcttgctgctcttttayctcttatttgttaataaataattatataaataaatgcttttcctgtttctctttttggtgccaggacttccctaaagcctgttcgtgaaccattggtgac

SEQ ID NO: 32270 - DNA, 201 bp, Homo sapiens
gggaagggagatcccagttgaaatcagcaatgaggagcgatgctgggcagaaaacccatagcgccgtgtccttggggagtccttggaccatctgtttgackgaagcctcggtttttttctgctccaccacacactggctggggtgagacaatgcgtgcgggaccctggcctccaggaagggtccctgccctggctgcaggg

SEQ ID NO: 32271 - DNA, 201 bp, Homo sapiens
aaatgtttccctccctcccttaagttgctcccaattgtgtgttttgtaccgttggcttagcagtttcaccaaagggaggacctgttgttcaccttggagcrgtgaatatttgtgtatatctgtcatattctgctctagtgttgatagattcctagagttggagttagaggctcaaaggccaggcatattaataaatttctt

SEQ ID NO: 32272 - DNA, 201 bp, Homo sapiens
tgtttttgagacagggtcttattctgtcacccaggctggagtgcagtggcgtgatcatagctcactgcagcctccacctcacaggctcaagctatcttccyacctcagtctcctgagtagctgggactacaggtgtgcaccaccatgcccagctaatttttgtattttttgtggagacggggtttcaccatattgcccagg

SEQ ID NO: 32273 - DNA, 201 bp, Homo sapiens
cagtggtgcagtcccagctcactgtaacctccaccttatgggttcaagcaattctcctgcctcagtctcccgaatagctgggattgcaggcacccgccacmatgtccagctgatttttgtatttttaatagagacggggtttcaccatgttggccaggctggtctcaaactcctgacctcaagtgatccacccatctcggc

SEQ ID NO: 32274 - DNA, 201 bp, Homo sapiens
cctcgcagcacacttttcagtgattcttcggaggaattcctcagaggtctgcaatttccctcaaacagcccagctgagatttttagctgtcatgccagttrtgtccagctacccatctgatatcagaaatcctgtctacagacttggatctgtttgtaattatgattgaggctgtctaacagttattcatttcttcagcaa

SEQ ID NO: 32275 - DNA, 201 bp, Homo sapiens
agctgctggggccaggcagcgtgtggggctccactgggcagtggcctgttagcacattcagaaagtgtgccaaaatgcacacacatgctgggtgctgactygggtatatatgacatgattctacctgtctcttaagggaaaggaacattttgaaaaatatttaggccattaaaaactaaaaggtgctgagcacttcctaaa

SEQ ID NO: 32276 - DNA, 201 bp, Homo sapiens
cctcctgggttcaagcaattctcctgcctaagcctcccgagtaggtgggattacaggcacctgccaccatgcccggctaatttttgtatttttcgtagaartggggtttcaccatgttggccaggctggtcttgaactcctgacctcaggtgatccaccagcctcggcctcccaaagtgctgggattacaggcttgagcca

SEQ ID NO: 32277 - DNA, 201 bp, Homo sapiens
tctagtatgttctaaacacagtataagatgctttcatttcaaaataccagttccaacaaatctttggcaaacatttcagttagcctcaggccaggcgcggyggctcatgcctgtaatccgctcatgcctcattttgggaggctgagacaggcagatcacttgagcccaggagttcgagaccagcctgggcaacatggagaa

SEQ ID NO: 32278 - DNA, 201 bp, Homo sapiens
tgaccaacatggcgaaaccttgtctctactaaaatacaaaaattagctgggtgtggtagcatgtgactgtaatctcagctactcgggaggttgaggcagtrgaattgcttgaacccaggaggcaaaggttgcagtgagccaagattgcaccattgcactccagcctgggcaacagagtgagactccttctcaaaaataaaa

SEQ ID NO: 32279 - DNA, 201 bp, Homo sapiens
ctgtatgttgaaattcatggacatatttcaaatttcttttaatctgtggattcctccctctttttttcattgtaattcatttgccaaagaaagtggtggtktatcccgtagtttcccatagtatggatagtgttgactgcaaccctgcactgtcatttaacgtaagctacagtctactcttaacagacttttgttattaat

SEQ ID NO: 32280 - DNA, 201 bp, Homo sapiens
atgtctgtgtctgtgtgtgggtctgtatgtgtgtatgtgtgtgtgtgtctgtgtgtatgtgtgtctgtgtctgtgtatgtctgtgcgtatgtgtgtatgtmtgtgtgtgtatatgcctgtgtatttgtgtatgcgtgtgtgtctgtgtatgtgtgtctatatgtctgtgtatgtgtccatgtgtccatatgcatgagtgtg

SEQ ID NO: 32281 - DNA, 201 bp, Homo sapiens
agtgctgcaagcaatccttcttggactgggcagatgtgaaaatgaccctgttgcttccagctccaccctggcatgcttagtctgggactgttgacccaacytgatttgcctatgagctgcccagagccctggctaaagaaccactactctcagttgcagtttcttcagggctgtctggctgtctgcttccagcttcctggc

SEQ ID NO: 32282 - DNA, 201 bp, Homo sapiens
acctacttctcagggtttttgtgaggacgagataaggtagtgtgttgaagcagttgtcacagtgtttagcatagggaagtcacacaataaatagtttctastaagttctctttaagaatcaaatttcatttggtcaaagtgataaatgtacgtaaactaaaacatcagatagtgcttttactagttaagacttactctgtc

SEQ ID NO: 32283 - DNA, 201 bp, Homo sapiens
ggaatgcagtgtggtgatctcggctcactgcaacctccgcctcccaggtttaaatgattctcctgcctcagcctcccaggtagctggaactacagttgtasaccaccatacctggctaatttttgtatttttagcagagacggtgtctccccatgttggccaggctggtctcgaactcctgacctccagtgatcctcctgc

SEQ ID NO: 32284 - DNA, 201 bp, Homo sapiens
atttgacatttccactgacaatgtcttatttctgagatgaggggaaacgcttttttaagtgtctagtctatatttgaagttagatgaacatggactgaacyccaactctatcacgtagtagttttaaggccttgggaaagggacctaactgtaaaaggaggtgataataccacttcactggctatgagggggattaaccag

SEQ ID NO: 32285 - DNA, 201 bp, Homo sapiens
ttttttttttttttttcctaaagagatggtggagtcttgctatacttcccaggctgttcttgaactcatgggctcaagcagttcccacaccttggcccccsccaattgcttggattacaggcatgagccaccattcctcgtcctgaaatgattttaaatgtgttgtttgcttaataaaatgaaaaaaatgcactttaaaaa

SEQ ID NO: 32286 - DNA, 201 bp, Homo sapiens
ctggttctttcctctcaacttcatctgcttcatcttttgttgtcttaaattcactggatatgaagaactagtatggcttatagttattggtgtttttctcytgttgcctatagccgttgtcctcgttaccaagtggctgctacaggaaaccatcttttaggtgaatggccagactggatggggcagactggttcccctttc

SEQ ID NO: 32287 - DNA, 201 bp, Homo sapiens
tgcgccatcatgcccagctcatctttttttttttttttttttttttcctaaagagatggtggagtcttgctatacttcccaggctgttcttgaactcatgsgctcaagcagttcccacaccttggccccccccaattgcttggattacaggcatgagccaccattcctcgtcctgaaatgattttaaatgtgttgtttgct

SEQ ID NO: 32288 - DNA, 201 bp, Homo sapiens
tgcagtaccttttctttggcttgggaagttgatagcttggtggtgttttcttggatggactaaatccttagaattgtttaggagatattggtcgaaggtgstatgttaaatttttgccaaggatctgaactgtgaagtaacttgtcaagtggggcccaaacctttcaaagtttaggatttacagatctttcctgttctttg

SEQ ID NO: 32289 - DNA, 201 bp, Homo sapiens
gcatactgtttcattgtatatctgtaccataactgattatttgaattttctgtttgtcaatacaggtataccttgtcttaaatacatccaataaacaggtrtcctagtgtatatatacctcaggctgaatttgaatatggtttttgttttttttttttttttttcttataaggattcacattcagtgtttcaaggtaggat

SEQ ID NO: 32290 - DNA, 201 bp, Homo sapiens
tcattcattttcaagaaaatgtttggcaaatactggagtccgaataaccatagtttgctagtctttctttcaaaaaaaaaggtgttccactaaaaaaacartgccagttagttcaacttgcaactcaaaaaattacataagtacttttcctcaaaacaaccatcatattttggtatgcctaaaaagggctttatgcatact

SEQ ID NO: 32291 - DNA, 201 bp, Homo sapiens
tttgctacgctgcaggttcctttcaactgtgtgtatatgtgccatacacacagctcagtggccattcaggccaacattcatcatctgcgtttgctcacctratacatttgtttgtctccatacaaaaccatctgagatttattgaatgtttttgatgaacctggcagtttggtgggtgtgttatgtagattatttcattga

SEQ ID NO: 32292 - DNA, 201 bp, Homo sapiens
caggatggtctcgatctcctgacctcgtgatcggcccgccttggcctcccaaagtgctgggattataggcgtgagccaccgctcccggccctacacccagstaattgttaattttttgtagagacggggtctcgccatgttgcccaggctggtcttgaactcctgggctcaagcgacctgcctacgttagcctcccaaagt

SEQ ID NO: 32293 - DNA, 201 bp, Homo sapiens
gtcagctgtttcctccctgagtgcaggctatgtccttggcccttgtgccaggagccaaagttacaaaaatgagtaaaacaggaatgtaatactgtaatagkgccttaaagaaccctaacagtgatggtagtactactgcataatgcttacagcctgccagggcttgtcagtaaattctttgcatatattaacccatgtaat

SEQ ID NO: 32294 - DNA, 201 bp, Homo sapiens
acagagaaaaggagacttctaggaattatagggcagtaaattatagggaagataaatataagggggaaacaaatagatgatagggattattttaacaaggkttatttatgcagactcatcttggtactgacatttcatctcttgtgacaacagtttttctcctcttcctagaaaggaggtaggggaaacactttcacaaag

SEQ ID NO: 32295 - DNA, 201 bp, Homo sapiens
agacttcaaatagccaaagtaatactaagccaaaagaaaaaagctggagtcattacactacttgacttcaaaatatactacaaagctatagtaaccagaayagctttgtattggtgtaaaaacaaatgcatagaccagtggaacagaacatagaacccagaaataaatccacatatttatagccaactgatttttgataag

SEQ ID NO: 32296 - DNA, 201 bp, Homo sapiens
acatctctgtcctgcttattttcatttaacacatcatgaacatttccacttcattaaaaagtcttcaataatatttaaaaaggcatgtcattgtattaaaygtttccctccctcccttaagttgctcccaattgtgtgttttgtaccgttggcttagcagtttcaccaaagggaggacctgttgttcaccttggagcggtg

SEQ ID NO: 32297 - DNA, 201 bp, Homo sapiens
gtgtgatgcttcatgcctgtaatcccagcactttaggaggatgaggtgggtgcattgcttgagcttaggagttttgagaccagcctgggcaacatggtgaraccctatctctgcaaaaaaaaaaaaaaaaaaaattaaccaggtgtggtagcacatgcctgtagtccccagctagtagggaggctgaggtgaaaagatcgc

SEQ ID NO: 32298 - DNA, 201 bp, Homo sapiens
cacttcattaaaaagtcttcaataatatttaaaaaggcatgtcattgtattaaatgtttccctccctcccttaagttgctcccaattgtgtgttttgtacmgttggcttagcagtttcaccaaagggaggacctgttgttcaccttggagcggtgaatatttgtgtatatctgtcatattctgctctagtgttgatagatt

SEQ ID NO: 32299 - DNA, 201 bp, Homo sapiens
gtgggtggatcatttgaggtcaggagctcgaaaccagcctgaccaacatggcgaaaccttgtctctactaaaatacaaaaattagctgggtgtggtagcatgtgactgtaatctcagctactcgggaggttgaggcagtggaattgcttgaacccaggaggcaaaggttgcagtgagccaagattgcaccattgcactcca

SEQ ID NO: 32300 - DNA, 201 bp, Homo sapiens
gaattgattatggaggctgatctgccatctggaagctggacaaccaggaaagccagtggtgtaattcagtcctagcccgaaggtctaaaaaccaggggaamtgatggtgtaaatcccagtctatgtttgaagttctgagaaccaggagcgccagtgtccaaaaaagaagatgcatgtcccagctcaagcagagagcaaact

SEQ ID NO: 32301 - DNA, 201 bp, Homo sapiens
ctggacatggtggctcacgtctgtaatcccagcactttaggaggctgaggtgggtggatcatttgaggtcaggagctcgaaaccagcctgaccaacatggygaaaccttgtctctactaaaatacaaaaattagctgggtgtggtagcatgtgactgtaatctcagctactcgggaggttgaggcagtggaattgcttgaa

SEQ ID NO: 32302 - DNA, 201 bp, Homo sapiens
aatgcaaaattttatcaaacacaagcactggaatctaacagagactgtgtgcacgattgttattggagaacagatctctagcatttgtacaggtgtagacygcctactatgttttctgtcacattatccattgcctttatttataaggaaagttgtctgggtggtggtgcctataagaagtcaagagtagcaacaacagtg

SEQ ID NO: 32303 - DNA, 201 bp, Homo sapiens
aagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatctgg

SEQ ID NO: 32304 - DNA, 201 bp, Homo sapiens
ctcggcctcccaaagtgttgggattacaggcgtgagccaccgtgccaggcctttttgttttgtttttaaggaagcaagtataaatgccatgctcttcttgytccagctgcatacagccacaattactgagatgactgggccttgtcctatagcctttgcctgaattcctgagataaaggaaagaaaagcagcctggatgcg

SEQ ID NO: 32305 - DNA, 201 bp, Homo sapiens
tcttcagcctccaggctctccagtttttcgtcgagagattcactatggaatcggtgagtgatctctagcccatcctgtccagaaaactcggcgtgggagayacagcgggattcttcttgggagttgaaatgcaaaattttatcaaacacaagcactggaatctaacagagactgtgtgcacgattgttattggagaacaga

SEQ ID NO: 32306 - DNA, 201 bp, Homo sapiens
ggtgatgaggggagatcagttaggaggcagctgcagtggcccaggtaagaatgatggaggcttggtccagagctggaccagtggaggtggggagagataartggagagatctttaggaagtaaagtagacatgaattggggatggattggatatgggggtgagggagatggtggaactgagatgtctctcggtttttcgcc

SEQ ID NO: 32307 - DNA, 201 bp, Homo sapiens
tctcacaaaaaaaaaaaaaaaaagaaaaagaaaaagaaaatgtcttatggctacagcattgtgcctggtagacaggataaggtcagagaggtgaacaagastcagaacatgttcagtgatttggatttttattctaaagcactgagaagctgttgagggatgttaagctagtggtggagagttgagggatgacacaatcaa

SEQ ID NO: 32308 - DNA, 201 bp, Homo sapiens
tctccttttcttctatgaatgtgttttattttaatgagaagtgaaacctataaaaggacaagcctcagagtttgaaggaacagagttgtagaattgtcagytttgaaaagtgtcataactatatttagagaagctcttgtagcttttgaaagagatgctgctcaagacagccttcaggaacaatgtgtccctccattcacc

SEQ ID NO: 32309 - DNA, 201 bp, Homo sapiens
gcctaaatcagggctgatcagggttggtagggaggcaggacttgttgcttgccagcagatatggaaactgaaagacctagcgattagtacaaaatccccaygaccaattcaaatggtctcagcatttacattcaagaatcaccacaggagaggaggttttttgtttttttttttgagacaccgtctcactctgtcacccag

SEQ ID NO: 32310 - DNA, 201 bp, Homo sapiens
atctcagtttggattttaaaaactcattaaattacagtatcctgtgccaagtgatgtccttggggcactgctcaatgaattgccagcagaatagtagaaawgagagatgagcatttattatgttggcaattttgtatgacttacagctgactttagatatctatcagggaggaaaggaagtaccacttaccttcataaact

SEQ ID NO: 32311 - DNA, 201 bp, Homo sapiens
tagcaggagtccaaagttacctggcctgaggttacagatgcctaaatcagggctgatcagggttggtagggaggcaggacttgttgcttgccagcagatayggaaactgaaagacctagcgattagtacaaaatccccacgaccaattcaaatggtctcagcatttacattcaagaatcaccacaggagaggaggtttttt

SEQ ID NO: 32312 - DNA, 201 bp, Homo sapiens
ccaatgggccgggcacagaggctcacacctgtaatcccagcactttgggaggccaaggtgggcagatcacctgaggtcaggagttcgagaccagcctgctygacatggcgaaaccctgtctctactaaaaatgcaaaaaagtagctgggcgtggtggcggacacctgtaatcccagctacttgggaggctgagggaggaga

SEQ ID NO: 32313 - DNA, 201 bp, Homo sapiens
aaatgccttggtttttggacttctgtggaacataccactcccctctggtattcgtgggctcagccctgggtaagtcagctgcttagacagtcaaaacttaygcgtacttggctcctcaaagtcacatttgggatgatggccatttgtcaagtgcctcactggcagctcagtttggagaagagcactatgtttaggcaagat

SEQ ID NO: 32314 - DNA, 201 bp, Homo sapiens
gccgctgataaaatgcagtaatcagtcctgttgaacccaggttcttgatttgtttttaacaaaacaatttctagtttctaacttcagactgatataaaaawtactgttttaatcttctaaaaggtataaaatccccccattccttctgcatatgaattcctagactcttggttttgaaatgttcggttttctgcatcacag

SEQ ID NO: 32315 - DNA, 201 bp, Homo sapiens
gcggagattacgtcactgcactccagcctgggcgacagagcaagactctgtctcaaaaaacagaaaaagaagatgacacaggttcccagaagtgatttttyatcactcaagatcagccagaaattaggtgggagagcccgtgttggaatgtgtctttctgtcccaagggctctcctctttgctgtgcttgggaaattcccc

SEQ ID NO: 32316 - DNA, 201 bp, Homo sapiens
aaaattcagatgagctaaaagaaaaaaaaataatagccactggtctttttaaaggttttttcccattgtttatatatttttcaagttaaaggtttttttgktttttttcattatttagattctttttctttttttttttttttaagacagggtctcactctgttgcccaggctggagtgcgatggcatgatcttggctcac

SEQ ID NO: 32317 - DNA, 201 bp, Homo sapiens
ggattgggaacttggatatccatggcaagtggtaatgtctgccacaagagtcacaagatctgatgcacagtataacagtgttgcattggatgctgtgttgrtaccagactgctgggaggcaaaagtagcaacagagagaccatttcagaagcagagtgtatttgccattgccacagataggggactgtgagaaaaagaatg

SEQ ID NO: 32318 - DNA, 201 bp, Homo sapiens
cttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaactga

SEQ ID NO: 32319 - DNA, 201 bp, Homo sapiens
cctaggacagataacccttcagtttaagtcagagaagtcatcgatggtcaaatgctccagagtccttctggggccataagaggagcagggaggggagtatwcagccatcagttccagatggttctgcatttacgattcagttagcatcacatttgagtgttccttggtcagcagttgcagaaagaatgcatgattgtggaa

SEQ ID NO: 32320 - DNA, 201 bp, Homo sapiens
ccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaactg

SEQ ID NO: 32321 - DNA, 201 bp, Homo sapiens
taaatgatatgtctgtacaaacctaggacagataacccttcagtttaagtcagagaagtcatcgatggtcaaatgctccagagtccttctggggccataasaggagcagggaggggagtatacagccatcagttccagatggttctgcatttacgattcagttagcatcacatttgagtgttccttggtcagcagttgcag

SEQ ID NO: 32322 - DNA, 201 bp, Homo sapiens
gccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaact

SEQ ID NO: 32323 - DNA, 201 bp, Homo sapiens
gagactccatctcaaaaaaaaaaagatattccttaaaatgtcttgatattgcttcattcagtctgctttgtgttgggcccactgtgatagggagatgagayagtcctcatgctcaaggtcctcgttgtttgtagggagacagcaaaacaggtagtgttttgagaaatagtctgctgtagggacatggttagagaagcttcc

SEQ ID NO: 32324 - DNA, 201 bp, Homo sapiens
gtgaaacattagccaaactatgtaaataaatgtagttggattgtgactggttttgaactacttgtttgttcttagtggaccttgtcattggatattggggraactgcttgctcatttttgagaagtagagtaatttggtgaatctctgggttgtgtagatagtaaaatgttgcttgacattctattaagtagtaccataat

SEQ ID NO: 32325 - DNA, 201 bp, Homo sapiens
tgtgggtaatggcattccccatcagggtagcagtctgacagagagcagagattctctttctgcaccctacagaggactgtgagaagcctccagactgaatrcaataatggaaaaagtgactgaaagatttcacatctcctgagtgtggttaccaacatagcagtggggacctatctagacaggcacagcctatgcctgttc

SEQ ID NO: 32326 - DNA, 201 bp, Homo sapiens
cactgtcttggacacgttatttcatatcttgtgagttatgatttttttcatctataaatctggcccagtgtctcccttgcaggattgttgtgtgagtccarctggcaccaaggaggtgggaattctgcaagaacagctgtcagtggtcatcatacttgtgctgtctatgtgcatggctttattgatactcggtgttcataa

SEQ ID NO: 32327 - DNA, 201 bp, Homo sapiens
cagtggtgtaattcagtcctagcccgaaggtctaaaaaccaggggaactgatggtgtaaatcccagtctatgtttgaagttctgagaaccaggagcgccartgtccaaaaaagaagatgcatgtcccagctcaagcagagagcaaactcacccttcctgctactttctgttctattaatattatgccttcaatggattgga

SEQ ID NO: 32328 - DNA, 201 bp, Homo sapiens
gagaccagcctgctcgacatggcgaaaccctgtctctactaaaaatgcaaaaaagtagctgggcgtggtggcggacacctgtaatcccagctacttgggargctgagggaggagaatcaattgaacccaggaggtggaggttgcaatgagccaagatcgcgccactgcactccagtctgggcaacgagtgaaactgtctca

SEQ ID NO: 32329 - DNA, 201 bp, Homo sapiens
ccttgacaaaccatcctgggtcacgtgcagaattcttggaggaggtagactgcaggggatgggctggttgacgattgacttttctcctcaagcatctaaaygtgccctaacgtcttccattatggagctggggccaggtgtcagcaaactggttcagtggcagctggagaacctaaaaaggcattgtgggcctctgtaggc

SEQ ID NO: 32330 - DNA, 201 bp, Homo sapiens
aatggcttactctcctaacttctgattccctcctgctaatttgtgctattctgttccccacttttcactggctttggcccagaccttttttgctgccagtwacatcactcataatcacattgctgctcccacagaaaggtctctagccagttttagcgggcttttcctgactttgcaaacaccattgattagaattagatt

SEQ ID NO: 32331 - DNA, 201 bp, Homo sapiens
gtgggtggctactggttaagtgttgagtccaggtgagatgattcgtgtctatggcttttgccatgacaaagaccttttaaagtctctccaatgaagagtcrctgtatctgtatttaagtttccttaggattccttgagcttgagggttcattccccctctctcctcaggtgctgtcttcctgactgctgcacttcttaggt

SEQ ID NO: 32332 - DNA, 201 bp, Homo sapiens
atttatatctatttaggtataagtgaatgaatttccaggacattttttctgggctaagtggagagattgccttgctgagtactgtttggggagatattctyaaaccaccttcatagtttaagaatatatcgatttcccataagggagcttcagtgagaagagaatgtcagttcctgggagagtctcaggagatcgctgcca

SEQ ID NO: 32333 - DNA, 201 bp, Homo sapiens
acctcccatgttcaagcaattctcctgcctcagcctcctgagtagctgggattacaggtgtgccgccatgcccagctaatttttgtatttttaatagaaaygaggtttcaccatgttggccaggctggtctcaaactcctggcctcaagtgatccgcccacctcagtttcccaaagtgctgggattgattttccatttttg

SEQ ID NO: 32334 - DNA, 201 bp, Homo sapiens
caggagatcgctgccactttttgagagactaaattgttgggcccaggaatgtgggacaagagctttggcctgaaaactgcccgtgggcctgccagggtgarcatagtcacttctgcaatacactgcctgggtgcacttcctgagccctggctgtatgccgggcacacttctgacatagacctcagacagaggcatccccga

SEQ ID NO: 32335 - DNA, 201 bp, Homo sapiens
aaagtgtcattctgagaagctagaattgaatattaaaaatgcagattcatttttttttaacacttgctaaagaaaatcagatgagcaatgtgctacattasaaaaagtggtaaaatgataaatttgtcatccacatgtttttggaatgcagttaaaggaggtgaaaggcattacacaagtattattaccagatcgacttgt

SEQ ID NO: 32336 - DNA, 201 bp, Homo sapiens
ttctatacctgtccctgccccaccagactgtgagctctctatgggcaatgaccttgtgttactcaactcaccctcctcactgtcaggcccagtgcctgcartatactcagagtaggctataagacatgcagtcacagttgtcatgagtgtataatccagcaagacagtggttctggtcttttgggttgtgggtccttcaca

SEQ ID NO: 32337 - DNA, 201 bp, Homo sapiens
taactttttaaaatgctgaggatttattaatcgcttatagtaggtaggtcctatggtaccagtacgtgccctttttcttgttgtcggtgaggttttttgaygaaggtcttattccttaagcagagaccacgtctattttgctaaccaatacttccttgatatttagcttaatattttttcttcagtatattagtggatgaa

SEQ ID NO: 32338 - DNA, 201 bp, Homo sapiens
ctagaggtccaaaatccagcagggttttgctccctccagaggccctgtgggaagaatctgtttcttgcctctctcagcttctggtgactccaggtgatccrtggagtggtgcagcctctgccttcatggtcatctccccactgccgccgcctctctgtgttctcagaactgcctttgcctctctctcataagtgtacgtgt

SEQ ID NO: 32339 - DNA, 201 bp, Homo sapiens
aaaatgtataatttgtggtggcccagactgggttgagcctgctcctgctggcatgaggattggattgcgtggctagttagtgagcctagcctccctccgartatagaataaacttgagaactctcaagtttatttcgttgttctcttcttgggggtcccgaggctgtttctctggcattcacttattctaagagtcacaaa

SEQ ID NO: 32340 - DNA, 201 bp, Homo sapiens
ttcacagaaggccacacttccttcattacaaagagtctgtctttccccctctcaaattccatttcatgccttcataaactcctttttctttgtttttgagrcagggtcttattctgtcacccaggctggagtgcagtggcgtgatcatagctcactgcagcctccacctcacaggctcaagctatcttcccacctcagtct

SEQ ID NO: 32341 - DNA, 201 bp, Homo sapiens
cacattccacacttgcacttcttcccaggggaaccctgaagaaaatgtataatttgtggtggcccagactgggttgagcctgctcctgctggcatgaggaktggattgcgtggctagttagtgagcctagcctccctccgagtatagaataaacttgagaactctcaagtttatttcgttgttctcttcttgggggtcccg

SEQ ID NO: 32342 - DNA, 201 bp, Homo sapiens
ttgcccaggctggtctcaaactcctgagttatgtgatccacctgccttggcctcccaaagtgctggagactaccggcatgagccaccacacccagcccatraattcttaatacaggtttatggcttgtaagacaaaagaaaatgacaattcattattttagaatcttcggataaaaaactacgtacgtaatattttataag

SEQ ID NO: 32343 - DNA, 201 bp, Homo sapiens
ttagaatcttcggataaaaaactacgtacgtaatattttataaggccatcacttgtaagtgcctcacagagtgctgggcattgtgttgagcacttcgcatrtgttaacgtacctcattcttaaccatggttacacagagagaaaatgctattatctcaacttcggggcgcagaaaggttaagtgatttacactgtttctca

SEQ ID NO: 32344 - DNA, 201 bp, Homo sapiens
tgccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaac

SEQ ID NO: 32345 - DNA, 201 bp, Homo sapiens
ctcattcttaaccatggttacacagagagaaaatgctattatctcaacttcggggcgcagaaaggttaagtgatttacactgtttctcacagctagtacgkcggggccaggattcacctgcagcctgtgtggctgagagccagccctcctcaccctctccacgcaccactctgtgctcgcaaaatgcaggcccactggcca

SEQ ID NO: 32346 - DNA, 201 bp, Homo sapiens
ccgggtgtggtggcaggcgcctgtaatcccagctactcgggaggctgaggagggagaatcacttgaaccccggaagcagaggttgcagtgggccaagatcrcactgttgcactccagcctgggggtcaagaatgagacttcgtctcagaaaaaaaagaatttctacattcattttacgggtaaagaacttgcccagctaga

SEQ ID NO: 32347 - DNA, 201 bp, Homo sapiens
acaagatcctgagccagtgggaacatcaccaagtttctatgctctttgaggccttgccacagagcagctgctcacctctttgatacactcctttaccagarataaaaaaccgcaaagcccaaaacagtgctcagttttgttttggtcttaggccagaaatgcatgccgttttggcttgggtcttttaaatgccgttctgga

SEQ ID NO: 32348 - DNA, 201 bp, Homo sapiens
gtgattagactggctggtgggttcagggggtatatgatacacttctctgtttttatgtctgtacacaattccctgtaataaaagattaaaaaaaaaaaaamcccacaaaagattattctgctttcagcatggaagactagatttcagagggagaaatggtgatgaggggagatcagttaggaggcagctgcagtggcccag

SEQ ID NO: 32349 - DNA, 201 bp, Homo sapiens
tttcccctgttggatccattgatgcaatggacagaattctagaaatgagttttcatgaatttcccagcgctgctcaaagctgtggtcagccaagtggggcwggccacaacaagaaaccagacgttcactcttggtttgcatgcacatcttgtgactggactgggcacaggtctgcagaccgttctctgagcagcaacgctg

SEQ ID NO: 32350 - DNA, 201 bp, Homo sapiens
tgtgattagactggctggtgggttcagggggtatatgatacacttctctgtttttatgtctgtacacaattccctgtaataaaagattaaaaaaaaaaaaaacccacaaaagattattctgctttcagcatggaagactagatttcagagggagaaatggtgatgaggggagatcagttaggaggcagctgcagtggccca

SEQ ID NO: 32351 - DNA, 201 bp, Homo sapiens
atgtgattagactggctggtgggttcagggggtatatgatacacttctctgtttttatgtctgtacacaattccctgtaataaaagattaaaaaaaaaaaaaacccacaaaagattattctgctttcagcatggaagactagatttcagagggagaaatggtgatgaggggagatcagttaggaggcagctgcagtggccc

SEQ ID NO: 32352 - DNA, 201 bp, Homo sapiens
aatgtgattagactggctggtgggttcagggggtatatgatacacttctctgtttttatgtctgtacacaattccctgtaataaaagattaaaaaaaaaaaaaacccacaaaagattattctgctttcagcatggaagactagatttcagagggagaaatggtgatgaggggagatcagttaggaggcagctgcagtggcc

SEQ ID NO: 32353 - DNA, 201 bp, Homo sapiens
gtacacactatcccccagcagtcctgcttttgtgaagatatttttccagagataaagtaacagcgtgtaagagcttgtgtataagagtatttattgtagcrttgtgttttgatggcaaaagctgcagaaaacctagtatcctttcagcaggcgtatttattatggaacatatcccagttaaaataattagatttacttata

SEQ ID NO: 32354 - DNA, 201 bp, Homo sapiens
attatgggttaatgtgattagactggctggtgggttcagggggtatatgatacacttctctgtttttatgtctgtacacaattccctgtaataaaagattwaaaaaaaaaaaaacccacaaaagattattctgctttcagcatggaagactagatttcagagggagaaatggtgatgaggggagatcagttaggaggcagc

SEQ ID NO: 32355 - DNA, 201 bp, Homo sapiens
ctaatctcttgcagaaacaccctcacagacacaaccagaaatgctgttttaccagctatctgggcatcctttagcccagtcaagttgacacataaaacaamaataaggggttgctatggttattagcagtgctgttagagttcacaagtggatagattactgggctgggaaagtttgagagagcttcctggaagaggtgga

SEQ ID NO: 32356 - DNA, 201 bp, Homo sapiens
gagttctgagtctgccaccactaaccagctgtatgacttgggaaatgttatgtaactttggtgagcctcagtttccttatctaaaattcagacaatcacarttccttgcaaagttccttgtaggatttaatgaatgtgcctaggatggggtctgatatgtaaaagggttcttcagagaaacagaatttataggatatatgt

SEQ ID NO: 32357 - DNA, 201 bp, Homo sapiens
aaactgaaagacctagcgattagtacaaaatccccacgaccaattcaaatggtctcagcatttacattcaagaatcaccacaggagaggaggttttttgtktttttttttgagacaccgtctcactctgtcacccaggctggagtgcagtggcgcaatctcggctcactacaacctctgcctactgggttcaagctatttt

SEQ ID NO: 32358 - DNA, 201 bp, Homo sapiens
gtcactggttcccaaaccaaaggaagccattggtcttgttgagtggtgacgcttatcttcataaatcctggctgtactgggcgcatcccttttagtttatkttcagcccagccctcatagctcactttcccctgcttaaaaattttcatgggttttccctcacctttagagaaaagttgagttactacaatttgactcccg

SEQ ID NO: 32359 - DNA, 201 bp, Homo sapiens
agccatccatagtgcatacaaaattagatatatcaagctacagaaaaaaactgtggaaaaatcttttcttcctgcaaatgtttcatcctcacttatgtcaytgtggcttgaattctaaagaaccctgatgagaaagaaggaaaaccaaagaaaagccactctttaccaaacagtactgtatcaacctgctgttggggtata

SEQ ID NO: 32360 - DNA, 201 bp, Homo sapiens
tcatcttgtttggttgaaaatcacattggcaaaaccaaatccagaatgctagggtatgactaaatggtagaacaagctaagcaactatttctaggggggawaatttctgtgctaggctttgttactacagtggttgaacatgggctttagaatcagaaagatcagttcagatccccacattggaacataaaagttgtgcta

SEQ ID NO: 32361 - DNA, 201 bp, Homo sapiens
ttgggaaaatgactctggtagaatgcttctcatttgaccacttctgagataagccgttttcatatattcttagttggttcagcattttcatgggcccattrtataaattaggattagatttcaactctgtacaaacaaaaacccaaataacattagcaattatgtttgtttgtttgttttccctctctgaccagagaagtc

SEQ ID NO: 32362 - DNA, 201 bp, Homo sapiens
tttttcttatctataaagcaactgccttgagggagtatcgcatgagtttcaggatattcactgtgattgaatccctctacttagtcagtgcttaataagthgcagccataattagagtcgctgagaatcaaaggttaggttggcaggcagtccagtccagaggttttgtgaatattgcccagtttggtaaggtataacaca

SEQ ID NO: 32363 - DNA, 201 bp, Homo sapiens
aacattagcaattatgtttgtttgtttgttttccctctctgaccagagaagtctggaggtagttcaaagctagtcagtgcctccatggttatcaggagccsaagccttttctgtttccctggttctactctctttatcatattgctttaggatcccaaatggttgctggagtgtcagccgtcacaaccacattacagtagg

SEQ ID NO: 32364 - DNA, 201 bp, Homo sapiens
gctctggagctacaccacctaaattcaattttcttttcttttcttttctttttttttttttttttgagagagtctctcactcaggctggaatgcagtgtggtgatctcggctcactgcaacctccgcctcccaggtttaaatgattctcctgcctcagcctcccaggtagctggaactacagttgtacaccaccatacctg

SEQ ID NO: 32365 - DNA, 201 bp, Homo sapiens
aagctctggagctacaccacctaaattcaattttcttttcttttcttttctttttttttttttttttgagagagtctctcactcaggctggaatgcagtgtggtgatctcggctcactgcaacctccgcctcccaggtttaaatgattctcctgcctcagcctcccaggtagctggaactacagttgtacaccaccatacc

SEQ ID NO: 32366 - DNA, 201 bp, Homo sapiens
gaaaatgagaggtgcagatggttttcactgaggcatggtttcaaatttaaagaggattatggcccagaaatggtgagtagaggtgtgaacctttgaaattstaattgcagaccagtctgaggaggtatatacttaccaaagcacaatatctcattgtgagcatattcctttcttggccaaaggagatgggggaggagcaga

SEQ ID NO: 32367 - DNA, 201 bp, Homo sapiens
ctttaaagctgcaaaatacctttaggagcatctagatcattccatccttctataagcctgcaaggccagcagggcccaccttggatacagacggaagctcsgaggagctcagggcctgctccttggattttcagtgccagcagcaagatttgtgaccccagtctagtgctccgttgcctagtttgagcagaagtcaaactg

SEQ ID NO: 32368 - DNA, 201 bp, Homo sapiens
gcagctgcccagatggctctgcgctcagcatactcgctgagagtgaattcaagattgtttgaaatgaccttgaagatatgatcacacaatgggcagcacarcagaccctaggctcccttggatttcacattccacacttgcacttcttcccaggggaaccctgaagaaaatgtataatttgtggtggcccagactgggttg

SEQ ID NO: 32369 - DNA, 201 bp, Homo sapiens
ttatcccatccaacacccatgtttagcaatgaagacatggggattcaaagaagggaagtgatttgcctggactcccacagagaattgggactggaacccaratgtttcagctcccagttatgtgattctttgggccagacaatggcctctctggccaatttagctacaagagcatgtcactttgccagttttacttttccc

SEQ ID NO: 32370 - DNA, 201 bp, Homo sapiens
cagccctggctggtttccattgtgtttatttaatctttcaagaattttcttataaaagactggacaatcaatgcctttttactgattaaggtgaaaagttrtacatggtttttcaaatatttgtgcaaatgagagaatgtatgagtctttgcatgcatgcagatattatacctaatgttagactatagctgtaggcagatt

SEQ ID NO: 32371 - DNA, 201 bp, Homo sapiens
ttcagagttgcacagtcaattttagaacatttttatcatgcaaaaggaagtcctgtaactgtcagagtcactcctcattttcctccaaatcctttactaakctactttctgtttctgtggatttgcttattctggacatttccaagccatgctttttaatggctgcacaatattctgttatgtggatataccttactttag

SEQ ID NO: 32372 - DNA, 201 bp, Homo sapiens
taactccccgccttccccactactcctcaggacatcagatcacatggaaatgtatgttttcctgtttattattcatttctcaggcacatcagcaaaggtayggctgtagacagctgatgtagaaaacagtcctggctttgaaatcatgctttttagtatttaacctctctgtgcctcaatttccttgtgcataaggtgggg

SEQ ID NO: 32373 - DNA, 201 bp, Homo sapiens
ggatcctgaagaaataggccactgattgtctctgaatatattctataaggtcattttcagttctcagggctgggaaacacaatgtggagagaagcattaarttaatgctttgcttttaaatgttgggattctcatagaagaatccatttctgctcatttgctgtctggctgtcttaatgcattcaaagtgtagaacccttg

SEQ ID NO: 32374 - DNA, 201 bp, Homo sapiens
tgctgtggagtcaaaaagacctaggttcctaagccagctccgccatggcagtttacttaaattttctccattttctcatttgtgaattggggataatgatrgtacttaaaacatcattgtgaagacaatagaaaatttcatgtaaggtgcataacttaccaccgtttctggcatatttagtactccctaaagcttgtgatt

SEQ ID NO: 32375 - DNA, 201 bp, Homo sapiens
ttggtgggtgtgttatgtagattatttcattgaagacattacaacaatcctgtggttactgtacctttaatccagatgaggaaactgaggcaaattgagatatataacttgttcatttaccctattagtatgtgttacagacttgaacccaaacattctgtctctgaacccgttgcctttgctcttctacaatatcctgcc

SEQ ID NO: 32376 - DNA, 201 bp, Homo sapiens
ttattgagctcatcgtgtacgaggcacttggcatgcagtatcttgcttaaatttaataacatctctgtgaggtaaatgccattataatttccattttccabatggggaggatgaggtttagaaagataaagctgcttgaccaaggtaccacacagacagtaaatgatagacttgagatttgaacctaggcctgtcctactt

SEQ ID NO: 32377 - DNA, 201 bp, Homo sapiens
taatattgggatgtttcagcatttaaattaaaatggtgcacatttgctgttccttccagctttcccaggctaaatctggaaagttcaatccacacgtccaygtagaatatgagtggaatcttcgacaggaggagatagatgagagcgatgatgatctggatgacaaagtgagtgtaaattatgtcctcgaattctcaacaa

SEQ ID NO: 32378 - DNA, 201 bp, Homo sapiens
tgccatttgttgaatacctactctgtgccaggtagagtccattgtgcttttcagtcttcaattagttattttcactgtttacataaagattcagattaatractgttaaggaccacctttgagccttaaacagacccttcttgacaactacagtcaaaagattctatggctttacctatatcttgctgcctcctatttcaa

SEQ ID NO: 32379 - DNA, 201 bp, Homo sapiens
ccctccaagggcttttggcctcatccagagaaaccacaagaagctgaaccctgctatctgtttcccaatgcattttcataattttcttgttttctcacaawgcttaagtgatacaaaacccatgtgatattttttaaacatttaaaaaggatttctatatttctggttggagattaccaatcactcagcttcccaaagtga

SEQ ID NO: 32380 - DNA, 201 bp, Homo sapiens
aggtgggagagcccgtgttggaatgtgtctttctgtcccaagggctctcctctttgctgtgcttgggaaattcccccagccctgggctgcagcatgagggrgcagctgcccagatggctctgcgctcagcatactcgctgagagtgaattcaagattgtttgaaatgaccttgaagatatgatcacacaatgggcagcaca

SEQ ID NO: 32381 - DNA, 201 bp, Homo sapiens
gtttcatatcacaaattaacctcctttccaaatttctctttaagttttaatcctcttgtttaagtggctttatttcttaaggtttgaagtgcctttattcmcattgtatagactcgaacattcctcaaataaatttaccaaatttctgctttctggcttgaaaatcatcacttttttagattttcacatcactcaagagca

SEQ ID NO: 32382 - DNA, 201 bp, Homo sapiens
aataatggaaagagagcccagctgaccccagctttgctctttacaggtactctgtatttgtcttctacctaacacatggtaggggctcaacaagggttgartgaatcgctacatgttggctggatgtgttactacctgggaagctctctgagaccagctattaatattcactaatcatgaatattcatgaatggatccatc

SEQ ID NO: 32383 - DNA, 201 bp, Homo sapiens
ggctttttcttttcttttaaatgcagttagctgaggcacaagaatcgcttgatcccgggaagcagaggttgcagtgagctgagatcgtgccactgcactcyagcctggtgacagagcaagactgtgtctcaaaaaaaaaaaaaaaaaaaaaaaaagcagcagcagcagcaaccaactcttaggacatcaggggacagaaat

SEQ ID NO: 32384 - DNA, 201 bp, Homo sapiens
tttttctcttagcccttatttaattttacatatatgacatttcagaggatgtcactgcagttgttgtttggcatttatgggaataaaactttgtagcacayttagacttgtattatttctagagggagccttgtttgattgaaggacagtatcccctgtctctctaaaacatgaggctcttaaaagtgcattttatttagc

SEQ ID NO: 32385 - DNA, 201 bp, Homo sapiens
cgcacacgttttatcatacttctaatgatttgggaaagataatcttatagcctatattatctaccatttttctcttagcccttatttaattttacatataygacatttcagaggatgtcactgcagttgttgtttggcatttatgggaataaaactttgtagcacacttagacttgtattatttctagagggagccttgtt

SEQ ID NO: 32386 - DNA, 201 bp, Homo sapiens
gtcaagcagattgttgctgattctgaactggttttcattgataatcagtgccataagacagaacatttagaggttgatagaggatgactttgctcggctartttgtctgttgcattcacagacaacagaaggatattctcagatcttccatgtcttgggtaattgatcagacatgtacttgtttcattgtggagagctgta

SEQ ID NO: 32387 - DNA, 201 bp, Homo sapiens
acattctagggatttgacaaatgtgcgatgatatgtatcctctgttactgtatcagagtagttttagcagcactaaaaatctcctgtggtccacctagtcrtctctccttccctcatcctaaacccctggcaaccactgatctttttgctgtctacatagttttgcctttttcagaatgtcatatagtcagagtcataaag

SEQ ID NO: 32388 - DNA, 201 bp, Homo sapiens
atgatggcattttccaacctgtttttttaaattaaaagattgccaaaattcaactgccatatgtcataactaatttttttttttaacactaaaagaaatckcaaaacttaaaagcactgtgaaaagctcttcaggtcattcctactcattataccccttgaaatgtttttctggctaaaattaccatttaggtgataaagt

SEQ ID NO: 32389 - DNA, 201 bp, Homo sapiens
cttagttaaaacagtccttttaattttaattaatgcattgaagctacttcttcctcataattttctacttcataattctgttgtctgagcccataacaatrgttatttctattatttgtagagaattataaagctctttcatatttgttctaccatttaatccctctatctttatctcctcccctcccctcacccccctcc

SEQ ID NO: 32390 - DNA, 201 bp, Homo sapiens
tagtgaagactttatatagaacatgtaaataattgtatgaagtagttagtgtacaaaataatgtcatatatgcagctgcattttctgcctttttcacctaraaagtttttttgtcatgtcattaaaaacttttgccctctgttttcatgactacataatattctgttgtgtgggtgtacctgtcttactgcttcacctact

SEQ ID NO: 32391 - DNA, 201 bp, Homo sapiens
agacctgaaactgtgaacctaccagaagaaaactttgggggaaactctccagcacattgctctcagcaaagatgtcttgagaaagacctcaaaagcacagwcaaccaaagcaaaaatgagcaaacgcaagtgggatcatatgaagttaaaaagcttctgcaccacaaaggaaacaatcaacaaagtgaagagacaacccac

SEQ ID NO: 32392 - DNA, 201 bp, Homo sapiens
ttttgctaatcaatatctctttgataaaagagctggtctcaccctcacagccttaaggcaggtgaagttttcattatttttatttttatggttaacttttrctatacaagtaattctgataacaggagcttgtctttatactgtggtgactgtatgccaggcactggcactttgagtactttacatgttttattggttaag

SEQ ID NO: 32393 - DNA, 201 bp, Homo sapiens
aggtgccccacctcaagtctagtcaagagattaccaaccaaatggagtcagaacaggttttgctattaagtgagtttaagctaaaaaaaaaaaaaaaaaaagccgtgtattttatatatatatatgcaaatttgctctaacaggctgcatactgtttcattgtatatctgtaccataactgattatttgaattttctgttt

SEQ ID NO: 32394 - DNA, 201 bp, Homo sapiens
agagatggaaaactccccagcatattcaaggggctgcagacattttggggcaggatgggtggaggagtcagaaatgcagtttctgaggtaaaaactcagamctgactacggaggaccttgggtgttgtactaagggacgtagacttcatgataaggataaattaaacagtaagcaccatttgttttctgggagaaattaaa

SEQ ID NO: 32395 - DNA, 201 bp, Homo sapiens
gcctgcatgtctcaccttggcattgacctctcctgtcccctagtacctgcctaggtgcagcaggatagattgagaaccaaagtttttccaaagctattttytcaaagccatgaggactgatatattttctctggttggtagtagtgaatgctttttaaaaaatctttattttaaaatattttaattgtggtgaagtatgca

SEQ ID NO: 32396 - DNA, 201 bp, Homo sapiens
ggtactaagctttagtccctttcatctagtagctcattatctagtcagccatatgaacaatccatcatgcctaaagtggtatggatactattagagatacrttggaagatgactgcagccagacagaaacctacaagacccagagatggaaaactccccagcatattcaaggggctgcagacattttggggcaggatgggt

SEQ ID NO: 32397 - DNA, 201 bp, Homo sapiens
tcaagcaattctcccacctcggcctcccaaaattctgggattacagacatgagccactgtgcccagccccatgactatagattttcaatcctagttttgargacatgcacttcaggagcatatgctgaaacatagtacattctacaactttcctctttagaccacttctgtctttctgggcagccaaaacaggcatgtctc

SEQ ID NO: 32398 - DNA, 201 bp, Homo sapiens
cttttgcaatccaagattgtttttccaaggagaattttctactttttcaggtaatcatagtttctttcttccttttccctttcctttttccttttctttcytttcctttcctttttcctttcctttcctttttcctttcctttcctttcctttcctttcctttcctttcctttttctttttctttttctttcccctttccc

SEQ ID NO: 32399 - DNA, 201 bp, Homo sapiens
aggacacatgaatttttcttttgcaatccaagattgtttttccaaggagaattttctactttttcaggtaatcatagtttctttcttccttttccctttcytttttccttttctttcttttcctttcctttttcctttcctttcctttttcctttcctttcctttcctttcctttcctttcctttcctttttctttttctt

SEQ ID NO: 32400 - DNA, 201 bp, Homo sapiens
cagccataattagagtcgctgagaatcaaaggttaggttggcaggcagtccagtccagaggttttgtgaatattgcccagtttggtaaggtataacacatagtgtcagttagataaacccctcagggagagacctatttaataattgctgtggttctgaaagttttgaggaaggcctcattggatgaatatacaaagtatg

SEQ ID NO: 32401 - DNA, 201 bp, Homo sapiens
gcagccataattagagtcgctgagaatcaaaggttaggttggcaggcagtccagtccagaggttttgtgaatattgcccagtttggtaaggtataacacatagtgtcagttagataaacccctcagggagagacctatttaataattgctgtggttctgaaagttttgaggaaggcctcattggatgaatatacaaagtat

SEQ ID NO: 32402 - DNA, 201 bp, Homo sapiens
tattgctctatagttacacagttgtgtgtgtgtgtgtgtgtgtgtgtgtgtgtgtgtgtgtgtgtgttttaagacgggatcttactctgtcacccaggctrgagtataatggcatgatcccagctcactacaaacttctgcctcctgggctcaagtgattctcccacctcagtctcccaagtagctgggactacaggtgca

SEQ ID NO: 32403 - DNA, 201 bp, Homo sapiens
ttgtcttcatgtgtttctaatgaaacagaagccagtgagtctctgggtaatttctttgtttccaccctgacgctgttgatgtcaacaaaaagtgcagttcmtttttaggtagggtcatattttctttttcttttttttttcatttagcacaggagtggtggacttaacctgccacacccttttaatttaataaaatatgtc

SEQ ID NO: 32404 - DNA, 201 bp, Homo sapiens
ttgttttttgagacagagtcttgctctgtcccctaggctgtagtgcagtggtgtgatcacacctcactgcagcctgatctcccaagctcaagcaatcctcytgtctcagcctccccagtatttgggactggagcttaccgcagccttttagtgacagtaagtctttttttaaatttatttttattttttatttcttcatca

SEQ ID NO: 32405 - DNA, 201 bp, Homo sapiens
ttcttcatagttcttaacaatttgtactactgttttagcttcctctgtagttggcacactaaaattagatgtcttttttgtttcattgtcttcaacattckttccacagaacccacctggctttcaaccaacttgggtattttgacctgtatagaatgttctggcatccatagggaaatgggggttcatatttctcgcatt

SEQ ID NO: 32406 - DNA, 201 bp, Homo sapiens
gtgcatctgccacagggtcattctaagggtgtgcttaagttactgctatcagggcacttgccctacagtagtgtcaggcattttgcctgtatttgcatccrctgtgtctcagctaactgcgtgtgtttggccaagttatttagtaataccttgtagggttaccaggagcagctaatgagactgtgtgtaaaacgagccacc

SEQ ID NO: 32407 - DNA, 201 bp, Homo sapiens
tgagcagtacttaatagaccttcagtccatcactgtcagaggtgatagtggcagtgagggaacatctctcacaggcctagaggtgttgcatagggtctctkaaggaaagcctttctcactttttcacaaggataaagtgcttaattttgttttcagttcagtatcaaagggaaacttttatggtagcccctaggctaaacc

SEQ ID NO: 32408 - DNA, 201 bp, Homo sapiens
ttttgatgaccaaataaaataaggaacatgtaagtgccagtttgaggtattcttaaacagtacaaagttgctgaatgagacacagactcaggtttctaacctggcacatagttgatgtttataaaagttagttcccatctcctctttttagttgtaggttttatattgattattggttcaagagaggcaaaaggttgtaaa

SEQ ID NO: 32409 - DNA, 201 bp, Homo sapiens
ccttacctaccctatcttatcttttattatcccccaacatccatccatcaagctgtcctgtcatccttctatactttcatccatctaactattatttgctwgttccaggcactgtgctttggacaggcaatatacaaaaatgtgtaaagttcagtccttgaactcttggtgatatgtagtcagctttgttcaattagagtc

SEQ ID NO: 32410 - DNA, 201 bp, Homo sapiens
tagtatcaccagctgttcacatagtgccacaacactcaaatccaaggacaactcttagaggaactggagtgcagggagaattattcattacatctgctcaraaagataaagtgccctaccaacacctttgcaaattgaaattcccttgctcttggcatgtgatcatcctgccaactctgtgaaagctcccttagctactca

SEQ ID NO: 32411 - DNA, 201 bp, Homo sapiens
aaagagccaagccaaagctgaagctttgttgtatcttcatcaagggaggttcccacccaatgtctgttccacaactggatgccatgttttgagaggagcamcagagaccaggatggaaacagaactggaaaacttatttagttaagtggcttagtgaaccgctgtgtcactcagagatgaggcagcagcagtggttgaggg

SEQ ID NO: 32412 - DNA, 201 bp, Homo sapiens
gagtactttacccacggtattttacagaaggcctctgttactggatgttctgaggagaaaatctggaaagtaaacaatattaacttcattttacagatgaraaaactgagggaaggagtgacttgacgaggatgtgcagtcaggggaagctggagtttgtgtctctgaggtctgtggtcttacatgatgagtgccaccctt

SEQ ID NO: 32413 - DNA, 201 bp, Homo sapiens
cctgtggggtgggtgctgtttcttcatttcacagatgatgaactaggtttagaaaggattcaactcaatttatgctctttctactcagactcatcctcaaraaaaaaaatgcagatatgcatgcaatgctaatgaaaaagaacaaacaggaaataggcttctgctgagacatgagatatgtaggttagactcaaaagaact

SEQ ID NO: 32414 - DNA, 201 bp, Homo sapiens
aatttggttttcacactttggctggtgcctgttgaagcgtctagcacactgagtggatgaataagtgcctaaatgatgtaaaaacccaagtttgatgatcrtcagaaaaaatctcagagaaattggttccaggatccccacagataccaaaatctatgcacatgcaagtcccacagttggcctgtggaacccacaggtatg

SEQ ID NO: 32415 - DNA, 201 bp, Homo sapiens
gaaaagatagttgcttttctctgttcttctgagacctcttgctggacccctcagtaaatctctgccttttgtgatcaaagacagtgctgcaagcaatcctycttggactgggcagatgtgaaaatgaccctgttgcttccagctccaccctggcatgcttagtctgggactgttgacccaacctgatttgcctatgagctg

SEQ ID NO: 32416 - DNA, 201 bp, Homo sapiens
taaaaatggcaagatataaggtattattttgtttttgaataatggtaatatcatttgatgccatcctgtgttctaagtttaaagttgttagattggttgttgctacttaagaaaaactcattcagagagttaggaaggaaaaaccaatagcttgaaaacctgtgtaccattttaagagttacttgatgtttggtaacttct

SEQ ID NO: 32417 - DNA, 201 bp, Homo sapiens
cccctccctttatagtataactcaatccacaaaatgtaatttaataaaagcttatatatatataaggatatatatatatatatatatatatatatatatatatatatataagaatgtgtatattcaggaagaagattttgaattttctttatccttcctgacttcaagctatatttttctttaaatatgttctaaaattta

SEQ ID NO: 32418 - DNA, 201 bp, Homo sapiens
gagatcgcacccctgcactccagcctgggcaacagtgcgagaccccatctcaaaaataaaagaaagtctttagttttttacagtgtttgtttgtttgtttrtttgttttccagagcaaaccccattgtcaggggaaagcagaacaaagaaaagtatttagaaatgtatttccgggatgcacagattcttttcaccctcacc

SEQ ID NO: 32419 - DNA, 201 bp, Homo sapiens
tttaaacaggagtggcgtgatctgagttattttctaaattgatcgtatgttctttttttttttttttttttttttttttgagatggaatttcactctcatwgcctaggctggagtgcagtgatgcgatctttgctcactgcaacctccacctcccgggttcaagtgattctcctgtcgcagcctcccgaatagctgggatt

SEQ ID NO: 32420 - DNA, 201 bp, Homo sapiens
gagcttttggggggaattttcaatggagcctattttataaatattttcaaaattctgttataccctttatcccaacatggatcatggaaagtaaggggttyttttagtctaaatattagttaaagacatttgaggagctaggaattccagttaacattcaaaggctactttcttcatacttgataattattttctacctca

SEQ ID NO: 32421 - DNA, 201 bp, Homo sapiens
gctatgattactaatattttacaggtaaagaaactgagattcagtgagaacttgatttacccagggtcacatagttagcacgtggtctcagacttgaatcragcgatttaatttttaagtctgctgctccatccatcaacacagtagctgcctttcacactttatataagacacatgcagcagaggcctcagaagccaggc

SEQ ID NO: 32422 - DNA, 201 bp, Homo sapiens
tcacaggtgaacttgtggatgggaacagacagtagaaaagggacagcattctttgagaataggtcttgaggaaagggaataccttttaagctgaaaagacrgaagtgcttttctctcctagccatggaatagatgatgagttggtcctctgcagagaagggacccgaagggcacaggcgaagggagtggccaatgccagtg

SEQ ID NO: 32423 - DNA, 201 bp, Homo sapiens
ctttggctgattaggtgaggcacacccacatcatgaagggtagttcccttgactcgaaatctactcatttaaatggtaattgcatctaaaaaattcctttrcagcaacatctagactagtatttgaccaaacaccaggacactgtagcctgttgacacataaaattaaccatgaagctaggcatggtggctcatgcctata

SEQ ID NO: 32424 - DNA, 201 bp, Homo sapiens
aagtggctcacgcctgtaatcccagcactttgggaagctgaggcggaaggctcacttgaccccagcatttgagaccagcctaggcaacatggtgagacctsatctctatggaaaacttaaaattagccgacgttctggtgcacacctgtgatcccagctactcaggaggctgaagtgggaggattgcttgagcctaggaag

SEQ ID NO: 32425 - DNA, 201 bp, Homo sapiens
tgaggcacacccacatcatgaagggtagttcccttgactcgaaatctactcatttaaatggtaattgcatctaaaaaattcctttacagcaacatctagaytagtatttgaccaaacaccaggacactgtagcctgttgacacataaaattaaccatgaagctaggcatggtggctcatgcctataatcccagcgctttgg

SEQ ID NO: 32426 - DNA, 201 bp, Homo sapiens
cagcccatccttagaagatttcattcataaattctttgcttttcatgtatctgttaaaacaaaaaaaattcttttaccaactattcaaagtaatgcagaaytgtgggaaccaaattcagtgtgaatctctgaatttgctataacagtagtaatattgtgatagcagcttccaactatggaccatctagtatgttctaaaca

SEQ ID NO: 32427 - DNA, 201 bp, Homo sapiens
ttttgtttttagatcatgtacaaaatgaagaaaactatgcacaagttcttgataagtttgggagtaattttttaagtcgagacaaccccgaccttggcacygcgtttgtcaagttttctactcttacaaaggaactgtccacactgctgaaaaatctggtaagacatttcatatgtgagtaaaaagaattacagcctttcc

SEQ ID NO: 32428 - DNA, 201 bp, Homo sapiens
cacttgaggagagagtagtgaataaaccttctgtctaacctatctgaaattccacaggttctctctctctctctctctctctctctctctctctctctctytttttttttttttttttttttttgagatggagtctcactgttgcccaggctggagtgcagtggcacaatctcggctcactgcaacctccatcccccgagt

SEQ ID NO: 32429 - DNA, 201 bp, Homo sapiens
ctgtattcccagctacttgggaggctgtgaagtgggaggatcgcttgaacctgggaggcagaggccgcagtgagccaagattgcgccactgcactccagcytgggcgacagagccaggccctgtctcaagaaaaaaaagttttagcctcaaaactcaagtataaagcttatatgaagcgactaaactattatcatttctat

SEQ ID NO: 32430 - DNA, 201 bp, Homo sapiens
ttctgttataccctttatcccaacatggatcatggaaagtaaggggttcttttagtctaaatattagttaaagacatttgaggagctaggaattccagttwacattcaaaggctactttcttcatacttgataattattttctacctcaagcattcacttgaggagagagtagtgaataaaccttctgtctaacctatctg

SEQ ID NO: 32431 - DNA, 201 bp, Homo sapiens
ttctctgagggcacttgcagtttacatcaatgtgctatgactgcccatgcctttaggttagggcaaagtaaaacatgttctgcagtgtagttggtaggtakaggaactattctaaacacccatcaaatgaatgaatgaatgaatgaatgaaagaaaaagaaacaaggaaggaaggagagagagagaagaaagaaagaaaaa

SEQ ID NO: 32432 - DNA, 201 bp, Homo sapiens
ttctactgtacgtttattaacactggttcttggaccgggtgcggtggcttacgcctataatcccaacactttgggagaccgaggtggccggatcacctgasgtcgggagttcgagaccaccctgaccaacatggagaaaccccgtctctactaaaaatacaaaatgagccgggcgtagtggcgcctgcctgtaatcccagc

SEQ ID NO: 32433 - DNA, 201 bp, Homo sapiens
tacttagaattgcagaaagaatgagacatccttagtggtaaacattaatgaaatctacgaatagatactctcaacaacaatgcatatgcatatctgttgayatggaaagacagtcgtgttgtattaactggaaaacagcatgatataaaacaacacagaaaggatgatcccattttatgtacctataaggaaatattgtag

SEQ ID NO: 32434 - DNA, 201 bp, Homo sapiens
gttgagcaatagattcttttttacaaggatttccccaactggagtgtatgaaaaggggctgtactagtttttttttgttttgttttttgttttgttttttktttgtttgtttgtttgtttgttttgagacagagtctcactctgggctgtactacttctttgtcctcttaatgactactttttttttgagggggtgggtgg

SEQ ID NO: 32435 - DNA, 201 bp, Homo sapiens
agccctgtcatcataaagccagtcccacatgcatacagagcatatcagctactgcatctggggtgtcccacttgacatttgtaggtagagttggacagtcscccttctcagggtgaacagaccttacagtggcttttatctgttccaccaagctgccagttaccgcaggaatagcctcctgtgtgtctggatcatatatac

SEQ ID NO: 32436 - DNA, 201 bp, Homo sapiens
ttgggagaccgaggtggccggatcacctgacgtcgggagttcgagaccaccctgaccaacatggagaaaccccgtctctactaaaaatacaaaatgagccrggcgtagtggcgcctgcctgtaatcccagctactcgggaggctgaggcaggagaatcgcttgaacctgggaggcggaggttgtggtgagccgagattgtg

SEQ ID NO: 32437 - DNA, 201 bp, Homo sapiens
cacctgcctcggcctcccaaagtggtgggattacaggtgtaagccaccatgccttgcctcttcatcatcattctacaggcccatttcttattagttgataygtactgagggagttgaaattatgttttatgtctgtcaaaaatatagatgttgaaaaattaaatctattgttgaaaaaactttaaaaatgatttccggatt

SEQ ID NO: 32438 - DNA, 201 bp, Homo sapiens
gagcaaaatatgagcaaaatgaaaagctttgaatttataagttacttgtctctacactggttatccaattaaccttttaaatgagggaagttatttctttrtacttttacatacagagctgattccttgagatcacacagatcagacagaaagaatgttagaattaggaatcatcagaattataagggtctgcagaagtat

SEQ ID NO: 32439 - DNA, 201 bp, Homo sapiens
accatcctggctaacacggtgaaaccccgtctctactaaaaaatagaaaaaattagccgggcatggtgacgggcgcctgtagtcccagctactcaggaggytgaggcaggagaatggcgtgaacccgggaggcggagcttgcagtgagccgagattgcgccactgcactccagcctgggcgacagagtgagactccgtctc

SEQ ID NO: 32440 - DNA, 201 bp, Homo sapiens
agtcaggaggctcacttgaggccagaagtttgagaccaatctgggcaacatggtgagaccctgtctctacaaaaaatataaataaaaaattacttgggcayggtggtacctacctgtggtgctaactatgtagaaggctgaagcaagatgatcacttgagcccaggaggtcaaagctgcagtgagtcaagatcacaccact

SEQ ID NO: 32441 - DNA, 201 bp, Homo sapiens
gcccttgcatgtccactgaactaggacgagctaaaacagagagaagagagaaaggaggaacagagaagccactgccctctgtgaaatgttttggcaggtcrtggtggctctctgtctaccctgtccacagctggaactgtgaccctcaaggagaagagaatgaagctcagagggacagtgcagatgacagcatgtcaccct

SEQ ID NO: 32442 - DNA, 201 bp, Homo sapiens
gaagggagacagagaagagaaggagccaacgaatagcatgttatcaggcaggaaactagggtttcattcctctggggacctctcaggttgtcagaaccaargggcaaggagctgggatattgtttcctgatttccactcatccttgtctgaaggccacagctagaagcattcatttcctggcactccgagcctgtgccttg

SEQ ID NO: 32443 - DNA, 201 bp, Homo sapiens
ccattctgaaacactgttccccacacatccctgcctttgtttggccttctttagctgtctgcatcctgccttctttttttttttttttttttttttttttytttctgtgatggagtcttgttctgtcaccaggctggagtggtgcagtgacgtgatctcctctcactgcagcctctgcctcctgggttcaagtgattctcc

SEQ ID NO: 32444 - DNA, 201 bp, Homo sapiens
taggctggagtgtagtggtgctcgctgcaacctccacctcccgggctcaagccatcctctcacctcagcctaccaagtagctgggactacagacaagtacyaccacaccagctaatttttgtattttttatagagatggggttttgtcatgtcgctcaggctggtctcaaacccgtgagctcaggcaatcctcccacctcg

SEQ ID NO: 32445 - DNA, 201 bp, Homo sapiens
tgaattttctccatttttttttaatgtgatactagagaggaatgatacttcttcctggttgtgtggaaagctacatctaggttggttataattttcattttaactcttcctccttcatacagccctagacttctcagtgtttaaatctaggtgtcaggcctcattcatatgtatgtatgtattctttttctttttttttta

SEQ ID NO: 32446 - DNA, 201 bp, Homo sapiens
cagttataacacttcattctgttctatgtatggtaactagttgtttacgtattagtgtctcactaaactgtaaatagaggctatgctttcctctttgtatrtcccaaaacgccttcctcagcacaatagctgatcttcaactagtcattcagacaggtgtgtttgaacttttagatcacatagtttaagaacagatgtctc

SEQ ID NO: 32447 - DNA, 201 bp, Homo sapiens
ttaagttaatgctttgcttttaaatgttgggattctcatagaagaatccatttctgctcatttgctgtctggctgtcttaatgcattcaaagtgtagaacmcttgaacatttacatttatttgttgttgctggtgttttctctactctttgttggcctccggatggacaccctgttaatattctttgactagcgtggagcg

SEQ ID NO: 32448 - DNA, 201 bp, Homo sapiens
gcggagccattggaagacagacagggccatagtatcaccagctgttcacatagtgccacaacactcaaatccaaggacaactcttagaggaactggagtgmagggagaattattcattacatctgctcagaaagataaagtgccctaccaacacctttgcaaattgaaattcccttgctcttggcatgtgatcatcctgcc

SEQ ID NO: 32449 - DNA, 201 bp, Homo sapiens
atcgcttgaacccgggaggtggacattgcagtgagctaagatcatgccactgcactccagcctgggcaacaaagagcaaaacttcatctcaaaaaagtgtytaaagatgagaatgtggaagtgaagtgataactcagttatgtccctgaaagttctagccggaaaggatgtgatgccatttagaggaagggaagcaagctg

SEQ ID NO: 32450 - DNA, 201 bp, Homo sapiens
aaggtttcatcctggcgtgtgagtgttttccaagcaaaaagccagtgttttacttattcagcagtgaaagcacactgatgtgtgccattttactcttgacmatttttaagttatgagtaagtgactaggagagcataagcgttttccctaaacgggagcaggcaggcattttaggactgctgtgacccagacagtagaagg

SEQ ID NO: 32451 - DNA, 201 bp, Homo sapiens
tttccaaaatattacgtcatatagagaacatttcaataatccttccccctcaatccttggtcctaggggtgagaaagaaaaaacaaaaagctttttagtcmtaggtaacttccacacctcaactaaaaagctttttagtcgcctaggatttgcttaaagaaaatcccattgtgaaattcctggaatttgtacctttggccc

SEQ ID NO: 32452 - DNA, 201 bp, Homo sapiens
atgtgctaagttataaacagctgacttagggccatcattttaaagtatgaagccttccagtcttcgcctccccagtcttttccattcttaaagtttggacyagtctgcaaggtagctgcctccctaaggatttggggtattctctaaaatttgaatatatgatattcttgtgccctttgaatacgctgtttaaaaataaat

SEQ ID NO: 32453 - DNA, 201 bp, Homo sapiens
caatcaatcaaatagtaaagaaaaactagcaccaattcttaaactgttccaaaaaaattgaagacaaaggaatttttcctaactcttccaatgaggccagyattgccctaataccaaaaccagacaaggacacaacaaaaaaagaaaactaccagccaatattcttgtggaacgtagatgcaaaaaatcctaaccaaatac

SEQ ID NO: 32454 - DNA, 201 bp, Homo sapiens
atgtatattcttctatatctgccttcttcctgcaactggtttcctttgccgggtgaacacttttgctttctcgtgggcacccagctgcaggtgtctgtctrtctgtctgtcgcatccatcagcacactttaattttatgtttaggagcctaggtctagagaagttaatgacttgtaaattgctctccaacgtagagctaga

SEQ ID NO: 32455 - DNA, 201 bp, Homo sapiens
ggttgcagtgagccgagaacacaccattgcactccagcctgggcaacaagagtgaaactccgtctcaaaaaaaagaaagaaagaaagaaagaaagaaaacwcgacatataaatggctaataagtatatgaaaaaatgctcaacatcactaatcatgagagaaatgtaaatcaaaaccacaatgagatattatctatttcca

SEQ ID NO: 32456 - DNA, 201 bp, Homo sapiens
cagaggggctgtcctgaaatatgtatattcttctatatctgccttcttcctgcaactggtttcctttgccgggtgaacacttttgctttctcgtgggcacmcagctgcaggtgtctgtctgtctgtctgtcgcatccatcagcacactttaattttatgtttaggagcctaggtctagagaagttaatgacttgtaaattg

SEQ ID NO: 32457 - DNA, 201 bp, Homo sapiens
agagtgtataaagctcttttggagcccttctggattactaggtatctactaatctgtgttaaacattcagtgtggcagtgttcttagctttctttcttttytttttttttttttttttttgagacggagtctcgctgtgacagccaggcaggaatgcagtggcatgatctcagctcattgcaaccgccacttcctgggttc

SEQ ID NO: 32458 - DNA, 201 bp, Homo sapiens
taattaagctttggtatgcatgaattaattaaaatcctctcccaggttcagaggggctgtcctgaaatatgtatattcttctatatctgccttcttcctgsaactggtttcctttgccgggtgaacacttttgctttctcgtgggcacccagctgcaggtgtctgtctgtctgtctgtcgcatccatcagcacactttaat

SEQ ID NO: 32459 - DNA, 201 bp, Homo sapiens
cagccacttcaatgtcactttgaataaacaaaactaagatcaaatacactactcccttaacagcttttaaaaacgaaccccatttttgtgtgtatgtggartattactatcattcctgctgtcttgtctttagctctggagaaagttgagtcttttttttagtctataaaaatcagtgtctatataaatgttgttcaggct

SEQ ID NO: 32460 - DNA, 201 bp, Homo sapiens
ttcctacagtttcaacaaaccctgatggtggcatttcagtttatcgtagaggtttcttttcccctacaagggtcattctctcttgcccaattttggctgaraagggaggaatatcatggccgttttggctgtatggtgttactgtataatgatatggggattggtgagtgaaaaataaaatgaaccctcacttgcttaggt

SEQ ID NO: 32461 - DNA, 201 bp, Homo sapiens
gatggtggaactgagatgtctctcggtttttcgccctggatggagatgccacactgagctaggaatcactggataaaagccaaggaggtcccttggctcartttatttttatatccccacctctgtttccctctattctgcaaatattgaagctgttcccttatgtaacatcttttatcccagacttcctgtgctctgtgc

SEQ ID NO: 32462 - DNA, 201 bp, Homo sapiens
cctggctaattttttaaatttttatagagatggcgtcttgctgtgttacccaggctggtctcaaactcttggcctcaagcaatcctcccacctcagctttytacagtgcaggggattacaggcatgagccactgcacctggccaattttattttttttttaaccaaatttttgaaaccctacttgtgagttattaggttga

SEQ ID NO: 32463 - DNA, 201 bp, Homo sapiens
taagtttccatatcatttttattaacctcttgtttagattcaagcctacagagtagctactcctgttgtgttcacaggattttctcctgagctacattttyttaacctcagactatctctccctgaccaaagagcccagtagtccttagtggggtggtgtgggagacacagcctcagcagggctgctgtactcttgatcaa

SEQ ID NO: 32464 - DNA, 201 bp, Homo sapiens
tggatgtgggtgacccatgtttatggaatttaagaataatgaatgaatgaatgaatattagtcctttaagatcatgaactttcttttcttttgttctttgytctgtctttaggcagcaggagcagtccctggcacagggtagttccctgcttctaagaaaattatggtaattgaaatgtattctttgttttacccttaaca

SEQ ID NO: 32465 - DNA, 201 bp, Homo sapiens
tccagattcacaggggagatttgggggtaatagttgttgtcagcagctctctattttttagatcaatgggttcacgctgatcgcttgcctaacattaaatrtggaatcaaacttgtaaagtaggcaagactcgaggcctcctgtcccaatctgttttaggccacctgttcacaccaccactctgttgtacccaccagtctc

SEQ ID NO: 32466 - DNA, 201 bp, Homo sapiens
aagtactataagagaaataagtttccatatcatttttattaacctcttgtttagattcaagcctacagagtagctactcctgttgtgttcacaggattttytcctgagctacattttcttaacctcagactatctctccctgaccaaagagcccagtagtccttagtggggtggtgtgggagacacagcctcagcagggct

SEQ ID NO: 32467 - DNA, 201 bp, Homo sapiens
taacaaggtccctaacactggagccaagctttggtaacaccctacactgaggtccagttggagctgttcagggaataacagcagcagcttgcccaacaatkttggtacaacagtttggtgggagaggatgagtgacttatttgagcggagccattggaagacagacagggccatagtatcaccagctgttcacatagtgcc

SEQ ID NO: 32468 - DNA, 201 bp, Homo sapiens
ctatgccctggttgtgtctgggcagttagggatggaaggtggcaggtaaatgccccagattcctttcccttcggtggggcaattctgagatgtgctctccrcagtctctcagaaggtcccttagtgggattgagcctgaggtgcccaagcaataaccttggacacgttcctcaatgtctgagtttcagcttcttctaggat

SEQ ID NO: 32469 - DNA, 201 bp, Homo sapiens
agattcttacaggcaagagcaaagagagaaatacaactaattgttaggttcatggtagccttaagactgacactattctaacactcttgaattaatacctrataacaatttcccccctcccctggccctccatcctttggcatttagagaagtgtctgcagtgcacgtgggaaaccataacatgcactgaaagaacattcc

SEQ ID NO: 32470 - DNA, 201 bp, Homo sapiens
cgtctcactctgtcacccaggctggagtgcagtggcgcaatctcggctcactacaacctctgcctactgggttcaagctattttcctgccccagcctcccragtagctgggactacaggcgcctgccaccatgcctggctaatttttgtatttttagtagagatggggtttcaccatgttggccaggctggtctcgaactc

SEQ ID NO: 32471 - DNA, 201 bp, Homo sapiens
ctcacacctgtaatcccagcactttgggaggccaagacaggaggatcacttgaggccaagtatttgagaccagcctgggaaatacagtgagaccttgtctytaccaaaaaaaaaaaaaaaaaaaaaaattagtaatgagaccttgtctctacaaaaaaaataaaaattaaaattaaccaggcatggtgggtcatgcatgta

SEQ ID NO: 32472 - DNA, 201 bp, Homo sapiens
tttgagcacctactatgtgcctggtttttggtagatgactgagggaagggtaacagaatgaattagacatgctttctgtcccaaaggtgttcacaggtgartggggtggtggttgtggggtgccaggttagctgcaatatagcatagaccggtcagagctgtgataattcagattgctctgagagcacacatgaggtcatg

SEQ ID NO: 32473 - DNA, 201 bp, Homo sapiens
aaagaagtccttaaatattaagttatatgggctcatgaacatatactgatggttagtttaattaaaattaaataaaactaaatttgaaagcctttggttcytctagtaatgccagtttatctcatttcttcttgtatcaatatcatagaattacagaacattctgtccaggaggtgagcaccctgccagcctctccctctt

SEQ ID NO: 32474 - DNA, 201 bp, Homo sapiens
tgatgtgcattgtgtgtttgcatgtgtgtgtgtatgtgtttctagatatgtctgtgaattttggggtgtattttttaaatgctttgcttgtatttttaatrttgctaataaaatactagctacatgattttgagggcttggcacctcttgactaggtaacagtactgtgctaaactctttacatgtttatctaatactttt

SEQ ID NO: 32475 - DNA, 201 bp, Homo sapiens
taagtagtgaatcatatgattttatgagcagttggtgccctgagtttactctccagcatttctgcgctctgttataatatattctcatttcgtccacacarcactttgttaggcaacaaagccactattttctcatttgacagatgaggaaacgggctcaaaaagttaaaaataatttctcaaaggtcatttgactgaaaa

SEQ ID NO: 32476 - DNA, 201 bp, Homo sapiens
tgtaatcccagcccctcgggaggctgaggcaggagaatcgcttgaacctgggaggtggaggttgcagtgagccgaggtcacatcactgcactccagcctgkgtgacagagtgagactctgtctcaaaaaaaaaaagaaatgtattgtctcacagtttggaggccagaagttcaagatcaacgtgttggcagtgtcgtgctt

SEQ ID NO: 32477 - DNA, 201 bp, Homo sapiens
aaattcatcatgtctaaaaaatcaaaaatttcttaatatcatcaaatacccagtgttaacatatccagctgtctcacaattgccccctttttttttttaaraacttgtttgtttgaataaggattaaaataaagtccacacagtagagttgattgatttgtctctaagtgtcttaggctaaagtttcccctgcatctctct

SEQ ID NO: 32478 - DNA, 201 bp, Homo sapiens
ccttgggccgagacttcacacagaaatatttggggatctgctctatggttctctgggtttgggcctcagtttccccatttttcagcttttgtggattctgrtcattctccccacttgatgtgcattgtgtgtttgcatgtgtgtgtgtatgtgtttctagatatgtctgtgaattttggggtgtattttttaaatgctttg

SEQ ID NO: 32479 - DNA, 201 bp, Homo sapiens
ttgacacatattttatcctttgatcctcataacaaatctgtaatgttagtaatattttaattttcaagtaagggtcctgaggcttggcagtcagcagtttyctgtcccaggttttactgccgaagggaaagaaccgaggtttatacaaagatctgtctgaccctcaagtctccaagtctctgccattaactgctctgcttg

SEQ ID NO: 32480 - DNA, 201 bp, Homo sapiens
gtcaagttttctactcttacaaaggaactgtccacactgctgaaaaatctggtaagacatttcatatgtgagtaaaaagaattacagcctttccaaaataytacgtcatatagagaacatttcaataatccttccccctcaatccttggtcctaggggtgagaaagaaaaaacaaaaagctttttagtcctaggtaacttc

SEQ ID NO: 32481 - DNA, 201 bp, Homo sapiens
gggtgagagctcagtccccaaaactgcccccccccgcgcgcgcgcgcgcgcacacacacacacacacacacacacacacacacacacacacacacacacayaccagttgcaagtccaggccttcagaacttctgactgactggctacaaggtggggctcctacaactccctctttggattcatttaatttgctgtagcagc

SEQ ID NO: 32482 - DNA, 201 bp, Homo sapiens
agagctcagtccccaaaactgcccccccccgcgcgcgcgcgcgcgcacacacacacacacacacacacacacacacacacacacacacacacacacaccarttgcaagtccaggccttcagaacttctgactgactggctacaaggtggggctcctacaactccctctttggattcatttaatttgctgtagcagctcaca

SEQ ID NO: 32483 - DNA, 201 bp, Homo sapiens
atgagtccctttattaaaatgattgggagatacagtgataaatgtttgacaaaaaaattagtaaaatggttgggagggttaagggaattcagccatctacyctagaatgaattacttcagttagataatcactacttatctttttccctgtctgaaggatcacacaggggatgtgagagctttagttgtggccacagagta

SEQ ID NO: 32484 - DNA, 201 bp, Homo sapiens
tcctcaagaaaaaaaatgcagatatgcatgcaatgctaatgaaaaagaacaaacaggaaataggcttctgctgagacatgagatatgtaggttagactcaraagaacttcctgacagtgtattaaataccaaccggatggccatggaagtaggatttttttcttcctgattttgggataattttgtcaatgataggctggt

SEQ ID NO: 32485 - DNA, 201 bp, Homo sapiens
gctgggcgtggtggcggacacctgtaatcccagctacttgggaggctgagggaggagaatcaattgaacccaggaggtggaggttgcaatgagccaagatygcgccactgcactccagtctgggcaacgagtgaaactgtctcacaaaaaaaaaaaaaaaaagaaaaagaaaaagaaaatgtcttatggctacagcattgt

SEQ ID NO: 32486 - DNA, 201 bp, Homo sapiens
gtctcatgaatattttcctgtagtttttttttttttttttgagatggagtttcactcttgttgcccaggctggagtgtgatcttggctcactgcaacctcygcctcctgggttcaagcaattctcctgcctaagcctcccgagtaggtgggattacaggcacctgccaccatgcccggctaatttttgtatttttcgtaga

SEQ ID NO: 32487 - DNA, 201 bp, Homo sapiens
aagaaaaagatttcaggagagaggtcagcaattctaaaagctttaaggcaggactagctcattggggttagaaagactgtaggtgtggctggaacataatragtagtggagggtgtgggaacagaggggagagggcagaaggctgggtcacgtagggccttgcaggcagtagcgaggacttagttttattggaagaacagt

SEQ ID NO: 32488 - DNA, 201 bp, Homo sapiens
gtgtaggagaggggtgtgtaaaatgaagacatctgtgtatattgttaattgggaaaaacagtttacaaaatagtatatacaagttgaaccaacatatgtcaaaaaaaaaaaaaacagacatctcacacacacatcttggtaaaattaaggtattaacagtgattattgctgcatgtgaaagtgagattccaacaactaatg

SEQ ID NO: 32489 - DNA, 201 bp, Homo sapiens
cagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaaac

SEQ ID NO: 32490 - DNA, 201 bp, Homo sapiens
atggttggattctggtgaggccctcttcccttgcaggctgctgacctctcattgtgtccttatatggctgaaaaatagctagagagctgctctctgttttktttgtttgtttgtttgtttttgagatggggtcttgctctgtcaccccccaggctggaatgcaacggtgtgatctcagctgactgcaacctccgcctcctg

SEQ ID NO: 32491 - DNA, 201 bp, Homo sapiens
ccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaaa

SEQ ID NO: 32492 - DNA, 201 bp, Homo sapiens
gctgtggcaagcccattgctgtttgtctctttggcagggaacattattgtggaattttaaatgattgctctggagagattgggcagaacattgattttaaagcaaagaagtctttgagctttatcatcttccttcctgtgtggaatctgccttgtctcctctcccttagccaaattgtgcaagggttgtgtaaataaattt

SEQ ID NO: 32493 - DNA, 201 bp, Homo sapiens
cccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaa

SEQ ID NO: 32494 - DNA, 201 bp, Homo sapiens
ccaggctgagagtggcaatatggagcagttaggaaaccggagccataaatgtgcaagtggacgaggtgaggcagccagtgatgagtccagttaggctaagmtcccaaagctgactttgctaagaggcagattcctgaagggggcccacaaatgattctttttgtggaatcctctttcacatgttaccttggaggtagtctt

SEQ ID NO: 32495 - DNA, 201 bp, Homo sapiens
tccatttcttgctggtaggacttcacttgcctaaactttctattaacacatttcaaagcactttccagtgaaaccagagggaggagaccttttttttttttccctcgagagtccaacttatactggagagcagtggcacaatcatagctcactgtaacctcgaactcctgggctcaagcagtccttcagcctcagcctctc

SEQ ID NO: 32496 - DNA, 201 bp, Homo sapiens
accattggtgattgagctctatctttagtccttcttcttcccccagacatctttttggccgtctcattagcgtacagaagacactcttaccactcaggagrctgcaagagttctgtgccagaagtcaaggacaaagaccaaatctattttttatgataccacaatgatctcataatattaatgagatcagatgagaaaaca

SEQ ID NO: 32497 - DNA, 201 bp, Homo sapiens
gaatctcgctctgtcactcatgctggagtgcagtggcgcaatctcggctcactgcaagctccgcctcctgggttcacaccattctcctgcctcagcctccygagtagctgggactacaggcgcctgccaccacgcccagctaattttttatatttttagtagagacggggtttcaccgtgttagccaggatggtcttgatc

SEQ ID NO: 32498 - DNA, 201 bp, Homo sapiens
ataggctatgtttcttccaagaggcaaaggttggacctcttaacaaatggtagttgatttctggaacattaatggtcacttagaactgtgggtactcataktaacttagtgccagatggtgtgggaccatcaaggattctactgattaggtgcagagaatgagcatcccagagaaaagcaaaacttagcttagccctcaga

SEQ ID NO: 32499 - DNA, 201 bp, Homo sapiens
agggttaccaggagcagctaatgagactgtgtgtaaaacgagccacctctgtggcctggaataaagtggagcttcattggtgtcagttcttttcttttctyttttcttttgagacagtctgttctgtctcaaaaggtctcattctgttgcccaggctggagcgcaatggcatgatctcagctcactgcagcctcaacctcc

SEQ ID NO: 32500 - DNA, 201 bp, Homo sapiens
tattttcagactagttaggttttaatttcatttgtggccactccacttaccctttcagatgaggagatagagctgctttggaagggtttattgtacccacrtggtcattttggattcttgcacagtctccaggaatgggcattcttgttttaatttcaagtaatcaggagattccgggaccatctgttcactagtatagga

SEQ ID NO: 32501 - DNA, 201 bp, Homo sapiens
ccccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagaga

SEQ ID NO: 32502 - DNA, 201 bp, Homo sapiens
taagtcaccagtattttaaagggcacctggaagctttcacaagcctgtgcatctccacgtggtgttgtggttggttatttatattaagcctattttctgtrtgcaggtacacatgccagcgatcagttttagtgaaaatgatgctcattgtcaagactagttttcaatttgtgaagtccacaaaagctgtggttcccaggg

SEQ ID NO: 32503 - DNA, 201 bp, Homo sapiens
ttgactcacactttccaccttctcatagtttagggtctctcatgctgccatggagcttttttgttagaggagagagagagagagagagagagagagagagwgtgtgtgtgtgtgtgtgtgtgtgtgtgtgtgtgtgtgtgtgtttgcagtcttggctctcagttcacgtttggcctgcaaatcccaatcacaaatccattt

SEQ ID NO: 32504 - DNA, 201 bp, Homo sapiens
ttaataatgagtatccacgtggagtgcagatggtaacagtcgtattgcaattggtgaaccttaagcagtttcagatgaaatttcaaaaatattttgatttrtttttaccaatagactaataattaagccatttctaaaaggaggaattaatatacaaatgcaaaagcgatttgtagttttgactaaaacatctgcaagtgt

SEQ ID NO: 32505 - DNA, 201 bp, Homo sapiens
ttttcttgagcgttggtaaccacggcaacaaggacgtcacttccacggtgcaaacatgcttgccaagctgaagtgtggagtgacagtttttggctgagccrtgaacctaaaagtggaggtttacaaagttactgcagacaggtcattagcacgactggctgcagtgagctccctaagtcttcatcgctcctgccttttcat

SEQ ID NO: 32506 - DNA, 201 bp, Homo sapiens
catggaagtatattatcaagaaagtaaaagacaacccacagaataggagaaaatatttacaaaatatttttctgataagagtctgatatccagaatatatwaaaaaaactcaacaacagtccaggtgtgctggctcacacctataatcctagcactttaggaggccgatgcaggaggatcacttgagcccaggagttcgag

SEQ ID NO: 32507 - DNA, 201 bp, Homo sapiens
tatttccattgtaaagacaaactaaagctcacagaggtttggaaaattatttaaggccacattgctggtcagtggcagaagtggaacttggctgcagggartctggccctggagcctgcagttttcacttttactccgtgtgctactatattatccccaggctctaaggaaagcctgttaagatgatcctttcatcccctc

SEQ ID NO: 32508 - DNA, 201 bp, Homo sapiens
catggcctgatcactgtgaaattctgggaccttagaagccttttgtattgactgctcgctcgctcgctctctctctctctctctctctctctctctctctstgtgtgtgtgtgtgtgtgtgtgtgtgtgtgtgtgtgtgtatttttcttttacttcttgtttggccaagaaactgtatgtgttaatagcttgtttgttttt

SEQ ID NO: 32509 - DNA, 201 bp, Homo sapiens
acggcttcagctggtccctctgtttggggtccctgacttcccgcaacacagagtctcgctctgtcacccagtctggagtgcagtggtgagatcttggcccrctgcaatctctgcctcctgggttcaagtgattctcatgcctcagcctcccgagcagctgggattacaggtgtgtgccaccatgcctggctaatttttgta

SEQ ID NO: 32510 - DNA, 201 bp, Homo sapiens
taaggttgaaagccttatctgttgttccccattctcatggcctgatcactgtgaaattctgggaccttagaagccttttgtattgactgctcgctcgctckctctctctctctctctctctctctctctctctctgtgtgtgtgtgtgtgtgtgtgtgtgtgtgtgtgtgtgtgtatttttcttttacttcttgtttggcc

SEQ ID NO: 32511 - DNA, 201 bp, Homo sapiens
ttgcttgaacctgggaggcagaggttgcagtgagctgagatcgtgccattgcactccagtctgggcaacagaactagactctttcttaacaacaacaacawcaaaattctcataaatatgtgaatgaatgaatgaatgaataaaatcacagtccacagcaatgcggttgtcatccctgggaaaactcaagtccaagggaat

SEQ ID NO: 32512 - DNA, 201 bp, Homo sapiens
aactgatttttgataagggtgcaaagaacatacattggggaaaggatccttctttaatttgctgagaaagctgggtatctctcaactcaagatgaattaargacttaaacataatacccgaaactataaaactactagaagagagcataagggaaacacttcaggacattagtctgggcaaaaattgtatgtgtagcacat

SEQ ID NO: 32513 - DNA, 201 bp, Homo sapiens
tctattatttgtagagaattataaagctctttcatatttgttctaccatttaatccctctatctttatctcctcccctcccctcacccccctccccccccmaaaaaaaactgtattagccccattttgtagatgaggaagctgagacaaagaaatcataggcaagtatgccaggtcggtatggttaatgtatggtagaact

SEQ ID NO: 32514 - DNA, 201 bp, Homo sapiens
ggccagaatttagttctctggctacattttgcggcaaagaaggctgggaagtgtaatctttattctgcaagactgtgtgcttaccaaattgagagttattrttatagaagaagagagcagatattggaggacaaatcttttcctccacactactcattcttgaaagatcgtgctgacaggataggctctgcagccagcctg

SEQ ID NO: 32515 - DNA, 201 bp, Homo sapiens
aagacacctgatttcagcagattgcagtaactccataatttatttgcatctaagagaaggaatcatgtttagttacagcattttcatttttttttttttttaaccacagatggcataaaattcatctccagagagacttctaactaaacctgagtatgaatttttatctctcagtttcttatgcaatttttcactgcatac

SEQ ID NO: 32516 - DNA, 201 bp, Homo sapiens
cccaaagtgttaggattatagccatgagctgtaacattaagcatggtatgttctttgacatacacattgtctctctctccaagagagatgaagggtgtgaytgcctagcctagagtagtcacacaggaagtgctcaggatatgttagtttgacctgaatatattgagaaagagcttccctcatgtacatccagcccaaagt

SEQ ID NO: 32517 - DNA, 201 bp, Homo sapiens
ctggccaccagagttcaagtgctcagtaaatgttagacagctgcagtagtggtgctagaagtagaagataataaaactcagtgtgtatatatatatttttyttttgcaaaagtgggatcctgttaaatcacctgtcttaaaaactgccatttccttttatattgagcatttctccatgtcattagtctaccaaaccatcat

SEQ ID NO: 32518 - DNA, 201 bp, Homo sapiens
catgtcccatcctttaaggatgtttcctggaagttgcacctcctgctcctacttatattctactggccagaatttagttctctggctacattttgcggcaragaaggctgggaagtgtaatctttattctgcaagactgtgtgcttaccaaattgagagttattattatagaagaagagagcagatattggaggacaaatc

SEQ ID NO: 32519 - DNA, 201 bp, Homo sapiens
ttctgctctagccatcacatctaacagcaggaggaaggaacgagacagagaaaggcatgtcccatcctttaaggatgtttcctggaagttgcacctcctgytcctacttatattctactggccagaatttagttctctggctacattttgcggcaaagaaggctgggaagtgtaatctttattctgcaagactgtgtgctt

SEQ ID NO: 32520 - DNA, 201 bp, Homo sapiens
aacctctattcccaaggtcacctcacagccccattttagctgcttctgctctagccatcacatctaacagcaggaggaaggaacgagacagagaaaggcaygtcccatcctttaaggatgtttcctggaagttgcacctcctgctcctacttatattctactggccagaatttagttctctggctacattttgcggcaaag

SEQ ID NO: 32521 - DNA, 201 bp, Homo sapiens
attttcaaaatttttctattataggattacccaaagtcatgtttattttgtttttttctttttttaagtcaagagtccagcacaaaatggcattcattttrcaggtatcttttcaggtgatattaattataattgcaataactcagtgcattattagaattaggttttgctgacaatgacataaaatctaaaagaacattg

SEQ ID NO: 32522 - DNA, 201 bp, Homo sapiens; identical to SEQ ID NO: 6131

SEQ ID NO: 32523 - DNA, 201 bp, Homo sapiens
actttgtgatgtgggaggctccacggcctccctcggtatcttggaagatggggatgatggtgatatccacatcgcggggctcttaggaagatgaagctacrtcatgcagcaggtctcaagaaggccagtctcctctctttccctgccctgtagtcccatctctctcctgcccagagttgagtcacctgggccagtgtaccc

SEQ ID NO: 32524 - DNA, 201 bp, Homo sapiens
attgtaattacttcaatttttaggttgaaaatagtttttaaaggatgattagataagcaaatgtgtcctgaatgggtggatgaagtgagaggctggaggcrgagaggccaacctgagaggcttttgatatgatcgagacatgatactgccttccagggtaaatgaagctttacttttattttcaaaatttttctattatag

SEQ ID NO: 32525 - DNA, 201 bp, Homo sapiens; identical to SEQ ID NO: 6132

SEQ ID NO: 32526 - DNA, 201 bp, Homo sapiens
cacagctgtgtatgcattttagacatttctccaactttccttggagatctgtggcagtagataggaagaagagtagaaagggtgaagacttgctcagtatrtgacagcacctgccaccatgaaagtacactactgcatgattcagactcgcatgggaaatattttcctatcagtggtgttattcatatattgatgacttta

SEQ ID NO: 32527 - DNA, 201 bp, Homo sapiens
gacaaagtaccacaaacttggtggcttaaaacaacagaaatatggccaggcgcggtggctcacacctataatcccagcactttgggagacggaggcgggcrgattacctaagatcaggagttcgagatcagcctagctaacatagtgaaaccccatctctactaaaaatacaaaattagctgggcgtagtggcgggtgcct

SEQ ID NO: 32528 - DNA, 201 bp, Homo sapiens
ttatcttgggtgatatgattgttttcacagggctgtttctgaaacttcgttttgcattatcttaatcccaggtgtctatctctggtaggctgatgagacartttggagttgagtagtcttcattgcatgcagcctggtcttattctggggctctcttttcctgtctcacttggaaatttcatttcccagtaatcatacttc

SEQ ID NO: 32529 - DNA, 201 bp, Homo sapiens
gaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtgagttt

SEQ ID NO: 32530 - DNA, 201 bp, Homo sapiens
ttttatactaaggtcaagacattttttgcccttttctctcttattctttcataaatttatagtttatgagactggagctgtttgggagaagtagtttcttsaaatgttctctggtggtttcattgggagtttagtatctttttagcttttctgctaggtctgacatctatctggcttaccgtcttttagagacaatgcaaa

SEQ ID NO: 32531 - DNA, 201 bp, Homo sapiens
ctggaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtgag

SEQ ID NO: 32532 - DNA, 201 bp, Homo sapiens
cggtcattatcagtacctttacttctgcaaaaaaatgtgactggtattatcttctacttggttgtaacggtttacgttctcctccagttctgttgttctcygtgaggaatgtagttttttacatgccttttccattggagagttacaacaaaaaagcaaaataaatctatcttttctctgatatggcctccttatttgttt

SEQ ID NO: 32533 - DNA, 201 bp, Homo sapiens
cctggaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtga

SEQ ID NO: 32534 - DNA, 201 bp, Homo sapiens
tcctctggtgattcagctcctcctagccccagaaccaaaagcctcttttctccagagaaccgtttgtttaatgaagctaatgaaacttgagatgtccccaygtgcccctccccctcagctggtgtctctccagggcttggctgccacctttggccttctttctatggccattaatctagtgctcccagcagatggcagctg

SEQ ID NO: 32535 - DNA, 201 bp, Homo sapiens
gttgggagttcgagaccagcctaagcaacatggagaaactctgtctgtactaaaaaagacaaaattagctgggcatggtggcacatgcctgtaatcccagmtacttgggaggctgaggcaggagaatctcttgaacccgcgaggcagaggttttggtgagccaagattgcgccattgtactccagcctgggcaacaagagc

SEQ ID NO: 32536 - DNA, 201 bp, Homo sapiens
aactggatcttgctagcccagtctgctgtcattaagtcctggtctcagaagacacactgtgcgaggccgcagtagctttccctgatgttaggctagcagcctttcattagaagccatttgtggtgttggatgttcaaacactacccagacctttgccttcattgtctgtttgtccagggagcctcagagagatggtttcca

SEQ ID NO: 32537 - DNA, 201 bp, Homo sapiens
tagtaaatggccaaagccaggattcagacctggagcctctgtctccaggctcagcatacacaggcacctccaggtgtttgtggttttcccttctgccttargtatggattctttggtttttaaccaaacaaaaaccagagtactcttttttttcccgtggtgacttaaatttcttgtaattgtttttatttcagttctctt

SEQ ID NO: 32538 - DNA, 201 bp, Homo sapiens
ggcactgatttgctgtgtgatctcacacaagacaccggctttcggccaggcgcgatggctcacgcctgtaatcccagcactttgggaggccgaggtgggcrgatcacctgaggttgggagttcgagaccagcctaagcaacatggagaaactctgtctgtactaaaaaagacaaaattagctgggcatggtggcacatgcc

SEQ ID NO: 32539 - DNA, 201 bp, Homo sapiens
tcaagtttgggtctggcattagaggcttttcttaatgtattcacctggtgtgttcagttatttctgaagatatagaaatgtttgatgaaatgaatgaagakacagaatgtagattcagtatcaagctctatctcataacagtaacattcctactacatgcaaaccctatacatactattatttaataccttttttcaccct

SEQ ID NO: 32540 - DNA, 201 bp, Homo sapiens
tcatttaaaaatattttttaaaagattttaaactttctgaaaaatggcaagtacagtacacagaaccctcccccctacaaccacttatttgagattaagtmactgatatgattcccctcatccctgaatgtctagacccctgttgtatacaatcactttgcagcttgagagtggattccactcaggtggaatcactgacca

SEQ ID NO: 32541 - DNA, 201 bp, Homo sapiens
gccgggaaaacttgtagagtctgagaatcttaaaaagctggcagactgactggcacagggttgacctgttggggccagggtttctaagaagtccgcgtagyggaaagtgtgtgggtgctagaaggggtggttgaatcctggccctggcactgatttgctgtgtgatctcacacaagacaccggctttcggccaggcgcgat

SEQ ID NO: 32542 - DNA, 201 bp, Homo sapiens
gcgagcatattttccagcaaccctgtagtagagggttaatgttaaattacatgcagttgctgttgatgttagtttaaggttaataaatttaaaagcaaatatttttttttatgagaaatactgttgtaagattaggtagaaaaatagagttaactataatgcaagtgtagtcacttaggaacttggaaccaggctagaagt

SEQ ID NO: 32543 - DNA, 201 bp, Homo sapiens
actatctgtattctcaggacatcctgctaacaatttttttgtttgcttccttcgagctagaggtacagtcaggtcacagaatggctattttacttggaaaytgtatcacagaaatctgcattggccttctctctctgggtgtgtgggtaattctgcaaacctcggattttactttcaaatttatccacagctaaaccagac

SEQ ID NO: 32544 - DNA, 201 bp, Homo sapiens
ggccgggaaaacttgtagagtctgagaatcttaaaaagctggcagactgactggcacagggttgacctgttggggccagggtttctaagaagtccgcgtartggaaagtgtgtgggtgctagaaggggtggttgaatcctggccctggcactgatttgctgtgtgatctcacacaagacaccggctttcggccaggcgcga

SEQ ID NO: 32545 - DNA, 201 bp, Homo sapiens
ggaattatttgtacacatatacgtgtactgtagtatagtgtttaagaacacaagctctggagctacaccacctaaattcaattttcttttcttttcttttytttttttttttttttttgagagagtctctcactcaggctggaatgcagtgtggtgatctcggctcactgcaacctccgcctcccaggtttaaatgattct

SEQ ID NO: 32546 - DNA, 201 bp, Homo sapiens
tcatctaatagtgacccccttaggggtgaaagagacagtcacacatagttatcaaaacctagaaaacctaggtttgctacactaagctgagatgaccactmtgtcagtatgaaacttggagagggactttggtaggtggcatgtattactgggaggcagtttaatctgttgggacataagtttaacattcttgtttctttc

SEQ ID NO: 32547 - DNA, 201 bp, Homo sapiens
cttcagtgaaatatcatctcaagccagctaaaatggcttttataaaaaaaacagtaatggatgctagcaaggatgcagagaaaggggaactctcatacgcwgttggtggtaatataaattagtacaaccactatggagaatggtatagaggctcctcagaaaactaaaaagagaactaccataagatccaggaatcccagt

SEQ ID NO: 32548 - DNA, 201 bp, Homo sapiens
gggtaggatttagtccctgaatgctgtcagggattgatagtctgggactttgcggtataggatactcacttggaagatacaaggtgtttgtttgtttggcrtttgttttttgtgttttattttatttatttattttttgagactggattgctctgttgtccaggctggagtgctgaggtgcagtggtgcaatcatagctca

SEQ ID NO: 32549 - DNA, 201 bp, Homo sapiens
ttcctgagtggaagtgtgccacctgagacaagaaatcttcacttgctggtaaagagcgtggatcagaatctggcagacctggatctgaattccaccagctytgctgcttactagctgcaacttaaccaagttttatacatactctgtacctcagttttacaaatggagatgagattgaagtgctttaattcattagagttg

SEQ ID NO: 32550 - DNA, 201 bp, Homo sapiens
aacccacagaataggagaaaatatttgcaaattacccatctgacaagggactaataaccagaatatataaggatctcaaataactcataggaaaaaaatcyagttttaaactgggcaaaagatctgaatatatatttctcaaaagaagacctacaaatggcccacaggtttattaaaaaatgctcaacatcactaatcatc

SEQ ID NO: 32551 - DNA, 201 bp, Homo sapiens
cccgggaagcggagcttgcagtgagccgagattgcgccactgcagtccgcagtccggcctgggcgacagagcgagactccgtctcaaaaaaaaaaaaaaaacagtgcaagatggcagaagcccaatcccgggggtgaggggtagggcgcggtgggtgtgtgtcgcagaggacaggctcagccttccatcctaaggctatca

SEQ ID NO: 32552 - DNA, 201 bp, Homo sapiens
attagggtatcactttcaataacactttctacttcagcttcctcatctgtgaaatgggtttgagggttcctgccttgcttgtctgtaaggattgttttgartgaactaatggatgaggaagggctttgtaaacatgcctaacactctctaattgtgagggcctttatgaaaagacttaaaagtaagaggtaaaagccatgg

SEQ ID NO: 32553 - DNA, 201 bp, Homo sapiens
gcttcattcagtctgctttgtgttgggcccactgtgatagggagatgagacagtcctcatgctcaaggtcctcgttgtttgtagggagacagcaaaacagrtagtgttttgagaaatagtctgctgtagggacatggttagagaagcttccaatagggcagagaaaattctaaacacgttttctgaggcatattgtttatt

SEQ ID NO: 32554 - DNA, 201 bp, Homo sapiens
tgggtgagcaagcattacctcctgagctccacctcctgtcacatcagcggtgacattagattctcaaagcagcgcaaaccctgttgtgaactgtgaatgtragggacttaggttgaacactctttatgagaatctaatgcctggtgatctgaggtggaagagtttcatcctgaaaacagctcccccaacccctgccatctg

SEQ ID NO: 32555 - DNA, 201 bp, Homo sapiens
cctgggctcaagcaatcgtcctgccttggccccccaaagtgctggtattacaggcatgagccatgtgtgcagtagcccttgcatgtccactgaactaggaygagctaaaacagagagaagagagaaaggaggaacagagaagccactgccctctgtgaaatgttttggcaggtcgtggtggctctctgtctaccctgtcca

SEQ ID NO: 32556 - DNA, 201 bp, Homo sapiens
agtggctaagagatgaatgagacatcctcgaggtaattttcccttctatttggaagatttatgtgttaagtgtagtgataggtagtcagaactcacacatrtgcttcactttccagctaacaacacttttatctgtagtagctcatctgatgctccttgaaactagaaaatgtccactttggagatgagcattctgttatt

SEQ ID NO: 32557 - DNA, 201 bp, Homo sapiens
tggatccatcaaatggaaaatcccagcattgtaacctgtgggatgactttggtgtttcccagatgagaccaccaatagtagtttccatggtcatgtctcabaaatatagggacaaactcagatccctctgggttcctcacagactattgaggcctgatagggtttctgcagtcacgaacaagtatagtatagctgggtttg

SEQ ID NO: 32558 - DNA, 201 bp, Homo sapiens
ataatttatgcctacgtaggagagcagacttttgcgagctagttttatgcagtaccttttctttggcttgggaagttgatagcttggtggtgttttcttgsatggactaaatccttagaattgtttaggagatattggtcgaaggtggtatgttaaatttttgccaaggatctgaactgtgaagtaacttgtcaagtgggg

SEQ ID NO: 32559 - DNA, 201 bp, Homo sapiens
ggtaaaaatggcaagatataaggtattattttgtttttgaataatggtaatatcatttgatgccatcctgtgttctaagtttaaagttgttagattggttkttgctacttaagaaaaactcattcagagagttaggaaggaaaaaccaatagcttgaaaacctgtgtaccattttaagagttacttgatgtttggtaactt

SEQ ID NO: 32560 - DNA, 201 bp, Homo sapiens
cctgcagattggccacatcgaaggacagcctgaaaggaagggggtctttccagtgtcctttgttcatatcctgtctgactagcaaaacgcagaaccttaakattgtccacatccttcatgcaagactgctgccttcatgtaaccctgggcacagtgtgtatatagctgctgttacagagtaagaaactcatggaagggcca

SEQ ID NO: 32561 - DNA, 201 bp, Homo sapiens
cttttctgtagagcaaaggggtcagacttagatcatctttaaaccttttaaaaaattacttctttgcaagtggatacagctctccagttggttaatgataytcaaccttttcatccctacctgcttccaagacagccttagacagtttcggccatactcccagacctgctgtttccttacccatgatgtttaccttctcat

SEQ ID NO: 32562 - DNA, 201 bp, Homo sapiens
tcagtttaccaaaccttcccagggtctctgctatatgctagactgagtgggaagggctaggggtatagaggtgacaaaacccaaacacagccctctgagcrttccctatgttaaagggcacaaatagttgctataataatgttctattaaatatgtaattatggcctttgacataatctgtgtctgatagtttgcacccaa

SEQ ID NO: 32563 - DNA, 201 bp, Homo sapiens
caagggaggttcccacccaatgtctgttccacaactggatgccatgttttgagaggagcaacagagaccaggatggaaacagaactggaaaacttatttakttaagtggcttagtgaaccgctgtgtcactcagagatgaggcagcagcagtggttgagggttaaggctggattttgaacagttggagggctctcataccc

SEQ ID NO: 32564 - DNA, 201 bp, Homo sapiens
acatgagttaagtacagtttaacatgattctgccatttgagcacctactatgtgcctggtttttggtagatgactgagggaagggtaacagaatgaattaracatgctttctgtcccaaaggtgttcacaggtgagtggggtggtggttgtggggtgccaggttagctgcaatatagcatagaccggtcagagctgtgata

SEQ ID NO: 32565 - DNA, 201 bp, Homo sapiens
ggaggagggaaaggagcagaaaaggtaactattgggtacttggcctaatacctggatgataaaataatacgtacaacaaacccctgtgacacatgtttacytacataataaacattcacatgtacccccaaacctaaaagtttttttttaaaaaaaaaagaaagaaagaaagaaatgagagctgagacctgaggccagcat

SEQ ID NO: 32566 - DNA, 201 bp, Homo sapiens
ctggcatgtgttggtccttcatacatgttaagtgaatgaatgcgtgtatgcatgattcagactttgttttttgcctttcttttctttttccctatagtctkctctttatagatttttaatagcatccaaaagggtagtaggggcaggaagctaaagggtaggaaataaaactcaaattcttcagtttcgagttcagttctc

SEQ ID NO: 32567 - DNA, 201 bp, Homo sapiens
gcctcgccagatgtaaagatggtgccacacacacatgctaactgtgatgtgaaattcacaaagacctcacacatgcatgatgccaactaagaccacacgcrgtgggtgggcaagccttcaggagagctgggcaggcctggttgactctgttccactcttaaaaccaccttcctctctatcgatttggcattggaagccaat

SEQ ID NO: 32568 - DNA, 201 bp, Homo sapiens
atcagtcacatgtaattaacagctacattgtgtgcttactttttgctagatgtttcataaacattatctcatataaacctcacaataactaggtattattrtcccgtatccctgttttacagctgtggaaagtgaagtgaaggatttttgtcatacagccagtaagtgccagaactgacttgaacctagctctctgtcttg

SEQ ID NO: 32569 - DNA, 201 bp, Homo sapiens
aaatactcagttacatgttagctgccattactgttactgttactggtttttgaagatcttgttatgttacagtaatttatagagaaagtggctaagagatraatgagacatcctcgaggtaattttcccttctatttggaagatttatgtgttaagtgtagtgataggtagtcagaactcacacatatgcttcactttcca

SEQ ID NO: 32570 - DNA, 201 bp, Homo sapiens
tcacatgtacccccaaacctaaaagtttttttttaaaaaaaaaagaaagaaagaaagaaatgagagctgagacctgaggccagcatggtgcctcacgcctrtaatctcacttgaggctgacagatcacttgagctcaggagtttaagagcagcctgggcaacatggagagactgtctccactaaaaataccaaaaaaaaat

SEQ ID NO: 32571 - DNA, 201 bp, Homo sapiens
agacaacccacagaataggagaaaatatttacaaaatatttttctgataagagtctgatatccagaatatattaaaaaaactcaacaacagtccaggtgtrctggctcacacctataatcctagcactttaggaggccgatgcaggaggatcacttgagcccaggagttcgagaccagcctgggcaacacagggagactct

SEQ ID NO: 32572 - DNA, 201 bp, Homo sapiens
gaatcttcccaagcactgtttcctctttggcaaaattctcttgtacttgacttctggttccattcctaaatcaaaggtacatgcattgaacatggaatccyctggggtctctcacttcctcccctaaagcagttcgctttggaatagatagatatgggacaaagggcattgttttctatgtttaatctcattgaaatcata

SEQ ID NO: 32573 - DNA, 201 bp, Homo sapiens
agtagagacggggtttcaccttgttagccaggatggtctcgatctcctgacctcatgatccacccgcctcggcctcccaaagtgctgggattacaggcgtragccaccgcgcccggcccctgggttggagttttgcactcacctgaccaggtatgcaaccttagatagtccctagtcccttttttaaaatgctagccctgg

SEQ ID NO: 32574 - DNA, 201 bp, Homo sapiens
gaaaagaagggcttttaactgtttccaactcatttcagctcactcactaattactgctcaatttcagacatgaacattgtcgggaacatgctgctttccaracagacatatcctccagttcacctgctccttttacctcctcacaagtgtcattatgacctgcagagttaacagcatttataaacattgctttattatctg

SEQ ID NO: 32575 - DNA, 201 bp, Homo sapiens
aggtatgcaaccttagatagtccctagtcccttttttaaaatgctagccctggtcctgagctgtctttattccctcttctttcctgtagcctgtctagackgaaaaaggcagtgtgtgactattataaatctcagctgcttgggagagggatgtttttgttaaaatgggcaattattgttcactttttttttttttatttc

SEQ ID NO: 32576 - DNA, 201 bp, Homo sapiens
agttggtaggtataggaactattctaaacacccatcaaatgaatgaatgaatgaatgaatgaaagaaaaagaaacaaggaaggaaggagagagagagaagraagaaagaaaaaagaaagaaagaatgagaaagaaaagaaagggaaggaaaggaagaaagaaaagaaagaaataggccaggtattgtggctcaagccttta

SEQ ID NO: 32577 - DNA, 201 bp, Homo sapiens
tttttttttttttttttttcagtagccatgaggtcttgctgttgttacccaggctggcctcaaactcctgagctcaagccatcctcccacctcgaccccaraaagtgctgggattacaggcgtgagctatagtgcccagcctgcattctctctgggtgctggtggtgagaggggaactttgttttgagtgctgtaggaggt

SEQ ID NO: 32578 - DNA, 201 bp, Homo sapiens
gaatttttatttgtttggagttttgcctcttcatttttagcatttctctctcatctctttctgcctttgagatagctgttcacagtgccacattttctgtrtctgtgaaaaaacgagccccttaacctccagtacacaccatagacatactcacccccttctaaaatatttattcttttagcagccctggctggtttccat

SEQ ID NO: 32579 - DNA, 201 bp, Homo sapiens
taccaaagatcagctactgtgcccagttctgggacagagataaagcaaggcttttccgctcaggagttaattgtccaggtataggaagtaagtcagatccrttattaatcataatggggctggacagtgacgggtaccatggagcatcaagaggaagagagacggctgggcgcggtggctcacgcctgtaatccccgcact

SEQ ID NO: 32580 - DNA, 201 bp, Homo sapiens
gcccagcctgcattctctctgggtgctggtggtgagaggggaactttgttttgagtgctgtaggaggtaatggcagtccacaaagaaagcacatgcctcaragggaagccttagttcttcacttacctccaggttacatagaggcagtttcactgcatcattgagtttatttttcatatgaaagtgttcgatgaaattgaa

SEQ ID NO: 32581 - DNA, 201 bp, Homo sapiens
cttaaagtttaccctaaatatatgaatgaaatggcttcctagctcctttcatccttacatctgctaatttaaccttatgcagagagctgagtttgttccgyttgtgccctaaggttattaacatctgtcccttagtctctccagtaaaaagtttgagaggaaacaaagaaccagctctacttagacctttgaccaattgat

SEQ ID NO: 32582 - DNA, 201 bp, Homo sapiens
ttcaactgaaacatttaaggaggtcagcattaatattatgtcaaaagcacaaagcttgggttagacaaattagatgagtcaacattttggctctgcagctrgttaactgtattcttaatcaggtacttcactaaacctcagtatactcactcgtcaagctgggttacgattctgtagcaaccaccttagggtttttgtaag

SEQ ID NO: 32583 - DNA, 201 bp, Homo sapiens
tctgaatttgggcattttgaaggtaagttttgtgatcaacacacgtaatcagacactatatgccaagtcaaagggagctattcatattagtaaattcataytcgtattagtaaaaatcaggtatttctggggatggatctttttctgtttccatgttgtacaaaagcagaaatattctcaacgtaaggggttaagggtaac

SEQ ID NO: 32584 - DNA, 201 bp, Homo sapiens
aatcccagcactttgggaggctgaggcaaacggatcacgaggtcaggagatcaagaccatcctggctaacacggtgaaacccgtctctattaaaaattttwaaaaaattagccgggcgtggtggcaggcactttgtagtcccagctactcgggaggctgaggcaggagaatggcatgaacccgggaggcggagcttgcagt

SEQ ID NO: 32585 - DNA, 201 bp, Homo sapiens
tcaaaaaagttaaattcataatttcctttgatctttcttattcttttcaatagttatatttagaaagatacctgtattcaactgaaacatttaaggaggtyagcattaatattatgtcaaaagcacaaagcttgggttagacaaattagatgagtcaacattttggctctgcagctggttaactgtattcttaatcaggta

SEQ ID NO: 32586 - DNA, 201 bp, Homo sapiens
gaacctcggtttcctcatctgtgaaatatgcccacttttcaaggcaaatttgttgtaaaacagatgtaaagtgtccctctgtgcatagttggtagaaggcrctggaagttgttattgtggaatgcatatagcatggtgaataagccctaggatgtagagcaagacattgctgagcttgattccctgatcttgctacttaat

SEQ ID NO: 32587 - DNA, 201 bp, Homo sapiens
atcccagcactttgggaggctgaggcaaacggatcacgaggtcaggagatcaagaccatcctggctaacacggtgaaacccgtctctattaaaaattttawaaaaattagccgggcgtggtggcaggcactttgtagtcccagctactcgggaggctgaggcaggagaatggcatgaacccgggaggcggagcttgcagtg

SEQ ID NO: 32588 - DNA, 201 bp, Homo sapiens
gactagataaaatactctcaaaaaagttaaattcataatttcctttgatctttcttattcttttcaatagttatatttagaaagatacctgtattcaactraaacatttaaggaggtcagcattaatattatgtcaaaagcacaaagcttgggttagacaaattagatgagtcaacattttggctctgcagctggttaact

SEQ ID NO: 32589 - DNA, 201 bp, Homo sapiens
gattttatgtcatacctaatggtacagggttctttacaaatcatgacagggaaaatattaagtaggcaacaaatgtgcttctaatggaaacacagtggccktctgcctgcccctcttgatcctgttagtccctcccctttttccaactcttttacctgcttcctgacttatctacacgttcctcagtattttcttgctctt

SEQ ID NO: 32590 - DNA, 201 bp, Homo sapiens
atgtctaggtatgggttctgcaaattcggaccctccagcctgaccccttttcacaacaatctctgaaccgtgagaagggactgctctttccgcccgtatcwcttgtgtcagagcgagccaagaaaactgcttccacagaggaaacgggctgacaatggaatgtcccgacccagcacatgaagtcctttggaagggcccctg

SEQ ID NO: 32591 - DNA, 201 bp, Homo sapiens
ttccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttg

SEQ ID NO: 32592 - DNA, 201 bp, Homo sapiens
aaaatcagtttaaaaggtgacttattttaacattataccatataatgagattcttatacattgggtggccatgtctaaatcaagagaatatgagagtgaaraggtgtgctccttataattacttgggggcaactgatatatatgaagcctcccttggcagagcatattattgacttacttatacttttctttcccttttta

SEQ ID NO: 32593 - DNA, 201 bp, Homo sapiens
ctgttagatgatcacttgagaggtggaagggaaacatttaaattgtccagcactatgcagatgatgtgtatctttctctcatagaaaggtggttacctgtkgggtgttggggagaaaaaagtaagagaaaaactagaggcaggtggcaggtaaaattttaccactttgctctggattgctagacccatttgaatcactgga

SEQ ID NO: 32594 - DNA, 201 bp, Homo sapiens
tgggatgccctggggccacaggaggggcatggaagctaacccagccccacaggctcatctgctgaaataacacagatgtgcttctcaaccaacccctttgwtgggggaaaagttcccacatcagtgggtaagctgaccacaggagggctacatcaagaaatataaagcagttccccccatcctttgcttaactggcactaa

SEQ ID NO: 32595 - DNA, 201 bp, Homo sapiens
aagttttttttttttttaaacggttatgttattttattttgttgaaggcagaggatatgttttattttagggacccaccagaattgcttagaaattatctkcaggctttagggatttttgcttatcagtatatttcatttgccccattgttcagcccatccaccacctccttccatttgttctcagaaactaaactaggag

SEQ ID NO: 32596 - DNA, 201 bp, Homo sapiens
accatacctggctaatttttgtatttttagcagagacggtgtctccccatgttggccaggctggtctcgaactcctgacctccagtgatcctcctgcctcrgcctcccaaagtgctgggattacaggcgtaagccaccatgcccagcctacactgcctaaattcaaatcttagctcctcactcacatgctttatggttctg

SEQ ID NO: 32597 - DNA, 201 bp, Homo sapiens
agcctaggggtggactgcagcaaattgtgtgtgagggaagccagcagtctgcagggctgagctgaagtggggagaggagaagagcatgggacgtggtgtcragtgcagtggcattgactgcagacaggctgctgctttacactgggggattcattccctttcccccagtaaagactgttaaaatatcagaactgatagtat

SEQ ID NO: 32598 - DNA, 201 bp, Homo sapiens
taccccttaggagtttgtttgtttgttttgagacagagttatcagggaacctgcccctgatagtcacgtaggttcttttctgttttccctaagcgttggcygggttgagaaataaagagacagagtacaaaagagagaaattttaaagctgggtgtcctggggagacatcacatgtaggtaggttccgtgatgccccacaa

SEQ ID NO: 32599 - DNA, 201 bp, Homo sapiens
tcaaagctcacaatggaggtaactggtttccaggttaagtgcactaaactgtgtggaaggtgttatgatagtacctctacaggttctgatggaagcatcartgatggatttggcttttccatttgggagaggaggctataaaaaaccttcctggaggacgtgggctcattctgattcacagacaggtccagccccttcact

SEQ ID NO: 32600 - DNA, 201 bp, Homo sapiens
ttatatagaacatgtaaataattgtatgaagtagttagtgtacaaaataatgtcatatatgcagctgcattttctgcctttttcacctagaaagttttttygtcatgtcattaaaaacttttgccctctgttttcatgactacataatattctgttgtgtgggtgtacctgtcttactgcttcacctactttattcatatt

SEQ ID NO: 32601 - DNA, 201 bp, Homo sapiens
ggaaggaactggggtttcttggagtataatttgtacaactctaacctagcacaaccacatcactttattcatcttaaatcctgtgaaatgcaaaataagayttggttttgtaatacctataaacatgccagaaccaattacagaccaacaggcacctctggaaatgcaggttgaagcagaaacacaattagtgcattagtc

SEQ ID NO: 32602 - DNA, 201 bp, Homo sapiens
atttgataggcatgataaatttggttttgcattaaaatatagtgacttttctgattatgaaagtaatttcccttttttattttattttttaaagaacattrtaagtaatttctcattataaaaatgtggaaaatacagaaaagtacaaagaagattgtgtgctaattttgtgaatactaatagcattaactagacaggaat

SEQ ID NO: 32603 - DNA, 201 bp, Homo sapiens
ataacccgtactctcatgttcatcggagcactattcacagtagccaagatacggaatcaacctaagtgtccatcaacagttgagtagataaagaaaatacrgtatatatacacaatggaatattattcagccataaaaaacaaagtcatgccacttgccacaaaatggatccaacattatgttaggtgaaataagccaagt

SEQ ID NO: 32604 - DNA, 201 bp, Homo sapiens
tctgcgaatcatctgacccagttgatcactcccttcctctaaaaacacggttttcttttggcttctatgacaccaagccggcttggatttcttcttgtgaytctaccctctcagtctctcagttgggcaccccttgctccaacttacctctaaatatttttgaagatgtctgcatgcaaattatacagacatgcaaattat

SEQ ID NO: 32605 - DNA, 201 bp, Homo sapiens
gcgtgcgccatcatgcccagctcatctttttttttttttttttttttttcctaaagagatggtggagtcttgctatacttcccaggctgttcttgaactcmtgggctcaagcagttcccacaccttggccccccccaattgcttggattacaggcatgagccaccattcctcgtcctgaaatgattttaaatgtgttgttt

SEQ ID NO: 32606 - DNA, 201 bp, Homo sapiens
gacttgatgatctgaaatgcctaattaatatccccatttggaagtctagcaggcctctcaaacttaatatgtccaacatggattattctcctcactcctcytgcagctcatgctgcacccctgcttacagccaccgctgatctccaagacccctgcccattttacttagaatgaaattcagatttcttaccgtggcctaca

SEQ ID NO: 32607 - DNA, 201 bp, Homo sapiens
tccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgt

SEQ ID NO: 32608 - DNA, 201 bp, Homo sapiens
agacagggtcacactctatcactcaggcagtggcaggatcatagctcactgtaatcttgcagtccttgcctcagcctcctgagtagctgaaactacaggcrtgcgccatcatgcccagctcatctttttttttttttttttttttttcctaaagagatggtggagtcttgctatacttcccaggctgttcttgaactcatg

SEQ ID NO: 32609 - DNA, 201 bp, Homo sapiens
ccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgta

SEQ ID NO: 32610 - DNA, 201 bp, Homo sapiens
cagtgactaggataacgggctatttgtatactgctggcagtgttgaagcaattgtaaggaataaacggctatttttgtccagtttaatattaattacagtyacttgcttccttaagccccttttgcataatgaaagatagacctcggcctccctctgtttgatttactccaaatttctggttaggcttgatgtatgtacta

SEQ ID NO: 32611 - DNA, 201 bp, Homo sapiens
catgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtat

SEQ ID NO: 32612 - DNA, 201 bp, Homo sapiens
ggcgagttacttaacctctctaagcctgtttcctcgttaacctagtgagactaagacccatcttacagaggtgttgtgagcaatatctttagataatataygttagatacagtaccctctgtcatttaaataaaattcatgctgttctgcctagattagaacacagtataatgggctgcattatcttacagtttatggaga

SEQ ID NO: 32613 - DNA, 201 bp, Homo sapiens
acagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgt

SEQ ID NO: 32614 - DNA, 201 bp, Homo sapiens
acctacccatttttctttctagcatttccagtaaaatgtactttatgagtaaattcagtcttgtcagtcccgagtgcctttagcacatggtgtaatttgtyttgcatttttccttgggcctttcccagatcttccagagcagtacctctgttcttcattgtaattatgccttagaccataggcaagtgatttctgctctct

SEQ ID NO: 32615 - DNA, 201 bp, Homo sapiens
tggttatacacagtttcattctgtgaatttatcataatttgcttaaccatctcccatcattggacattgttatttgtccttccctcccttctttccttctwtaagtaatgctgctgtgaacatcttgcattgaccagattactggggcagattacctgtgcttccacagtggttttaccatagtacagatgccatcttctt

SEQ ID NO: 32616 - DNA, 201 bp, Homo sapiens
agccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgtac

SEQ ID NO: 32617 - DNA, 201 bp, Homo sapiens
gccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgtaca

SEQ ID NO: 32618 - DNA, 201 bp, Homo sapiens
ccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgtacat

SEQ ID NO: 32619 - DNA, 201 bp, Homo sapiens
caagcaagcttgaagtaatttgcccaaggtcacacagctagtaagggatggagctgagattcgggtccaacaagctggtaacagagcctgcctgcttagtrgctatactgtatgttcctcattggagcccgatacccattctaccaagtaggtattattattgccagtgagggaagactcataattttgtgttaagaggaa

SEQ ID NO: 32620 - DNA, 201 bp, Homo sapiens
tttgacttttccaaagtagctgaaccattttgcactcccaccagcaatgtatgagggttccagtttctctacatcctcgccaagacttgttattgctattktgtgtgtgtgtgtgtgtgtgtgtgtgtgtgtgtgtatttcattatggccagcctagtgggtgtgaggttttatcttactgtggttttgatttgcatttcc

SEQ ID NO: 32621 - DNA, 201 bp, Homo sapiens
aagttcgaagcaggaatcattgccttgagttgattgatcactgaatttattcagcaaacatttatcttgggtgatatgattgttttcacagggctgtttcwgaaacttcgttttgcattatcttaatcccaggtgtctatctctggtaggctgatgagacagtttggagttgagtagtcttcattgcatgcagcctggtct

SEQ ID NO: 32622 - DNA, 201 bp, Homo sapiens
gaacggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcc

SEQ ID NO: 32623 - DNA, 201 bp, Homo sapiens
ttatctgtaaaagcggttattattagtatttaccccatcatatagttgtaaagattcaatgaactaatacatgtaaatgttaagaaacagtgtctgtcccrtaggacctggcactctaaataaatactgcctgttatcactgtattgcttataaatctaggttagaaacatcataattttctctattataataattaggtc

SEQ ID NO: 32624 - DNA, 201 bp, Homo sapiens
tgagtggaatcttcgacaggaggagatagatgagagcgatgatgatctggatgacaaagtgagtgtaaattatgtcctcgaattctcaacaactaccccarcttttctagtctgtgtagacaagatccatttttggtgagattgattgattgtggttttatgatccaatgtatcagggccatttatgttgttcagtcctta

SEQ ID NO: 32625 - DNA, 201 bp, Homo sapiens
agagcaattcagtaagatgatgggaggaaataatttcatttctgggtactaattccagtagcagctgttttctgctaactgagaaatatgcctgtgctaayaactttacacttccagcaaaaacactggaaccatggtgcacactaagctgtctaaagacaaatgtgcggtgtttattttcttttaggaaacacagaaaca

SEQ ID NO: 32626 - DNA, 201 bp, Homo sapiens
ccattgcatttgtgtatgtgtgtatgtgtgcatgcagttggacttgggttgtatatctgtctgtctgtatgtgtgcagttgtacgtgggttgttttctgtrtgtgtgcagttgtacgtgggttgttttctgtgtgtgtgcagttgtacatgggttgtatttctgtgtgcagttgtacatgggtttcacttctgtgtgtatg

SEQ ID NO: 32627 - DNA, 201 bp, Homo sapiens
catcgctcctgccttttcatcagcagcgagataattgactgttagactcccgagccacagaccacggcagaggtgagtccgcttctaactgtttctgcagrgtgaggtacagttgtcagaagttcccaaacaatgtgagtttggtaagaggagactggaaatggagttttcaccagtaaagcgacgcgtggcgattgtgta

SEQ ID NO: 32628 - DNA, 201 bp, Homo sapiens
gaagttcccaaacaatgtgagtttggtaagaggagactggaaatggagttttcaccagtaaagcgacgcgtggcgattgtgtatctacagggtggagagcrcagcgcttagccctgtgtcgacagccctgtgggctgaggccacagtctgaatttgctgtgcccagctgtgttttttcatcaggacagggtgtgggagcgg

SEQ ID NO: 32629 - DNA, 201 bp, Homo sapiens
caagcagacagggcagggctttccaagcaaagggagcagagatggctttgacctcctgtcagttaaatgaagacaataatgtctactatgagacattactrtgtcaccctagtacgtggtaagccctgtgtgcttgcatatgtttgttgaattttttaaattgtgttaagaaggtgtgtcctgagtaaaagatattgcaaa

SEQ ID NO: 32630 - DNA, 201 bp, Homo sapiens
tgagttagtgagggcagagccaccctgatgagcactggcctcttgtgtcactgtggcagtagggcccggggagtgtctcagcaggaatggcacaggcagcrtccagcatctctggtgaagtagagtgtttccaggtgcaatgtcttctttctgacaccacttctgactccaaatgtttggggttttctctataccaagcaa

SEQ ID NO: 32631 - DNA, 201 bp, Homo sapiens
ggcaacccccacaattctgtgggctcagtcccatagaacagctcccacttcagatgccagtcacaattcccagaggctgcgtgtgtctgaccaaccagctrtaaattgagaggtttccacaatttccttctcaagtgtgatgattggctagaactcacagaactcaggaaaatacatctacagccataccaccctgaacac

SEQ ID NO: 32632 - DNA, 201 bp, Homo sapiens
attgcttcagagctgttgaagcaaagcaaagatttctccatctgcatagcatttcctgtttgcaatctctgactgtagggtattgtggtttgtgttaaagwtgtttttttttttatttttcttcttttctttcccctcaaataagaatatctgataatgtacaggttggatctagatttgtagccagcagattatttctca

SEQ ID NO: 32633 - DNA, 201 bp, Homo sapiens
cacctcaactgagatcagagggatagaggtgggagagaacctgccacttttgaggaagtaaaagatgtatgttatagctaaaggataatggggaacaagamcggtaatgagcctggaaagatggggggcttatcttggaaaggcatggaaagcctttagggtttgaagcaaaggattggcatgctctgatttgctttttag

SEQ ID NO: 32634 - DNA, 201 bp, Homo sapiens
agctggaggcttacccctgtctctccacctcaggtcctttgagggcttactgtgcttgggcccatgtttcctttacctgcgtttagtctttggcagggcgygtgacaccgttaggcacattaccacagttgagtgatgggcagccgtgtggacccaggtccttgtggccccagccacagccccctactctccacacccttg

SEQ ID NO: 32635 - DNA, 201 bp, Homo sapiens
cactggattattatagtattaataggctacattaatattagtattactatggtattaatagccactataggggactttgtattataaaaagaacacatgcytacaggggaattgcaatttctctttcatattccccctaatcaaagataactataattgacacttggagtttatctttctagtccttttgtctgtacctct

SEQ ID NO: 32636 - DNA, 201 bp, Homo sapiens
aaataatattcatgaaaataatatgatattgaaaataagttctctgctgtctatgtaaatatagcaattttataaatttgtttgtataatgcctctcaacmtctaaggccagagcaaaaaacctaattttttaaaaacaaaaaaccagaaaatattagggaacagaagctggatgctgtctcagaaggtttgctagcaatt

SEQ ID NO: 32637 - DNA, 201 bp, Homo sapiens
ctcactgcagcctcagtctcctaggctcaggtgatcctcttacctcagcctcctgagtagctgggaccaaggtacatatcactacgcctggcttttttttwatatttttggtagagatggggttttgccatgttgcccaggctggtcttgaactcatgggctcaagcactcctcccatcttggcctctcaaagtgctggga

SEQ ID NO: 32638 - DNA, 201 bp, Homo sapiens
tccagcctagaggaaggaaggccttcttggagtgaagcctaagtgccgtgtgttgtcagtgctccatggggtaactgagtctcagagagcttaattagctyaactagcatgggccatatttgttccaagtcacagaattttccagatgcagagtgacttggttagtatgtggggaaggatggtaggattttctcctgggta

SEQ ID NO: 32639 - DNA, 201 bp, Homo sapiens
aggcacaggttgcagtgagatgagatcacaccactacactccagcctgggcaacagagcgagactccatctgaaaaaaaagaaaaacagccatggggcttygaagacaggtcaagagaattaacatttgtatgtactttacccatggtatcatgtaaccttgtgagttgtaggcattttctgatttttcatataaatacta

SEQ ID NO: 32640 - DNA, 201 bp, Homo sapiens
aacggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcct

SEQ ID NO: 32641 - DNA, 201 bp, Homo sapiens
ccagaactcattctcaagatgtccttaacctaggtcagttattcatgtatcacataggcttctgtggccttaggtgataatttgtcataatccattagatrcaaaaggttagtttacagatgaagataacctatttgaaaaatgaaaactacctttctacactccattaacctatttggccagttacaatattctttttct

SEQ ID NO: 32642 - DNA, 201 bp, Homo sapiens
acggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcctg

SEQ ID NO: 32643 - DNA, 201 bp, Homo sapiens
ggaggcagacccagggatgggggtggtggaggaaactgtttgccaggcagtcgtgtgtgggcatccccatgttgtgctgcaaccccctccccagccctcayaccatgtgcacacttagaaaggttctgggtaacaccacctggacggatcatttggattttgttggttttgggggatgaaattatttctctaagagccacc

SEQ ID NO: 32644 - DNA, 201 bp, Homo sapiens
ccgtgcctcatcttatgatgtgtccattcatgtcagcccagctatctacttgttcatctcattgattctgcccattgttgaggacttagtctaagtgtcawagcacccaaagtcttctctgataccttgccacccatcacctctctgttagtcaggatgagttagtttttctcctctgttgttttataggaaattgtgtac

SEQ ID NO: 32645 - DNA, 201 bp, Homo sapiens
cggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcctga

SEQ ID NO: 32646 - DNA, 201 bp, Homo sapiens
cacaggcaggatgtaaggaatggccaaagaggtcctcaagccttaacaactttaagaggaaataaattataatacaatgtgataatcattataagagtatrgaaaaattcctgagagctattcagaggaccaagcagctgcctcagtctgccttctcaaggacattggagatgggtttctaaggataggtggaagcttgcc

SEQ ID NO: 32647 - DNA, 201 bp, Homo sapiens
cagactgatataaaaaatactgttttaatcttctaaaaggtataaaatccccccattccttctgcatatgaattcctagactcttggttttgaaatgttcrgttttctgcatcacagaagttaagctgtgtatatgcgtttctcccaacatactgaaggtgagcgccacctagagtcaaaggtgtgacttgcatagttcac

SEQ ID NO: 32648 - DNA, 201 bp, Homo sapiens
agagggaagagccccttataaaaccatcagatctcaactcactcactatcatgagaacagcatgggggaaaccgccaccttgatccaatcacctcctacaygggtctctccccagacacgtggggattatggggataacaattcaagatgagatttgggtgaggacacaaatccaaaccatatcaatcatataataggttt

SEQ ID NO: 32649 - DNA, 201 bp, Homo sapiens
ccatgtttttgtaaatcttagattatataaacctcatttattcagaagagcaccctcggttttccttcactctgagcattgcctgcactttcactggaggycttgctcaaagtgtggtgtggtagaaagagaggaagcaaaacaagactgacagttcactttggtaatagctggtaaaggacttgcttgggcaggaagatc

SEQ ID NO: 32650 - DNA, 201 bp, Homo sapiens
taagcaatacctggctagtccagtgagtgttccagcccctggccacagaaattagttcaaggatggatgaacagtcagagtcaatcctgagacttttattrgaaccaccagtacagcgaggctttcctgcagggattgctgaattgtgtctggatgtaagcctgaaagccagtggcccctttggtgagatcctgcctgaaa

SEQ ID NO: 32651 - DNA, 201 bp, Homo sapiens
ttagatctccaagattggagccccaaattaatccatactctttcttttactatgtctccttggtagagattgtggtgtgttgtgcagatgttgatgctttyagttaaatctctgtgatgagcactcttggaagtagatgagaaatatatggtaagaaggctgggcgtggtgggtcatacctgtaatcccagcactttggga

SEQ ID NO: 32652 - DNA, 201 bp, Homo sapiens
caggacttgtggggttttctgtctcatgaagcatgtctaggtatgggttctgcaaattcggaccctccagcctgaccccttttcacaacaatctctgaacygtgagaagggactgctctttccgcccgtatcacttgtgtcagagcgagccaagaaaactgcttccacagaggaaacgggctgacaatggaatgtcccgac

SEQ ID NO: 32653 - DNA, 201 bp, Homo sapiens
gaataggaattaatttgggtaacttggaattctcatttaaaaaaaacattttcctagttctagtaagtaccttcctgttgatgacctttttttgctctttrgatcactaatgcacatacatagagcgcaactgaaaaactgttagatctccaagattggagccccaaattaatccatactctttcttttactatgtctcct

SEQ ID NO: 32654 - DNA, 201 bp, Homo sapiens
tgggaacttcgttggtattatactaggagcaggtgattcaaagtaaatattcccagtctagagagtgagatggacactgaagagggacagttcctcaagakgtgaagtgacgtttgattcactgcatgactgtgtgggaaaagggaatccccaaagttctctcagatggtggcccatgagtcaccatgtagacaatggtgg

SEQ ID NO: 32655 - DNA, 201 bp, Homo sapiens
aacacccatgaggcttcacggggttccctgatggctgtgagtctcttctgtaatctcagcttctgggggataggcatggtgttccattctgcatgctgctygtcacataataggccctccagaaatactactgaatgaataaatgcatctaatagtctgataattttatctgtatgattggcgaaaatattaatcttctgg

SEQ ID NO: 32656 - DNA, 201 bp, Homo sapiens
acaaggatacttgtggtgtggttaccaaattcacacgaggcaagcatagtgtagcactggtcttttctcactgtgcactgtttgaagttggcctcagtgckagaaatctgtattacctgagcaaatgtttaggaattctctttgcttttgaatacgttgaaagaaaggaattctttctccaatttgttcagctctcctcct

SEQ ID NO: 32657 - DNA, 201 bp, Homo sapiens
attgtctccggtcggcatattttaattcttgaggttgcactctcttgagtggttactttttgcatagatgtgaaaagtatgctttaggtttttttactgawggatagccaccatagttgaattttaatttttcccccatgcttacatatgtggaagtagtgcattattataaatatcttaggtgggtcacaattcagttct

SEQ ID NO: 32658 - DNA, 201 bp, Homo sapiens
taattttatctgtatgattggcgaaaatattaatcttctggtgttgtgacttgtatatgaacctttctgtttcatgatggcaatatgccctgccatacttkaaaaaaattgttacagccatgccgtttgttttttgttttgttttgttttgtttttgagacggagtttcactctggttggccaggctggagtgcaatggca

SEQ ID NO: 32659 - DNA, 201 bp, Homo sapiens
gatttcaagtgatttcgcccacttcggcctctcaaagtgttgggattacagggataagccattgcgcccggcctgacccacactgtttgtccactcttttwtttatttatttatttatttatttttattgagacggaatctcgctctgtcacccaggctggagtgcagtggtgagatctcggctcactgcaacctctgcct

SEQ ID NO: 32660 - DNA, 201 bp, Homo sapiens
atgaatgaagtaacttttttttttttttttgagttggagttttgctctttttgcccaggctggagtgcagtggcgtgatcttggctcactgcaacctctgsctcccgagttcaagtgattctcctgcctcagccttccaagtagtgggattacaggtgtgcaccactacgcctggctaatttttgtatttttagtagagat

SEQ ID NO: 32661 - DNA, 201 bp, Homo sapiens
gtgagactctggagtgtgggatggtacttagcattttataaacacccactgtataccagatactagatgaggcacttcatagtctttctcatctatttccyttaataaccccatcaagtaggtattactatggctaagaagacaagagtctgagatgatgtataaattgccctagatcacagtttataaacagaaaacctg

SEQ ID NO: 32662 - DNA, 201 bp, Homo sapiens
ggaaattataattttatctttatatttctctgtaatagcatatgaattacttatataattttaaaaacaaatagaattaaatattttataagtgtgattartgctacaaagtatgcataggataatataaaaagaatttgtcacttccccttttatggcagtgctatgatttatgtcacatattacatggctttattatta

SEQ ID NO: 32663 - DNA, 201 bp, Homo sapiens
aattaggttcggtgtcttaccatggtgtcatgtaatgcttattttaatcctgcggttttcagtggggagaaaagttttcttaacaagcatatgtaagagayataatagattagaataaaatgtcacaaggtgtacaaaagcagcttgtctctaggaaattttacctttttttgctgtttttcaagtttgtggatagccaga

SEQ ID NO: 32664 - DNA, 201 bp, Homo sapiens
tgttccacacccaacataaattattgcccagggtgagttaatttgtgtttatttctgaagtggcagtggttgcttcctgagggtctaaccttgtttgactsttttgtaggctaaatttctgcaggccttctgcagagccctgtcttcttcctctcagagacaacccaggtgtttttcattccctagaaagttcccctttgc

SEQ ID NO: 32665 - DNA, 201 bp, Homo sapiens
cataaatttaaaaaataatatctaatgtgcaggggattgtatggacaaaaggagagaccatctaaggcccctaatacactgcctgccacatagtaggtgcytaacaaatggtagatgggggaaaaggacagctagatgaattcttgagtgccttctctattttaattcagtgattccacatacaacatttgaccagcctga

SEQ ID NO: 32666 - DNA, 201 bp, Homo sapiens
tccttgctaatccacttcttattagcaaggtgaccttgagctggttatttctccttcttgagcctccatttttcttctgtaacgtgaggatagtggtattwaaaaaagttgttgaagggatttaatgatctcatatctgtaaagggtctgccaggttatgggagttcagtaaatgcatgttcctcttaattttatcatcat

SEQ ID NO: 32667 - DNA, 201 bp, Homo sapiens
acttctctaggaaatcagtggtctgtaacttaacagaaaacctggaagggaaggcagcagactataatagaaagagcgcaggccgtgaagttggacagatrtgggctttcgtccttgctaatccacttcttattagcaaggtgaccttgagctggttatttctccttcttgagcctccatttttcttctgtaacgtgagga

SEQ ID NO: 32668 - DNA, 201 bp, Homo sapiens
cagctcactacaacctcccaattcctgggcacaagcgattctaccacctcagcctcctgagtagctgggactataggcacatgccaccatgcctggatacttttttttttttttttttaaatataagcagggtccctctttgttgcccaggctggtcttgaactcctggcctcaagaaattctcccaccttggtcccccaa

SEQ ID NO: 32669 - DNA, 201 bp, Homo sapiens
accagctcacctaccaataggttacttctctaggaaatcagtggtctgtaacttaacagaaaacctggaagggaaggcagcagactataatagaaagagcrcaggccgtgaagttggacagatgtgggctttcgtccttgctaatccacttcttattagcaaggtgaccttgagctggttatttctccttcttgagcctcc

SEQ ID NO: 32670 - DNA, 201 bp, Homo sapiens
ctcatggcctgatcactgtgaaattctgggaccttagaagccttttgtattgactgctcgctcgctcgctctctctctctctctctctctctctctctctstgtgtgtgtgtgtgtgtgtgtgtgtgtgtgtgtgtgtgtgtatttttcttttacttcttgtttggccaagaaactgtatgtgttaatagcttgtttgttt

SEQ ID NO: 32671 - DNA, 201 bp, Homo sapiens
tctttcctgtctgcacccttactcccattccttcctggcttgttccaagaggagtgtcagatagaatgccatgggcgtcttctcctccaggattgcagggrttaaagatggagatgacctaggacagcacctggcccacaggggacactcttagttagctcccttcttctctgcttaattactttccaaccttctttttgt

SEQ ID NO: 32672 - DNA, 201 bp, Homo sapiens
tctggctgcagtgtggagaatggactggaggaaggaaactggagaaggggccattctggaggctagagctgcagtgggagctggtgagcacctgtactagraggggcttcaagggatatttccaaggggaatgcaggaaccagggactccaggtgacactgaggtttctaacctgggcagttgagtggatcctaatgccat

SEQ ID NO: 32673 - DNA, 201 bp, Homo sapiens
tggaggaaggaaactggagaaggggccattctggaggctagagctgcagtgggagctggtgagcacctgtactaggaggggcttcaagggatatttccaargggaatgcaggaaccagggactccaggtgacactgaggtttctaacctgggcagttgagtggatcctaatgccatcaccacaagcgcaaataccagagat

SEQ ID NO: 32674 - DNA, 201 bp, Homo sapiens
gattcccacctgagcccgccctgcggaggccctctgtacacatgaagggtggtccttgattattatctcaccttcttatttcatctgccagccaagccctrtcaagaaagagcgctcacccagacctcagagcttctgccactcctccagcatctccccccaggacaagctggcactgccaggattcagcactccaaggga

SEQ ID NO: 32675 - DNA, 201 bp, Homo sapiens
aaaaccatcagatctcaactcactcactatcatgagaacagcatgggggaaaccgccaccttgatccaatcacctcctacatgggtctctccccagacacstggggattatggggataacaattcaagatgagatttgggtgaggacacaaatccaaaccatatcaatcatataataggtttttttgttgttgatttcaca

SEQ ID NO: 32676 - DNA, 201 bp, Homo sapiens
gtggtacaaatctcgctcactgcagcctctgcctcccaggttcaagtgattctcgtgcctcagcctcccaagtagctgggactacaggcatgtaccaccaygcctggctaatttttatgtttttagtagagaccggggtttcaccatgttggccaggctggtctcgaactcctcaagtgacctcaagtgatctgcccgcct

SEQ ID NO: 32677 - DNA, 201 bp, Homo sapiens
gatgaaatactctatggtagagccacacaacagaacactatgcagatggaaaaaaaaagcacaaattacactgaaaaggcttttcaaaagttaatttgatygtaaaactaccatgaacaaataagacctaagttttactttaccagcttgataacagcaagtgctcaagcacatacacagtgcactcttgtccacaccagc

SEQ ID NO: 32678 - DNA, 201 bp, Homo sapiens
catattggaaaacacagatgtagagcattctcattgaaactcacctttaaaaaaaaaaattgggaagagatttaattagtgttctcttatttttaaaaaawgtttatttcagtagtttctggagtacaggtggtttttggttacatggataagttatttagtggtgatttctgggatcttggtgtacctgtcacccgagca

SEQ ID NO: 32679 - DNA, 201 bp, Homo sapiens
gaatccaggaggcagaggttgcagtgagccgagatcacgccattgcactccagcctggacaacaagagcaaaactctgtctcaaaagaaaaaaaaaaaaaacaggaagagagacatctgaccaggaggactgaggagaaggtattagcaccttgaaggaggtggtgggacttgtcattgaacttggaggatagctaggatt

SEQ ID NO: 32680 - DNA, 201 bp, Homo sapiens
tttacattcctaccagcaatgtggtgggttccagtttcttcacatccttgacaatacttgtcaatttccatcttttttattacagccatcctagtgggtgyaaagtggcatttcattgtgtttttgatttgcattttcctaatgtttagtgatgttcagcatcttttcatgtgcttattatccacttgtatatctttggag

SEQ ID NO: 32681 - DNA, 201 bp, Homo sapiens
caggtcgtaagccctcataaatgattataaaatgatttcattattgatacgtgatgtgactgacttttgaaaggcaagatgaggcttgggaaccactgtarcctccaagagtcccggggcgattagatagtgaatatttttacgtgtgctacccaaacaaaaaatatgtgttgcaatatttaccttagttaagatggtgct

SEQ ID NO: 32682 - DNA, 201 bp, Homo sapiens
gtgtgtgtgtgtatgtatttctgtgtgtgtgggggggtgtctgtgtgtgcttatgtctgtgtctgtgtgtgggtctgtatgtgtgtatgtgtgtgtgtgtstgtgtgtatgtgtgtctgtgtctgtgtatgtctgtgcgtatgtgtgtatgtctgtgtgtgtatatgcctgtgtatttgtgtatgcgtgtgtgtctgtgta

SEQ ID NO: 32683 - DNA, 201 bp, Homo sapiens
tttgagtggggacacagagccaaaccatatcaagggttttgaaggggatctgttttcctttctctgtacacattgctgaattctgccattggtacaaaagrcagagtggtttaatgaaaaggttgttgatatgataggaggcccatacttcactcatctcccttcactcatctagtctctctcggagtctgcttttcccat

SEQ ID NO: 32684 - DNA, 201 bp, Homo sapiens
gagaaaatggtgagaggcagaagtattgttcagaaaagagaaaattttagctactagaattagcatctccagagtcataaaggccagaaaggagcctggcrtgttaggacatcatgaacttggagaaccaggaatataaagtggacagtcacagtgacaagggtgggttggctgcaaaggcgagtctgtgaaagtagattg

SEQ ID NO: 32685 - DNA, 201 bp, Homo sapiens
ttagatggtaggttccagtttctgtacactgggcacatctagatcttctcctacaccctggggtgcagggccagcaagatggctctacaactgggaggaartaatatataaataaacacatacatatgtgtgtctggtatcttaaaagattaataactgttctttgtcaagataaaaatgtgaggaaaatgtcattataac

SEQ ID NO: 32686 - DNA, 201 bp, Homo sapiens
gtagaataaaacatgttttttagttggagaagcagtcagacatggcagaaagcacagactttggagttaagctttccagggttaaaatcctgatttttccrtttactagttttttggccctggatccctactttctgacttaatttcttcatctccaaaaaggcattattaatgcatgtcttcttagattgatgaagtctt

SEQ ID NO: 32687 - DNA, 201 bp, Homo sapiens
tagtaatgagaccttgtctctacaaaaaaaataaaaattaaaattaaccaggcatggtgggtcatgcatgtagtcctagctacttgggaggctgaggcggkaggatcatttgagcccaggagtttaaggctgcagtgagctatgattatgccactgcactcccacctgggtgacagagcaagaacttgtctcttaaaaaaa

SEQ ID NO: 32688 - DNA, 201 bp, Homo sapiens
ccattcaccaaatttcttttttctatttcttacagctttagaaggataaaaaatgcattttattattgttccatgtggaattttaaacttatcagtgcaaytgaaattacttgcatatgtttgctattttcggtttcttgtgttaatgttttttgtccctctgttcttctgggtctttatagcagcaacataagaattcta

SEQ ID NO: 32689 - DNA, 201 bp, Homo sapiens
ctatcttgggtcacgtggtcagccctgtaccagtcactgtggacaaggccatggactattctgattggacaagcccatgtcacctgatcattcccagactycagggagaggttgaaagtgagacccacaggaaccaaaggatgtggggggactccccagtgggaatttgaaatgcattcaccggcaggagtactgggtgct

SEQ ID NO: 32690 - DNA, 201 bp, Homo sapiens
ggcactttatatggatttcttcacttaatccttataactctatgagattaattactataaatttccctgttttatagagggaggaaactgaggcacagccsggttaagtttctggcccaggtcatgtaagtagtggagctaggatttgaccacaggcggtttggctctagattttgtgttccaaaccatgttatttaaatt

SEQ ID NO: 32691 - DNA, 201 bp, Homo sapiens
catgcacatgcaggaaaaaaaatatgcaaaggttatttgcagtttaatattaagtgaaaaaagcagaatacaggttgcacataaaacatttattaggtacrtagagaaaatgtacatgaacaagttaggaagccaacaaaaaagaaaatagcgttttagagtggtagagttctggctaaagtttaagctttttgtctttag

SEQ ID NO: 32692 - DNA, 201 bp, Homo sapiens
agtgaaagcatgtcccagaaataggtggccaggataaggaggggacatttataaaactaaaccagatgtccacaggtgtgatagttgacttgctgaaaatytaataaatgcagcagttgtgcccagacacagctgtgtatgcattttagacatttctccaactttccttggagatctgtggcagtagataggaagaagagt

SEQ ID NO: 32693 - DNA, 201 bp, Homo sapiens
acttaatggcttgaaacaacacacatttattatcttaaaattctggaagtatcgtcattgtgccttggacatggcagatgggtcagcaaacattcgtccartgaaaggtctttctaagactgtgcctttgaacctactgttctgtccattcagaattccctcttcctacctttctgtctggtgtactcctgttcatcctca

SEQ ID NO: 32694 - DNA, 201 bp, Homo sapiens
gcacagacttaatggcttgaaacaacacacatttattatcttaaaattctggaagtatcgtcattgtgccttggacatggcagatgggtcagcaaacattygtccaatgaaaggtctttctaagactgtgcctttgaacctactgttctgtccattcagaattccctcttcctacctttctgtctggtgtactcctgttca

SEQ ID NO: 32695 - DNA, 201 bp, Homo sapiens
atcacaccactgcactccagcctgggtgacagagcaagaccctgtctcaatcaatcaatcaaatagtaaagaaaaactagcaccaattcttaaactgttcyaaaaaaattgaagacaaaggaatttttcctaactcttccaatgaggccagcattgccctaataccaaaaccagacaaggacacaacaaaaaaagaaaact

SEQ ID NO: 32696 - DNA, 201 bp, Homo sapiens
ctcaatgagatacactgaccagcccaaggtcacaccactggtaagaggtaaagttgagattcaatctgaggtccacgtggctccagaacctgtactttttrtaatgtggagtggagtttcagttctctggaaagttacttttctctacattaaaatgccactcttttgaagacgctagtaataatagtggtagttaatagt

SEQ ID NO: 32697 - DNA, 201 bp, Homo sapiens
ttatggagcacttgccttatgagaggctctacgcctagtacttcttttgtaatcatctcaaaatgaggtaggtgctattatgcagttactggcatcatgtraattaggggatttgttcagagatactgagtaattggcctgtagttctcagcctgggattctaacccaggttctgtgtgaccaaagcccattctcttgtac

SEQ ID NO: 32698 - DNA, 201 bp, Homo sapiens
gaatgtgtctgtctagagatttacatggtttttttttttttctggctcttgttttccagaaaagatgagactctgtgtgtgtgtgtgtgtgtgtgtgtgtrtatgtatttctgtgtgtgtgggggggtgtctgtgtgtgcttatgtctgtgtctgtgtgtgggtctgtatgtgtgtatgtgtgtgtgtgtctgtgtgtatg

SEQ ID NO: 32699 - DNA, 201 bp, Homo sapiens
gaaaatagcactgtcataccactgagcaattctactactgggtatttatccagtgcaaaggaaatcagtatattaaagggatacctgcaccccatgtttaytgcagtgctatttacagtagccaagatatggaatcagtctaaatgtccatcagcaggtgaatggatgaagaaaatgtgtatatatacatatggaatatta

SEQ ID NO: 32700 - DNA, 201 bp, Homo sapiens
atttgtgtgtggtagtttctcgtttgtgatcagtagcttccccctgcccccaccccacttctactgtacgtttattaacactggttcttggaccgggtgcrgtggcttacgcctataatcccaacactttgggagaccgaggtggccggatcacctgacgtcgggagttcgagaccaccctgaccaacatggagaaacccc

SEQ ID NO: 32701 - DNA, 201 bp, Homo sapiens
atttcactctcattgcctaggctggagtgcagtgatgcgatctttgctcactgcaacctccacctcccgggttcaagtgattctcctgtcgcagcctcccraatagctgggattacaggcatgcgccactatgcccgactagttttttgtatttttagtagagaaggagttttctccatgttgatcaggctggtctcaaac

SEQ ID NO: 32702 - DNA, 201 bp, Homo sapiens
cattccccttacaaaatttccctttaattagctggaacccttgttagctgaagcatggcctcttagaggacattgatgagcatctcgctggaggcacagtrcaggttcagtacagccaatagagggaggtgaacatctcacacttttctaatggctttcctgtgcacaaagcactttctcttccatcatcagtgaactcaa

SEQ ID NO: 32703 - DNA, 201 bp, Homo sapiens
tatgcccgactagttttttgtatttttagtagagaaggagttttctccatgttgatcaggctggtctcaaactcccgacctcaggtgattcacccacctcrgcctcccagtgtgctgggattacaggcatgagccactgcacccagcctcttaaactgatcatatgatattggttctcaaccaagggtgactttgccctca

SEQ ID NO: 32704 - DNA, 201 bp, Homo sapiens
tcggcctcccagtgtgctgggattacaggcatgagccactgcacccagcctcttaaactgatcatatgatattggttctcaaccaagggtgactttgcccycagaggatacttggcaatgtctggagatactcagttgtcatgacttggacaggtgctactgtcacccagtgggtagaggtcagggatggtgctaaacata

SEQ ID NO: 32705 - DNA, 201 bp, Homo sapiens
tcttttattcctcacccccttcctaccctttccccctgagtccccaaagttcactgtatccttcctatgcctgtgcatcctcatagcttagctcccacttwtgagtgagaacatatgatatttggttttccattcctgggctcaggaattctaagtgatgtatgtgtgtttgtctgtccatgctatttgtgaggtttgtca

SEQ ID NO: 32706 - DNA, 201 bp, Homo sapiens
gaaatgacaaaaagcagggctgtagtgagaagagaggacaaaggtttggaaagtgaggtcagggagatggacagtggcctggtcatataaggcctttagaytaagtcatgggagtagattttattctaagtgccttgagaagccaccgtagtgattcttttctagcttggaggacgcattctccaagccaggcgtcatcct

SEQ ID NO: 32707 - DNA, 201 bp, Homo sapiens
acaagagatggggattagggtgggaggagagtggtcaggaaggagggaccctgtggaataagacctggagagtgacaaggaacaagcatgcagaggcctgsgtgcagggcattccagctgaggggaacagcacgtgcaaaggccctcaggggggtgtgttccagaaatgacaaaaagcagggctgtagtgagaagagagga

SEQ ID NO: 32708 - DNA, 201 bp, Homo sapiens
tcttgatggagtctcactctgtcacccaggctggagtgcagtggtgtaatcttggctcattgcaacctccacctcctgggtccaagtgattctcctgcctmagcctcccaagtaagtgggattacaggcgagcgccaccatgctcagctaatttttgtattttgagtagggacgaggttttgccatgttacccagcctggt

SEQ ID NO: 32709 - DNA, 201 bp, Homo sapiens
catactctgagtgccttgaaggcgggaaccatgcatgcattggtcagccctgtgatagtgcctgcatgtctcaccttggcattgacctctcctgtcccctrgtacctgcctaggtgcagcaggatagattgagaaccaaagtttttccaaagctattttctcaaagccatgaggactgatatattttctctggttggtagt

SEQ ID NO: 32710 - DNA, 201 bp, Homo sapiens
tattatagttactgctctgggcccacacaggctccaaagacataccctctaaatatgtgactttactgtattatcagcgtggacatttggaaaacagttayattagtttttataaaattatgggttataagaaggtacattgatatagtgtgggaaattttaaaaaagggaagaaatgatgcttctttaccacctttagca

SEQ ID NO: 32711 - DNA, 201 bp, Homo sapiens
ttctcagggatgttccttgctgagaaaaagaattcagcgatatttctcccatttgcttttgaaagaagagaaatatggctctgttccgcccagctcaccgrtggtcaaagtttaaggttatctctcttgttccctgaacattgctgttatcctgttcttttttcaaggtgcccagatttcatattgttcaaacacacatgc

SEQ ID NO: 32712 - DNA, 201 bp, Homo sapiens
attttttaaaaaacagaaatgtaatgaattttagtatattaatgctttttgaattttcgaaaggagatacagcttggagtatttcccaaatttaccgactrtagatccctttttttcgcaacagcattaattgggctagttgggcacagattttgagaaatactgatctcaatgaatattactcaaatttaagtattttct

SEQ ID NO: 32713 - DNA, 201 bp, Homo sapiens
gggcgtagtggcgggtgcctgtaatcccagcccctcgggaggctgaggcaggagaatcgcttgaacctgggaggtggaggttgcagtgagccgaggtcacrtcactgcactccagcctgggtgacagagtgagactctgtctcaaaaaaaaaaagaaatgtattgtctcacagtttggaggccagaagttcaagatcaacg

SEQ ID NO: 32714 - DNA, 201 bp, Homo sapiens
gcgacgccacaatcagtacatgctccatgcccacaaacatctctgtttttccagaagcgtgtgtggacgtactgccattagcacatgcaatccacagatamacttgtgctcacgcctgcctgcacacatgagctgagccagggctcacactcaccttctcacccgcatgttccaccccccgctactcactgcagccagttc

SEQ ID NO: 32715 - DNA, 201 bp, Homo sapiens
ccctgttcccatgtccccctcctcctgacctttcccccatcacttcttcctgtcagctgagaggtaccctggattgaccctgcctctctggcttggctttyctgtccccacagtgggtgatggggccacttaccagcttccgaagggctccctcatccagcccagctaaggcctcgtccgccatctcgctggcccctagct

SEQ ID NO: 32716 - DNA, 201 bp, Homo sapiens
  misc_feature (1)...(201): n = A,T,C or G, or insertion/deletion polymorphism (see Tables 1-2)
gaaaccagtttggcaaggccatcatctccaggatgtcatccagccgctgtgttctctgggcaacagtgccaggcaaacttctggccctgcaggaggagaangggcctcagatgcccactgggcagcagtgaattccaggagacccagcctcacagacaaaggagaggcaaggggctggaacaggaaggagagagttctgga

SEQ ID NO: 32717 - DNA, 201 bp, Homo sapiens
actctaggacctagagcttgtgtgcaaacacatctccctccctcccttcattttacaggtagaggaactgagactcaagagtagaaaaatgagatgagaarccacagaatccataagggcccacaaaacctgtctctctcttatggcctcgtccagccttgactttcccaggactctggtcccccgtggcccactatgggg

SEQ ID NO: 32718 - DNA, 201 bp, Homo sapiens
gatgccagggcctcctcctcgcgctccagctcctgccgctgcagttcccggatggctgagcggatgcgccgccgctctgccagatctgctgtgacctccasctgcagtgggtgcgagaggcaggtcattttggctgccaggggcggagggctggcaccagctgcccacggctctgcctagggcacaatgtgtggcctgtgt

SEQ ID NO: 32719 - DNA, 201 bp, Homo sapiens
aaccctcgttcttttgttgttttttttttgttttgttttgtttttgagacagagtctcactctgtcgcccaggctggagtggagtggcacaaccatggctyactgcagccttgacctcccaggctcacagtgggactacagacacgtgccaccatgcctggctaatttttttattttttgtagagacaagggtctccctat

SEQ ID NO: 32720 - DNA, 201 bp, Homo sapiens
agaccaatagtctgggaaaaggaggaggataggctgtgggcggagcaggaaatgtgggtggttctctttgccaaggattctgaatgccagatgagcaggaygaatgtatcttgtgggcaccagagaggcctgggcctcagcctgccccctgtaaaatgaggtgattagactggtctgcttcaagccttcctagggcaaggg

SEQ ID NO: 32721 - DNA, 201 bp, Homo sapiens
ccatggctcactgcagccttgacctcccaggctcacagtgggactacagacacgtgccaccatgcctggctaatttttttattttttgtagagacaagggkctccctatgttgccggggctagtctcgaactcctgggttcaagaaatccgcctgccttgaccttccaaagtgctaggattacaggcgtgagccactgcgc

SEQ ID NO: 32722 - DNA, 201 bp, Homo sapiens
gaccaccattatacagataaggagacaggctcagaaccctcgttcttttgttgttttttttttgttttgttttgtttttgagacagagtctcactctgtcrcccaggctggagtggagtggcacaaccatggctcactgcagccttgacctcccaggctcacagtgggactacagacacgtgccaccatgcctggctaatt

SEQ ID NO: 32723 - DNA, 201 bp, Homo sapiens
  misc_feature (1)...(201): n = A,T,C or G, or insertion/deletion polymorphism (see Tables 1-2)
ccaggatgtcatccagccgctgtgttctctgggcaacagtgccaggcaaacttctggccctgcaggaggagaaggggcctcagatgcccactgggcagcantgaattccaggagacccagcctcacagacaaaggagaggcaaggggctggaacaggaaggagagagttctggatgtgccagcctggacctctttagactt

SEQ ID NO: 32724 - DNA, 201 bp, Homo sapiens
tgaggctggagaatggagcccctagaggtggatggttcttgttggggttggctggatccaaggggtatgaccttcctccttatgtgcagaactggatgcgycctaggtcatggccagcagccctcggagtgggactgaggacctgctgggaaaccagtttggcaaggccatcatctccaggatgtcatccagccgctgtgt

SEQ ID NO: 32725 - DNA, 201 bp, Homo sapiens
agttcctccatgcttggatttactgtctggcacatgcgctcactagcccttggccctatggaagggatgtgtgggtcctgccccttcaagcccttagtgcytgggtccacctccagacatacccgcctgcctctgtcttcctctctgcaagggagtgggggtgatctagagatcaaagggcagtccggtacagtgctaggg

SEQ ID NO: 32726 - DNA, 201 bp, Homo sapiens
aaggaggaggataggctgtgggcggagcaggaaatgtgggtggttctctttgccaaggattctgaatgccagatgagcaggatgaatgtatcttgtgggcrccagagaggcctgggcctcagcctgccccctgtaaaatgaggtgattagactggtctgcttcaagccttcctagggcaaggggctgtcacagaaagggtc

SEQ ID NO: 32727 - DNA, 201 bp, Homo sapiens
gaacttggccacctctacagcacaacccccggagcttcagtgtccccatctggaaaatgggagcctccctctgatcccccaaagtgggtgggcaaggctgsagactgacaacctcattccactggtcaccctctggcacgacccttccctttgggcctggaggcaaaggttggaccacagtgtctcctctgtgtgtcccga

SEQ ID NO: 32728 - DNA, 201 bp, Homo sapiens
gaacagtgtgagcaaagaccaatagtctgggaaaaggaggaggataggctgtgggcggagcaggaaatgtgggtggttctctttgccaaggattctgaatrccagatgagcaggatgaatgtatcttgtgggcaccagagaggcctgggcctcagcctgccccctgtaaaatgaggtgattagactggtctgcttcaagcc

SEQ ID NO: 32729 - DNA, 201 bp, Homo sapiens
aagaggctaggactacaggcacacaccaccacgcccagctaatttttaaaattcatcccacatagaagagggggaaaggcatgaaagggcatttgtggcakaggaacagtgtgagcaaagaccaatagtctgggaaaaggaggaggataggctgtgggcggagcaggaaatgtgggtggttctctttgccaaggattctga

SEQ ID NO: 32730 - DNA, 201 bp, Homo sapiens
ctttggggttggggaaggagccctgccccactgggttgccctacggcctctgtgcatggaggtagacagggctctcaggaagaggaacaagaaaggggatrgagtgggctcatctttcctccacctgagatctgggtccatgcctcattctgtccccatgccaactctaggacctagagcttgtgtgcaaacacatctccc

SEQ ID NO: 32731 - DNA, 201 bp, Homo sapiens
ggctttcctgtccccacagtgggtgatggggccacttaccagcttccgaagggctccctcatccagcccagctaaggcctcgtccgccatctcgctggccyctagctccgtcggttcctttctggtgagatccccagtgcctgtggcacctgtcaccagctcagagaattctgcaggggacagacatgaatcaggcatgct

SEQ ID NO: 32732 - DNA, 201 bp, Homo sapiens
ctggccccgccctgccccgacgcgccagccaaccctcgattgggtacctcccactctcgtgccccattgggaaaattcaatttgacggccacgccccgagrggaaggccccgcccctcgcgggccagggaggtcggaaattgggagtcttggggtcgtctgcctcggtggctttagcgagtcgggtgggcatcggcagggg

SEQ ID NO: 32733 - DNA, 201 bp, Homo sapiens
ctcgcgctccagctcctgccgctgcagttcccggatggctgagcggatgcgccgccgctctgccagatctgctgtgacctccagctgcagtgggtgcgagrggcaggtcattttggctgccaggggcggagggctggcaccagctgcccacggctctgcctagggcacaatgtgtggcctgtgtccactccctgtgtccca

SEQ ID NO: 32734 - DNA, 201 bp, Homo sapiens
ttttgttaccactatgaccttcacagcttgagtcctgtgaggtaggaccaccattatacagataaggagacaggctcagaaccctcgttcttttgttgttktttttttgttttgttttgtttttgagacagagtctcactctgtcgcccaggctggagtggagtggcacaaccatggctcactgcagccttgacctcccag

SEQ ID NO: 32735 - DNA, 201 bp, Homo sapiens
aaactcctggctcaagcaatccttccatctcagcctcccaagaggctaggactacaggcacacaccaccacgcccagctaatttttaaaattcatcccacrtagaagagggggaaaggcatgaaagggcatttgtggcagaggaacagtgtgagcaaagaccaatagtctgggaaaaggaggaggataggctgtgggcgga

SEQ ID NO: 32736 - DNA, 201 bp, Homo sapiens
caaactcctggctcaagcaatccttccatctcagcctcccaagaggctaggactacaggcacacaccaccacgcccagctaatttttaaaattcatcccayatagaagagggggaaaggcatgaaagggcatttgtggcagaggaacagtgtgagcaaagaccaatagtctgggaaaaggaggaggataggctgtgggcgg

SEQ ID NO: 32737 - DNA, 201 bp, Homo sapiens
aagggtctactctaggttcttccaggttcaaccctggaaaggcagaatgggaagtggctggagcagctcagaggctaggggtaatattttgctccagagcycaagtctgagaatgactattttaccaagctgtctgtgttgcatccctaagtcaccctggctaaccctccacccagtcagggtccttcagagaaagcccag

SEQ ID NO: 32738 - DNA, 201 bp, Homo sapiens
aagtcactgcttgttccccctcccatcctggtaggctcagaggtgtcaacctcccaatctctgcctgttaggatccttgcctcttacctagttactctgtmtgggttaaacctcttcaagactgtccagtggtcaccagccttaggttctgcggacattctgattccccccatgtctgttcttctatggggcagctgaccc

SEQ ID NO: 32739 - DNA, 201 bp, Homo sapiens
actttgctgccactaggatgggggaagctctggaagacttcttagggaagtggtgtataaactgtgtgtcacacttgtttttattttattttattttttttggagacagggtcttgctgtgtcccacaggctggagtgcagtcgcatgatcacagcttaccatggcctcaaactcctggctcaagcaatccttccatctca

SEQ ID NO: 32740 - DNA, 201 bp, Homo sapiens
ccttagtgcctgggtccacctccagacatacccgcctgcctctgtcttcctctctgcaagggagtgggggtgatctagagatcaaagggcagtccggtacrgtgctagggaagtttacagctacagccgaggaaagagtaaacatcccgtgacgagggccccagcatttgctgaacacctgttgcatgtcagacgtggggc

SEQ ID NO: 32741 - DNA, 201 bp, Homo sapiens
cagtgtttaagcttggccgccgtccctaggctgctttcgggacacctggtctgagccacctcagagcagggactgagtgactggcagcaccttgaccctgygttggagtgccgggaccatctcaggtggagcagaatcaatcacacagcacgcctcccccagcccacacacctttgaacagacattgccttcttgtagcat

SEQ ID NO: 32742 - DNA, 201 bp, Homo sapiens
tagtctgaagagagcagggagagtcttgggggaagagccctccaggctccacattcctgaggaattatgagaagaccccctgaaactcaggccagagcccytagttggttccagccctagtccaatcctggctgggtgatcaagagcatatcccttaaactctctgtgtcttggttttttcatttgccagtgggtggggtt

SEQ ID NO: 32743 - DNA, 201 bp, Homo sapiens
gcggagcaggaaatgtgggtggttctctttgccaaggattctgaatgccagatgagcaggatgaatgtatcttgtgggcaccagagaggcctgggcctcascctgccccctgtaaaatgaggtgattagactggtctgcttcaagccttcctagggcaaggggctgtcacagaaagggtctactctaggttcttccaggtt

SEQ ID NO: 32744 - DNA, 201 bp, Homo sapiens
ctcaaaaaaagaaaaaagaaaatcaaggcacagaagaaagcgacttgtcaatgctacacagcaggagaggcaaacagagctcacttcggaggacatatttsaaggtcctaggctttctctacctgggcgagatgccatgttattatccagaacgagggtcaggcgccctctaagaccaattctgaatacttcaaaattcac

SEQ ID NO: 32745 - DNA, 201 bp, Homo sapiens
cctagagccttctgtggtacatttggaggctgggggctggaggggacagagggtccagccccttctgtacagagggtaaagaggcccagaggggcaagggstagccttttgtctcctaggtccccattctcagtgctctgggctcggagatggggtgcttgtctctgacaaaagcctgatgtaggaacttggccacctcta

SEQ ID NO: 32746 - DNA, 201 bp, Homo sapiens
gccttgggctctctaagcctctctccccaggacagcactgtcattctggagacgggaacagcattagcaaaggaacggaagtaggattgtgacgaccttgytgggcaacagacaggcaggtgaggctggagaatggagcccctagaggtggatggttcttgttggggttggctggatccaaggggtatgaccttcctcctt

SEQ ID NO: 32747 - DNA, 201 bp, Homo sapiens
atcccgtgacgagggccccagcatttgctgaacacctgttgcatgtcagacgtggggctcccactactgccaggtgaccactgtgcaagataggtacactytgattcgacagaggaagctgaagctcagggaggtgaaggcaccttggcctagtaaaggcattcagactaaagtggaattctgcctgatgctgaagcccct

SEQ ID NO: 32748 - DNA, 201 bp, Homo sapiens
aaaggtgacagatgaagtccaccctctgagcaagggaggctccctggtctagtcaccaaacaccacagcccagctgggggttgactgcttcatccacagayggggaaactgaggacaggtgctcaggagtcctgcctggctgagggctattgtccccactgcactggcctggacctagccaccatggaagaagccagggtg

SEQ ID NO: 32749 - DNA, 201 bp, Homo sapiens
gcaggtgaggctggagaatggagcccctagaggtggatggttcttgttggggttggctggatccaaggggtatgaccttcctccttatgtgcagaactggrtgcgtcctaggtcatggccagcagccctcggagtgggactgaggacctgctgggaaaccagtttggcaaggccatcatctccaggatgtcatccagccgc

SEQ ID NO: 32750 - DNA, 201 bp, Homo sapiens
aaattgggggtgactggtctaaccaggttcaggaaagaacaccttctctggagtgagtcagccaatcctgttgcctcccccacacctccaccatgtagagycacctgctacatacagatcctccgtggctcaagggagagaggactggcccagggttcccctggaagatagtggcagagataagcctccagtgtgggtctg

SEQ ID NO: 32751 - DNA, 201 bp, Homo sapiens
cctgtaaaatgaggtgattagactggtctgcttcaagccttcctagggcaaggggctgtcacagaaagggtctactctaggttcttccaggttcaaccctrgaaaggcagaatgggaagtggctggagcagctcagaggctaggggtaatattttgctccagagctcaagtctgagaatgactattttaccaagctgtctg

SEQ ID NO: 32752 - DNA, 201 bp, Homo sapiens
tgagtcagccaatcctgttgcctcccccacacctccaccatgtagagccacctgctacatacagatcctccgtggctcaagggagagaggactggcccagkgttcccctggaagatagtggcagagataagcctccagtgtgggtctgataaccagacgggagccagtaaaggcggggtgatttcctctgtccccaccccc

SEQ ID NO: 32753 - DNA, 201 bp, Homo sapiens
gtaatattttgctccagagctcaagtctgagaatgactattttaccaagctgtctgtgttgcatccctaagtcaccctggctaaccctccacccagtcagkgtccttcagagaaagcccaggccttgggtcaggaggcaagaagggtgatgggtgtcttacccctggctccaaccctaggtaagggttggccctcttggag

SEQ ID NO: 32754 - DNA, 201 bp, Homo sapiens
ggctcctggctggaagctgccctctgccctagggtggtttgctggaaaactcaccaaacccagggtagggggtctctggttccagccctgccagcttggcygccagtctgctgtgtggcctgggatggactctcatcctgtctaaacctcaaaacagggagggcagggacctggattgagaagccagggcctggcaagacc

SEQ ID NO: 32755 - DNA, 201 bp, Homo sapiens
tcttaggaatccgggggcgtcttcccccaacagtctcataactttatcccatggcttagacctctcgtatgggtgggggctcccaggtctggacgttccasaactcctgtctagacatccgggttccacccccggacacgttggggcagcaccaggatcccccccgaggtccgcacacccacctctcagtccagcccaccc

SEQ ID NO: 32756 - DNA, 201 bp, Homo sapiens
ctacctgatgggttggacactggctcctgatcatgcttatactacatgtgtggcaattttgttaccactatgaccttcacagcttgagtcctgtgaggtargaccaccattatacagataaggagacaggctcagaaccctcgttcttttgttgttttttttttgttttgttttgtttttgagacagagtctcactctgtc

SEQ ID NO: 32757 - DNA, 201 bp, Homo sapiens
gtgaggctggagaatggagcccctagaggtggatggttcttgttggggttggctggatccaaggggtatgaccttcctccttatgtgcagaactggatgcrtcctaggtcatggccagcagccctcggagtgggactgaggacctgctgggaaaccagtttggcaaggccatcatctccaggatgtcatccagccgctgtg

SEQ ID NO: 32758 - DNA, 201 bp, Homo sapiens
ctgccgccacagactagcgcccctgtggggcgtggagtctcttaggaatccgggggcgtcttcccccaacagtctcataactttatcccatggcttagacytctcgtatgggtgggggctcccaggtctggacgttccagaactcctgtctagacatccgggttccacccccggacacgttggggcagcaccaggatcccc

SEQ ID NO: 32759 - DNA, 201 bp, Homo sapiens
caagggcctggaacactctcagtgacagaggcaagagccccatcttgccccagtgctgcccatcaaaatggacccctaaatcctggcccagcctcccagcrcagatctctccttcctcctgtagccccaactaatgtctgtctggaatttgaggggccctggtctggcacactgtggatgcttagttaatgtatggtgact

SEQ ID NO: 32760 - DNA, 201 bp, Homo sapiens
ggtgaggctggagaatggagcccctagaggtggatggttcttgttggggttggctggatccaaggggtatgaccttcctccttatgtgcagaactggatgmgtcctaggtcatggccagcagccctcggagtgggactgaggacctgctgggaaaccagtttggcaaggccatcatctccaggatgtcatccagccgctgt

SEQ ID NO: 32761 - DNA, 201 bp, Homo sapiens
acagacaaaggagaggcaaggggctggaacaggaaggagagagttctggatgtgccagcctggacctctttagacttctgggagtccctgatgcctgggckcagggagtgggggtctaggctcatggtgggacactatgtaattgctacctgatgggttggacactggctcctgatcatgcttatactacatgtgtggcaa

SEQ ID NO: 32762 - DNA, 201 bp, Homo sapiens
aggctcggcttagctctttcgggacccgacagacggattagacacgcgcaggccggaggtgccgcgacccgctgtcccaggcccgctcagcaaccgtcccytggattctgcggagagctgcccgtccagccgcgccagcagcccggctggccccgccctgccccgacgcgccagccaaccctcgattgggtacctcccact

SEQ ID NO: 32763 - DNA, 201 bp, Homo sapiens
cccagagattcaaccactgctccagcttctctccaaaactcttttccagcgccgcccgagcctcgcttaagagagggaggtggcggctgaagaaccctgascctgcctgtggataccttgagatgaggatgtgcgggaaccaggcctggcattccctctttttggactgtgctgcctctacgacccccactgggacttgga

SEQ ID NO: 32764 - DNA, 201 bp, Homo sapiens
gggtgatcaagagcatatcccttaaactctctgtgtcttggttttttcatttgccagtgggtggggttgggaacagtgacttggcctctcctgtacatagytgcagttgcaataagcatcacccccatacttggttctagccagtcaggaggagggagagagacaagggggcaaatgggaagggcaggataccccgaggca

SEQ ID NO: 32765 - DNA, 201 bp, Homo sapiens
gagacagagtctcactctgtcgcccaggctggagtggagtggcacaaccatggctcactgcagccttgacctcccaggctcacagtgggactacagacacrtgccaccatgcctggctaatttttttattttttgtagagacaagggtctccctatgttgccggggctagtctcgaactcctgggttcaagaaatccgcct

SEQ ID NO: 32766 - DNA, 201 bp, Homo sapiens
agccccttctgtacagagggtaaagaggcccagaggggcaagggctagccttttgtctcctaggtccccattctcagtgctctgggctcggagatggggtscttgtctctgacaaaagcctgatgtaggaacttggccacctctacagcacaacccccggagcttcagtgtccccatctggaaaatgggagcctccctctg

SEQ ID NO: 32767 - DNA, 201 bp, Homo sapiens
actctgtcgcccaggctggagtggagtggcacaaccatggctcactgcagccttgacctcccaggctcacagtgggactacagacacgtgccaccatgccyggctaatttttttattttttgtagagacaagggtctccctatgttgccggggctagtctcgaactcctgggttcaagaaatccgcctgccttgaccttcc

SEQ ID NO: 32768 - DNA, 201 bp, Homo sapiens
acccttccctttgggcctggaggcaaaggttggaccacagtgtctcctctgtgtgtcccgagttccacccgcccaggccccaccgctgtgtaaggagggarctgtgggagggagggaaggaagtacaaagcgccattgtctaccgagggggaaggggaaggggatggggcggtttccgaaactgcccagtgaaattctccc

SEQ ID NO: 32769 - DNA, 201 bp, Homo sapiens
ccccattcctcccatccccggcccaatcctcaagaatgtgcgggagccggggccggaagcgactgcccgcgtccccaaatcggccagacgctggggcgcakggcgggcggagcgggcctagcttttccttatatggcccggccccgcggggaggagcccggctcgggacgcccccgttcttgccacgaggccagcgggggc

SEQ ID NO: 32770 - DNA, 201 bp, Homo sapiens
gccagcagccctcggagtgggactgaggacctgctgggaaaccagtttggcaaggccatcatctccaggatgtcatccagccgctgtgttctctgggcaayagtgccaggcaaacttctggccctgcaggaggagaaggggcctcagatgcccactgggcagcagtgaattccaggagacccagcctcacagacaaaggag

SEQ ID NO: 32771 - DNA, 201 bp, Homo sapiens
tgccccactgggttgccctacggcctctgtgcatggaggtagacagggctctcaggaagaggaacaagaaaggggatggagtgggctcatctttcctccamctgagatctgggtccatgcctcattctgtccccatgccaactctaggacctagagcttgtgtgcaaacacatctccctccctcccttcattttacaggta

SEQ ID NO: 32772 - DNA, 201 bp, Homo sapiens
  misc_feature (1)...(201): n = A,T,C or G, or insertion/deletion polymorphism (see Tables 1-2)
gatgcgtcctaggtcatggccagcagccctcggagtgggactgaggacctgctgggaaaccagtttggcaaggccatcatctccaggatgtcatccagccnctgtgttctctgggcaacagtgccaggcaaacttctggccctgcaggaggagaaggggcctcagatgcccactgggcagcagtgaattccaggagaccca

SEQ ID NO: 32773 - DNA, 201 bp, Homo sapiens
ccgaggtccgcacacccacctctcagtccagcccacccgtccggcgcaggctcggcttagctctttcgggacccgacagacggattagacacgcgcaggcsggaggtgccgcgacccgctgtcccaggcccgctcagcaaccgtcccctggattctgcggagagctgcccgtccagccgcgccagcagcccggctggcccc

SEQ ID NO: 32774 - DNA, 201 bp, Homo sapiens
ttatgtgcagaactggatgcgtcctaggtcatggccagcagccctcggagtgggactgaggacctgctgggaaaccagtttggcaaggccatcatctccabgatgtcatccagccgctgtgttctctgggcaacagtgccaggcaaacttctggccctgcaggaggagaaggggcctcagatgcccactgggcagcagtga

SEQ ID NO: 32775 - DNA, 201 bp, Homo sapiens
ggttggctggatccaaggggtatgaccttcctccttatgtgcagaactggatgcgtcctaggtcatggccagcagccctcggagtgggactgaggacctgytgggaaaccagtttggcaaggccatcatctccaggatgtcatccagccgctgtgttctctgggcaacagtgccaggcaaacttctggccctgcaggagga

SEQ ID NO: 32776 - DNA, 201 bp, Homo sapiens
aaaggcagaatgggaagtggctggagcagctcagaggctaggggtaatattttgctccagagctcaagtctgagaatgactattttaccaagctgtctgtrttgcatccctaagtcaccctggctaaccctccacccagtcagggtccttcagagaaagcccaggccttgggtcaggaggcaagaagggtgatgggtgtct

SEQ ID NO: 32777 - DNA, 201 bp, Homo sapiens
tcactgcagccttgacctcccaggctcacagtgggactacagacacgtgccaccatgcctggctaatttttttattttttgtagagacaagggtctccctrtgttgccggggctagtctcgaactcctgggttcaagaaatccgcctgccttgaccttccaaagtgctaggattacaggcgtgagccactgcgcccggcca

SEQ ID NO: 32778 - DNA, 201 bp, Homo sapiens
agaaggggcctcagatgcccactgggcagcagtgaattccaggagacccagcctcacagacaaaggagaggcaaggggctggaacaggaaggagagagttytggatgtgccagcctggacctctttagacttctgggagtccctgatgcctgggcgcagggagtgggggtctaggctcatggtgggacactatgtaattgc

SEQ ID NO: 32779 - DNA, 201 bp, Homo sapiens
tagtcaccaaacaccacagcccagctgggggttgactgcttcatccacagatggggaaactgaggacaggtgctcaggagtcctgcctggctgagggctaytgtccccactgcactggcctggacctagccaccatggaagaagccagggtgcagagtgggaggaccaatcccccagacatataaggtggctggcactagg

SEQ ID NO: 32780 - DNA, 201 bp, Homo sapiens
ccctgtaaaatgaggtgattagactggtctgcttcaagccttcctagggcaaggggctgtcacagaaagggtctactctaggttcttccaggttcaacccyggaaaggcagaatgggaagtggctggagcagctcagaggctaggggtaatattttgctccagagctcaagtctgagaatgactattttaccaagctgtct

SEQ ID NO: 32781 - DNA, 201 bp, Homo sapiens
gaaaggcagaatgggaagtggctggagcagctcagaggctaggggtaatattttgctccagagctcaagtctgagaatgactattttaccaagctgtctgygttgcatccctaagtcaccctggctaaccctccacccagtcagggtccttcagagaaagcccaggccttgggtcaggaggcaagaagggtgatgggtgtc

SEQ ID NO: 32782 - DNA, 201 bp, Homo sapiens
ttgctacctgatgggttggacactggctcctgatcatgcttatactacatgtgtggcaattttgttaccactatgaccttcacagcttgagtcctgtgagrtaggaccaccattatacagataaggagacaggctcagaaccctcgttcttttgttgttttttttttgttttgttttgtttttgagacagagtctcactct

SEQ ID NO: 32783 - DNA, 201 bp, Homo sapiens
acggtgactcacacctgtaatctcagcactttgggaggctgaggcaggtggatcccttgaggtctggagttcaagacaagcctggccaatatagtgaaacyccgtctctactaaaaatacaaaaattagctgggcgtggtggtgtgcacctgtaatcccatttactcagaaagctgaggcaggagaactgcttgaacccag

SEQ ID NO: 32784 - DNA, 201 bp, Homo sapiens
ctacaacaacaaatgggaatgaacattaattggttttgattatgtcatttcatagcaaatgaggctggagtgaggctgaacatcatgttctcagtaatagyatgtgctatggtttgctccaaaactcatgttgaaacttaatccccaatgcaacagtgttgagaggctgggcctttaagagctaattcgatcatgagggct

SEQ ID NO: 32785 - DNA, 201 bp, Homo sapiens
ctggctgaattcatcatttttttctttgttcactgtcctttcgacattgatgtatataaggtgatacattatgactgctcaatgataatagacaatgatcrttgtcataataataaaaatcatgctgggtgcggtggctcacacctgtaatcccagcactttgtgaggccgaggtgagtggatcatgaggtcaggagttca

SEQ ID NO: 32786 - DNA, 201 bp, Homo sapiens; identical to SEQ ID NO: 6153

SEQ ID NO: 32787 - DNA, 201 bp, Homo sapiens
attattatttttatttttatttttgagacagagtctccctctgttgcccaggctggagtgcagtggtgcaatctcagctcactgcaacctccacctcctgwgttcaaacgattgtcctgcctcagcctcccaaggagctgggactacaggtgcgtgccaccaagcccagctaatttttgtatttttagtagagacagggtt

SEQ ID NO: 32788 - DNA, 201 bp, Homo sapiens
cttgaacccgggaagcagagattgccgtgaacctagattacgccatcgcactccagcctgggcgacaagagcaaaactccgtctcaaaaaaacaaaaacargggtctatcttttttctatttccacccattgcccaagccaggacccagtgaaggcaggtagttgatctttgttgaataaatgaaatgcctagctaattat

SEQ ID NO: 32789 - DNA, 201 bp, Homo sapiens
aggcacacgccacccgcctggctaattttttgtattttagtacagacggggatttaccatattgcccaggctggtctcaaactcctgagctcaggcaatcygcccgccttgtcctcccaaagtgctaggattacaggcgtgagccaacgcggccggccttgtaaaacattttcatcacacaaaagaaaaccttctacccat

SEQ ID NO: 32790 - DNA, 201 bp, Homo sapiens
agaagtgttcccaggcgcctgtaatcccagctacttgggaggctgaggcgggagaatcacttgaacccgggaagcagagattgccgtgaacctagattacrccatcgcactccagcctgggcgacaagagcaaaactccgtctcaaaaaaacaaaaacaagggtctatcttttttctatttccacccattgcccaagccag

SEQ ID NO: 32791 - DNA, 201 bp, Homo sapiens
tacaaaaattagccagaagtgttcccaggcgcctgtaatcccagctacttgggaggctgaggcgggagaatcacttgaacccgggaagcagagattgccgygaacctagattacgccatcgcactccagcctgggcgacaagagcaaaactccgtctcaaaaaaacaaaaacaagggtctatcttttttctatttccaccc

SEQ ID NO: 32792 - DNA, 201 bp, Homo sapiens
ttaactggggaagaattgtaaccatatttgcatttgaaggtattctcatcaagaaacttctacgacagcaaattgccccggatgtggatacctataaggakatttcatattttgttgcggagttcataatgaataacacaggagaatggataaggcaaaacggaggctgggtatgtgtgatggaaaaattcttcattgttc

SEQ ID NO: 32793 - DNA, 201 bp, Homo sapiens
aatttattcttttataggaaaatggctttgtaaagaagtttgaacctaaatctggctggatgacttttctagaagttacaggaaagatctgtgaaatgctmtctctcctgaagcaatactgttgaccagaaaggacactccatattgtgaaaccggcctaatttttctgactgatatggaaacgattgccaacacatactt

SEQ ID NO: 32794 - DNA, 201 bp, Homo sapiens
ggatcacctgaggtcaggagttccagaccagcctggccaacatggtgaaacctcatctctactaaaaatacaaaaattagccgggtgtggtggcgtgcacytatagtcccagctatttgggaggctgaggcaggagaatcacttgaatccaggaggtggaggttgcagtgagctgagatcgcaccattgcactccaggctg

SEQ ID NO: 32795 - DNA, 201 bp, Homo sapiens
accgtgttagccaggatggtctcaatctcctgacctcatgatccaccagcctcggccttccaaagtgctgggattacaagcatgagccaccgcgcccggcygtgttcattcatttttgtgtgttaatcagagctgagtggtgggaatgaacagtcactgatggttctaacaggaagtacatatatgggcactattacctgg

SEQ ID NO: 32796 - DNA, 201 bp, Homo sapiens
gcaaccatctatgccatctgaggcgcctgtcactcggagcagggtaagacttcacagtttcctttttccttctcttcctccaagtgcctcacccccacccyccccccaactgcttttagtgttcattctttttttatttttatttttgagacggagtcttgcttgctctgtcgcccaggctggagtgcagtggcgcgatct

SEQ ID NO: 32797 - DNA, 201 bp, Homo sapiens
ttttcatagcttcaaaggtattagtttaatttggatttactgtgagttctcatgattttcaatacaatgcagtttacagtataatataattcatattacawatataagtgcattgaaatcaatgttggacaattgaacaagaacgagaaaaaaaaaggctttctatcctctagagctgtgcttgctgtccactatggaagt

SEQ ID NO: 32798 - DNA, 201 bp, Homo sapiens
ccggcctaatttttctgactgatatggaaacgattgccaacacatacttctacttttaaataaacaactttgatgatgtaacttgaccttccagagttatrgaaattttgtccccatgtaatgaataaattgtatgtatttttctctatatgccattttgtcttaatttcttgggtctggctggaaattcagccaaagggt

SEQ ID NO: 32799 - DNA, 201 bp, Homo sapiens
gtggccggatgaacctctcccgagtgtagatacaaatacacacattgcctgcacgtgcacacactcagcctttctaaagtttccaagctcttttttttttwtaaaaaaaacacctgaatagttcaagttgtagacatgaaataaatactcttggaaatgtcatttcaaagcaatctccatgccgctttcccagctcagatg

SEQ ID NO: 32800 - DNA, 201 bp, Homo sapiens
gaaaattgactaatgcagcatgggagagtgtaatggctgtttaatggttgttgtccatctgtgaagaactttagatacataatttttaatcttcatgatgwccctctgaagtagatattttccgtattttactgttgaagaaacaggcttaaaaccagtaagaaacatgcccaatgtcacagagttgggggcatctgacct

SEQ ID NO: 32801 - DNA, 201 bp, Homo sapiens
ggtagaagattaactatttgcactatttaaatgaaaatatttttgctttttattccagcatacttaatctccaatgatgtttaaagtgttaaatttattcktttataggaaaatggctttgtaaagaagtttgaacctaaatctggctggatgacttttctagaagttacaggaaagatctgtgaaatgctatctctcctg

SEQ ID NO: 32802 - DNA, 201 bp, Homo sapiens; identical to SEQ ID NO: 6155

SEQ ID NO: 32803 - DNA, 201 bp, Homo sapiens; identical to SEQ ID NO: 6156

SEQ ID NO: 32804 - DNA, 201 bp, Homo sapiens
agacgtaaatgtttgccagatgaccatttgaaaaaattattttaacaattttctaattcttttggcacttgtttggaaatgtatggagtggaaagaagtarggtgttcacattctcatccaagtccaggcaccaacgggttggctaatcttagataacttatttttctgggcctcgatttcctcatttgttaaaataatgg

SEQ ID NO: 32805 - DNA, 201 bp, Homo sapiens; identical to SEQ ID NO: 6151

SEQ ID NO: 32806 - DNA, 201 bp, Homo sapiens
cttattactataattattattattttttgtttgcttgttttttgagattcagtcttgctcttgtcatccaggctggagtgcagtggcacgatctcagctckctgcaagctccgcgtcctgggttcaagtgattctcctgcctcagcctcccaagtagctgggactacaggtgcccgccaccacactcagctaatttttgta

SEQ ID NO: 32807 - DNA, 201 bp, Homo sapiens
aacctcaactcttacttcatgtggcacagaaaaattaaatggaaagagatcacaggcctaaatttatgtgaaaattatacaacgtctagaagaaaattaawtttttttaatttttactgttaaaaagacactttaagaactcaaacagaaggtatttgaattatacctcaataaagctatttaaaaaagctctcaaaaagg

SEQ ID NO: 32808 - DNA, 201 bp, Homo sapiens
acaacatatctgtatgctcctttgtgctctacaggtcctatatcagtctggatactccaagaaaatgtcatgaggggattagacgtctaacagatttactrgggtaaatgcctgtgagggaaaagagggagggaggcagaagagactacagagctgtcagactacaatgcaggactgacctctgcaaaggacagaaggagg

SEQ ID NO: 32809 - DNA, 201 bp, Homo sapiens
gaggcaggacaatcgcttgaacccaggaggtggaggttgcagtgagccaagatcgcaccactgcaccccagcctgggtgacagagtgggactctgtctcaraaaaaaaaaaaaaaaaagaaggccctcaccagatgcacctcctcaaccttggacttcctgacttccatagcagtacaaaaatacatttctttcctttaca

SEQ ID NO: 32810 - DNA, 201 bp, Homo sapiens
ctcttgaatgattcatttcaggggaaatggcacaatcacacacctatgctggtagagtcagtggcccacaagaagaggtaagagtagagaaggcacttacrgctttatcaagatgtgagcacatacaatctataatttaattaaatgttaaaattgcccagagactttatgaaaactttgaatcaacaatgcggtatgtgc

SEQ ID NO: 32811 - DNA, 201 bp, Homo sapiens
cgtgttagccaggatggtctcaatctcctgacctcatgatccaccagcctcggccttccaaagtgctgggattacaagcatgagccaccgcgcccggctgkgttcattcatttttgtgtgttaatcagagctgagtggtgggaatgaacagtcactgatggttctaacaggaagtacatatatgggcactattacctggaa

SEQ ID NO: 32812 - DNA, 201 bp, Homo sapiens
atgaatttactcttgaatgattcatttcaggggaaatggcacaatcacacacctatgctggtagagtcagtggcccacaagaagaggtaagagtagagaargcacttacagctttatcaagatgtgagcacatacaatctataatttaattaaatgttaaaattgcccagagactttatgaaaactttgaatcaacaatgc

SEQ ID NO: 32813 - DNA, 201 bp, Homo sapiens
gatcatgtcttggcctaatcataaccctccaagctgcccttttaccctgggaacaaaagcacaaaatcctgactgtggtcctcaaagccctacatgacctrgcctctaaccgcctctcaaatctcatctgtgaatccctccgtgctctcatagctccagcctccttggataagctaagcacattccaccctcaaggccttt

SEQ ID NO: 32814 - DNA, 201 bp, Homo sapiens
aaaactgttatcatcttttcatagtgatgttgacaaatctgcttaaatgaatgaatttactcttgaatgattcatttcaggggaaatggcacaatcacacrcctatgctggtagagtcagtggcccacaagaagaggtaagagtagagaaggcacttacagctttatcaagatgtgagcacatacaatctataatttaatt

SEQ ID NO: 32815 - DNA, 201 bp, Homo sapiens
tggtactaatgctgccacttatttttttacccagaattatttaaaatagtattattaagagtgctgtgtatattctgttatatgtaagtgctgtagagtayctggccatttctagctgatagctgtttaggttatttcgagtttgctgtcacacacaatgcttcattgaatatcattttacgtaaatcttcccttgtgcgt

SEQ ID NO: 32816 - DNA, 201 bp, Homo sapiens
tggccggatgaacctctcccgagtgtagatacaaatacacacattgcctgcacgtgcacacactcagcctttctaaagtttccaagctctttttttttttwaaaaaaaacacctgaatagttcaagttgtagacatgaaataaatactcttggaaatgtcatttcaaagcaatctccatgccgctttcccagctcagatga

SEQ ID NO: 32817 - DNA, 201 bp, Homo sapiens
cagggtttcaccatgttggccaggatggtctcgatctcttgacctcgtgatccacctgccttggcctcccaaagtgctgggattacaggcataaaccaccrtgcctggtcttatacttttttttttttataagtagagatggagtttcaccatgttggccaggctggtctcaaacttctgacctcaagtgatccacctgcc

SEQ ID NO: 32818 - DNA, 201 bp, Homo sapiens
ttcctgccttcctgctttcctgccttcctgccttcttttgtttgtggcttctcatctctctttttgtcctcttccatatttaccatggtttcctcctgtcygctctcctaattggaagtgctgagaggatgtgctctcacaagatctgacaggagagctagtgccatttggctgcctccagcattcataaggaaaggatgg

SEQ ID NO: 32819 - DNA, 201 bp, Homo sapiens
tgtggccggatgaacctctcccgagtgtagatacaaatacacacattgcctgcacgtgcacacactcagcctttctaaagtttccaagctctttttttttwttaaaaaaaacacctgaatagttcaagttgtagacatgaaataaatactcttggaaatgtcatttcaaagcaatctccatgccgctttcccagctcagat

SEQ ID NO: 32820 - DNA, 201 bp, Homo sapiens
tgttaggtccttgccctccaaagtggctctaccaagttacactcccatcagcagctcgttagggtatgccccgggattctcctaccccagctgactaacaktaggttgctgcaattcatcataattttcttaatttgttgggctaaaaatatagagtttatcttgtttcaattcttgttttcttgatttctagtaaggtta

SEQ ID NO: 32821 - DNA, 201 bp, Homo sapiens
cagcctgtaggatgtgtggcctcagtgcaaagctgtggtagattcaaagcactgcggctggggcccttagtcaattaaaccaccacagtaggtctgaaagrtgcattttcatggctgccacgctattaacgagcattctaagcagcacctctcctttcctccttaaccctatggtgatagttcagaaatgcaggttatata

SEQ ID NO: 32822 - DNA, 201 bp, Homo sapiens
tgaaggcaaatgttctctggcacagaggaccacagatgagcctgcagagaaatactctactagtttgcaggctctatttgggtttggattgtatttccaaygcttagcataatacttggagcacacagacagtgaataaatgttagttaaaaatttaacttctccacaataaattttgtgagctcctggaactcactgtta

SEQ ID NO: 32823 - DNA, 201 bp, Homo sapiens
tagatgctgggtcatggtgtacatacattttttaatttgttaggtccttgccctccaaagtggctctaccaagttacactcccatcagcagctcgttaggrtatgccccgggattctcctaccccagctgactaacattaggttgctgcaattcatcataattttcttaatttgttgggctaaaaatatagagtttatctt

SEQ ID NO: 32824 - DNA, 201 bp, Homo sapiens
ttattatttttatttttatttttgagacagagtctccctctgttgcccaggctggagtgcagtggtgcaatctcagctcactgcaacctccacctcctgarttcaaacgattgtcctgcctcagcctcccaaggagctgggactacaggtgcgtgccaccaagcccagctaatttttgtatttttagtagagacagggttt

SEQ ID NO: 32825 - DNA, 201 bp, Homo sapiens
gtgagccaccgcgcccggctaggtacttgctaagtgtgaacaggtttcgccaattatcttccatcatcaccctctccccaactggctgccgtttccacctrtgatagatcagtgttacacatgtgcattttccagaactcccagctgtgaggctgcaaacctggctccagggcctgagcaagggttccagggagggtctct

SEQ ID NO: 32826 - DNA, 201 bp, Homo sapiens
ctcggtttacatttcaatattagttacactgggctctgagctacttgcaggcatttgtaaccccaaggttctgaaacctgtaaggtgaagacgtaaatgtytgccagatgaccatttgaaaaaattattttaacaattttctaattcttttggcacttgtttggaaatgtatggagtggaaagaagtagggtgttcacatt

SEQ ID NO: 32827 - DNA, 201 bp, Homo sapiens
atgggatcacaggcgtgagccatgcacccaaattatttttatgtatgtggcagatatcttttagtttgctgattaacgctaatgatgtctttggtcattawaaatgtttaaaagtttgttgcaatcaaatttattgatcttttacttgatgcctttttcattttgtttaaggccttcctgcatgatagagcttactgcagc

SEQ ID NO: 32828 - DNA, 201 bp, Homo sapiens
aagtttagataggtaattctttgcccttctgaagtaggatgtacagtcagagttggtgctttcccagtaaccaccattttaaaggttgggtcatacagttrggtcaagaggttttttttcttttttttttttttctttgtcatcctcttactctaaataatagtccggtcaatttgaggccaaataaatgggcacacagag

SEQ ID NO: 32829 - DNA, 201 bp, Homo sapiens
cattacgtcctggggttgtttgtgattagccatctctcgagcagttgttcattgttcttccccacctggggccgtcccccacctggggcccctttctcctygttactgtggagtcgggactccacagaatattatgtctgtgagacaacaaaagtaaaagatcagcagagtcctggatgagtaccctaaacacatcactgc

SEQ ID NO: 32830 - DNA, 201 bp, Homo sapiens
gttcacagcagcctgtaactcctgggctcaagtgatcctcccacctcagcctcccaagtagctgggactacaggaacctgtcaccatgtctggctaatttwaaaaaaaaatttttgtagagacagagtcttgctatgttgcccaggctggccttgaacttctggcctcaagtgatcctcccgccttggcctccttaagcgc

SEQ ID NO: 32831 - DNA, 201 bp, Homo sapiens
aattttaaaatgtacaataaattattgttgactgtagtcaccctgttgtactatatcaaatagcaggccgtattcattctcttaatcactacatttttgcrcccattaatcatcctcgctttccatgcccctacctcttcctttccagcctctggtaaccatcattctactctctgtgtctgtgagttccattgttttaat

SEQ ID NO: 32832 - DNA, 201 bp, Homo sapiens
ttacaggtgcacactactatgcccagctaatttttgcatttttagtagagatggggtttcaccatattggccaggctggtctcaaactcctgacctcagawgatctgcccacctcaacttcccaaagtgctaggattacaggcatgagccactgcacctggcctgtaccacattttctttatccaatcatctgttgatgga

SEQ ID NO: 32833 - DNA, 201 bp, Homo sapiens
aaatacaaaaattagctgggcatggtggtacacgcctgtaatccaagctgctcggggggctgaggcaggagaatcacttgaacccgggaggcagagattgyagtgaaccgagatagtgccactgcactccagcctgggtgacagagtgagaccctgtctaaaaaaaaaacaaaaaaaaaaaaaaagaaagaaaagaaaatg

SEQ ID NO: 32834 - DNA, 201 bp, Homo sapiens
gtttgttgttagcggggcccagcagtgctctgggagcacatcctgaacccaggcggtgacaaggggcttgtccccacaggtggcccggcagtctctgaccrtgttcgttctcatcatgaatggctgccacatcgagattgatgcccaccggctgaatgatggggggctcctgctctcctacaatgggaacagctacaccac

SEQ ID NO: 32835 - DNA, 201 bp, Homo sapiens
tggggtttcaccgtgttagccaggatagtcttgatctcctgacctcgtgatctacccacctcagcctcccaaagtgctgggattacaagcttgagccaccrcgcccagctgctagtatttcttattgcctgtcttttggataaaagccattttaactggagtgagacaatgtctcattgtggttttgatttgcatttctct

SEQ ID NO: 32836 - DNA, 201 bp, Homo sapiens
gctagtatttcttattgcctgtcttttggataaaagccattttaactggagtgagacaatgtctcattgtggttttgatttgcatttctctgatgatcagwgatgttgggtgccttttcctatgcctgtttgccattcgtatgtcttcttttgggaaatgtctattcagatcttttgtctgtttttaattggattcatgag

SEQ ID NO: 32837 - DNA, 201 bp, Homo sapiens
cagcctcctggcaaggacccgagcctggattgacccctagctacccgactcctatgcagccacttgaacccgccaccctgtgcagtctggggttgtccccrccccctccccgctccccagcaaagagaccacactccctaatgtcgggtctcccagcacagtggctggggtgggacagagagcctagaggtactctgaagg

SEQ ID NO: 32838 - DNA, 201 bp, Homo sapiens
tcccacatcaacctcctgagtagctgagactacaagtgtgcaacaccatgcccagctaactttttaaaattttttgtacagataaggtctcactatgttgwctaggctggtctcaaactcttgggttcaagcagccctcccacctcagcctcccaaagagctggtgttacaggcatgagtcaccatgctcatccttgagct

SEQ ID NO: 32839 - DNA, 201 bp, Homo sapiens
gcaccactgtgcccggccgtgggctcaatcttttgagcaatggtttgagtgaaccttcgtaacatatggcctctgaatacttcattctaaaggcctcctasaacaagagcattccggtccaatgccctagtgcaattatgacacttgagaaatagagcattgataccacatctatatctaatatataccattcacattaaa

SEQ ID NO: 32840 - DNA, 201 bp, Homo sapiens
tcccacctttccacccactgtcttcctgccaccattttgaggggtctttactggtttgagcttaaaccaaggtttttctgagctggtacatttataaaggygaaaactatctctctctttctctttctttcttctttttttatttttttggacagagtctcactctgtcacccaggctggagtgcagtggcatgatcttgg

SEQ ID NO: 32841 - DNA, 201 bp, Homo sapiens
ccattcttcatgtccagtttccccttcgggtgccctttacaaaaacttcctttaactctgcagccaacatggttgcttctcaccttccctagctctaaaartctagtgcttttacttgatgcatgtattttcttgttgtgtgatgttgtttcataaatatttttccttttcccaactgtactatttgctccactgtgaaaa

SEQ ID NO: 32842 - DNA, 201 bp, Homo sapiens
aggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggtttatttatagtgaatatgcagttttgtattctac

SEQ ID NO: 32843 - DNA, 201 bp, Homo sapiens
cacattgcagaaaattagaaaaggaaccccccaaaaaagtaattttgcagcttctatcattctggtatagttccctctcatcttctgtctttatgtggttwatttatagtgaatatgcagttttgtattctacttttttcactgtattaaaacattttccttgttgaaaagtctctatacttaatgtctgctcaaatctca

SEQ ID NO: 32844 - DNA, 201 bp, Homo sapiens
gaagctcatggaacagctaggtaagggggtcccaaaggcttcacctctcagaggtcaagagaggcccagctggcccactgctgggggtttctaggatgttmaaaataaaatgaaaaaataccaaaatacagctataataactgtgagatttttaaagatattcacatttgtctgtttgttttgttttgtttttttgaggtc

SEQ ID NO: 32845 - DNA, 201 bp, Homo sapiens
ttcaggtcattccagatcttctgccaagaaccccaagtcacaaatgtcagtttgtattcccaagtgccccttttccccatctgcatgccatctgttaccaytctctgcaaccaatctctttttctttcttttaagatgtttttcctcctatctgaccatatatagcagtagcaaccctttcctgcgtttctgtaacttccc

SEQ ID NO: 32846 - DNA, 201 bp, Homo sapiens
ctcagcctcccaaaatgctggggttacaggcatgagctaccatgattggaggacattcacatttctaaatcaacctttttaacattttatatatatatatatatatatatatatatatatatatatatatatatatattgccatcgtgaatttatttctcagcatacacaaaagatagcaattgaagtatttggggctgat

SEQ ID NO: 32847 - DNA, 201 bp, Homo sapiens; identical to SEQ ID NO: 6172

SEQ ID NO: 32848 - DNA, 201 bp, Homo sapiens
caggccacaagggctaacaacccctttgggcatcagaaggtggccttgggtgctctccccagaaaacttcacagacactggcactctgaattccatcttargagagccatggacaggagccctgttgtatgccactgttggtgggaggctgcaatgcttgcatgctttccaagctgggcagctcacccttcagccttgtag

SEQ ID NO: 32849 - DNA, 201 bp, Homo sapiens
cttctctggaagaaggggttgggggttggcccaggcacttcacgtgcgagttccattcctttccaccaccttgatccacccctgttgtgcagatgaggaagctgaggcacagagaggtgaaggcatttgtccatggttatgcagagacggaatcaagtctgcttggctccagaacccagccctttccttttatgacctagg

SEQ ID NO: 32850 - DNA, 201 bp, Homo sapiens
ttattattattactatttcctgagtcttggatgccaaaatagtcgtgaagattaaatgaactaatatttctcaggtacttggcaagagaataaagcatccrtatttggtagataataaatagaaaggggggcaagtctcccacctttccacccactgtcttcctgccaccattttgaggggtctttactggtttgagctta

SEQ ID NO: 32851 - DNA, 201 bp, Homo sapiens
aacgtggccctcgtcacagaaagttctagtggttcatgctgctccaggccctataccatcccagccctcctctgatggttcttgcctcaaaaagggcaccrataggtctgctacctttcgaggctcttaccatttgggggctttttctttgccttccaataaaataatccgccagattaaaaagagcattctcctccacgt

SEQ ID NO: 32852 - DNA, 201 bp, Homo sapiens
cgtgtatccccagtagagccgatcagaattctttagggatggctgacagtgctgatgtggagagaacctaccaatgcagggggaagccaagcccagagatagagggggagatccagtcctgttggtggtacttggatgcctggatcaagccatgcctgaagtcagtagcccagtcccaggaacctatccatggtttttgtt

SEQ ID NO: 32853 - DNA, 201 bp, Homo sapiens
ctgtgagtccttgttaactgggtgacatcactgagcctcagtttccctcctttgtaaaagggggttaagaacaggaccaacctcagagggccgaggtaagrgtctgatgagctaattgctgacatgcagtgtgattgtcagtgctgttattattgcattcttgttttcatgtagggtgcctggggacctggagagatgtgt

SEQ ID NO: 32854 - DNA, 201 bp, Homo sapiens
gtgtatccccagtagagccgatcagaattctttagggatggctgacagtgctgatgtggagagaacctaccaatgcagggggaagccaagcccagagatagagggggagatccagtcctgttggtggtacttggatgcctggatcaagccatgcctgaagtcagtagcccagtcccaggaacctatccatggtttttgttt

SEQ ID NO: 32855 - DNA, 201 bp, Homo sapiens
actaccactcatggggtgctttcagtatgccaggccaagtgctttgtaggtgtggtctcatgccatcttcaaaataccactgtgggggcactaagtggagrgtgttgtacccatttcacaaaccactttaatggaaaaaaagaaaaacctcacacaaatttggaattgtcccagcaagtccaggacgtggggtccccctat

SEQ ID NO: 32856 - DNA, 201 bp, Homo sapiens
aagggggcagggggagaataaggggtaaataaaaatgttggaaatgaggccaggcgtggtggctcacgcctgtaatcccagcattttgggaggctaagggsggcagatcacttgaggccaggagttcaagaccagcctggccaacacagtgaaaccccgtctctactaaaaatacaaaaattagctgggcatggtggtaca

SEQ ID NO: 32857 - DNA, 201 bp, Homo sapiens
acccttcccctcaccagctcccaagcgtagcaggggtgcttgtttaaaaagctcagattgactctggccctgcctcagtctctctctctctctctctctcttttttttttttttttttttgagatggagtttcactctgtcacccaggctggagcacagtggcatgatctcagctcactgcaacctccacctactgggttc

SEQ ID NO: 32858 - DNA, 201 bp, Homo sapiens
ctaccactcatggggtgctttcagtatgccaggccaagtgctttgtaggtgtggtctcatgccatcttcaaaataccactgtgggggcactaagtggagastgttgtacccatttcacaaaccactttaatggaaaaaaagaaaaacctcacacaaatttggaattgtcccagcaagtccaggacgtggggtccccctatt

SEQ ID NO: 32859 - DNA, 201 bp, Homo sapiens; identical to SEQ ID NO: 6174

SEQ ID NO: 32860 - DNA, 201 bp, Homo sapiens; identical to SEQ ID NO: 6176

SEQ ID NO: 32861 - DNA, 201 bp, Homo sapiens
ctccccaattgattattttatttattatcttgttattttgccttcctctgctccaaaagtcagttggccttttttctcagggtcattcttttcccctaacrttttactatgaaaatttccaaatgccaaaaagtcaaaatatttcatagcactcaccccaacccaccatcttgatgccaccattgacatctgactgtgctt

SEQ ID NO: 32862 - DNA, 201 bp, Homo sapiens
tacctggacatcagcctctacaaagaagtgactgactccagatctggaaatgtaaggctggcccgcgccgtgggggtctaagtcaaagcagaagcaggctkcttgggccatcaatttgtagattaagatggcatttggaggcggtcttgccttgctctcccatgtcattctgggttggggtagccccctctgagtgttatg

SEQ ID NO: 32863 - DNA, 201 bp, Homo sapiens
aataaaaatacaaaaattagcagagcgtggtagcacacatctgtagtcccagctactcgggaggctgaggcaggagaatcacttgaacctgagaggtggargtagcagtgagctgagatcacaccgctgcactccagcctgggcgacagagcaagactccctttcgaaacaaacaaacgaaacaaaacaaaaaacaatcta

SEQ ID NO: 32864 - DNA, 201 bp, Homo sapiens
taggattgtgggcgattcaaaggctatgatatggtgaacgaaggagtgatgtgctgcatgaacttgggtgagtcccttcccctctctgagtctccaatttmtcatctttagaatgaggaggctgaggctgggcctgatggctcatacctgtaattccagcactttgggtggccgaggtgggtggattgcttgagctcagga

SEQ ID NO: 32865 - DNA, 201 bp, Homo sapiens
gggcgattcaaaggctatgatatggtgaacgaaggagtgatgtgctgcatgaacttgggtgagtcccttcccctctctgagtctccaatttctcatctttrgaatgaggaggctgaggctgggcctgatggctcatacctgtaattccagcactttgggtggccgaggtgggtggattgcttgagctcaggagttcaagac

SEQ ID NO: 32866 - DNA, 201 bp, Homo sapiens
cgggaggctgagggaggaaaattgcttgaacctgggaggtggaggttgcagagagccgagattatgccactgctctccagcctgggcgacagagtgagackcagtctcagaaaaataaaataaaataaaataaagaaataattatatcaaaagacacctgtacttgtatagttatcacagcactattcacagtagcaaaga

SEQ ID NO: 32867 - DNA, 201 bp, Homo sapiens
agtgtcctgggggcccccagccacctggccctccagcctgggcttctgcccttctgtccacagctctgaagggaacgtggcagagcggattctttgaccayggcagtttcaaggaaatcatggcaccctgggcgcagaccgtggtgacaggacgagcaaggtaatcatgaagacgggagcaggctgcccatgtctgactca

SEQ ID NO: 32868 - DNA, 201 bp, Homo sapiens
tcctgctacacattttggcagaatactacacaggtgttgtgtccttaatacatctcatcatgaagcctgttaaatctgatcatttggttaagctggttccrtaattgtctactttttacccattcttcatgtccagtttccccttcgggtgccctttacaaaaacttcctttaactctgcagccaacatggttgcttctca

SEQ ID NO: 32869 - DNA, 201 bp, Homo sapiens
cctcccctcgcccgaggccacgtcattgccgccagaatcaccagcgaaaacccagacgaggcaagttatgggggcccctgtgtttccaccatctcagatcycccagcatgtgggggaccctggatgttagcctgggaagagacacccacaagctatccaggcatctcagtttacaaatggggaaactgaggcatgggaagg

SEQ ID NO: 32870 - DNA, 201 bp, Homo sapiens
ccaattccttcctttaagaaatgaaacggtcccctggggcttcagatacagtagcatttcaggagaccaagaaaagtaaatcacagggtaggccccatttwaaataccctgtgcttgaagttcaagatcaaagcctgccctttttttcctttattgaagatccacaaagtaaaataagtgcaccaaggtcatttggtcttg

SEQ ID NO: 32871 - DNA, 201 bp, Homo sapiens
gagctctaaatctggtccagctcactgaagcttcaggagtaggagcagctcgtagagttgggtctgcaagcagctgcctcatccccgacttgccatcaccytacaggatgaccgtgcccatcagcatcaccaaccctgacctgctgaggcacagcacagagctcttcatggacagcggcttctccccactgtgccagcgca

SEQ ID NO: 32872 - DNA, 201 bp, Homo sapiens
catctgcaggtgcaccccacacacaccaggcagagcagctgtgtggaaggtgagagggtggcaccagctctggggacaggagatttgaataggtcaagggrgagacagaggcggtgaccgattttccctttgttttttttttcttcttttaagagatagcgtctcactgtgttgcccaggctggagtgcaatggtgtgatc

SEQ ID NO: 32873 - DNA, 201 bp, Homo sapiens
tatccaaagctttatttttctagctaagacacatccttttcttaatgtcttcattttttttttcagtttagtttccagtactgtcagttgctttcttttcsgggaccaatttccaccaagaaaccaggggttagtggcttcatgagaattgccacaggctgtgacagatggagaacagcctggtcacgctggcaggtgata

SEQ ID NO: 32874 - DNA, 201 bp, Homo sapiens
gtggtggttcacgcctgtaatcccagcactttgggaggctgaggcgggcggatcacgaggtcaggagatcaagaccatcctggctaacatggtgaaacccygtctctactaaaaatacaaaaaattagccgggcatggtggcaggcgcctgtagtcccagctatgcaggaggctgaggcaggaggatggcgtgaaggcagg

SEQ ID NO: 32875 - DNA, 201 bp, Homo sapiens
agagccctaagaggtgaaactgtcattattcctcattttacacttggggaaactgaggctcaaggaggggagccacttctgaagatcacagaggtattggkgggggcagttcctgggattctagtccaggcctggctgacttgggtgcccaagctgtgaactgccaagcaagagagatagcacagtcctggctctgcggcc

SEQ ID NO: 32876 - DNA, 201 bp, Homo sapiens
ggatatccggcttctgtatggagagtcaccatggggagtgactcccatttcttttgaaaccccctcaaaccctcccctcgcccgaggccacgtcattgccrccagaatcaccagcgaaaacccagacgaggcaagttatgggggcccctgtgtttccaccatctcagatctcccagcatgtgggggaccctggatgttagc

SEQ ID NO: 32877 - DNA, 201 bp, Homo sapiens
ctgctttctgtctatcaattcaactcctctaggtgcctcatataggtggaatctatatagtatctggccttttgtgactagcttatttcatttagcgtaaygtctccaagtttcatccatctgatagcatgtggcagaatttccctgttttttaaggctgcataatattcccttgtaggggtgaatcacattttgtttatc

SEQ ID NO: 32878 - DNA, 201 bp, Homo sapiens
taaaacaggaaattgacattggcacaggactgttcgcaccaacactgaccacgttcggatttcaccagcgtttccatgcatgcctgttgttgggagtgtgwgatgccttgatcactgtatttttggaactgcattccacagcccctgttgtcccttcttgttctggccctccacagtggtgaagaagggagttttacgtag

SEQ ID NO: 32879 - DNA, 201 bp, Homo sapiens
aggtgtacatgtttatgggggtacatgtgatcttttggtataggcataccgtctaataatcaaatcagggtgattggggtatctattacctcaagcatttwtcatttctttgcgctaggaacattccagttctactcttttggttagtttaaaatgtacagtcgattttaattgactgtagagtcaccctgttgtgctatc

SEQ ID NO: 32880 - DNA, 201 bp, Homo sapiens
gtgtgatgccttgatcactgtatttttggaactgcattccacagcccctgttgtcccttcttgttctggccctccacagtggtgaagaagggagttttacrtagcccaggcactcactttgtcatgccatgtgacatgctttgcttcccccacctgcattttcattgaggactgggcagaaataaattgggggagatgtgt

SEQ ID NO: 32881 - DNA, 201 bp, Homo sapiens
gatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatatata

SEQ ID NO: 32882 - DNA, 201 bp, Homo sapiens
atcaaccagcaagtagaagaagagagagaataggagaggggaaaaatgcataaaccagtaggccagtgtaggaatttcaacatccagataataggacttcrggaaaaaatagagaaaaaaagaggcaaggacatcatcaaggaggtatttgtttcttgttgttgttgttgttgtttgagatggagtctcactctattgccc

SEQ ID NO: 32883 - DNA, 201 bp, Homo sapiens
aacaatggtgatgtaggggcctagaggacagccagtacctacggaaggagaacagaggccttcaggagagatgtcaccagtggaaaaaaacagaactgatmaattatttattattattatttttaatgagatggggtcttgctacattgcccaggctggtctcgaactcctggtctcaagcagtcctcctgccttggcctc

SEQ ID NO: 32884 - DNA, 201 bp, Homo sapiens
caacccagtgctttcagaggctgagggaggaggatcacttgaagccaggagttcaagaccagcctgggcaacatagcaagaccccatctccagaaaaagtaaaaaaaaaaaaaattaactggttatggtggtgcatacctgtagtcccaactactgaggaggctgaggcaggagggtggcttgagcctaggaggtcgaggt

SEQ ID NO: 32885 - DNA, 201 bp, Homo sapiens
cttaaggcacctgccactatgcccagctaatttttgtatttttagtagagatggggtttcaccatgttggccaggctgatctcgaactcctgacctcaggwgatccgcccacctcagcctcccaaagtgctgggattacaggtgtgagccaccatgtccagcctcaatactagatcttattcattctatctaactggattt

SEQ ID NO: 32886 - DNA, 201 bp, Homo sapiens
ctcagcctctggagtagctcggattacaggcacgcgccaccatgactggctaatttttgtgtgtatttttagtagagatggggtttcaccatgttggccargctggtctcgaactcttgacctcagttcatcctcccacctcggactcccaaagtgctgggattatggtcatgagccaccgtgcccggccaagtcatctct

SEQ ID NO: 32887 - DNA, 201 bp, Homo sapiens
caccgccaccccacaaaactgtctggggtgtgaaactgtgtactgggccatttgcaaaaggaatggtttggaaaacccacattggggtgtgagtttggccrttttaactttccagttcattgtctttgattttttcctcagacctcatcctcacttgattacggaagccggcagatctgtcctgcctcccattctgcccgg

SEQ ID NO: 32888 - DNA, 201 bp, Homo sapiens
gagtttggccattttaactttccagttcattgtctttgattttttcctcagacctcatcctcacttgattacggaagccggcagatctgtcctgcctcccrttctgcccggtcccatttggaattcccagagttttcctgacctgtcgttcttgtggtgtctcatcaggctgaaccgttcacaggagaactccctgcccag

SEQ ID NO: 32889 - DNA, 201 bp, Homo sapiens
ttttcagacaaggtctcactctgtcacccagactcactgcagcctcgacctcctgggctcaagagatcctaccacctcagcctcccacgtagctgggactwtaggtgcaccccaccacgcccggctaattttttgtatttttgtagagatggcattttgccatgttccccacgctggtcttgaactcttgggctcaagtga

SEQ ID NO: 32890 - DNA, 201 bp, Homo sapiens
acccttgctgggtctcatctgctcactcagtagagaaacaagaagttctctgatttgcagacctccttgaaagacccatgatgctcatagcagtgactaascatcacactgtgtgctgtaccgggtccgtctcaggagagcaaatcatgatggtgatgacgataataaccgccaacccttagcaagtatgtaccatgtgtc

SEQ ID NO: 32891 - DNA, 201 bp, Homo sapiens
tttctttttagagtgacgaaaatgctttaaaattagatggtggtgatagttgcacaactttatgaatacactaccaaccactgaatgtacactttaaaggkagatggtggaatatgatggtgtgtaagttatatctgaactaaaaaataacaaaagccaaactctagaggatcctaactgaaaaagtacacacttggaact

SEQ ID NO: 32892 - DNA, 201 bp, Homo sapiens
ttgtaaactcctgagctcaagagatctgcccaccttggcctctgaaagtgctggggttacaggcatgagccaccgtgcctggccttgatgctgcacttttytaagcaataattcaagtattttttaactggggtagagggatgcccaccctatcaattttatgcacctgctgtttcttatatctcacaatttcaaatgcac

SEQ ID NO: 32893 - DNA, 201 bp, Homo sapiens
catgcctggccttaatttttttgttttgttttgtagatatggggtcttggctatattgcccaggcttgaactcctgggctccagtgatcctcccacctcartgtcctttctaaaatcctttctctctctctcttttttttttttttttttttgagacggagtcttgctctgtcgcccaggctggagtgcagtggtgcgatc

SEQ ID NO: 32894 - DNA, 201 bp, Homo sapiens
tgcctggccttgatgctgcacttttctaagcaataattcaagtattttttaactggggtagagggatgcccaccctatcaattttatgcacctgctgtttyttatatctcacaatttcaaatgcacacatttaaaatttgcctaagattggtcgcatttgtatgagttgttctcttcagccctttctttcaaaactgtcat

SEQ ID NO: 32895 - DNA, 201 bp, Homo sapiens
cctatcaattttatgcacctgctgtttcttatatctcacaatttcaaatgcacacatttaaaatttgcctaagattggtcgcatttgtatgagttgttctyttcagccctttctttcaaaactgtcatggagatacttggctcattctcttggtgttcctgaatgcagtttcagaaatgaaaactttaaaaatcaaaattc

SEQ ID NO: 32896 - DNA, 201 bp, Homo sapiens
tttcagaaatgaaaactttaaaaatcaaaattccagcttggttcaagacattggttggtgctcaatgtgtgtgcatatatatatatatctatatatatatwtttttttcattttttcagcacacaggtttttttttttcatttgttttgttttgtttttttgagacaggatctcacttggttgcccaggctggagtgcatt

SEQ ID NO: 32897 - DNA, 201 bp, Homo sapiens
tttcacttctttggttaaatttattcctaggtaggaaacaagtgtgataggcaataatagaaaaaggaaacattgaaattaaacatatttatttctaggtkttttattcttttgaatgctattataaatggaattgttttcttaatttctttttcagattatttaccactggtgtatagaaacacaactatttttgtgtat

SEQ ID NO: 32898 - DNA, 201 bp, Homo sapiens
cccaccttgatcaagccgtttgctgatgccaaagcttcaagggtggctatgcacaaaaggagaagacacgagccttctcagaagtttccttccttccttcyttccttctttccttccttccttccatccttccttccttctttccttccttccttccttccttccttccttccttccttccttccttccttccttccttcc

SEQ ID NO: 32899 - DNA, 201 bp, Homo sapiens
ggcttagcatttttagtgcagtcaggtttgctgatgcagagagttgcgtaatttttttaaatgcaagggatggctgtggagttctcagtccctcccaaggstgaccacaaccctgtcttttctttcaggggccaggtcctcccagcggattcactactgaacctcgtagatgtggaattaatttacggaggtgttaagtac

SEQ ID NO: 32900 - DNA, 201 bp, Homo sapiens
tggccgatgcgatgttcagaacgtgcatgacagatttcttacactccctggaaaggtaggggctgtggcagttcccttctgcttttgtgatatgtgttagyggcttaggaggctgaatctgtctcctttatttgtgtggccagttagtcaccaggcaattggtgagtctctcctccggtcttgcctctgggaaattcctct

SEQ ID NO: 32901 - DNA, 201 bp, Homo sapiens
tgaagtggtatctcactgtgattatatgatttgcattttcctgacacctaagcatgttgaatatcttttcatctatttattgaccatttgtatatcttcawtggagcaatgtctatccaagtcttttgtccacttaaaaattgggttgtctttttgttgttgagttttaggagttctttatacattctgggcactagactc

SEQ ID NO: 32902 - DNA, 201 bp, Homo sapiens
gagttaaacagcctgcagcaccggcagctcccggacggcacctgcgtggtagaattccagttcatgctgccgtcctcccacccaaaccggtatggagtggracacacccagggacggcctgtgtttctgttcttcctgacctctgtcgtcctgtctctggaaggacctggcaagtgtgtttgggcacgctgctggggagac

SEQ ID NO: 32903 - DNA, 201 bp, Homo sapiens
tgggttgtggttgtgcagagacatctgatccccgcagctctgtgttccagataattcagcaggcaggacaggtgtggttcccagactcagcctacaaaacygcccaggccatcaaggacttcaaccgggagaagttgcccctgatgatctttgccaactggagggggttctccggtggcatgaaaggtaagcccctccctg

SEQ ID NO: 32904 - DNA, 201 bp, Homo sapiens
tgattatatgatttgcattttcctgacacctaagcatgttgaatatcttttcatctatttattgaccatttgtatatcttcattggagcaatgtctatccragtcttttgtccacttaaaaattgggttgtctttttgttgttgagttttaggagttctttatacattctgggcactagactcttattagatatatggttt

SEQ ID NO: 32905 - DNA, 201 bp, Homo sapiens
gtgttggattttgtcaaatgcttttcctgcatcaattgggatgatcatgtggtttttttccctttgttccattaatgtggcatgttacattgacattgagycacccttgactgacttttctttaaaaaaaacacatgatgatcttgaaaggaaaaaacccctctgaccctgtgtactacctagaaaatagccttggcaaca

SEQ ID NO: 32906 - DNA, 201 bp, Homo sapiens
gcgagaccttgtctcaaaaaaggaaaaaaggaaagaaatcattccttgtgcatctactgcatgcacagggctcgatgccatgaaactgactttctagaagrcctcagcctagttggggaagatgaccttgtgtttagttataatttaagctgaatgagccaaggctggcaagagccacaagtgatgatggtagtctagagg

SEQ ID NO: 32907 - DNA, 201 bp, Homo sapiens
ccagctagtttttgtatttttagtagagacagggtttcaccattttggccaggctggtctcgatctcttgacctcgtgatctgcctgcctcggcctcccaragtgctgggattacaggcatgagccaccatgcccagccaatcctttctctttttaaaaatcataaaaaaaaatactaaatattcaggtactcaaggaagg

SEQ ID NO: 32908 - DNA, 201 bp, Homo sapiens
acagaatgagatcctgtctcaaaaaacaacaaaaaaaatcccaactttgtatacaaaaacaggcaatgagtcgggtttgttggcactgggaagatcatgamtaatgcaaagcacctagtttgtgccaggtactcctgaagtgctttccaaataaatagttgctcatttaattcacgcagcagtcctagaaagtgggtactg

SEQ ID NO: 32909 - DNA, 201 bp, Homo sapiens
ttgtttctctttccactcgatgatagcagtcttttgttttttgtctgttttttcttttgagacagggtctcgctctgttgcccaggctggagtgcagtggygccatcatggctcactgtagcctctatcccctgggcttaagccatcctcccacctcagcctcccaagtagctgggattacagactcacaccaccacgccc

SEQ ID NO: 32910 - DNA, 201 bp, Homo sapiens
gatcaagccgtttgctgatgccaaagcttcaagggtggctatgcacaaaaggagaagacacgagccttctcagaagtttccttccttccttctttccttcyttccttccttccttccatccttccttccttctttccttccttccttccttccttccttccttccttccttccttccttccttccttccttccttccttcc

SEQ ID NO: 32911 - DNA, 201 bp, Homo sapiens
gagagagtgtgtatgtgtatgcgcacgtacgttcttattagagaaaaatcaaatatgataatgtggcaaaagttttaacaattagtgaatctaggtgattmctatgggtttttaacatactgatcttcaattcttctgtagttttgaagtttgtaaaaattaattgggagagaggactctccaagtgattgcaacacgcag

SEQ ID NO: 32912 - DNA, 201 bp, Homo sapiens
gctgatgccaaagcttcaagggtggctatgcacaaaaggagaagacacgagccttctcagaagtttccttccttccttctttccttctttccttccttccwtccatccttccttccttctttccttccttccttccttccttccttccttccttccttccttccttccttccttccttccttccttccttccttccttccc

SEQ ID NO: 32913 - DNA, 201 bp, Homo sapiens
atgccccacagctctaccatctggtgacctcttgaagaccagtcttagtggatgcccggggtggggaatgggggcatattgctcaggagctctgatatttrgcattcattgctccatcttcagtgggtggttagggagcacctgcgctgagctgttcccaagccccatatgcacttagggcataagaggagatgcgaacac

SEQ ID NO: 32914 - DNA, 201 bp, Homo sapiens
caaagcttcaagggtggctatgcacaaaaggagaagacacgagccttctcagaagtttccttccttccttctttccttctttccttccttccttccatccwtccttccttctttccttccttccttccttccttccttccttccttccttccttccttccttccttccttccttccttccttccttccttccctcctttca

SEQ ID NO: 32915 - DNA, 201 bp, Homo sapiens
actgaaacactctctttctcccaacccctgaacccagacctcccaccagggccagcttcacaggcatgccctgtgcttcaagggaccccgtgcttgttttracgctttgttgtcgccgtcttgagattcttttttattttgttttttgagacatgatcttgctctgatacccaggctggagtgcagtagcatggtcatggc

SEQ ID NO: 32916 - DNA, 201 bp, Homo sapiens
tgggagaatttggggagttgtatataaagggtctagctgtttactagccacctggcacatagtatgtgcctgataatcactgacctttttttttttttttkggggggagacagagtctggctctgttgcccaggctggagtacagtggtgcgatctcagctcactgcaacctccacctcccaagggatgatcaaatcatcc

SEQ ID NO: 32917 - DNA, 201 bp, Homo sapiens
agcttcaagggtggctatgcacaaaaggagaagacacgagccttctcagaagtttccttccttccttctttccttctttccttccttccttccatccttcyttccttctttccttccttccttccttccttccttccttccttccttccttccttccttccttccttccttccttccttccttccttccctcctttcaaaa

SEQ ID NO: 32918 - DNA, 201 bp, Homo sapiens
gggcaacagagcaagaccctgtctcttaaaaaaaaagtataagtaatcccctataagtagcggatattcaggctgtttctctctgtttttttttttttttkgggggggggctattatcaacagcacagtgaggagtacccctgtagctgaatctctgcctccatcctttattttcttaggatatgtttacctggtccataa

SEQ ID NO: 32919 - DNA, 201 bp, Homo sapiens
gggtggctatgcacaaaaggagaagacacgagccttctcagaagtttccttccttccttctttccttctttccttccttccttccatccttccttccttcyttccttccttccttccttccttccttccttccttccttccttccttccttccttccttccttccttccttccttccttccctcctttcaaaatcattcct

SEQ ID NO: 32920 - DNA, 201 bp, Homo sapiens
gtaggcagggacttagttgtatttgtttgttcttaccaggcatttagggcatgttgtggggtggatgaatgggtggccgagtgagtgagtgagtgagtgartgaatgactgactggggtgggtgcacagtagaaagtggtgagggtttgcataacaggctgtgctgggcctgtttggagagtggagcagccgcctggcttt

SEQ ID NO: 32921 - DNA, 201 bp, Homo sapiens
tgtgtcccctaccgtgctcagccctcaccatgcacagtcccaccgtgctgccggcccgtgcccgagcctctgccttctgccctgggaggttggctcacgcyagcgcccccatccctccccctgcagatcctgattgcctcccacctcccctcctacgagctgcggcataaccaggtggagtccattttcctgtctgccatt

SEQ ID NO: 32922 - DNA, 201 bp, Homo sapiens
ggctatgcacaaaaggagaagacacgagccttctcagaagtttccttccttccttctttccttctttccttccttccttccatccttccttccttctttcyttccttccttccttccttccttccttccttccttccttccttccttccttccttccttccttccttccttccttccctcctttcaaaatcattccttgag

SEQ ID NO: 32923 - DNA, 201 bp, Homo sapiens
gttgaccaggctggacttgaactgctacgctcaagcgatcctcctgcctcaccctccccagtagcttggactacaggtgcatgccaccatgcttgacttayagttactttttaaagtgctaaatgctgtttgtgtcaattagagatttttctaggatgcttttgggtttttttatttgttttgtttttccaccacgcccag

SEQ ID NO: 32924 - DNA, 201 bp, Homo sapiens
ttgagaggctgaagcaggagggtcacttgagcccagaagtttgtggttatagtgagctataattgtgccactgcactccagcctgggcaacagagcaagaytctgtctcaaaataaaaaaacaaaaaagaatgtatcaaaccaacaaacttataacatgattattattattactatttcctgagtcttggatgccaaaata

SEQ ID NO: 32925 - DNA, 201 bp, Homo sapiens
agttgaaaagcttccagtgtttaaactccagaactgcattgtccactatggcagccaccagccacgtgtggttagtgagcacttgaactgcatccagtctraatcgagctgtgctctaagtggaaaatacacactccattccaaagatgtagtactgtatggagaaaagaatgtaaaccatctcaataatttcttatattg

SEQ ID NO: 32926 - DNA, 201 bp, Homo sapiens
aaaaaaaaaaaaaaaaatgaatgaggaggctgcaccagactcctgagatgtgacctgtggccctaaagctcactgacatacagttagttattttgtccccrgtatgtgtgcattttcagagttgagaatttagaattttagcacccaggggcaatgcgggtggttctgctggcacctcctgagacactggcacttcctcaa

SEQ ID NO: 32927 - DNA, 201 bp, Homo sapiens
ggtacagagtcaggtgcagtggctcgcacctataatcccagcactttaggaggctgaggcgggtggatcacctgaggtcaggagttcaagaccagcctggytaacaaggtgaaaccccatttctacaaaaaatacaaaaattagccaggtgtggtggtacgcacctgtagtcccagctactcgggaggctggggcaggaga

SEQ ID NO: 32928 - DNA, 201 bp, Homo sapiens
gagcttggctttataggcagaacagggctgaagaaagcagaaacaagggacaaaggggagcttcatagtttctttctttttctttttctttctttcttttyttttttttttttttttttgagacagagtcttgctctgtcacccaggctggaggctggagtgcaatggcacaatctcggctcactgcaacctctgcctccc

SEQ ID NO: 32929 - DNA, 201 bp, Homo sapiens
aggggccaggtcctcccagcggattcactactgaacctcgtagatgtggaattaatttacggaggtgttaagtacattctcaaggtaaatgcccccgtgcytctccgatgtctccaacactctgcaagcttcagggagtttctttcttccatgaaccatccctggagtggatttgctcatgcttgggtttgagctcttgtg

SEQ ID NO: 32930 - DNA, 201 bp, Homo sapiens
gatccccctcggctgggaagctgacacagtacacagtggaggatgggggccacgttgaggctgggagcagctacgctgagatggaggtgactgcagagccsgccgtggggaatcctgaaccctcaaactcccactcttctggctttgtcccatgtctgaacaaacaggcctacctctccccttgaccactgtctgcaaatt

SEQ ID NO: 32931 - DNA, 201 bp, Homo sapiens
gggaatgtagagggtacactccccctttaggaaggggaaatggtattgaaagccggactagggcttgctgagttggtagtcctcatcagtctccctacccsactcctcctctctcccagttaccgaattaccatcggcaataagacgtgtgtgtttgagaaggagaacgatcctacagtcctgagatccccctcggctggg

SEQ ID NO: 32932 - DNA, 201 bp, Homo sapiens
ctgaaccgttcacaggagaactccctgcccagcagacactgcccatcctcggagagaaactgcaccaggtcttccacagcgtcctggaaaacctcaccaaygtcatgagtggcttttgtctgccagagcccgtttttagcataaaggtaaagtcacctatgagcgcaggcgtgtagaccagtgcggagggtcagaagatct

SEQ ID NO: 32933 - DNA, 201 bp, Homo sapiens
gccggcagatctgtcctgcctcccattctgcccggtcccatttggaattcccagagttttcctgacctgtcgttcttgtggtgtctcatcaggctgaaccrttcacaggagaactccctgcccagcagacactgcccatcctcggagagaaactgcaccaggtcttccacagcgtcctggaaaacctcaccaacgtcatga

SEQ ID NO: 32934 - DNA, 201 bp, Homo sapiens
ctcggggtagcacgtggcccccagcgcaggtagatgtgcatctacagctccttccttgtcttcccatgcaggtgcttattgccaacaacgggattgccgcygtgaagtgcatgcgctccatccgcaggtgggcctatgagatgttccgcaacgagcgggccatccggtttgttgtgatggtgacccccgaggaccttaagg

SEQ ID NO: 32935 - DNA, 201 bp, Homo sapiens
agtgaggcgaagcacattctgtttttaaaaaaaaattttatagacaggatctcgccatgttggccaggctggtctcgaactcctgggctcaagtgatcctyctgccttggcctcccaaactgctggggttataggcgtgagttactgcacctggctgggaggcatattcttgaaggaagattgttgctcacccctttctgt

SEQ ID NO: 32936 - DNA, 201 bp, Homo sapiens
ctgggactacaggcatgtgccaccatgcccggctaatttttctatttttttttttgtagagacaaggttttgcgctgttgcccaggctggtctcaaactcytgagctcaagcgatcctcctgcctcagccacccaaagtgctgggattataggtgtgagccaccatgcctggcctaatcactggctattaatagtaacgta

SEQ ID NO: 32937 - DNA, 201 bp, Homo sapiens
ttttatagacaggatctcgccatgttggccaggctggtctcgaactcctgggctcaagtgatcctcctgccttggcctcccaaactgctggggttataggygtgagttactgcacctggctgggaggcatattcttgaaggaagattgttgctcacccctttctgtgtttgcaggcggtgtgggctggctggggccatgct

SEQ ID NO: 32938 - DNA, 201 bp, Homo sapiens
cttctgtgtccaagatgctgcccttatgtggtgactgagagcttgaaagtggccagtgtgactgaggaactgaattttacattttatttcattttgatcartttaaatagctgtgtgtggttaggggtcaccgtatcagacagggcagatctaaagtgttccattgcaaggttgttggcttgctaattttgttctaatttt

SEQ ID NO: 32939 - DNA, 201 bp, Homo sapiens
tagttcagtagataccctcagtgttctcacctgagaatatctttttttgatttttttgagatggagtctcactctgtcacccaggctggagtgcaacggcrcgatctcagctcactgcagcctccgcctcctgggttcaagcgattctcctgcctcagcctcctgagtagctgggaccacagtcatgcaccaccaagcccc

SEQ ID NO: 32940 - DNA, 201 bp, Homo sapiens
tttctggcctcttaggatttttaaaataactttcttttcctgttggttttaagaagaaagatgctgctatgttttggatgaagaaaagggggcttccccasgaggcactgcctttcctagttatttgtttttacccttcttatttccaaaaataggattgtgacattttaccccattgagagaaaggggactgactgcttg

SEQ ID NO: 32941 - DNA, 201 bp, Homo sapiens
ggagcagaggggccatgatcgtgatttcagagcacccaacaggaatgcacacacctgtgtcagggtccccaaaagcacccccaggttcgatcatcgcctakgagaactcacaggtctcgggacatagtcatgcttatagctctgacttattagggggcaaggatacaaagcagttagccaaggcagaaggcatcagggtga

SEQ ID NO: 32942 - DNA, 201 bp, Homo sapiens
aagagtgtgagcctgcgtgtcagcttgcctggtttgaattctggctatgtgctttctaactaagagactgagcaaaatatttttacctctccataccttcrttttcttatctgtaaaatgggaataataaaggactcacttcataggtgcgccatgagaattaaatgagataacatatgtgaaataacatatttaaagtat

SEQ ID NO: 32943 - DNA, 201 bp, Homo sapiens
ttcgtcatcccagcccacatctcttatcggctccaagcaaggaacaggtcaggaaactaaattgtctatgcatatttttatgcgcccctgagtgaaatgcyaaggatcttcctgtaatgtttaatttattcatttattgacttaggaaggggctgggagaaactctcttttcaagtctctttagctcctaaaatgtttact

SEQ ID NO: 32944 - DNA, 201 bp, Homo sapiens
tagcatcttgttttattttttaagagatgggatggggccgggtgtggtggctcaagcccgtaatcctagcactttgggaggctgaggcaggaggtttgctwgagctcaggagttctagaccagcctgggttatatagtgagaccctgtctctacaaaaaaattaaaaaatcagcctggcattgtgatgcaagcctgtggtc

SEQ ID NO: 32945 - DNA, 201 bp, Homo sapiens
tcaggcatggctgcttaaacaggggcccagggtgtttatgttgtggccaagtacttggcacccccgggaagtgtggccctgcctgtgccttttctttcttyctttctttctttttttttttttttttttttttttgagaaagggtcttgctctattccccaggctggagtgtagcgagatcatggctcactgcagcctcag

SEQ ID NO: 32946 - DNA, 201 bp, Homo sapiens
attctcttgcttcagcctcccgaatagctgggactataggcacatgccaccgtgcctcccagctccctggcatctttgatattcatgaagaatatagtctkcagtccttaaggcatccccatattcaagaatgtagcaacttttgtgtagactgcagtcttcctctgggattgtatttccattgagagccctctgttccct

SEQ ID NO: 32947 - DNA, 201 bp, Homo sapiens
cttaaacaggggcccagggtgtttatgttgtggccaagtacttggcacccccgggaagtgtggccctgcctgtgccttttctttcttcctttctttctttytttttttttttttttttttttgagaaagggtcttgctctattccccaggctggagtgtagcgagatcatggctcactgcagcctcagctacctgggctca

SEQ ID NO: 32948 - DNA, 201 bp, Homo sapiens
cacatttataggatacatgtaaaattttgttacatgcatagaatgcataatgattgtagggaccaagggaatatcttctgctttgccctctgaagtttcgytgaaaaattaacttgtaaaaaggcagattagttggagaaaagacacacaaatttaattaatgtgtacactgggagaaccgcagagtgattacccagaagg

SEQ ID NO: 32949 - DNA, 201 bp, Homo sapiens
aagtataagtaatcccctataagtagcggatattcaggctgtttctctctgttttttttttttttttgggggggggctattatcaacagcacagtgaggartacccctgtagctgaatctctgcctccatcctttattttcttaggatatgtttacctggtccataaacattcatgcacacctcccatgcataaggcctgc

SEQ ID NO: 32950 - DNA, 201 bp, Homo sapiens
gtaaaagatcagcagagtcctggatgagtaccctaaacacatcactgcgtttgttttatgttctctcctgagaacttccagaagcttccagagctggtttycccatgaagatcaggctgctctgcttcccccgacaggtacagagtgagatcccaggctcgcccatctttctcatgaagctggcccagcacgcccgtcacc

SEQ ID NO: 32951 - DNA, 201 bp, Homo sapiens
gactgagtgatcgttttccattgtttcttgcatttagaaaagtaatccatggccgggtgcagtgacccatgcctgtaatcccagtactttgggaggctgakgtgggcggatcacttgaggtcaggggttcaaaaccagcctggccaacatggtgaaaccctgtgtctactaaaaatacaaaaattacctgggcgtggtggc

SEQ ID NO: 32952 - DNA, 201 bp, Homo sapiens
aggctggtcttgaactcttgagctaagcaatcctcacaactcagcttcccaaagtgctgggattacaggcatgagccaccatgcccggctctttcttggtycgttgagactctgtgtggaagtcgctggtcttgagtactgccctgggtcagcacaaacattgatgaaaactaataagtaaagacagagttcggttatgaa

SEQ ID NO: 32953 - DNA, 201 bp, Homo sapiens
gcacctgctggaacctctattgaaggtgcttctcccagagccctttgtgcagtggactccctccccacccagcctgtaggtctcaacatgatcatcgcatytctctcagagaacctcatttattttcttcccagcactgacctgagtctgtagttattgtgtttattttcttgtttatcttctccaacataaaagaaaaac

SEQ ID NO: 32954 - DNA, 201 bp, Homo sapiens
ctgggcctttgctgagacagaatagtgggcccgggtctgtttccaggggctctgaggctggttttgttctctgtctctgcaccacgtgtagattactggcrtcttccctggtttactactggagtccctggggcttattccggttgctctcctctgtcagaagtgcctagttgccctttgtgggccatccaaggtcaattc

SEQ ID NO: 32955 - DNA, 201 bp, Homo sapiens
gccgaggcatgagaatcgcttgaacctgagaggcggaggttgcagtgagctgagatggagcccttgtacttcagcctgggggatagagtgagaccctatcmcaaaaaaaaaaaaaaaagaaaaaaagaaacagaagtaatccatgattatattgtgaaaattttaaataagactgaaaacgatttttaagaacctagcgca

SEQ ID NO: 32956 - DNA, 201 bp, Homo sapiens
aggagtttgaggctgcagtgaactatttttgcaccactgcactgtagtcctggcaacagagggagaccctgtctctataaaaaacaaataaggctgggtgyggtggctcacacttgtggtcccagcactttgggaggccaaggtgggcagatcgccctgaggtcaggagttcaagaccagcctggccaacatggtaaaacc

SEQ ID NO: 32957 - DNA, 201 bp, Homo sapiens
tgggaggcagaggttgcagtgagccgagatggtgccacttcactccagcctgggtgacagagctagactctgtctcaaaaaaaaaaaaaaaaccaaccaamcaaacaaaaaacctcagcattatacatgtttgtctcttatttgagaggaatataagaggccatatgtgtaatgcatgttttaaaagtccagttaatagag

SEQ ID NO: 32958 - DNA, 201 bp, Homo sapiens
cacaaggggtggagggtccagatcccacaaggctccaaattcctgggctgatgtaacacagaaaagagtgttcaagtgaggcgaagcacattctgtttttwaaaaaaaattttatagacaggatctcgccatgttggccaggctggtctcgaactcctgggctcaagtgatcctcctgccttggcctcccaaactgctggg

SEQ ID NO: 32959 - DNA, 201 bp, Homo sapiens
gagagctgggaccagagaattttctctgtcatctgctccttacctggccccaccaccgtgcactcggtcggccttcagcctcgagggtcttgtgactgacyggattctgcttcccttcttgtccccgattcctcaggccctcccagtgaggccatgtgggccttaggagataagatcgcctccaccgttgtcgcccagacg

SEQ ID NO: 32960 - DNA, 201 bp, Homo sapiens
ctgtcatctgctccttacctggccccaccaccgtgcactcggtcggccttcagcctcgagggtcttgtgactgaccggattctgcttcccttcttgtcccsgattcctcaggccctcccagtgaggccatgtgggccttaggagataagatcgcctccaccgttgtcgcccagacgctacaggtcccaaccctgccctgga

SEQ ID NO: 32961 - DNA, 201 bp, Homo sapiens; identical to SEQ ID NO: 6179

SEQ ID NO: 32962 - DNA, 201 bp, Homo sapiens; identical to SEQ ID NO: 6182

SEQ ID NO: 32963 - DNA, 201 bp, Homo sapiens; identical to SEQ ID NO: 6158

SEQ ID NO: 32964 - DNA, 201 bp, Homo sapiens
gtatatacccagaggaatttaaaatcattcgaccataaagacgcatgaacacgaatgtttattgcagcactattcacagtagcaaaggcatggagtcaacytaaatgcccatcaataacagattggataaagaaaatgtggtacatatacaccatggaatactatgcagccatcaaaaatactgagattatgtcttttgtg

SEQ ID NO: 32965 - DNA, 201 bp, Homo sapiens
atccattctgtggccatgttggatttttgatagagacaaggtgtcaccatattggccaggctggtctcgaattcctgacttcaagtgatctgcccgcctcracctccaaagtgctgggattataggcgtgagccaccacgcctggccatatggccatatttgggataagttgtgcactactgtggttgactgtaatgcagt

SEQ ID NO: 32966 - DNA, 201 bp, Homo sapiens
gaacaaggtctgcattgaagaaaaagaaatgaatgtgttgagaacgacttcatagtatttttctccaaataagactaatttatcccaatgataaaagtcayaggatatagaaacttcagaaaataaaggaggttggaacaaagaaaaaataattcctagtcccacactctgatgacaaattgcttaacattttgatgtgtt

SEQ ID NO: 32967 - DNA, 201 bp, Homo sapiens
gcagaggttgcggtgagctgagattgcgccattgcactccagcctgggcaacaagagaaaaaaaaaatagaaaaagtaatttgcggaaggatgtgtacagygtggtactctttatttaaagtttgcagtgcaaaacgatactgtatgtttccaatgtatgcatacaggataaaggaaaatgaaaaaaaaagcatgcatagg

SEQ ID NO: 32968 - DNA, 201 bp, Homo sapiens
gcaaaccactggcgtgagtccaagagtccaaaggccgaagaacctggagtctgatgtttgagggcaggaagcttccagcatgtgagaaagatgaaagccaraagactcagcaaggcagcttactccaccttctttcacctgctttttctagccgcgctggcagctggatgactggatggtgcgcacccacattgaggatgg

SEQ ID NO: 32969 - DNA, 201 bp, Homo sapiens
tctcagactttctgaagctgaaccatcaagccagccagtcagggaaggtcgtggacagaatgaggggtgcggctgtgtgtgggaatgtcgattagtacaayctctgtggaaaacagtttggagagttctcaaggaactaaaatagatctgccagtctctccagcaatcccactactgggtatgtacacaaaggaaaagaaa

SEQ ID NO: 32970 - DNA, 201 bp, Homo sapiens
ttttgccaaggttagggacacatccagaagcaaagaacacggaatcatagaaaccgtctgtggcgtgtgcctttcttcaaagatgatttggagggcttcaktatttaaaggagaaaagcaggctggaggggaaagagggaagttctggtaatcacatgttgcaggagaaaaggcgcaggcaggggaagtcagttatgtatt

SEQ ID NO: 32971 - DNA, 201 bp, Homo sapiens
gtaaataaatgaagttctctttttttttttttttaggtagagtttcactctgttgcccaggctggagtgcagtggtgtgatctcagctcactgcaacctcygcctcccgggttcaagtgatttttgtgcctcagcctccccagtagctgagactacaggcgtgcgccaccatgcccagctactttttgtgtttttttagtt

SEQ ID NO: 32972 - DNA, 201 bp, Homo sapiens
caaagatgatttggagggcttcagtatttaaaggagaaaagcaggctggaggggaaagagggaagttctggtaatcacatgttgcaggagaaaaggcgcakgcaggggaagtcagttatgtattcttcctgcgctcagtaagtcagcactttctataagataaggtggacatagaggaactacctgtggagatatttcagc

SEQ ID NO: 32973 - DNA, 201 bp, Homo sapiens
gatgaatgagtggtcactggcttaaggctgagtcctaatggagcagtgaggaaagttggggacccctggccatctgtaccacagaacccccaaaaggcatrgtgtctggcagcaagggatgcccctggagctgaggggtaaggagggtaccaaaatgagaaggacagggtggaagactcccaggtcccctcccctgtctcc

SEQ ID NO: 32974 - DNA, 201 bp, Homo sapiens
ctgaaacattcactgtctgctgcttgtctttacagcaatctttgttaaccatgttatttccagataggaatccaagctcaataaagtggcctgaagaatargcttttgcctctactgtggtttggctccaaatcgggttgccattggtcaaaacataacttccatttggtcccagcaggttcctggactcttccctgctgt

SEQ ID NO: 32975 - DNA, 201 bp, Homo sapiens
gaacgattagaatgtgtggacttcttccctgatcataaaactctcacccttgttataagttttttagtattattcaggttcctaaacaatgggcatgtaawgtaaaaattaacttaggattaaaaatctaaacatccaccttgggacaggtagaagaaactgctccttctagttcatgtgctggtaccttagctggcctct

SEQ ID NO: 32976 - DNA, 201 bp, Homo sapiens
tcctcacaggagcaagtgctctcaacaaggtgaccaaaaaggggcctgtgcagagtggatccttgggggccaggagtcattttaacattcccattggtctytggtgggggatttttctcaatatgaagccagtttcattcctactgatacaagagctctttttttccaatttgcagctatctgggtccttatgagaaaaaa

SEQ ID NO: 32977 - DNA, 201 bp, Homo sapiens
aaactctcacccttgttataagttttttagtattattcaggttcctaaacaatgggcatgtaaagtaaaaattaacttaggattaaaaatctaaacatccmccttgggacaggtagaagaaactgctccttctagttcatgtgctggtaccttagctggcctcttaaggtgctttcagttgggtacagtggttcacgcctg

SEQ ID NO: 32978 - DNA, 201 bp, Homo sapiens
gaccaagaaggggtggaaacagcctccagtttctggagctaatagatggaggtggggtgcaatggtggtcctggtctccctcccctgatgctccatgctcygtggtctctaactgccccactgtctcatcagtagaaaattcagtgctgaaacatcagagtttcaaagagaagactgcatctttctctttctttctctctt

SEQ ID NO: 32979 - DNA, 201 bp, Homo sapiens
cgaggctgcagcgagccacgattgcaccactgcgtactagcctaggtgacagaatgagatcccgtctcaaaaaaaaaaaaaaaaaaaaaaaaaaaaccgarggtgcttcctgaccttgagcctccttgtaaattgcttcaggggctctggagagcaagtgcaaagcaggggggctctggtgcagtttggctcctctgctcc

SEQ ID NO: 32980 - DNA, 201 bp, Homo sapiens
aggaagcctgtctggccgctcacttcatcatctctggaatctccccgttggccgacacttctgtgtttgataaacataggaggcaggcaggccggaaggarcagctgctctgggatttctttctgtgtttgcatataaagtgccacattgttcaatttcaggatcttagcaattctatagtacagatgtcccaacccctgt

SEQ ID NO: 32981 - DNA, 201 bp, Homo sapiens
ggcctgcgcaacagagcaagaccctgtatctaaaaaaaataataataactaaaataaaataaaaagttttcccccaaagaaacaaactcattttccttgtrcattcatccccttgccaggtgggcatggtggccttcaaaatgaggtttaagacccaggagtacccggaaggacgggatgtgatcgtcatcggcaatgaca

SEQ ID NO: 32982 - DNA, 201 bp, Homo sapiens
agtagctgggattacaggtgcctgccaccacacccagctaatttttgtatttttagtagaggcggagtttcaccatgttggccaggctggtcttgaacacrtgacctcaagtgatctgcctgcctcagcctcccaaagtgctggaattacagacatgagccaccatgcctggccaattttacctcttctatacctacacac

SEQ ID NO: 32983 - DNA, 201 bp, Homo sapiens
tgggcagatcatttgggcccagcctgggtttgtgttcaagttcaagaccagcatggacaacatgacaaaatcctgtctctgcaaaaaaattaaaaaattascaggatgtggtggtgtacacctgtagtcccagctactcgggaggctgaggtgggaggatcacttgaagctggaaggtcgaagctgcagtgagctgtgatt

SEQ ID NO: 32984 - DNA, 201 bp, Homo sapiens
tttctcagatgtaaccactattagcagctgccgatggtggggggctcttttcagcactgtcactgtatatacttttacatagacattcatacagttgtttyattattttttgcatgacttcatcctatacattattgcaaatttgttaaacttaatttgtcttagaaatcattgcacgtgaatacttttcacattgtcttt

SEQ ID NO: 32985 - DNA, 201 bp, Homo sapiens
cttgaagctggaaggtcgaagctgcagtgagctgtgattgcaccactgtactccagcctgggtgacagagcaagactctgtctcaaaaaaaaaaatatatrtatgtgtatatatatatatatatatatatatatatatatatttcagacaaacagccatccatccatccatccatttgatgatccattcatgtggatggca

SEQ ID NO: 32986 - DNA, 201 bp, Homo sapiens
gtctgggaagcagagccctagtccatgtccaggtgtcttagtccatttgggctactgtcgtaaaataccaaagactgagtggcttctaaaccacacactgratttctcacaattctctaggctgggaaggtcaatatcaagatactggcagatttggtatctactgaggacccacctttcgtttcatagatgctgtccttt

SEQ ID NO: 32987 - DNA, 201 bp, Homo sapiens
ggaaggtcgaagctgcagtgagctgtgattgcaccactgtactccagcctgggtgacagagcaagactctgtctcaaaaaaaaaaatatatgtatgtgtayatatatatatatatatatatatatatatatatttcagacaaacagccatccatccatccatccatttgatgatccattcatgtggatggcagactttgag

SEQ ID NO: 32988 - DNA, 201 bp, Homo sapiens
gggggtctaggctgcagtgagctgtgattacaccgctgcattccagcctgggaaacagactgagactctgtctcaaataaaacaacataaacctaaaagcrtaactcaggtccgagcacagtggctcacgcctgtaatcccagcactttgggaggccaagatgggcgaatcacttgaggccaggagttttgagatcagcct

SEQ ID NO: 32989 - DNA, 201 bp, Homo sapiens
aataaggggtaaataaaaatgttggaaatgaggccaggcgtggtggctcacgcctgtaatcccagcattttgggaggctaaggggggcagatcacttgagrccaggagttcaagaccagcctggccaacacagtgaaaccccgtctctactaaaaatacaaaaattagctgggcatggtggtacacgcctgtaatccaagc

SEQ ID NO: 32990 - DNA, 201 bp, Homo sapiens
caagtctcactctgttgcccgggctggaatgcagttgcatgatctcagctcactgcaacctccacctccaggttcaagtgattctcatgcctcagactccygagtagctggaattacaggcacccacctccatgcccagctaatttttgtatttttatttttagtacagacagggcttcaccatgttggccaggctggtct

SEQ ID NO: 32991 - DNA, 201 bp, Homo sapiens
gaggcaaagatgagatctgaaccatggccatcaggattctgactctgtgctcttcgcccccacgttatgctgcctgatgattattaccaccattgcaacattttttttttttttttggagacagggtcttgctctgtctcccaggctggagtacagtgggggaaacactgctcactacaacctcgacctctgggttcaagc

SEQ ID NO: 32992 - DNA, 201 bp, Homo sapiens
gcccccagcttacacacagtttttgagctcttactctgtgccaagcaccaagctgggtacaaggatccaaaatgaatgacacttggtctatgtccccaagsaccacccagtcggtcagggagaacagacaaccgaacaagccacttccatgccatgttttctgtgtcatcatgatggaagtctgtacccaggcctcccagg

SEQ ID NO: 32993 - DNA, 201 bp, Homo sapiens
cccaagactacaccagaatcagctccctgaactccgtccactgtaaacacatcgaggaaggaggagagtccaggtaaataacttatcaggtagctccttarttttgctcatggttaatttcagctgtcttctttcctcggggcttgtggcgatattttccagtggggtggtggtgtttgtatgatgggaaccaatgcctgt

SEQ ID NO: 32994 - DNA, 201 bp, Homo sapiens
tgaacacacatgcacatgcacacacatttttgcacacacacattctctctctgaaagggatgagtttctctcttggaggtatattatttcagtctgagcamccagaacacaacaggaaagttgagctgctcccgtcactatatcccaaatctagaatttcacatgctgctacctttagacttggctgctccttggctgtgc

SEQ ID NO: 32995 - DNA, 201 bp, Homo sapiens
attttcttcttggcctcaggattttctaaaagaaaaaaccaatttggggaatgatttctgcagtgtctgtgtgtgcccttagaaggtatctcagccagcckcctcctgaggcctgggaccctgtagtcagtccccaggccacaagggctaacaacccctttgggcatcagaaggtggccttgggtgctctccccagaaaac

SEQ ID NO: 32996 - DNA, 201 bp, Homo sapiens
tcagccagcctcctcctgaggcctgggaccctgtagtcagtccccaggccacaagggctaacaacccctttgggcatcagaaggtggccttgggtgctctmcccagaaaacttcacagacactggcactctgaattccatcttaggagagccatggacaggagccctgttgtatgccactgttggtgggaggctgcaatgc

SEQ ID NO: 32997 - DNA, 201 bp, Homo sapiens
ccgggcgtggcagctcacacctgtaatcccagcacgttgggaggccaaggcgggtggatcacctgcagtcaggagttcgagaccagcctggccaacatggygaaaccccgtctctactgaaaatacaaaaattagctgggcgtggtggcaggcacctgtaatcccagctactcggggggctgaagcagcagaattgcttga

SEQ ID NO: 32998 - DNA, 201 bp, Homo sapiens
ctctgtctcaaataaaacaacataaacctaaaagcataactcaggtccgagcacagtggctcacgcctgtaatcccagcactttgggaggccaagatgggsgaatcacttgaggccaggagttttgagatcagcctgcccaatgtggtggaaccccatctctactaaaaatacctcccaaaaatttgccgggcatggtggc

SEQ ID NO: 32999 - DNA, 201 bp, Homo sapiens
gaagcagcagaattgcttgaacccagaaggtggatgttgcagtgagccgagattgcgccattgcactccagcctgggtgacagagcgagactccatcttcmaaataaataaaataaaataaattatatttttaaaagcaaaaaataaaaaaaaaaaaatccactccttcttccatgtgaaaacactttgatttgaagactg

SEQ ID NO: 33000 - DNA, 201 bp, Homo sapiens
tagagagagagaagatcgttggttgccaaggacatgagggagggagagaaagggagttgttcatgagtatagagcttcagattcataaaatgaaaaagttstggacatctgtttcacaatataaatatacttcactattgaactgtacactcaaaaatggttaagatggtaaattttgtgtgtgttttttttttaccataa

SEQ ID NO: 33001 - DNA, 201 bp, Homo sapiens
aagtgatcctcctgccttggcctcccaagtagctgggactataggcatgcaccaccattcctggctactttttttggatttttttttttttttttttttgkggagacaaagtctctgtgtgttgcccaaactggtcttgaattcttggcctcaagtgatcctcctgcctctgcctcccaaagtgctgggatgtcaggcgtg

SEQ ID NO: 33002 - DNA, 201 bp, Homo sapiens
aacaaatgactgaatgaatacttgcatgagaggataccggttcttcgcgggagaggtaacctccttggcactttccttaggaggaatttattccagagatkcttacagaaaggatgatgacaataatgttcacagcacagtgactgatgactttgaagtgaaaactacatgctacacaggatgtcaaggcctcaagagtca

SEQ ID NO: 33003 - DNA, 201 bp, Homo sapiens
tacaggcgtgagccaccacgcctggccttctctttacattttcatacatgtttgtccattgttaccatagaaatctgcatggttctgctttccatggctgyacatagtcacatcttgtaatgttctgccattgatgtcagtctgtcagcagttccttccttctccctcccatttaatttcagagtacatcaagatggcgga

SEQ ID NO: 33004 - DNA, 201 bp, Homo sapiens
catgagaggataccggttcttcgcgggagaggtaacctccttggcactttccttaggaggaatttattccagagattcttacagaaaggatgatgacaatmatgttcacagcacagtgactgatgactttgaagtgaaaactacatgctacacaggatgtcaaggcctcaagagtcattctactccaaatataggcacggc

SEQ ID NO: 33005 - DNA, 201 bp, Homo sapiens
caagaagtacaaaaaagaaatggaaatcattcataatcctatgacccagtgttgaacatttattacattgtaggtatctacctttccaacctttttctggscatattctttgggaaaaaaaaaaaaaaaagacagatcttggccagtggctcatgtctgtaacccaaccccccaacccagtgctttcagaggctgagggag

SEQ ID NO: 33006 - DNA, 201 bp, Homo sapiens
tttccttaggaggaatttattccagagattcttacagaaaggatgatgacaataatgttcacagcacagtgactgatgactttgaagtgaaaactacatgmtacacaggatgtcaaggcctcaagagtcattctactccaaatataggcacggcattcctgtgttcactccctcattcatttgctaattcaatgaatatcc

SEQ ID NO: 33007 - DNA, 201 bp, Homo sapiens
tacaaaaaagaaatggaaatcattcataatcctatgacccagtgttgaacatttattacattgtaggtatctacctttccaacctttttctgggcatattytttgggaaaaaaaaaaaaaaaagacagatcttggccagtggctcatgtctgtaacccaaccccccaacccagtgctttcagaggctgagggaggaggatc

SEQ ID NO: 33008 - DNA, 201 bp, Homo sapiens
gccaacacagtgaaaccccgtctctactaaaaatacaaaaattagctgggcatggtggtacacgcctgtaatccaagctgctcggggggctgaggcaggakaatcacttgaacccgggaggcagagattgcagtgaaccgagatagtgccactgcactccagcctgggtgacagagtgagaccctgtctaaaaaaaaaaca

SEQ ID NO: 33009 - DNA, 201 bp, Homo sapiens
cctgggcaacatagcaagaccccatctccagaaaaagtaaaaaaaaaaaaaattaactggttatggtggtgcatacctgtagtcccaactactgaggaggytgaggcaggagggtggcttgagcctaggaggtcgaggttacagtgaactatggtggcaccactgcactccagcctgggtgatgagaccctgtctttaaaa

SEQ ID NO: 33010 - DNA, 201 bp, Homo sapiens
tccaggcctgacagtggagtggacagaagatgatctgcagcagggaaaaagaatcagtgtcccagaagatgtttatgacaagggttgcgtgaaagacgtaratgagggcttggaggtaaatgcagagcctgtgggggccaggggagccagaaccgaactgcctctgtcctggtagcagttggcaactggctaacctctaaa

SEQ ID NO: 33011 - DNA, 201 bp, Homo sapiens
atttctcacaattctctaggctgggaaggtcaatatcaagatactggcagatttggtatctactgaggacccacctttcgtttcatagatgctgtcctttygctatgtccttagatgtcagaaatgggccacagagctctacaggggatcttttataagggcactaatctcttttacaagggccccaccttcatgatctca

SEQ ID NO: 33012 - DNA, 201 bp, Homo sapiens
agtacatcaagcgtccaggtgccgtgctggaagcaggctgcgtggtggccaggctggagctcgatgacccttctaaagtccacccggtatgtggctccacrgcccaagtgctctggctggtgcaggtgcactcgtgacctccactggttcagtgagacaggtggactcaaggctggtagcgcttctcctgcctccacctgc

SEQ ID NO: 33013 - DNA, 201 bp, Homo sapiens
gtgttaagggtgatcacaatgacaccaaaggaataaaaaaaaaatcattcactgggctcggcacagtggctcatgcctgtaatcccagcactttgggaggrtgaggtgggcagatcatttgggcccagcctgggtttgtgttcaagttcaagaccagcatggacaacatgacaaaatcctgtctctgcaaaaaaattaaaa

SEQ ID NO: 33014 - DNA, 201 bp, Homo sapiens
atcaccgtgccagatgactttgagggggtttataccatcctggagtggctgtcctatatgccaaaggtgcagtactccccctgcagcttagaacctggaaractcttattaagctcattggctaattctgtccctgtcacctcctgggtggtgtgggaggctgaggagcaggaagcactgcacatgtggctggggttgatt

SEQ ID NO: 33015 - DNA, 201 bp, Homo sapiens
tactcaggaagctgaggtgggaggatcgcttcagcccagggggtctaggctgcagtgagctgtgattacaccgctgcattccagcctgggaaacagactgmgactctgtctcaaataaaacaacataaacctaaaagcataactcaggtccgagcacagtggctcacgcctgtaatcccagcactttgggaggccaagatg

SEQ ID NO: 33016 - DNA, 201 bp, Homo sapiens
gaggtgggaggatcgcttcagcccagggggtctaggctgcagtgagctgtgattacaccgctgcattccagcctgggaaacagactgagactctgtctcarataaaacaacataaacctaaaagcataactcaggtccgagcacagtggctcacgcctgtaatcccagcactttgggaggccaagatgggcgaatcacttg

SEQ ID NO: 33017 - DNA, 201 bp, Homo sapiens
ggacagtggaatacctctatagtcaggatggcagcttccacttcttggagctgaatcctcgcttgcaggtggaacatccctgcacagaaatgattgctgaygttaatctgccggccgcccagctacaggtgagaaaatgggcttggggccctgggacttctctgccctgggtcaggggtccatgtgctgctcccattagtc

SEQ ID NO: 33018 - DNA, 201 bp, Homo sapiens
gtgatctcagctcactgcaaccccacaggctcaagaaatcctcccacatcagcctcctgagaagctgggactacaggcatgcatcaccatgtctggctacttttttttttttttttttttttttagtatttttagtagacactgggtttcaccatgttggctaggctggtcttgaactcctgagttcaagcaatccaccca

SEQ ID NO: 33019 - DNA, 201 bp, Homo sapiens
caccacgcctggctaatttttgtatttttagtagagacagaatttcaccatgttgcccaggccggtttcgaactcctggcctcaggccatctgcctgcctyggcctcccaaagtgctgggattacaggcgtgagccaccacgcctggccttctctttacattttcatacatgtttgtccattgttaccatagaaatctgca

SEQ ID NO: 33020 - DNA, 201 bp, Homo sapiens
tatgcatatttttatgcgcccctgagtgaaatgccaaggatcttcctgtaatgtttaatttattcatttattgacttaggaaggggctgggagaaactctsttttcaagtctctttagctcctaaaatgtttactttttctttttctttttctttttttcttttcttttcttttttctttcttttttttttttttgagacg

SEQ ID NO: 33021 - DNA, 201 bp, Homo sapiens
atgcatatttttatgcgcccctgagtgaaatgccaaggatcttcctgtaatgtttaatttattcatttattgacttaggaaggggctgggagaaactctcktttcaagtctctttagctcctaaaatgtttactttttctttttctttttctttttttcttttcttttcttttttctttcttttttttttttttgagacgg

SEQ ID NO: 33022 - DNA, 201 bp, Homo sapiens
catttacactggggatatttgggggatgaatacttgttggttttggtttgaatctctaaaaatcaggatacagtgggttacttttttggaggaggtgaagrcaaggctgtgaacaccttcccagaaacttgaagaactgagaattttgtttatctgttttttttcttaaacctgttgttgaaatgttatttaatatatggt

SEQ ID NO: 33023 - DNA, 201 bp, Homo sapiens
gtgcccctcctctaggagggcagaaattagcaaagttagagaggactgtggctggagagcaggagggttatgctgccatggaaaaagtcgtacactcttaracctgaaaggggccctccagagttcagaaagcattattttaaacagttggctcagtctttccatctgtgggtaaagatacagaggcccagagagggaaag

SEQ ID NO: 33024 - DNA, 201 bp, Homo sapiens
ctccggtggcatgaaaggtaagcccctccctgcctatgttaccccaaagccttggggtcagcacccaggacagcaccctctgggtggtgatgctaatgtcstagtctgtgcccatcatcatcttagctgtgtctcccaacaaccctgaggagaaaatattgttcaggtgccccactaccccgttttaaagatgaggaactg

SEQ ID NO: 33025 - DNA, 201 bp, Homo sapiens
taggctggagtgcagggtgcaatctcagctcactgcaacctctgcctcccaggcataagccatcctcccatctcagcctgagtagctgggactacaagtaygcaacaccatgcctagctaatttttgtatttttgtagatgtggggtttcgccatgttgcccaggctgttctcaaactcctgggctcaagcaatccaccta

SEQ ID NO: 33026 - DNA, 201 bp, Homo sapiens
aggcataagccatcctcccatctcagcctgagtagctgggactacaagtacgcaacaccatgcctagctaatttttgtatttttgtagatgtggggtttcrccatgttgcccaggctgttctcaaactcctgggctcaagcaatccacctacctcagcctcccaaaatgctggggttacaggcatgagctaccatgattgg

SEQ ID NO: 33027 - DNA, 201 bp, Homo sapiens
cccaccccaccaggatggtcacactgggccggctcccggtctggctcgatatctggcctctgatcaagttgaactccttgagacccacttatagcctaacrtatcaggggccgagggtttccttttgagccttgtctgcagaatcctatcatttactcaaagcaacagttgtttgaatgaacatcagtattccttaggcct

SEQ ID NO: 33028 - DNA, 201 bp, Homo sapiens
ttggtggtacttggatgcctggatcaagccatgcctgaagtcagtagcccagtcccaggaacctatccatggtttttgtttgtttgttttaatgtttgcaytagtttgagttggagctctatccttagccctggagatggcccagttagcccagaagacagcagttaatttccacccacagcagcacctaatggtggtctg

SEQ ID NO: 33029 - DNA, 201 bp, Homo sapiens
aaaggaggggccaggctaggaacccaggctggctcagacccaatccccctgggcttaatgcctttccgtaaatcctgaacctttgcaagggttagatcccraaacatgagagcatcctgtagaccaagctccactcctcctgcctccctgacttcctggctaattcagccaatggcatcattcagatcctcatcaaaagcc

SEQ ID NO: 33030 - DNA, 201 bp, Homo sapiens
atctgccggccgcccagctacaggtgagaaaatgggcttggggccctgggacttctctgccctgggtcaggggtccatgtgctgctcccattagtccatcycgcccatctcttggccgactgtcccaggggaatgactggccaaagagcactttgagaaatctgtaaaagctatagttctccctgggaaaatatcttttat

SEQ ID NO: 33031 - DNA, 201 bp, Homo sapiens
ctcctctgtgctctgacagcccctgttctctctcttttgtgcaacatatgtgaaacagatttctaactaaaacacacagctagggatccctaggtgtttcyggttgctgaaccagggctggattttggagaacagtctgctgacagagaggtggtcctctcctgggaggggaggtgagaggatgctcctgaggatgttctg

SEQ ID NO: 33032 - DNA, 201 bp, Homo sapiens
aggtgtttccggttgctgaaccagggctggattttggagaacagtctgctgacagagaggtggtcctctcctgggaggggaggtgagaggatgctcctgakgatgttctgtattttgtaataccctgaccaacgcggtatgtctctggatggaatactgtgtaggaaacacaggcaaagagcctacatgtttttttgtttt

SEQ ID NO: 33033 - DNA, 201 bp, Homo sapiens
tttttttttgagatggagtttcactctgtcacccaggctggagcacagtggcatgatctcagctcactgcaacctccacctactgggttcaagcgattctyctgcctcagcctcctgagtagctgggattacagatgtgcaccaccacacacagctaatttttgtatttttagtagagacggggtttcatcatgttggcca

SEQ ID NO: 33034 - DNA, 201 bp, Homo sapiens
gtcccttcttgggaaatgcatccaccttggattttttggggctagagcccagcctttaacctgtgcttgcttttgaagatacatgatcacggatatcatcrggaaggatgatggcttgggcgtggagaatctgaggggctcaggcatgattgctggggagtcctctctggcttacgaagagatcgtcaccattagcttggt

SEQ ID NO: 33035 - DNA, 201 bp, Homo sapiens
gctcctagcttacctctttgatctagctttctgccttccctccaaagtgaattttgtatatgccactgtagcctaggttgtaactcacaacaggtttacartccacatacgttgaaagttgactgatgcaatagcagactaacagattatttttcttccctgacatgaggttaagctccttgagagctgggaccagagaat

SEQ ID NO: 33036 - DNA, 201 bp, Homo sapiens
agttcaagaccagcctgggcaacatagcaagaccccatctccagaaaaagtaaaaaaaaaaaaaattaactggttatggtggtgcatacctgtagtcccarctactgaggaggctgaggcaggagggtggcttgagcctaggaggtcgaggttacagtgaactatggtggcaccactgcactccagcctgggtgatgagac

SEQ ID NO: 33037 - DNA, 201 bp, Homo sapiens
actactgaggaggctgaggcaggagggtggcttgagcctaggaggtcgaggttacagtgaactatggtggcaccactgcactccagcctgggtgatgagaycctgtctttaaaaggaaacaacaacccatcttacatttcctagtttgtgactttttttttcctcactaatgaatatctttctatgtaaaaaatacacttt

SEQ ID NO: 33038 - DNA, 201 bp, Homo sapiens
gacagagtttcaccatgttggctgggctggtctcaaactcttggccttgagtgatccacccgccctggcctcccaaagtgctgggattacaggtgtgatcygctgcgccctgcctgatcaattttaactgtaggaacgaattgcacatttacttactggtagctagttttcctcttttaaaaccttatgtccgttatcagc

SEQ ID NO: 33039 - DNA, 201 bp, Homo sapiens
gagacccatcagtggactccaaaagccatgcctatctttgggacaagcagccaggtttagaaccctagtccttggatttctggccccgtgtgctttttgcyacagtatgaagtctggctcattgtagagagtccctttgtgacttggccttacttgggtcttaaaaaacaaaccaactggcatcccttacagtttacatgc

SEQ ID NO: 33040 - DNA, 201 bp, Homo sapiens
ttgctttttaaaaaatagactttatttattagagcagttttagggtcacagcaaaatggagcggaaagaatagagagttcccacataccccaggccctcaygtgcacacagatgcccaagcttttttattttacttatatgagtgcactatgaatatgttcttaatgtagagagtcagtcaagtcagccatgtgttaagaa

SEQ ID NO: 33041 - DNA, 201 bp, Homo sapiens
cagctcttaacaggatgaagtaagtttgtccttagattccacccgggagagctagctgagaaagtgcagtaagtggaagaaaaagacaaccacagattagkgtgttttggtcccattttcattcaaagaaactttctctgtatgtgttgctatatgcatagaagaaagccagtttggacaccaaactctttaacagtgcaa

SEQ ID NO: 33042 - DNA, 201 bp, Homo sapiens
gaatgactggccaaagagcactttgagaaatctgtaaaagctatagttctccctgggaaaatatcttttatacaatttcaggacattcatagacctagagraatgtttcttaaccttgttatcattatcactccctgcaaggatcctttggacacattttatatcctaatccctgtcttgtgaaattttaatatcacaaat

SEQ ID NO: 33043 - DNA, 201 bp, Homo sapiens
cccactagcttctttaggagagaaatcacttgattatgtaaatcctaaaatgtctctccttttctccttacagattttctgaatggtcttgcttctttgtytatcttgtctgattttctcctgtctgaccttttcctggttaaaaatctgggggaaaatgacggactccaagccgatcaccaagagtaaatcagaagcaaa

SEQ ID NO: 33044 - DNA, 201 bp, Homo sapiens
gcccccactcatcagactggtgattaaaaaacttactcactggctgggcacggtggctcatgcctgtaatcccagcactcgggaggccaagactggaggaycacttaagcccaggaatttgaggccagcctgggcaacatgtgagaccctgtctctacaaaaaatagacacacaaaaaaaagagccacgatgttggcgcac

SEQ ID NO: 33045 - DNA, 201 bp, Homo sapiens
tcctttacatttaaaccttatcagtagttccctaatgggttgtatttcacaccgaagactaaattttaaggagtgtgtcctgctgtgaaccacccaccacyctgaggcctgtgacagcagccccatgtccccagctcagccaagtcctcccatacttgtgatagtttctgcagagctgagaagcccacattgacagaggga

SEQ ID NO: 33046 - DNA, 201 bp, Homo sapiens
tcctgaatgcagtttcagaaatgaaaactttaaaaatcaaaattccagcttggttcaagacattggttggtgctcaatgtgtgtgcatatatatatatatmtatatatatatatttttttcattttttcagcacacaggtttttttttttcatttgttttgttttgtttttttgagacaggatctcacttggttgcccagg

SEQ ID NO: 33047 - DNA, 201 bp, Homo sapiens
aggctggtctcaaactcctgacctcagatgatctgcccacctcaacttcccaaagtgctaggattacaggcatgagccactgcacctggcctgtaccacaytttctttatccaatcatctgttgatggacatttaggttgattccaaatcttggctattgtgaatagtgctacaataaacatgggagtacagatactcttc

SEQ ID NO: 33048 - DNA, 201 bp, Homo sapiens
cttctgtctgtttgtataattttagggggctcaatcttttttttttttctttgagatggagtctcgccctttcacccaggctggagtgcagtggtgcgatsttggctcactgcaacctccacctcccaggttcaagcgattctcctgcctcagcctcccgagtagctgggattataggtgcctgccaccacacccagctaa

SEQ ID NO: 33049 - DNA, 201 bp, Homo sapiens
tgtagagatcgggtctcattatgttgcccaggctggtctccaactcctaggctcaagcgatctgcctgcttcagcctcccaaagttctgggattacaggcmtggacactggcatttttgaggagctcaggcagaatgtccctcattggatttctctgattgtttcttcctggttcgattcctgctacacattttggcagaa

SEQ ID NO: 33050 - DNA, 201 bp, Homo sapiens
ggatgatggctcgttcccaggttcctaggaggatggaggaccaggtatggtaacagcccaggcacttgggtcgctccatctctcacttctacatacctctycccaaatccttcatcccttagttcaggagccctaatcccagtgagaggtgccatgtccacccactcttaccaaaattgtacttagagggagacgggccgt

SEQ ID NO: 33051 - DNA, 201 bp, Homo sapiens
tattgctgttagtgagagtccagtagggggatcaactgtcctcgttttcctggcaccggtttctcaggttgaaggacttctcagtgctaaaatggggaccrccccaaggaaactgggacaagtcactcacccgtgagaccagcgggttaactctcatacccagcttccagacccacagctgacttttcatggcctatggat

SEQ ID NO: 33052 - DNA, 201 bp, Homo sapiens
gtccttccccgttacctgctgacagcacacaggatgctgcaagacatgaaagcttactcggccaggcacagtggctcatgcctgtaatcccagcactttgrgaggccaaggcgggcagatcacttgaagccaggagttcaagaccagcctggccaacatgacgaaaccccgtgtctactaaaaatactgaaattagccggg

SEQ ID NO: 33053 - DNA, 201 bp, Homo sapiens
gcagtgggattacaggcatgaaccaccatgcctggctggttctttctctactaatcattaactattatagtcaataattataacaataataactaatcacrttcattgtagttaacatttattgatcagtgaccatgtgcattacatggattgtctcatttcaattctcgaacaccctcatgaagtcagggctatttcccc

SEQ ID NO: 33054 - DNA, 201 bp, Homo sapiens
ctcatgaagtcagggctatttccccattttccatatgaggaaactgaggcccagagttctcaagtcacttggccaagattagccaggcagtaaaccctggygctgattcaatgcactggctgtgtcagtcagagccctctcttaactcttctttttttttttttttggagacagagtcttgctctgtcgcccagcctggag

SEQ ID NO: 33055 - DNA, 201 bp, Homo sapiens
ggcaacagagcaagaccctgtctcttaaaaaaaaagtataagtaatcccctataagtagcggatattcaggctgtttctctctgttttttttttttttttkggggggggctattatcaacagcacagtgaggagtacccctgtagctgaatctctgcctccatcctttattttcttaggatatgtttacctggtccataaa

SEQ ID NO: 33056 - DNA, 201 bp, Homo sapiens
atttattgaccatttgtatatcttcattggagcaatgtctatccaagtcttttgtccacttaaaaattgggttgtctttttgttgttgagttttaggagtwctttatacattctgggcactagactcttattagatatatggtttgcaagtggtcctcccattctgtaggttatcttttcactttcttgatagcatcctat

SEQ ID NO: 33057 - DNA, 201 bp, Homo sapiens
cagcaactctgttgatgtatgcatgaatttggaaaatgatccatgtgcctttcccttcaaggaacatggtggtggctttgaaggaactgtccatccgaggygactttaggactaccgtggaatacctcattaacctcctggagaccgagagcttccagaacaacgacatcgacaccgggtggttggactacctcattgctg

SEQ ID NO: 33058 - DNA, 201 bp, Homo sapiens
agtacttggattgtttagttctgggaaatattgagaacttttccacttcctttaaaaacattgtgttgaaatttaaaaagaaaaagctttatggcagggcrcagtgtctcacgcctgtaatcctagcactttgggaggcagaggtgggcggatcacttgaggtcaggagttagacaccagcctagccaacatggtgaaacc

SEQ ID NO: 33059 - DNA, 201 bp, Homo sapiens
acattgcccaatgtcccagggttaggagtagaataatcacccccagttgagaactgctgcaagaggcaaaggaactatcaaaaagaaaataaaaggataawcttttttttttttgagacagagtcttgctctgtcatccaggctatcacccaggctagagtgcagtggtatgatcacagctcactgcagcctggacttcct

SEQ ID NO: 33060 - DNA, 201 bp, Homo sapiens
tcagggttgaaaactcgtgcctagcttggggtcagcagactgctattataaacggccagacagtaaatatttttggctttgtggccatgtggtctctgttrtaactactcaactctgctgtttcctgcaccagaagccatagttatgtaattgaacaggcctggctgtgtttcaatcagacattatttatagatggggaaa

SEQ ID NO: 33061 - DNA, 201 bp, Homo sapiens
accattgacatctgactgtgcttgtaccttctttaacaccattctctccatctgtccatctctctgtgaatgcatgttattattttgtcacatttcagagyaaattgcagacattaatacatttctccagagttatttttgcatttcaaaaccagttgtttgttttgtaaatcacttcctgagcttttttgcagctgagag

SEQ ID NO: 33062 - DNA, 201 bp, Homo sapiens; identical to SEQ ID NO: 6165

SEQ ID NO: 33063 - DNA, 201 bp, Homo sapiens
cccgtcacctggaagttcagatcctcgctgaccagtatgggaatgctgtgtctctgtttggtcgcgactgctccatccagcggcggcatcagaagatcgtkgaggaagcaccggccaccatcgccccgctggccatattcgagttcatggagcaggtacacttctcagagcccagggggcagcttcagagagagccgtctc

SEQ ID NO: 33064 - DNA, 201 bp, Homo sapiens
tatgtggaggaatggacagcagggagggggctgggagatagagaaggagagtagctggaaaatggcagaaaagtttgttaatttacaggcaggctgaagcrggaggatcgtttgagcccaggagtttgaggctgcagtgagctatgattgtgccagtgtaccccagcctgagcaacagagcaagaccctatctctcttaag

SEQ ID NO: 33065 - DNA, 201 bp, Homo sapiens
caaggggtctgagagcccacaggccagggcattccccatcatttttacagagagagctgtggaatagttaagagcacaacacgctggtggctgaggctggrggctggtgtgctggcttctccacctagccatcatgtgacttggggccaagttctgtgattttctgtgcctcagtttcctctgaaatgaagtcatcgtgtt

SEQ ID NO: 33066 - DNA, 201 bp, Homo sapiens
caggatctgttccgagcctccccagcttctggtgctgctggcagtccctggtgatttttggcttgtggatgccttgccccagtctctgtctctgttttttkttgttgttgttgttgttgttgttttttcaaacggagcctcactctgtcacccaggctggagtgcagtggctcaaccttggctcactgcaacctccatctc

SEQ ID NO: 33067 - DNA, 201 bp, Homo sapiens
ggattacaggcatgcaccaccatgcccagctaatttttgtatttttaatagagacagggtttcaccatgttgtccaggctggtcttgaactcctgacctcrtgatctgccctccttggcctcccaaagtgctgggattacaggtgtgagccactgcgcccggcctcctaaaatgttttctaggagcttgggggaaagagga

SEQ ID NO: 33068 - DNA, 201 bp, Homo sapiens
gcttctggtgctgctggcagtccctggtgatttttggcttgtggatgccttgccccagtctctgtctctgtttttttttgttgttgttgttgttgttgttktttcaaacggagcctcactctgtcacccaggctggagtgcagtggctcaaccttggctcactgcaacctccatctcccaggttcaagcaattcttctgtc

SEQ ID NO: 33069 - DNA, 201 bp, Homo sapiens
acctggttggtggggattcagagctgaacgggacatgactcccagctctgtggcctgcgaggtgtgtgaccaggtgcctgctgcctgtgcatctgggctcyggcatccacccagttagtgcggcagtgacctactaagctcctccgtaccaggcgctgtgctgggtgttgggatagcattctgggtgtgactcgtggagct

SEQ ID NO: 33070 - DNA, 201 bp, Homo sapiens
tttgcttttctgcaaaaatgaaggcaaattgtatgtggataattttatagttgaggaagtggagagacgggatttacttaaggtcatccgtgaggggaagkgtaagttcaagcccatggatggcacagtctttctaccacgctgctggccacatgcatgcggattttcttgttgattttgtgtgtgtattgttcattgacc

SEQ ID NO: 33071 - DNA, 201 bp, Homo sapiens
ctccttcagtggaagcaaatgctggccgaaggtcagctctctagagccaatgttggttggcttccagctttatcaaaaagaattaaaatagccacttgccyggagattgggcctgaaacaaggccagtccggcagctttgtgtgttcgcttgcctagcctgcggtaatgggcttgtggcctgcctgatggaggggctctgt

SEQ ID NO: 33072 - DNA, 201 bp, Homo sapiens
caaactcctgaactcaggtgattcacctgcctcggcctcccatagtgctgggattacaggcgtgagccactgcacccggccctgaggtccagtttctcatrtgtaagtcaaggtccaaaccagtagacacaggaagcttggaagaaacagaaaccacgctggagaagagaagtttaaaaagctctcattaatatcatcgtt

SEQ ID NO: 33073 - DNA, 201 bp, Homo sapiens
acggccttagacaatacaaacagcccatcctgatctatatcccgccctatgcggagctccggggaggctcctgggtggtcatagatgccaccatcaaccckctgtgcatagaaatgtatgcagacaaagagagcaggtgggtgtgttgcccttagcctggcttagccttttcttgttctcccagccttgagagcccatgac

SEQ ID NO: 33074 - DNA, 201 bp, Homo sapiens
tcagcacacatttcctgtgctgggttaatgaggcagggcctgcccacccattccctgcagcctcacataaatgcttgtgagacagactgggagatcgagtracttcacttggtgagtgtagttagaagaccgcccttggccctgggctgtggggacccacatggagaagctatgatcagattgtgtaggggaaaaccctca

SEQ ID NO: 33075 - DNA, 201 bp, Homo sapiens
cagaaataaattgggggagatgtgtgattctctctcactctctgttttccctcctttctggtccagatcatgtttcactccttcggcaacaagcaagggcsccagcacgggatgctgatcaatactccctacgtcaccaaggatctgctccaggccaagcgattccaggcccagaccctgggaaccacctacatctatgac

SEQ ID NO: 33076 - DNA, 201 bp, Homo sapiens
tcaactctgaaagtgctgagattataggcgtgagccactgtgcctggtaagaaatgtttttagtgtttggttatgcttttgaacggtagtagaatcacagyccctgctctggtttctttcataagccgaaggcaggatcccatatgtgaaatttttccaagagaccgttatggattttgctcctgaaaagcctttgtaaga

SEQ ID NO: 33077 - DNA, 201 bp, Homo sapiens
tgtgagctgggcctttgctgagacagaatagtgggcccgggtctgtttccaggggctctgaggctggttttgttctctgtctctgcaccacgtgtagattwctggcatcttccctggtttactactggagtccctggggcttattccggttgctctcctctgtcagaagtgcctagttgccctttgtgggccatccaaggt

SEQ ID NO: 33078 - DNA, 201 bp, Homo sapiens
  misc_feature (1)...(201): n = A,T,C or G, or insertion/deletion polymorphism (see Tables 1-2)
atgctttcacaatcatcctcctttgcccctaatgcctcttggctacctttggggacctagctgcccccaacttgattttaaatgtcacatatgcacaatgnagaaaatttcaaaatttcaagcgagcataaaaaatcaggaaaacaaatccatcatgtgctaatgcctagaggtaatcctggtaaacattttagcaaatct

SEQ ID NO: 33079 - DNA, 201 bp, Homo sapiens
cattttatttcattttgatcaatttaaatagctgtgtgtggttaggggtcaccgtatcagacagggcagatctaaagtgttccattgcaaggttgttggcytgctaattttgttctaatttttgttgttattacaaataatgctgcaatacacattcctctatttcttgctgccttgtgtcataaactgtgaattttatag

SEQ ID NO: 33080 - DNA, 201 bp, Homo sapiens
agcaatctttgttaaccatgttatttccagataggaatccaagctcaataaagtggcctgaagaataggcttttgcctctactgtggtttggctccaaatygggttgccattggtcaaaacataacttccatttggtcccagcaggttcctggactcttccctgctgtggggggtgggtccctcgccactctccagaattc

SEQ ID NO: 33081 - DNA, 201 bp, Homo sapiens
gtttcaaaatgactttcccttcagggttaaaacaaatgcaactttcttatcatgttggctcaggtacactggaccccttctgattggttgctattgttttytggaaaactggtcagtttcaaagttcagactgattgcgaggcagttggccaggagtgatccgtcgttttggtttggtctgtaggggctaagcacaggagc

SEQ ID NO: 33082 - DNA, 201 bp, Homo sapiens
gctgcaatacacattcctctatttcttgctgccttgtgtcataaactgtgaattttataggttgaaggccctttagggtgtgtgttttctgagagaaaacygaactgaagtaccagatggggcaggcgctcttcctggagggagatgtagtgctggggccagggcttggctgtgtctctctcacgtgtcccaaagctcttg

SEQ ID NO: 33083 - DNA, 201 bp, Homo sapiens
ccagcctgggtgacagagtgagaccctgtctaaaaaaaaaacaaaaaaaaaaaaaaagaaagaaaagaaaatgtatgttggaaatgggaggacagctcacrcaagactacactgggctctcaaggtgcttttgtgagatttaaagcgatcagaaacagtgcccctcctctaggagggcagaaattagcaaagttagagagg

SEQ ID NO: 33084 - DNA, 201 bp, Homo sapiens
cagtctgcatttggtgaaggaactgatagtcaccatttacagttccctgaaaagacctctggaacccccttggcctctttctgtttcttcacagtgtgccrtccgcctggccaagaccgtgggctatgtgagtgcagggacagtggaatacctctatagtcaggatggcagcttccacttcttggagctgaatcctcgctt

SEQ ID NO: 33085 - DNA, 201 bp, Homo sapiens
cttcaaggggctgtctccttcctgcagtgcccagagcatcccagagttctcacaactgtgttcctgttttgggagttcgcactgggttccctctgaactgraacactctctttctcccaacccctgaacccagacctcccaccagggccagcttcacaggcatgccctgtgcttcaagggaccccgtgcttgttttgacgc

SEQ ID NO: 33086 - DNA, 201 bp, Homo sapiens
ccacctacatgaaggaagaggttgacaggtgcgtgggggtgcgagtcccactgtgggctgggcatgcacagctctctgtcctaggcatggaaaacacagcrctggcctgtgtgcaggtccaagggtcttagagaaggtgcctttctggtaaattctgggggtgtgcagagaagttaatctcttggttggaattctgtgcaa

SEQ ID NO: 33087 - DNA, 201 bp, Homo sapiens
tcacttcctcaaagggccttccctgtccctttctcacatttaaaaaatctaccccccaattaccttcagtatctttatcaatcactctgattagttgtctytgcaacatttaattatttcttgagattatgtctgtttttgtttgtttgtttgtttgtttgttttgacacagtttcactctgtcacccaggctggagtgct

SEQ ID NO: 33088 - DNA, 201 bp, Homo sapiens
tcccactgtgggctgggcatgcacagctctctgtcctaggcatggaaaacacagcactggcctgtgtgcaggtccaagggtcttagagaaggtgcctttcyggtaaattctgggggtgtgcagagaagttaatctcttggttggaattctgtgcaactggcagatatttaggggaggatcctaggaggcccttttctagta

SEQ ID NO: 33089 - DNA, 201 bp, Homo sapiens
tggtgactgactatatgataataatactagaatgatgatgatgatgacagaagcaacaattccctttcatttataaagtggaatataattaagagtctttaaaaaaaaaaaataacagctttggctgggcgcggtgggtcacgtctgtaatcctagcactttgggaagccaaggtcaggagttagagagcaacctggtcaa

SEQ ID NO: 33090 - DNA, 201 bp, Homo sapiens
atgtgatgaatgagtgtgggaatggatgaacgaatggatgaatgaatggatgaatgaatgaatggattaattaattaattaacaggtgaataggcattttrtagttgttgctctttagcagcagtaaatttttgttttcataaaattctttctccttgtatcttgtgactttggagactagttctggggtgaaactccaat

SEQ ID NO: 33091 - DNA, 201 bp, Homo sapiens
ggggaggatcctaggaggcccttttctagtaacctggttggtggggattcagagctgaacgggacatgactcccagctctgtggcctgcgaggtgtgtgaycaggtgcctgctgcctgtgcatctgggctccggcatccacccagttagtgcggcagtgacctactaagctcctccgtaccaggcgctgtgctgggtgttg

SEQ ID NO: 33092 - DNA, 201 bp, Homo sapiens
aaatttttcttctgtctttgataggatcatgcaaactcagcctttctctcctttctcccagctggcaagggctggctgagaatatgaatccaacaacctcrttaagctctctcctcccatctcctcccctttgggttgatctcagggcagggattagaacttggcctttccttggacttggaaacagtccctgaggtttgg

SEQ ID NO: 33093 - DNA, 201 bp, Homo sapiens
gcatatgctaccacgcccagctatttttttttttttattttttgtagaggcagggtctcactgtgttgcccaagcttgtcttgaactcctggcctcaagcsatcctcccacctcggcctcccaaagaaagcatcacagccttggccaggcacagtggctcacgtctgtaatcccagcactttgggaggctgaggcgggcgg

SEQ ID NO: 33094 - DNA, 201 bp, Homo sapiens
tggcctttccttggacttggaaacagtccctgaggtttggaaatcccatgcaacacttagaaacagagctaatgagaacattacatgatgtggcaaaatcrctgcttacatgctctgaaatgagcacggttacaagaacctcctgttctgtgtgatcccattttgttggacaaacagcatgtggttagtagtgcatagtgg

SEQ ID NO: 33095 - DNA, 201 bp, Homo sapiens
atgtggctccacggcccaagtgctctggctggtgcaggtgcactcgtgacctccactggttcagtgagacaggtggactcaaggctggtagcgcttctccygcctccacctgcagacagagctcgtcgcagcagccaccgtgatggtgcagaaacacaaggaagccgcgccctgctttactcagatccctctctgtggctc

SEQ ID NO: 33096 - DNA, 201 bp, Homo sapiens
tagtaattatttatcctattctgctgctgaaatattaatatgataatgtggaacagaaagttttaccttcctaaaaacaataatttccaagttccaaaacrtatcaggccctgggaatttcagataagggattatggactatatataacatgcttagaatagttcctggcatatagtaagcacaaaaaatgcttctgctta

SEQ ID NO: 33097 - DNA, 201 bp, Homo sapiens
tttttttttttttttgagagtgagtcttgctctgttgcccaggctggagtacagtggtgcgatcttggctcacagcaacctctgcctcacggttcgaacamttctcctgcctcagcctcctgagtagctgggactacaggcgtgtgccacgacgcccagctaattttttgtgtatttagtagagatggggtttcaccgtgt

SEQ ID NO: 33098 - DNA, 201 bp, Homo sapiens
attatggactatatataacatgcttagaatagttcctggcatatagtaagcacaaaaaatgcttctgcttagtaaatgtgcctaataaatgtgtgtgtgtrtatgcgtatgtgtttgtatgtgtgtgtcttagagggactgtaaagagtgtctccaaatagtaaataatcattttatgtggtatgattatgagtgatttaa

SEQ ID NO: 33099 - DNA, 201 bp, Homo sapiens
gtgctgatcagaggtattattgacaagcaccacagactgagtcagagacttggctttcttttttaggataatcacagccctgtccctatcatcacacccaytgaccccattgacagagaaattgaattcctcccatccagagctccctacgacccccggtggatgcttgcaggaaggcctcacccaagtaagttctaaagt

SEQ ID NO: 33100 - DNA, 201 bp, Homo sapiens
atagtaaataatcattttatgtggtatgattatgagtgatttaaattttcttctgcattttctaactttctgctctaaatgtcattttataatgcattttracaatgtataataataaaacagtataaaaatattgggagaaagagtaaaccaatcatctcacttcctagataggaagctgaagcccagagacattccagg

SEQ ID NO: 33101 - DNA, 201 bp, Homo sapiens
ccgtgttctggtaggactgacagtctgtgggttggatctcttgattttagatcgccatgggcgtgccactgcaccggctgaaggatatccggcttctgtayggagagtcaccatggggagtgactcccatttcttttgaaaccccctcaaaccctcccctcgcccgaggccacgtcattgccgccagaatcaccagcgaaa

SEQ ID NO: 33102 - DNA, 201 bp, Homo sapiens
tacaggcatgcgccaccacgcccggctaatttttgtgtttttagtagagacgtggtttcaccatgttagccaggctggtcttgaattcctgacctcaggtratccaccagcctcggcctcccaaagtgctgggattatagacatgagccaccacgcccggcctggcaacttttttttgtaaagggctccagatagtaaaga

SEQ ID NO: 33103 - DNA, 201 bp, Homo sapiens
cagggtgcggtccccacgatgtgcgtttccccccaccctcctatgtgtcccctaccgtgctcagccctcaccatgcacagtcccaccgtgctgccggcccstgcccgagcctctgccttctgccctgggaggttggctcacgccagcgcccccatccctccccctgcagatcctgattgcctcccacctcccctcctacga

SEQ ID NO: 33104 - DNA, 201 bp, Homo sapiens
acaccgcatgtgctcactcataagtgggagctgaacattgagaacacatgggcagagggagggtaacaacgcacaccggggcctgtcggggggtgggggcygaggggagggaacttagaggacaggtcggtaggtgcagcaaaccaccatggcacatatatacctgtgtaacaagcctgcacgttctgcacatgtatcctg

SEQ ID NO: 33105 - DNA, 201 bp, Homo sapiens
ttacgtggcagccaacagtggcgcccgtattggcatggcagaggagatcaaacacatgttccacgtggcttgggtggacccagaagacccccacaaagtaygtcgtgaaactggcggggcagggtgattctgctcagctactactgtattttcagtgggagtgctagcacctgcaagaggtgaaaaaaatctcacttatgt

SEQ ID NO: 33106 - DNA, 201 bp, Homo sapiens
ggtgtgttgcccttagcctggcttagccttttcttgttctcccagccttgagagcccatgaccttgggagatcatggagggatgcagtggctggaacctgwaagtggtggagaaatgttgtctcttctttcatggtttccacttccccttcccaaggaagtttgcaatcaaaaaataaaaaggaaagaccaaaagcacttg

SEQ ID NO: 33107 - DNA, 201 bp, Homo sapiens
ctgcagaccctgccaacctggattctgaggccaaggtgagggggccgggagctgtggctgctggtttagccagcggtactgtcgagagtgggtcctgggcrtgggggtcccatccctgccctgccaacttaggtggagaagcaggggacccagtgcagtccctggccctggggggctcagtgcctgtttctctgacacttt

SEQ ID NO: 33108 - DNA, 201 bp, Homo sapiens
ctcacacgagcctgtgtttgtgtcggttgaggtagaagtgggtgccaggtttttatgggggacattttttcaactatggccagtctggagtcctggtgacrtcctgcctctgagcaggtgccttctcctccctgagcctcagcttacttgcctgggatgatctgggaatgatctcagagcctgggcccagccccgggcagc

SEQ ID NO: 33109 - DNA, 201 bp, Homo sapiens
caccgtgcccggccaagtcatctcttaaaaggggagaaaagcctgcagggctaggggtggggatgggtgtgggtggaggggtagagggtgggcaggaaacrgagtgttctctgctgggagaacagcaccccagcactgtgcgtcatgcacagtaggtatttgtagaatgaatgagtagacgaatgagcacatttagtctgt

SEQ ID NO: 33110 - DNA, 201 bp, Homo sapiens
ctaggggtggggatgggtgtgggtggaggggtagagggtgggcaggaaacagagtgttctctgctgggagaacagcaccccagcactgtgcgtcatgcacrgtaggtatttgtagaatgaatgagtagacgaatgagcacatttagtctgtgttgccctctagggagctttttatttttccatgtgtttacctaagactga

SEQ ID NO: 33111 - DNA, 201 bp, Homo sapiens
ctgagagaatgtccgtgtgtttctgccttgtcaggtttacgtgcggaggggctacatcgcctatgagttaaacagcctgcagcaccggcagctcccggacrgcacctgcgtggtagaattccagttcatgctgccgtcctcccacccaaaccggtatggagtgggacacacccagggacggcctgtgtttctgttcttcct

SEQ ID NO: 33112 - DNA, 201 bp, Homo sapiens
gcttgagcccacccacccagctcctgagatcttatggggaagctgcttatcactagcttcaggtgttttctatctatcaggagattgcctttccctggagscagctgtgaccaatattaattttagagagacactttagcaactgcctaactatcacctgatggttgccttcctctcctgccctgctcatgtctgcttaac

SEQ ID NO: 33113 - DNA, 201 bp, Homo sapiens
tctagattatatgtatagtctttttattttgaagtcatctaggacccaccgtaagttataagatactacagagaatttccaagtacccttcacccagcttyccctatggtacttacataaccgtagtacattatcgaaaccaggaaactgacattggcacaatattgttaactcagtacagaccttattttgaatttcacc

SEQ ID NO: 33114 - DNA, 201 bp, Homo sapiens
ccccactatgaggtaatgtgcattttctccttgtaactgaggagtgcagagttcaggtggggtccacacccttcccaacctgtgcccaccttgatcaagcygtttgctgatgccaaagcttcaagggtggctatgcacaaaaggagaagacacgagccttctcagaagtttccttccttccttctttccttctttccttcc

SEQ ID NO: 33115 - DNA, 201 bp, Homo sapiens
caggcatggtggctcacacctgtaattccagcactttgggaggatgaggcaggaggatcgcttgaggccaggagttcaagaccagcctgggcaatatagtragacctcatctctaaaaaaaaaattaagaatttgccagacattgtggtgcatacctatagttctagctacttgagaggctgaagcaggagggtcacttga

SEQ ID NO: 33116 - DNA, 201 bp, Homo sapiens
catgtgacatgctttgcttcccccacctgcattttcattgaggactgggcagaaataaattgggggagatgtgtgattctctctcactctctgttttcccycctttctggtccagatcatgtttcactccttcggcaacaagcaagggccccagcacgggatgctgatcaatactccctacgtcaccaaggatctgctcca

SEQ ID NO: 33117 - DNA, 201 bp, Homo sapiens
cacacctgtaattccagcactttgggaggatgaggcaggaggatcgcttgaggccaggagttcaagaccagcctgggcaatatagtgagacctcatctctaaaaaaaaaattaagaatttgccagacattgtggtgcatacctatagttctagctacttgagaggctgaagcaggagggtcacttgagcccagaagtttgt

SEQ ID NO: 33118 - DNA, 201 bp, Homo sapiens
ttttaaaaattgtggttaaatacacataacaaaatttaccatcttagccatttttaaatgttctcttgagcagtattaaatccattcacattgttgcacarccatcaccatcatccatctccagcacttgcaaaactgaaacttgacactcgttaaatggtaactcctgagtccctcctccctccagcccctggcaaccat

SEQ ID NO: 33119 - DNA, 201 bp, Homo sapiens
cagaacttcagtttatggctgttattaatacggtatttacatgagatgtgttaatgtgtcattgacatgttactaacatgttattaacatccatccctacratgttcacattaagaaaaaaaaaacagtggctttcagtgcagggaactggattcgtagcctcactaaagtattttttaagggatttaaatacctgtacct

SEQ ID NO: 33120 - DNA, 201 bp, Homo sapiens
gtttcaccatgttggccagtctggtcttgaactcctgacctcaagtgatccacccgccttggcctcccaaagtgctggaattacaggcatgagccatcacrtctagcctacttaactatctttcatagggaaaatgaaaccaaaatgttgagtgaatttcctgccctcgtgtcttcatggcatagaaacctaacattgtag

SEQ ID NO: 33121 - DNA, 201 bp, Homo sapiens
tccactgatggacacttggattgtttctacctgttggctactgtgaataaggcagctatgaacatgagtgtacgattttcttagtttttacctattgtccrggatcccatccaggttagcacattgcatatagttgtcaggtctctttcaaccgccctttaaaaaattgtgctcacctccacccacgtgcaaacacacacc

SEQ ID NO: 33122 - DNA, 201 bp, Homo sapiens
tgaggtgggagaatcacttaagcccaggaggcagaggttgcagtgagctgagattgccccactgcatcccagcctgggtgacacaggcagaccctgtctcaaaaaaaaaaaaaaaaaaaaaatgaatgaggaggctgcaccagactcctgagatgtgacctgtggccctaaagctcactgacatacagttagttattttgt

SEQ ID NO: 33123 - DNA, 201 bp, Homo sapiens
ggatcccatccaggttagcacattgcatatagttgtcaggtctctttcaaccgccctttaaaaaattgtgctcacctccacccacgtgcaaacacacaccrtacctcacaaagatgatctcactgattgtcttgttgctttattatttggcctccaggagactggaaacaccgtgagaacagggccttttggctttcttgc

SEQ ID NO: 33124 - DNA, 201 bp, Homo sapiens
gttgagaatttagaattttagcacccaggggcaatgcgggtggttctgctggcacctcctgagacactggcacttcctcaaggaacattcccagccccagratcaggggcttctgacagagaagactcatgtgtgcttgttgtttctaatgaactgtagtgagaatcccacatcaaagaatcttcagggagtcaagcctta

SEQ ID NO: 33125 - DNA, 201 bp, Homo sapiens
tccttagggagaccagggcaaggggtctgagagcccacaggccagggcattccccatcatttttacagagagagctgtggaatagttaagagcacaacacrctggtggctgaggctggaggctggtgtgctggcttctccacctagccatcatgtgacttggggccaagttctgtgattttctgtgcctcagtttcctctg

SEQ ID NO: 33126 - DNA, 201 bp, Homo sapiens
tcaggaccaccagggggtgcaccagagtgtctgtcatgtgaccctgagctcaggctcttgggggcacctccaatttagattcctcttaatttgtcaagctstgtcattaccgatgagtccctgaggtcaaggactactttcgatgtccactgttgtgatcctggggcttagcacagtgctcggagcatagtgggtgctcag

SEQ ID NO: 33127 - DNA, 201 bp, Homo sapiens
gtttgctggttacccattgactcttttgcacacatacaggcagggtagtaatacctcttccctggtgttcacaggtcaacacccaagcagttttgggtgtrggccatggaaggtggtgtcaaaagacaaaatcacagcaaatttgatttaaaactcgaattggcttttatttacaattctaggatcatgcagcacctcatt

SEQ ID NO: 33128 - DNA, 201 bp, Homo sapiens
taaaataattagtacatctgtccagtaaaaaaaaaatttaaaaatatcacatggtctcttttctccagagtattctattaattgtatttgttttctttttwaaaaaaattataattattatgggtacataataggtgtacatgtttatgggggtacatgtgatcttttggtataggcataccgtctaataatcaaatcagg

SEQ ID NO: 33129 - DNA, 201 bp, Homo sapiens
ccccatctctactaaaaaaaaaaaaaaatagaaaaattagctgggcgtggtggcaggtgcctgtaatcccagctcttcaggaggctgagttaggagaatcrcttgaacctgggaggcagaggttgcagtgagccaagaccacgccactgcactccagcctgggcgacagagtgagactctgactcgaaaaaaaaattatta

SEQ ID NO: 33130 - DNA, 201 bp, Homo sapiens
tatgggggtacatgtgatcttttggtataggcataccgtctaataatcaaatcagggtgattggggtatctattacctcaagcatttttcatttctttgcrctaggaacattccagttctactcttttggttagtttaaaatgtacagtcgattttaattgactgtagagtcaccctgttgtgctatcaatactatatctt

SEQ ID NO: 33131 - DNA, 201 bp, Homo sapiens
aatcccagctcttcaggaggctgagttaggagaatcgcttgaacctgggaggcagaggttgcagtgagccaagaccacgccactgcactccagcctgggcracagagtgagactctgactcgaaaaaaaaattattattattttttcttgataagttgctaaataatctgtatcctctggcaaatcttctaaccgtttgag

SEQ ID NO: 33132 - DNA, 201 bp, Homo sapiens
tgttcattgacctgggttttccctctgcaataccagtaagtaaaattgagcttctagtaagtctgagaggaagggcttaatgcatgagacagcaactaccrccatgcttgaactgtttcatcaaaaagcacaacaatggatgtttgtataaaggtggtgttgtgcttggaggtggatattaggttggtgcaaaagtaatcg

SEQ ID NO: 33133 - DNA, 201 bp, Homo sapiens
gcgcaggcgtgtagaccagtgcggagggtcagaagatctaccccgtgacagcagaggtcattattgagtaagaaatgagaaaatggtcggtcctctgttgkttttattttatttattttattttttcagacaaggtctcactctgtcacccagactcactgcagcctcgacctcctgggctcaagagatcctaccacctca

SEQ ID NO: 33134 - DNA, 201 bp, Homo sapiens
ctttgtaggtgtggtctcatgccatcttcaaaataccactgtgggggcactaagtggagagtgttgtacccatttcacaaaccactttaatggaaaaaaaraaaaacctcacacaaatttggaattgtcccagcaagtccaggacgtggggtccccctatttataataatatggacatactttgttgggggactacattgt

SEQ ID NO: 33135 - DNA, 201 bp, Homo sapiens
attctctctcactctctgttttccctcctttctggtccagatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggcaag

SEQ ID NO: 33136 - DNA, 201 bp, Homo sapiens
ggctgtgaacaccttcccagaaacttgaagaactgagaattttgtttatctgttttttttcttaaacctgttgttgaaatgttatttaatatatggtcagrgcatagctatccactgctgtcaggcatggctgcttaaacaggggcccagggtgtttatgttgtggccaagtacttggcacccccgggaagtgtggccctg

SEQ ID NO: 33137 - DNA, 201 bp, Homo sapiens
caaatgataacatgaaaagaaagttcctagaacactgtctggcactaagcaagtatcctataaacatcagctcatcatgtgaccttatgtttgatcccccmcaccatgctggctttctgatgcacagagagggggagtcagggtcttcctatgtagggaaactgagtattcccctgtggtcagggggccattccactctgg

SEQ ID NO: 33138 - DNA, 201 bp, Homo sapiens
acacacaaatttaattaatgtgtacactgggagaaccgcagagtgattacccagaagggaatttactggccagcatttacattatttttggttggtttgtkggctatgaaagtaggctacctttattattactgcgatgacttctaggtagtgttttggttctttgcatttattacattacttgaagaagcattcattcat

SEQ ID NO: 33139 - DNA, 201 bp, Homo sapiens
cctcagtctctcgagtagctgggactacaggtgtgcaccaccatgcccggctaatttttgtattattagtagagacagggtgtcaccatgttggccaggcyggcctcaaactcctgacctcaagcgcctgcctcagcctcccaaagtgctggtattacaggcatgagctaccaggcccggcctcattcgtttattctaact

SEQ ID NO: 33140 - DNA, 201 bp, Homo sapiens
cgtccggaaggcggggccctcctggggcggggtcggtgtgggggcggggcctgggtggggcctaggcgggcgcgatggcccgggactctggcgcgcagggygcatttcgggatggagcaagcgcagcgcgaagttgggcgcccgccggctgcagcagaaccccgcccgcggcgctctaggactgcatctcggcctccgggt

SEQ ID NO: 33141 - DNA, 201 bp, Homo sapiens
tggcccgggactctggcgcgcagggtgcatttcgggatggagcaagcgcagcgcgaagttgggcgcccgccggctgcagcagaaccccgcccgcggcgctstaggactgcatctcggcctccgggtcgcgacctggctgtcctgctgggtcccgggcctcgggtcggcttcaggcggttaaggggtgcatgctctgcaccc

SEQ ID NO: 33142 - DNA, 201 bp, Homo sapiens
tgttttagagtattttaaagccagcccccatcatgtcttttcatccataaatacgtaagggtagatctttaacagataatgactctcaccctcttcccccrgtttttaaaaacataactgaaatactaatattacacccaacagaatcagcaatatcattgaaacccagtgtggtttaacagttatctcaaaatacccttt

SEQ ID NO: 33143 - DNA, 201 bp, Homo sapiens
gggtatatacccagaggaatttaaaatcattcgaccataaagacgcatgaacacgaatgtttattgcagcactattcacagtagcaaaggcatggagtcawcctaaatgcccatcaataacagattggataaagaaaatgtggtacatatacaccatggaatactatgcagccatcaaaaatactgagattatgtcttttg

SEQ ID NO: 33144 - DNA, 201 bp, Homo sapiens
ggttgcagtgagccgagatggtgccacttcactccagcctgggtgacagagctagactctgtctcaaaaaaaaaaaaaaaaccaaccaaccaaacaaaaamcctcagcattatacatgtttgtctcttatttgagaggaatataagaggccatatgtgtaatgcatgttttaaaagtccagttaatagaggggcttccatt

SEQ ID NO: 33145 - DNA, 201 bp, Homo sapiens
agatatggaatcaacctaagtgtccaccaacagatgactagatacagaaaatttggtgtatatatatatataattttttatggctcagtagtattcttttktgtgtatgtgtgtgtgtggtgtgtgtgtgtgtgtatacctacatgtatacatgggtgttcctcttacaaaattaatagcttttttcttattgaaaataac

SEQ ID NO: 33146 - DNA, 201 bp, Homo sapiens
ggaatcaacctaagtgtccaccaacagatgactagatacagaaaatttggtgtatatatatatataattttttatggctcagtagtattcttttgtgtgtrtgtgtgtgtgtggtgtgtgtgtgtgtgtatacctacatgtatacatgggtgttcctcttacaaaattaatagcttttttcttattgaaaataacacatca

SEQ ID NO: 33147 - DNA, 201 bp, Homo sapiens
ctgccctctggtgggagggttccccaccatcatcatccacccacccacaaattggtgatttgggaaaccagaggacagtgtagttcaggccattctcggargttaggagttctatgggttggaatgttgttcagccaaagaaagaaagaatactgattcatgctcccacgtggatgaacctattgtgctaagggaaataag

SEQ ID NO: 33148 - DNA, 201 bp, Homo sapiens
ttccccgttccccccggggctccaggctgacctttactgtccaggcagaagactggaaaacttctccctggggaatctggccagcgagagagaaagacacraagatactgactcaggggatccccaacgcactcctacctcaccctacattgagctcagggtcaaccaggtccaccacagtctcagaaattctgttctcac

SEQ ID NO: 33149 - DNA, 201 bp, Homo sapiens
attcctctttttttttttttttttttttgagacctcccgaatagttgggattacaggtgtacaccaccattcccagctatttttttgtatttttttagtgragatgggttttcaccatgttggccaggctggtcttgaactcctgacctcaggtgatctgcctgcctcggcctcccagagtgctgggattacaggcatgag

SEQ ID NO: 33150 - DNA, 201 bp, Homo sapiens
caaccaaaacttcaccagccagagggaaacctctgttctcattgttctacttcttccttctagtgtgtttttctcctctggagtgaagttttactggctaktcttttaagcatctcctgtactctctcccaaattagaaaaatctagaggtggtcttccatacatgtccatgttagcagtgagcttggttttaaccctggt

SEQ ID NO: 33151 - DNA, 201 bp, Homo sapiens
ggctggagcgcagtggcacaatcttggctcactacaacatccgcctcctgggttcaagtgattctcctgcttcagcctctcaagtagctgggattacagaygcacaccaccatgcccggctaatttttgtatttttagtagagacggggtttcaccatgttggccaagctggtctctaactcctgaccttaagtgatcttc

SEQ ID NO: 33152 - DNA, 201 bp, Homo sapiens
cgttcatgaagaaggaagtagattagtggccgccaggggctgcagtgcagggaaaatggagagtgagcgctaatgactacaaggtttctttttagagtgaygaaaatgctttaaaattagatggtggtgatagttgcacaactttatgaatacactaccaaccactgaatgtacactttaaagggagatggtggaatatga

SEQ ID NO: 33153 - DNA, 201 bp, Homo sapiens
cactgcagccttgacttcctgggctcaagtgatccttctaccttagcctcctgagtagctaggactacaggcaggtgccaccatgcctagctaatttaaatttttttttttttttttttgagatggagtctgaccctgttgcccagtctggagtgcagtggtgcaatctcggctcactgcaacctccacctcctgggttca

SEQ ID NO: 33154 - DNA, 201 bp, Homo sapiens
aagcctgcaattgtaatgaccatgatcttttacaaacttacgcagtcttccttccccttgaagtcaagctgtgtgtcctcttagcaccgccccctttaccsccacccccatccaaagaaacacgggcttgagttggctgctggggagatgatgcccgccttggaaactctagctggccttggcgggaggggaggaaggagg

SEQ ID NO: 33155 - DNA, 201 bp, Homo sapiens
gcaatggggaggggctgtaaatacagatgaagcttcgctccctcacccactgcttacctcccactgttcagccagttcctaacaggccacggaccagtgcycgtttgggtactggtttggggaccctttctttaggggactgctgtgtgtcatctgaatcatcagcagtcagacctgtcttgttttcccatccagatagcc

SEQ ID NO: 33156 - DNA, 201 bp, Homo sapiens
actgcagccttgacttcctgggctcaagtgatccttctaccttagcctcctgagtagctaggactacaggcaggtgccaccatgcctagctaatttaaatttttttttttttttttttgagatggagtctgaccctgttgcccagtctggagtgcagtggtgcaatctcggctcactgcaacctccacctcctgggttcaa

SEQ ID NO: 33157 - DNA, 201 bp, Homo sapiens
ctcccaaagtgctgggattacaggcctgagccaccatgtctggcctataaatgtattaagttttgtgaagtgctgacaaatagtaaatacttgatagatayattagattgagacaatgggatgaaatagctttatgtatgataaaacactgcaaaaattgttattgtggcttttgggacaattgcaaaggaaagtggatga

SEQ ID NO: 33158 - DNA, 201 bp, Homo sapiens
ctcacaagattgcatacacttgttgtttaggactatggagatgtgtaattgctagaaaaaatcagcatcagtttcctctggtgtggagggacagagcaggwaacctgttttgttgttaaacatttaaaaaattgttttcagttttctaaagaaattttgtgggctgggcgtggtggctcatgcctgtattttggaaggccg

SEQ ID NO: 33159 - DNA, 201 bp, Homo sapiens
ggagagagattttagtgtggattccccacaaactgcaagtttcacagccaagggctaggaagggagtcctcctaaaacacatagactgctaaccttaagcycatcctttaagcttcagagaaacatctaggaaaaatgaaccattaataaattaactgaattttctagcaagttttctgtgctgaccataaatattaaagc

SEQ ID NO: 33160 - DNA, 201 bp, Homo sapiens
gtagaaaagtacatgaaagatattaataccatgtaacaagtcggaacgattagaatgtgtggacttcttccctgatcataaaactctcacccttgttatargttttttagtattattcaggttcctaaacaatgggcatgtaaagtaaaaattaacttaggattaaaaatctaaacatccaccttgggacaggtagaagaa

SEQ ID NO: 33161 - DNA, 201 bp, Homo sapiens
ctgctaaccttaagcccatcctttaagcttcagagaaacatctaggaaaaatgaaccattaataaattaactgaattttctagcaagttttctgtgctgamcataaatattaaagccctgtcctgtattgtgtaagtatgttttaaaatcacatttgtatcagagtcttttagcatcttggtctgttttgttgtgatttgg

SEQ ID NO: 33162 - DNA, 201 bp, Homo sapiens
tacaaaaatgtttaaaagtcggctgggcttggtagtgccctctgtggtcccagctacccaaggaggtcgaggctgcagcgagccacgattgcaccactgcrtactagcctaggtgacagaatgagatcccgtctcaaaaaaaaaaaaaaaaaaaaaaaaaaaaccgaaggtgcttcctgaccttgagcctccttgtaaatt

SEQ ID NO: 33163 - DNA, 201 bp, Homo sapiens
tcggttatgaaagagccctctggagttgggaggcatttgggatcttgtgctgaaggctcgggccatctaagaagccagaactcctgagaaggtgaggtcgsaaatgatgactgatttttcatggcatgagaacggggtcacagttcagagagtagagaaatgattgtggatcagagtgcagaagggcttgaaataaagttg

SEQ ID NO: 33164 - DNA, 201 bp, Homo sapiens
atttttggaagaacatccaggttaaaactttgttttaaaagaagcggctaggtgcgatggctcacacctataatcccagcactttgggaggccaaggcggrtggattgcttgagctcagaggttcgagaccagcctgggcaatatggtgaaaccctgtctacaaaatatacaaaaattagccaggcttggtggtggccacc

SEQ ID NO: 33165 - DNA, 201 bp, Homo sapiens
tgcctgcatgcaaatattggctgtagacctatcaggggttttcactcttggctacacattagaatttcctggtggggagatttttgaaaaatctggatgcyggggaccccacctctaccccctagacatgctgatgggaccccgacatcagaatcttataaagtttttcatgtcagggttgaaaactcgtgcctagcttgg

SEQ ID NO: 33166 - DNA, 201 bp, Homo sapiens
ctcagcctcctatgtagctaggaccacagtcatgcgctaccactcccggctaatttttttgatttttttgtaaagacaaggtctcaccttgttgcccaggytgctcttgaacttctgagctcaaatgatactcacgcctcagcctcccaaagtgctgggattattggtgtgagccaccatgcctggccttaatttttttgt

SEQ ID NO: 33167 - DNA, 201 bp, Homo sapiens
attgaacaggcctggctgtgtttcaatcagacattatttatagatggggaaattcaaagttcatataatttttatgtgtcacaaaacaggattcttttgattttttttttttttcgatgacttaaaaatgttggctgggcatggtggcttatgtctatagtcccagcactttagaagaccaagacaggagggttgcttgag

SEQ ID NO: 33168 - DNA, 201 bp, Homo sapiens
gatgatcctccttcagtggaagcaaatgctggccgaaggtcagctctctagagccaatgttggttggcttccagctttatcaaaaagaattaaaatagccmcttgcccggagattgggcctgaaacaaggccagtccggcagctttgtgtgttcgcttgcctagcctgcggtaatgggcttgtggcctgcctgatggaggg

SEQ ID NO: 33169 - DNA, 201 bp, Homo sapiens
tggaaggtcgaagctgcagtgagctgtgattgcaccactgtactccagcctgggtgacagagcaagactctgtctcaaaaaaaaaaatatatgtatgtgtrtatatatatatatatatatatatatatatatatttcagacaaacagccatccatccatccatccatttgatgatccattcatgtggatggcagactttga

SEQ ID NO: 33170 - DNA, 201 bp, Homo sapiens
cacctccctatactccgaggatgactgcaaggtaagcgtctaagcccagggagcaacctggggagcaggtgggccgtggcccccaggctttccagccctaycccttgcttctccctctcagagcctcagagaagagcccatccacattctgaatgtgtccatccagtgtgcagaccacctggaggatgaggcactggtgcc

SEQ ID NO: 33171 - DNA, 201 bp, Homo sapiens
gtaatcccagcactttgggaggctaaggtgggaggattgcttgagcccttgagtttgagagcagcctgggtaacataataagaccctgtctctacaaaaawtaaaaataaaaaaattaactgggtatagtggcacgcacctgtagtctcagctactcaggaagctgaggtgggaggatcgcttcagcccagggggtctagg

SEQ ID NO: 33172 - DNA, 201 bp, Homo sapiens
tccagcctgggcaacagggtgagattctgtctcaaaaaataaataaaagaaaaagtaagccagcaagtaaattttttagactttgcaggttggtgtggtckctgtcgtgaccactcaacactgcctttgtacaatgtaagggaatgggcatggctgtgttcccataaaactttgttgggagcccgaggtgggaggatcact

SEQ ID NO: 33173 - DNA, 201 bp, Homo sapiens
actattgaactgtacactcaaaaatggttaagatggtaaattttgtgtgtgttttttttttaccataatttaaaactctggattgtatttttgtttgtttstttgttttttgagacagggccttgctctgtcacccaggctggagcgcagtgacatgatcacgactcattgtagcctcgaccttctaggctcaagtgatcc

SEQ ID NO: 33174 - DNA, 201 bp, Homo sapiens
acttggacttggcttatagtagaaaggggtttggcaatttttttttttttttttttgagatggagtcttgctctgtcgcccaggctggggtgcaatggcayaatcttggctcactgcaacctccgcctcccgggttctatctatcttctatctatctttttttttttttttgaggcagagtctcactctatcccccaggct

SEQ ID NO: 33175 - DNA, 201 bp, Homo sapiens
ctttgtcatgccatgtgacatgctttgcttcccccacctgcattttcattgaggactgggcagaaataaattgggggagatgtgtgattctctctcactckctgttttccctcctttctggtccagatcatgtttcactccttcggcaacaagcaagggccccagcacgggatgctgatcaatactccctacgtcaccaag

SEQ ID NO: 33176 - DNA, 201 bp, Homo sapiens
gtagcctcgaccttctaggctcaagtgatcctcctgccttggcctcccaagtagctgggactataggcatgcaccaccattcctggctactttttttggatttttttttttttttttttttgtggagacaaagtctctgtgtgttgcccaaactggtcttgaattcttggcctcaagtgatcctcctgcctctgcctccca

SEQ ID NO: 33177 - DNA, 201 bp, Homo sapiens
gagatggagtcttgctctgtcgcccaggctggggtgcaatggcataatcttggctcactgcaacctccgcctcccgggttctatctatcttctatctatctttttttttttttttgaggcagagtctcactctatcccccaggctggagtgcagtggcacgatctctgttcactgcaacctccacctccagggttcaagca

SEQ ID NO: 33178 - DNA, 201 bp, Homo sapiens
cccaggctggagtgcagtggcacaatctcagctcactgcaacctctgccttccaggttcaaacaattctagtgcctcagcctcctgagtagctgggattayaggcgtgtgccaccacacgcagctcatttttgtctttttagtagagacagagtttcaccatgttggctgggctggtctcaaactcttggccttgagtgat

SEQ ID NO: 33179 - DNA, 201 bp, Homo sapiens
ttgggaattgggacattttcctggacctccttggtgatagaggctaaaaatgttgaaccaattacagtctcgggataaatgtgagattcattattcttctractttcttggtcccatttgttagaaaatagtgagttctctgcacctgatggtatttggtacctgagaggttttgaacaaagacttgtgaattgaatgatt

SEQ ID NO: 33180 - DNA, 201 bp, Homo sapiens
acaatctcagctcactgcaacctctgccttccaggttcaaacaattctagtgcctcagcctcctgagtagctgggattacaggcgtgtgccaccacacgcrgctcatttttgtctttttagtagagacagagtttcaccatgttggctgggctggtctcaaactcttggccttgagtgatccacccgccctggcctcccaa

SEQ ID NO: 33181 - DNA, 201 bp, Homo sapiens
cttggtgaatgtgatcctatccttttctcttcaaggtagctatgttaatagtcccatcttacagaggaaggaactgaggctcagagaggtcaagtgacttatgcaacgtcacacagctagaaagtggcagaaccaggttttgcattattgggtctgcctcattccagattccatgctagttaccactgctgtctcatgtca

SEQ ID NO: 33182 - DNA, 201 bp, Homo sapiens
cttcccttccattgccttcctgccttcctttcttccttccttcctcccctcttctgccctcccctccccttccatcccttcccctcccttccttcctcccktccttcctcctccccttcccttctttcctcccttcctccctccttccttcttttcctgacttctctgctttcctccccctccctttcttcctccttcttt

SEQ ID NO: 33183 - DNA, 201 bp, Homo sapiens
tcagagaggtcaagtgacttatgcaacgtcacacagctagaaagtggcagaaccaggttttgcattattgggtctgcctcattccagattccatgctagtyaccactgctgtctcatgtcattccagcctcttccaggcagggcacattaaatactaatccctgagagccaagtctgaggcacctcatctaaactttctga

SEQ ID NO: 33184 - DNA, 201 bp, Homo sapiens
ttccattgccttcctgccttcctttcttccttccttcctcccctcttctgccctcccctccccttccatcccttcccctcccttccttcctcccgtccttyctcctccccttcccttctttcctcccttcctccctccttccttcttttcctgacttctctgctttcctccccctccctttcttcctccttctttccttcc

SEQ ID NO: 33185 - DNA, 201 bp, Homo sapiens
gtgtgtgtatacctacatgtatacatgggtgttcctcttacaaaattaatagcttttttcttattgaaaataacacatcattgcagaacattttttaaaayatagcaaagagataacggctcttaatactttagcatttttttcccccagatcaggggtctgtctacaaatgatgtcccttgggttgcatctacctttttt

SEQ ID NO: 33186 - DNA, 201 bp, Homo sapiens
tttgtatttttagtagagatggggtttcaccatgttgtccatgctgctctcaaactcctgaactcaggtgattcacctgcctcggcctcccatagtgctgrgattacaggcgtgagccactgcacccggccctgaggtccagtttctcatatgtaagtcaaggtccaaaccagtagacacaggaagcttggaagaaacaga

SEQ ID NO: 33187 - DNA, 201 bp, Homo sapiens
ctctgcctcctgggttcaaatgattctccttcctcagcctccccagtagctgggcctacaggcgcccaccaccacacctggctaatttttgtattgttagyagagacagggtttcaccatgttggccaggctggtctggaactcctgacctcaagtgatctgcctgcctcagcctcccaataaatctgctgcccttttaga

SEQ ID NO: 33188 - DNA, 201 bp, Homo sapiens
aaatgcataaaccagtaggccagtgtaggaatttcaacatccagataataggacttcgggaaaaaatagagaaaaaaagaggcaaggacatcatcaaggargtatttgtttcttgttgttgttgttgttgtttgagatggagtctcactctattgcccaggctggagcgcagtggcacaatcttggctcactacaacatcc

SEQ ID NO: 33189 - DNA, 201 bp, Homo sapiens
tgtgccagcgcatgggagccatggtagccttcaggagattcgaggacttcaccaggtacccagcatggcccggtctccaacaccctgagcatgggggctgsgcagacttcccttgaatccccccccaattcactggacagatggggtgggagagacccagacacgtggcacagcatgtcaataacaacagaataataatag

SEQ ID NO: 33190 - DNA, 201 bp, Homo sapiens
ggagagacgggatttacttaaggtcatccgtgaggggaagggtaagttcaagcccatggatggcacagtctttctaccacgctgctggccacatgcatgcrgattttcttgttgattttgtgtgtgtattgttcattgacctgggttttccctctgcaataccagtaagtaaaattgagcttctagtaagtctgagaggaa

SEQ ID NO: 33191 - DNA, 201 bp, Homo sapiens
ggccaagctggtctctaactcctgaccttaagtgatcttcccacttcagcttccaaaagtgctgggatcacaggcgtaagccaccatgttcagcccatcarggaagtatttgaagacaaattcccaggatggaagtttccagattgagagggcctgagagatgtgcagcctcattggtggaagcagacacatacttgagcc

SEQ ID NO: 33192 - DNA, 201 bp, Homo sapiens
tttttttgagagtgagtcttgctctgttgcccaggctggagtacagtggtgcgatcttggctcacagcaacctctgcctcacggttcgaacaattctcctrcctcagcctcctgagtagctgggactacaggcgtgtgccacgacgcccagctaattttttgtgtatttagtagagatggggtttcaccgtgttagccagg

SEQ ID NO: 33193 - DNA, 201 bp, Homo sapiens
ggaagggcttaatgcatgagacagcaactaccaccatgcttgaactgtttcatcaaaaagcacaacaatggatgtttgtataaaggtggtgttgtgcttgkaggtggatattaggttggtgcaaaagtaatcgtggtttttgcaatcccttttaatggcagaaactgcaattagttttgcaccgactgaatattattcatt

SEQ ID NO: 33194 - DNA, 201 bp, Homo sapiens
gtgcacttcattcccccagcaaggagttgtgacaacacaagtgaagggttgtcttccagccccgcaccagggattggtggctggtcacatcaccctctgcyctgcatcgaaatctcaggcttgcagaagaaagcaggtgttcagcataaaccacactgtttgtgcaaacagttgaggcacagtgagccccccttgtcacct

SEQ ID NO: 33195 - DNA, 201 bp, Homo sapiens
ttgaactcttgagctaagcaatcctcacaactcagcttcccaaagtgctgggattacaggcatgagccaccatgcccggctctttcttggttcgttgagaytctgtgtggaagtcgctggtcttgagtactgccctgggtcagcacaaacattgatgaaaactaataagtaaagacagagttcggttatgaaagagccctc

SEQ ID NO: 33196 - DNA, 201 bp, Homo sapiens
accttgggacaggtagaagaaactgctccttctagttcatgtgctggtaccttagctggcctcttaaggtgctttcagttgggtacagtggttcacgcctrtaatcccaatgctttgaaaggctttgacgtcacttgacatcaagagtttggacgagcctgggcaacatagtgagaccccatctctacaaaaatgtttaaa

SEQ ID NO: 33197 - DNA, 201 bp, Homo sapiens
ggaagtagttgtaattacagaattgcctggctcagaatcagctcttagcagtgcgggtagccgttaccatctctattttatagaagaaaagagagggaagraattgaaggtctgattaatgccggggccctagcctaatggcccagcctgggctcctgtaatgctatcctgcagacgtacatggtagctaaagtgttgcaa

SEQ ID NO: 33198 - DNA, 201 bp, Homo sapiens
tctaccagagtttctaaactgcggctctgttgacacttggggctgtccagttctttgtggggctgtcctgtgcattgcagggtgttgagcagcatccctgrtctccacccactagatgccagtagcgcatcccccaagttgtgacaatcaaagatgtctccaggtattgctccccggggagcaaaatttcccccagttaag

SEQ ID NO: 33199 - DNA, 201 bp, Homo sapiens
gggaagtatttgaagacaaattcccaggatggaagtttccagattgagagggcctgagagatgtgcagcctcattggtggaagcagacacatacttgagcycatcactgtgaaatcatagagttctggggacagagggacgctcctataagcatctggatatgaaaaaacaggtcacctacaaaggatcaaggatcagaat

SEQ ID NO: 33200 - DNA, 201 bp, Homo sapiens
ttcctctacagatcaacctaggctacccttgaagaggctgtgggttagggaatgggattctcgaggccagggtggcagtcagtgaacaggctgttgtgtayggatccatgctgacttgtgtaaggtacatcataatagtcaggagttctgagttcaaggaggtggatttgggaagcaaagcggcttaaaggtcatctctac

SEQ ID NO: 33201 - DNA, 201 bp, Homo sapiens
ttacctcccactgttcagccagttcctaacaggccacggaccagtgctcgtttgggtactggtttggggaccctttctttaggggactgctgtgtgtcatytgaatcatcagcagtcagacctgtcttgttttcccatccagatagccaccatcctggactgccatgcagccaccctgcagcggaaggctgatcgagaggt

SEQ ID NO: 33202 - DNA, 201 bp, Homo sapiens
tgtagggctgtgcattctgcagagggcacaatggagcgtggataagtttcctgtagctgcggtaacaaggtaccacaaactggtttaaaccaacaaaaatktattgtgtcccagttctggaagccaagtctaaaatcgaggtgttggcgggccgtggtctctctgaaggcgctggggcaggatctgttccgagcctcccca

SEQ ID NO: 33203 - DNA, 201 bp, Homo sapiens
catggcccggtctccaacaccctgagcatgggggctgggcagacttcccttgaatccccccccaattcactggacagatggggtgggagagacccagacaygtggcacagcatgtcaataacaacagaataataatagcattgtagccaagagtatgagcctacatgtcagcttgcctggcacagcacatcaataacaaca

SEQ ID NO: 33204 - DNA, 201 bp, Homo sapiens
tttcttaaaagggccagaaagtggctgggtgcggtggctcatgcctgtaatcccatcactttgggaggctgaggcgggcagatcacttgaggttaggagtktgagaccagcctggctaacatagtgaaacctcgtctccactaaaaatacaaaaattagctggccatggtggtgcatacctgtaatcccagctacttggga

SEQ ID NO: 33205 - DNA, 201 bp, Homo sapiens
ctgtgcattctgcagagggcacaatggagcgtggataagtttcctgtagctgcggtaacaaggtaccacaaactggtttaaaccaacaaaaatgtattgtktcccagttctggaagccaagtctaaaatcgaggtgttggcgggccgtggtctctctgaaggcgctggggcaggatctgttccgagcctccccagcttctg

SEQ ID NO: 33206 - DNA, 201 bp, Homo sapiens
ccccctcttcagcgaggcccgcacctccctatactccgaggatgactgcaaggtaagcgtctaagcccagggagcaacctggggagcaggtgggccgtggyccccaggctttccagccctaccccttgcttctccctctcagagcctcagagaagagcccatccacattctgaatgtgtccatccagtgtgcagaccacct

SEQ ID NO: 33207 - DNA, 201 bp, Homo sapiens
tagtagaaatgggatttcaccatgttgcctaggctggtcttgaactcctgagctcaagtgatctgccctgccttggcctcccaaagtgctgggattacagkcatgagccaccccccggcctctgcctctgtgtgtgtgtgtgtgtgtgtgtgtgtgtgtgtgtgtgtgtgtgtgtgtgtgtgtgtgtgtgtgtgtgtgtgt

SEQ ID NO: 33208 - DNA, 201 bp, Homo sapiens
gaggatgactgcaaggtaagcgtctaagcccagggagcaacctggggagcaggtgggccgtggcccccaggctttccagccctaccccttgcttctccctmtcagagcctcagagaagagcccatccacattctgaatgtgtccatccagtgtgcagaccacctggaggatgaggcactggtgccgattttacggacattc

SEQ ID NO: 33209 - DNA, 201 bp, Homo sapiens
gagtgcagtggcaccatcatgactcactgcagcctcaacttccctgggctccgagatgatccccccacctcagtcccccaagttgctgggactacgggcaygtgccaccacgcctggctaatttttgtattttttgtagagacggggttttgccatgttgctcaggctggtcttgaacttctggactcaagcagttggcca

SEQ ID NO: 33210 - DNA, 201 bp, Homo sapiens
acttcagagccacagacctggcttcccactctagctctgctcgcctcatagctggcgaccttgggcagatgtggctgaacgtggggtcagcatttctctcrctcacggtgttgcaatgattcaatgacaaagtatatacacggcttagccagtcccaggtacggagggcacacccaataaatagtttggagattttctggg

SEQ ID NO: 33211 - DNA, 201 bp, Homo sapiens
gttagcagtcactcccctctgtccccaacccaaaaaccctctccccaccacagccctaggcaaccactaatctactttctctctatatagatttgcctatkctggacgtttcatataaatggaatcagatcacaggaggtctcttatgattgacatcttccacttagcataatgtttacaggttcatccgtgtggtaacat

SEQ ID NO: 33212 - DNA, 201 bp, Homo sapiens
gagactctgtctcaataaataaataaataaataaaatgaggctgagcattttattatcttgtagagcttttggctttggattttggcatctttgggatccktggtagcctggtgtttgctggttacccattgactcttttgcacacatacaggcagggtagtaatacctcttccctggtgttcacaggtcaacacccaagc

SEQ ID NO: 33213 - DNA, 201 bp, Homo sapiens
atacatgtgtatatgtatatatacgcacatacatgtgtatatgtgtatatatacatgtatgtgtatatacgcacatacatgtgtatatgtgtatatatacrtgcatgtatatacacatatatacatgtatgtgtgtatatacatataaacatatatatgtatatatataatattttttaagaattatactgaggtcgggtg

SEQ ID NO: 33214 - DNA, 201 bp, Homo sapiens
tgtgtgtatgtgtctgtcttctctctctggtccgcctacagtttgcagaagatcgcatttaccgtcacttggaacctgccctggccttccagctggaactyaaccggatgcgtaacttcgatctgaccgccgtgccctgtgccaaccacaagatgcacctttacctgggtgctgccaaggtgaaggaaggtgtggaagtga

SEQ ID NO: 33215 - DNA, 201 bp, Homo sapiens
tgtatatatacgcacatacatgtgtatatgtgtatatatacatgtatgtgtatatacgcacatacatgtgtatatgtgtatatatacatgcatgtatatayacatatatacatgtatgtgtgtatatacatataaacatatatatgtatatatataatattttttaagaattatactgaggtcgggtgcattggctcacac

SEQ ID NO: 33216 - DNA, 201 bp, Homo sapiens
acacatatatacatgtatgtgtgtatatacatataaacatatatatgtatatatataatattttttaagaattatactgaggtcgggtgcattggctcacrcctgtaatcccagcacgttgggaggccagggcaggtggatcacttgaggtcaggagttcgagaccagcctggtcaacatggtgaaaccccatctatacta

SEQ ID NO: 33217 - DNA, 201 bp, Homo sapiens
agcaattctccctcctcggctttccaaggtgctgggattacaggtgtgagccaccacgcctggccctgaatagcctttcttagaaagctacttgaggatgycttccactgaaaacagagggtaaaccaaggaagagcaacacacaggagacaggaaacaggagattcaacatagactgaaagggagtctccagggtgatgg

SEQ ID NO: 33218 - DNA, 201 bp, Homo sapiens
agtggtggtagtagtggtggtggtagtagtagtagtggtagtagtgtttgtggtggtgaatctgtatgggtctaaggcagagtgagagaccgaggcaagtytctcagcaggagtgaaagtttattaaaaagttttaaagcaagaatgaaatgaagtacacttggaagagggccaaacaaggcaacctgagagatccaagtg

SEQ ID NO: 33219 - DNA, 201 bp, Homo sapiens
cctcggctttccaaggtgctgggattacaggtgtgagccaccacgcctggccctgaatagcctttcttagaaagctacttgaggatgccttccactgaaamcagagggtaaaccaaggaagagcaacacacaggagacaggaaacaggagattcaacatagactgaaagggagtctccagggtgatggtgataaggaagcc

SEQ ID NO: 33220 - DNA, 201 bp, Homo sapiens
ccctgtctctactaaaaatacaaaattagccaggtgtggtggtgcctcaacccgggaggttgaggcaggagaatcactgaatccgggaggcagaggttgcrgtgagctgagattgcgccattgcactccagcctgggcaacaagagaaaaaaaaaatagaaaaagtaatttgcggaaggatgtgtacagtgtggtactctt

SEQ ID NO: 33221 - DNA, 201 bp, Homo sapiens
atccttagccctggagatggcccagttagcccagaagacagcagttaatttccacccacagcagcacctaatggtggtctgtatcagcagaccctccaggyagggaggcgaggacctgagaacaagctgaaatgcagccctctgggatggggaggaggaagctctgatttggttttgcatcctgaagactacaggtcaatt

SEQ ID NO: 33222 - DNA, 201 bp, Homo sapiens
ccaggaaaaggcaaaaagaaaggaactaaaatctggtacactgcagctctcatatgtgaataatgatcacaaacttcatatgtgaataatgatcacaaacwagtaaaacattgaatacccagtttgctaaattacagtagacttctatggtattgaccagctggtggaggggagccgatggggtggccttgtgagataact

SEQ ID NO: 33223 - DNA, 201 bp, Homo sapiens
ctgtattttggaaggccgaggtgggaggatcacttgaagccaggagttcaagaccagcctgggcaacaaagtgagacccctgtctctacaaaaaagaaaayttaaaaacttctgaaatacaaatgtagaaaagtacatgaaagatattaataccatgtaacaagtcggaacgattagaatgtgtggacttcttccctgatc

SEQ ID NO: 33224 - DNA, 201 bp, Homo sapiens
gagccacgattgcaccactgcgtactagcctaggtgacagaatgagatcccgtctcaaaaaaaaaaaaaaaaaaaaaaaaaaaaccgaaggtgcttcctgmccttgagcctccttgtaaattgcttcaggggctctggagagcaagtgcaaagcaggggggctctggtgcagtttggctcctctgctccactggctttaca

SEQ ID NO: 33225 - DNA, 201 bp, Homo sapiens
agtggctcatgcctgtaatcccagcactttgggaggatgaggtgggcagatcatttgggcccagcctgggtttgtgttcaagttcaagaccagcatggacracatgacaaaatcctgtctctgcaaaaaaattaaaaaattagcaggatgtggtggtgtacacctgtagtcccagctactcgggaggctgaggtgggagga

SEQ ID NO: 33226 - DNA, 201 bp, Homo sapiens
ttgttgtgatggtgacccccgaggaccttaaggccaacgcaggtacctgggccttgaccctctcctcccatcacgctccatccttgcctgccctcgcctcyttcccctgtgcctaggcaagtccatcctggactcccgatggtcaggacctctcatgagtctgtatttatttgtccttccttctttatttaattaaaacgt

SEQ ID NO: 33227 - DNA, 201 bp, Homo sapiens
tctttcccctgtgcctaggcaagtccatcctggactcccgatggtcaggacctctcatgagtctgtatttatttgtccttccttctttatttaattaaaaygtctgctgacatcaagaacaactcatgtgccttacaaaaatgcagatggttaacatgcagagaggaaattcgatctttgagaaatgtctgtgttctagca

SEQ ID NO: 33228 - DNA, 201 bp, Homo sapiens
aaaaaaaaaaaaaaagcaaaacaaaaaccaacataagtcaggtcttcaggtctttttgtgcttctccttaaaatgcatcagaggctgtgtgctgttcccartattagcaacctcagcaccatcccctaagccttcctgccccaagctcttcacagacatggcctcatttgttacttacagctctgttttacagatggcaca

SEQ ID NO: 33229 - DNA, 201 bp, Homo sapiens
cataaaatgaaaaagttgtggacatctgtttcacaatataaatatacttcactattgaactgtacactcaaaaatggttaagatggtaaattttgtgtgtkttttttttttaccataatttaaaactctggattgtatttttgtttgtttgtttgttttttgagacagggccttgctctgtcacccaggctggagcgcagt

SEQ ID NO: 33230 - DNA, 201 bp, Homo sapiens
caggagccctagggaggggatattgctgcataaccaggcataatcatagtcagaggagcaaagtgctgatcagaggtattattgacaagcaccacagactragtcagagacttggctttcttttttaggataatcacagccctgtccctatcatcacacccactgaccccattgacagagaaattgaattcctcccatcca

SEQ ID NO: 33231 - DNA, 201 bp, Homo sapiens
aagaaatggaaatcattcataatcctatgacccagtgttgaacatttattacattgtaggtatctacctttccaacctttttctgggcatattctttgggaaaaaaaaaaaaaaaagacagatcttggccagtggctcatgtctgtaacccaaccccccaacccagtgctttcagaggctgagggaggaggatcacttgaa

SEQ ID NO: 33232 - DNA, 201 bp, Homo sapiens
ttgtgcagagacatctgatccccgcagctctgtgttccagataattcagcaggcaggacaggtgtggttcccagactcagcctacaaaaccgcccaggccrtcaaggacttcaaccgggagaagttgcccctgatgatctttgccaactggagggggttctccggtggcatgaaaggtaagcccctccctgcctatgttac

SEQ ID NO: 33233 - DNA, 201 bp, Homo sapiens
tcttcccggattcaagctattctcatgcctcagcctcctgagtagctgggactaccggcgcgtgccaccatgcccagctagtttttgtatttttagtagaracagggtttcaccattttggccaggctggtctcgatctcttgacctcgtgatctgcctgcctcggcctcccaaagtgctgggattacaggcatgagccac

SEQ ID NO: 33234 - DNA, 201 bp, Homo sapiens
ggtcttgctcccgggagcaagaattcaggtcttcttgaattcaggaaccaagaagtgttgtgttggttccaggaaatcagagttttaaatctgctcttttwttattattattattattattttgagactcgcttgtgcctagggtggagtgcagtggcactatctcggctcactgcagcctctgcctcctgggttcaaatg

SEQ ID NO: 33235 - DNA, 201 bp, Homo sapiens
catcctgacatacactgaattagtgttggactctcagggccagctggtggagatgaaccgacttcctggtggaaatgaggtaatagctcagcggagcctarcccctggctggagtcacccccttaaaaatatttttgggccaggtgcagtagctcacacctgtaatcccagtgctttgggaggccaaggtgggtggatcac

SEQ ID NO: 33236 - DNA, 201 bp, Homo sapiens
ggtcggtaggtgcagcaaaccaccatggcacatatatacctgtgtaacaagcctgcacgttctgcacatgtatcctgtttttttttttagaagaaataagaaaaaaagtgtacaatttaatatatttttagtatattcaccaggttgtacaaccatcaccagaatcaattttaggacattctcatcactccatagaaaaac

SEQ ID NO: 33237 - DNA, 201 bp, Homo sapiens
ccttaaaaatatttttgggccaggtgcagtagctcacacctgtaatcccagtgctttgggaggccaaggtgggtggatcacttgaggtcagaagttcaagrccagcctgggctacatggtgagaacctgtctctacataaaattttaaaattagctgtgtgtggtggtgtgctcctatagtcccagctactcgagagactg

SEQ ID NO: 33238 - DNA, 201 bp, Homo sapiens
ttgatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatata

SEQ ID NO: 33239 - DNA, 201 bp, Homo sapiens
gacagtcatcctttccattcagagcatgcattctcgggggcgatattgcccactacccccaagaagacagaaaaataatttttggggtggcaataaaataktttttaacatatatacatatacagagtatgtaaatagtggttaaacagtgtatcttgaaaattaaaatttcatgttggggtgctggcaataagaaataaa

SEQ ID NO: 33240 - DNA, 201 bp, Homo sapiens
tatgttatataacattatatatacataatataatacatattatatgtatttatataaatatatatttatataaatgtatatataattattatatatatatwtttttttggagatggagttttgctcttgttgcccaggctggagtgcaatggcacaatctcagttcactgcaacctccgcacccccgggttcaaacaattc

SEQ ID NO: 33241 - DNA, 201 bp, Homo sapiens
gcatgcattctcgggggcgatattgcccactacccccaagaagacagaaaaataatttttggggtggcaataaaatattttttaacatatatacatatacrgagtatgtaaatagtggttaaacagtgtatcttgaaaattaaaatttcatgttggggtgctggcaataagaaataaaaatgagatagtccttagaggaga

SEQ ID NO: 33242 - DNA, 201 bp, Homo sapiens
ccctaggggctttaaaggagcctgaaccactgacattggtgatgtgaatgtctcttcattttccaggattgctttggaatgacattatatatatatatatwttatttatttatttatttattatactttaagttctagggtacatgtgcacaatgtgcaggtttgttacatatgtatacatgtgccatgttggtatgggat

SEQ ID NO: 33243 - DNA, 201 bp, Homo sapiens
acaccagaatcagctccctgaactccgtccactgtaaacacatcgaggaaggaggagagtccaggtaaataacttatcaggtagctccttaattttgctcrtggttaatttcagctgtcttctttcctcggggcttgtggcgatattttccagtggggtggtggtgtttgtatgatgggaaccaatgcctgttgggggcac

SEQ ID NO: 33244 - DNA, 201 bp, Homo sapiens
cctaggggctttaaaggagcctgaaccactgacattggtgatgtgaatgtctcttcattttccaggattgctttggaatgacattatatatatatatatattatttatttatttatttattatactttaagttctagggtacatgtgcacaatgtgcaggtttgttacatatgtatacatgtgccatgttggtatgggatc

SEQ ID NO: 33245 - DNA, 201 bp, Homo sapiens
agtcgaggcacagggatgtgaatttatcacttgtccagggtcacacaaccatcatgtgatgcgggtgggatgggaaccctggtctgggttcagagcatcayccagtgggtcctcccatcttggttagtctaaaattcaaaattgtcacccaggcctattaagtcccctcctggctccatctcgaacctcttgccctccatc

SEQ ID NO: 33246 - DNA, 201 bp, Homo sapiens
catcacacatgctaaagtgcattgtgaatctctaacagaggctggcgggacagtgtttctcattatgtggccctggaatttttgattgattgattgtgaaygggtttcctctgtgtacccccatctctctgtagaccgttggaggaatatgggccgagggtgatatttcactgagacagcccctgaacaggcagatatctt

SEQ ID NO: 33247 - DNA, 201 bp, Homo sapiens
gtctgggttcagagcatcacccagtgggtcctcccatcttggttagtctaaaattcaaaattgtcacccaggcctattaagtcccctcctggctccatctygaacctcttgccctccatcagccgggtaccagtcaccctgacctctggtagctcctgggcctgttgcagagtcttggcacctgctggaacctctattgaa

SEQ ID NO: 33248 - DNA, 201 bp, Homo sapiens
attatgtggccctggaatttttgattgattgattgtgaacgggtttcctctgtgtacccccatctctctgtagaccgttggaggaatatgggccgagggtsatatttcactgagacagcccctgaacaggcagatatctttggttgtataaaccaaaaagtatctgagacaggtctcaatcaattgagaagtttattttgc

SEQ ID NO: 33249 - DNA, 201 bp, Homo sapiens; identical to SEQ ID NO: 6177

SEQ ID NO: 33250 - DNA, 201 bp, Homo sapiens
ctttgtgcagtggactccctccccacccagcctgtaggtctcaacatgatcatcgcatctctctcagagaacctcatttattttcttcccagcactgacckgagtctgtagttattgtgtttattttcttgtttatcttctccaacataaaagaaaaactggacaaggaccaggaagcctgtctggccgctcacttcatca

SEQ ID NO: 33251 - DNA, 201 bp, Homo sapiens
tcacaatataaatatacttcactattgaactgtacactcaaaaatggttaagatggtaaattttgtgtgtgttttttttttaccataatttaaaactctgkattgtatttttgtttgtttgtttgttttttgagacagggccttgctctgtcacccaggctggagcgcagtgacatgatcacgactcattgtagcctcgac

SEQ ID NO: 33252 - DNA, 201 bp, Homo sapiens
acagtagagcaccatgttgtctatagagtagtgtctgtatatcctaaatcattgactgaacctccgttgcatctaccactgtgcctggtgttttggggccrtgttctggtaggactgacagtctgtgggttggatctcttgattttagatcgccatgggcgtgccactgcaccggctgaaggatatccggcttctgtatgg

SEQ ID NO: 33253 - DNA, 201 bp, Homo sapiens
agcctgggcaacaagagaaaaaaaaaatagaaaaagtaatttgcggaaggatgtgtacagtgtggtactctttatttaaagtttgcagtgcaaaacgataytgtatgtttccaatgtatgcatacaggataaaggaaaatgaaaaaaaaagcatgcataggactgggtaggcactgaattcaagggaatggtcacctgtgg

SEQ ID NO: 33254 - DNA, 201 bp, Homo sapiens; identical to SEQ ID NO: 6185

SEQ ID NO: 33255 - DNA, 201 bp, Homo sapiens
gtttcaccatgttggctgggctggtctcaaactcttggccttgagtgatccacccgccctggcctcccaaagtgctgggattacaggtgtgatctgctgcrccctgcctgatcaattttaactgtaggaacgaattgcacatttacttactggtagctagttttcctcttttaaaaccttatgtccgttatcagcaatgtt

SEQ ID NO: 33256 - DNA, 201 bp, Homo sapiens
ctgagacaggtctcaatcaattgagaagtttattttgccaaggttagggacacatccagaagcaaagaacacggaatcatagaaaccgtctgtggcgtgtrcctttcttcaaagatgatttggagggcttcagtatttaaaggagaaaagcaggctggaggggaaagagggaagttctggtaatcacatgttgcaggagaa

SEQ ID NO: 33257 - DNA, 201 bp, Homo sapiens
taaaggaatttaccaagacagctgtaggtaaagaaaggcagatttattggaggaagtatgaaaatatgttgcaagattgcaacaggcagcacagcagagarggatctgtctgcaaagaggcaagggctggtgggaggttttatagggtggtgctggaggaggggctgtgaggtcattacgtcctggggttgtttgtgatta

SEQ ID NO: 33258 - DNA, 201 bp, Homo sapiens
agctctgccgggccgcggcggtgatcgatggggagcggctggagcggacccagcgagtgagggcgcacagccgggacgccgaggcggcgggcgggagaccmgcaccagcgcagccggccctcggcgggacgtgacgcagcgcccggggcgcgggtgagtccgcgcggaccgccaggcatgcttgggggacttcaagggcgg

SEQ ID NO: 33259 - DNA, 201 bp, Homo sapiens
ttggaggtggggcctggtgggaggtgtttggatcctgcaggcggatctctcatgaatggcttggtgccctccccatgttaatgaaagagttcttgctctgraactgtgacacctcccccctctctctcttgctcctgctctcgccatgtgacatgctggttccctatcaccttctgccatgattgtaagcatcctgtggcc

SEQ ID NO: 33260 - DNA, 201 bp, Homo sapiens
tgaaatagatgttactaaccttgatgattattctttctttttcagtgagatcaacataatcttggagttgagaccctacttaccaaaatgttaggataggrtgccattatgtattcttcatgaaaatatttacaggttaggtagactccttatttttggtacatttaaaaaatacatacagaaaagaatatttaccataga

SEQ ID NO: 33261 - DNA, 201 bp, Homo sapiens
aataaggaagaaaagtttactctgctacttacccaaagcccaggtaaaatgcttagctgagaaggaatttaaaactcatagtttaaatgcatgatgcatgyctgctgtcattttatctgtgctgccacagtgtcctttcaagcagataactgagagttgctgtattttgctttcgaatttgttacagggacaaaaatagtg

SEQ ID NO: 33262 - DNA, 201 bp, Homo sapiens
catccccaggccacagttaattggtccaggcttgaagtggaccaatcacagtttttcatgaggatttttcaaacaggcgctgatgaagagctggccccagwgttggcatttctgagacgtaagctcaacaccagccacatctctcaccacgtggaagaagctagtctgcaacagagtgaagtaaacagaaaaggcaagaga

SEQ ID NO: 33263 - DNA, 201 bp, Homo sapiens
ttacccccatctcaagtgctcagtagacacatgtggttagtggacaacacagatttagaacatttctatcataggaagtactactggacagtactgctgtmaacacacttattaataatgcagcagactttcttggccacttggtaagaaagttttctgctcttttaaacttatttgggaagtttttaatacttttgaaat

SEQ ID NO: 33264 - DNA, 201 bp, Homo sapiens
actagtgactattgctgctagctgtggttgtattaacattaaaatatttgctatgggatttttcttcttatcaaagcagatgctcagatgaggaaaaactytcttgcatatgaaaatcaaaattgtcttccaaaatatttaagtaacaaaaaattcattatgtagtataaatgctgtatgattacattattcttatagtta

SEQ ID NO: 33265 - DNA, 201 bp, Homo sapiens
ctcccaggttcaagcgattttcctgcctcagcctcccaagtaactgggattacaggcacgcatcaccacacctggctaatttttgtatttttagtagagaygggttttcactaggttggccaggctggtcttaaactcctgacttcaggtgatctgcccgcctcagcctcccaaaatgctgggattacaggtgtgagccac

SEQ ID NO: 33266 - DNA, 201 bp, Homo sapiens
ttggcatggcagtggtgtcttatttctgctcctctttttccccagggcatgccattgcaagagaatgctcagccatgttcatctggggacctgctcctggyagagcaataggatctgtgtgcccagcaccactgcccacctagctgtcctggcctgtgcccaatgctgaccttcacctcagagtgtggctgtaccacattc

SEQ ID NO: 33267 - DNA, 201 bp, Homo sapiens; identical to SEQ ID NO: 6255

SEQ ID NO: 33268 - DNA, 201 bp, Homo sapiens; identical to SEQ ID NO: 6257

SEQ ID NO: 33269 - DNA, 201 bp, Homo sapiens
aggagcgctggaaatgatcctgtgaaaaatactggctcacaatgtatcagctgagtttggggcaactgaggtagtaggaggcgccccctggacttctgctrgaatttagatttaaatagatggatgaattagacaaaacatactctctgaaagagtgagaaatacaatattcaccaattaagtgaaggaaaaatctacact

SEQ ID NO: 33270 - DNA, 201 bp, Homo sapiens; identical to SEQ ID NO: 6260

SEQ ID NO: 33271 - DNA, 201 bp, Homo sapiens
aggaataaaattatttaatggaaaatttcaaataggctaactctaaaaatgtacagataatctggatgagagaaaactatcctcactttgtgttatttttyaatggtagcattttctcataatccccatgcttttttcatgtcctgctattctttaagatttcctaatgaggattagggaataggcatatttaacaatctg

SEQ ID NO: 33272 - DNA, 201 bp, Homo sapiens; identical to SEQ ID NO: 6266

SEQ ID NO: 33273 - DNA, 201 bp, Homo sapiens; identical to SEQ ID NO: 6267

SEQ ID NO: 33274 - DNA, 201 bp, Homo sapiens; identical to SEQ ID NO: 6269

SEQ ID NO: 33275 - DNA, 201 bp, Homo sapiens; identical to SEQ ID NO: 6270

SEQ ID NO: 33276 - DNA, 201 bp, Homo sapiens
atgtcgtcttgctacattgcctaggttgctcatgaacccccagcctcaagtgatcctcctgcctcagcctcccaaaatgctaagattacaggcatgaaccmctgcacccaaccaatattaatatttttaacaattgaaagagctcaaagaaataggttttaaatttagaggccctgttttgctgacaggaaaggcttttag

SEQ ID NO: 33277 - DNA, 201 bp, Homo sapiens
ggacatgtacagttgctaaatgataattttccaaaaataagcttcaattctccaaaatggcagatagaaagcagctggtgttactcaacagagataagccctcctagagctcaccacagagaggagagcatcatgtctgcagatgccacagcagatctgctgagaatcagccagcgccatgtgacacaagaacccacagat

SEQ ID NO: 33278 - DNA, 201 bp, Homo sapiens
agactccttatttttggtacatttaaaaaatacatacagaaaagaatatttaccatagagatctaggtgcccaacagaatgcaaaagctacatttatattraaatatatatttcaatatacacccatttacacccatttctgaggtgtaaatttcaatatacacaatattaaaatttacctcattctaagcttttggggaa

SEQ ID NO: 33279 - DNA, 201 bp, Homo sapiens
ggcaatttaagctgtgtttcctgattaaagccagggactgaaaaatcactacctattcatgatgaaagactagaaaacttctgaagaccagacagagtttsagagtggtatagttactaatctactaaatactgcaaatatatagtatctgcaaatatatatataaggttgaaaactaagctcagaaatgagcattaaaaa

SEQ ID NO: 33280 - DNA, 201 bp, Homo sapiens
tcttattgatttaaactagtgatatgtaaacagcacttcagagcttgtttcacaggaccaaaaaatttatgctgaaatctactcatgacaaatgggaaaamcctgattagcacatttaaatgaataaataaagaaccgtattcaatggcttaaaatttatagacctgcatcatccattatggtagccatttactatatgtg

SEQ ID NO: 33281 - DNA, 201 bp, Homo sapiens
atggccacaggtgattcctttgagcagtgttcttcctgtatagggcttaagaggaccagaagggaaatgattgtactctcttgtcagctacttcctgggcratttgggttctttgataccccagtgctcactttcggaagtgttaagaccataaaccttaacagttgaccttctcaccttcagaaaacccaaatgtctcgg

SEQ ID NO: 33282 - DNA, 201 bp, Homo sapiens
tttctttgggcaaccatttgtgacctggctattgagcccacctgggcctcttctctttgtttgctgatagcctcgttaagtattaaaaacctactcccccycttcaggagccctcttttaatgaaagtttgggtactgggatcagatttgggacttggctacatttatttcctgtgtcattctgagaagagaaagtaatag

SEQ ID NO: 33283 - DNA, 201 bp, Homo sapiens
cagagtggtatagttactaatctactaaatactgcaaatatatagtatctgcaaatatatatataaggttgaaaactaagctcagaaatgagcattaaaarcttttccagatcaagggagtgctgtacccccaagctgaggtttcataggctaccatcatccaggcactcagtcttcccaagcaagttaattcccaccaaa

SEQ ID NO: 33284 - DNA, 201 bp, Homo sapiens
ttgtgatggtagggtgtcaattttggatctttcctgctttctcttgtgggcattgagtgctataaatttccctctacacactgctttgaatgtgtcccagrgattctgttatgttgtgtctttgttctcattggtttcaaagaacttcttaacccaggaatacagtgaactgataagacagagccctgtcgcagaggcaca

SEQ ID NO: 33285 - DNA, 201 bp, Homo sapiens
ctatctcatcctcccaagtatctaggactacaggcacatgcactatgcccagctaattatttttttaattttttgtagagatgtcgtcttgctacattgcmtaggttgctcatgaacccccagcctcaagtgatcctcctgcctcagcctcccaaaatgctaagattacaggcatgaaccactgcacccaaccaatattaa

SEQ ID NO: 33286 - DNA, 201 bp, Homo sapiens
ttccaatagatgggagccaaggaaaagacaagcatctgtgatgtcatgtctcccccaaacgggtagctgcctcaccagcctccattagagacatcccccasagtaagaaataagaaataatcatgagtagaatgagaaaaaaatgcagcttcctttatctgagaaaaacaatagtagctcaatgctgtggcctaaagggct

SEQ ID NO: 33287 - DNA, 201 bp, Homo sapiens
tgttttagtcaaataagattttagcaagcatatttcaaattgttctaaatctaagtaaattggtaattaaatgctatcattagaaagtattttaatatcaraaaaattggaccataagaaagttagtttacccttgtattcatatatacatgtgctttgtgctaaaaattgttatcatttagtgagaacctgtgactatat

SEQ ID NO: 33288 - DNA, 201 bp, Homo sapiens
cctagaaatggggttgtgttgagttgacagagatgtgtggctctttaaactgaaatataatccaaagagaacaagatctagtagaatttcaggtcctaagsctggttaaatttcaggtcctaaggctggttaatagtacaaatacagttatttatttataactagtgcaaatacagttatttatttataactatacaggaa

SEQ ID NO: 33289 - DNA, 201 bp, Homo sapiens
agtcaggagctctgagaggaatgttcaggatagaataaagcagatattttaatgtctcatttcagtgaggaaaattgttaattcatatgccaccagccatyggcagaaatgtaacaggaaatgaagaaaaacttaattactttaaatacagtggtctgtagtacaaattattgtgccgtgaattagtttccttctgctgta

SEQ ID NO: 33290 - DNA, 201 bp, Homo sapiens
atctcatggaactttttcccaagcttgatgaagttctgctgtgccatatggacatgtacagttgctaaatgataattttccaaaaataagcttcaattctscaaaatggcagatagaaagcagctggtgttactcaacagagataagccctcctagagctcaccacagagaggagagcatcatgtctgcagatgccacagc

SEQ ID NO: 33291 - DNA, 201 bp, Homo sapiens; identical to SEQ ID NO: 6253

SEQ ID NO: 33292 - DNA, 201 bp, Homo sapiens; identical to SEQ ID NO: 6256

SEQ ID NO: 33293 - DNA, 201 bp, Homo sapiens; identical to SEQ ID NO: 6259

SEQ ID NO: 33294 - DNA, 201 bp, Homo sapiens
gaagcttatcagtagcagaagtgcagactgggaaatggcctatgtcaccctcccatctagaaatgcccagtgcacatccagatcccacacccccaagagckttgtgcaatatctgttaatttatgagagctgtttcccatagatgatgctgcaggcattagtaaggagggcaaagttcaagtgatgacaccatctctactc

SEQ ID NO: 33295 - DNA, 201 bp, Homo sapiens
atccaaacctgccaaaatccaatggaaaaggccttcatttaccaagctaacacaacttacatgagaaattatataactgaagttgaaaagatgcatttcarcaatcaggaagagccagaattagaaatcagactgttttttttttccagaagctgagaataagagaagttagctttagtaatatttaattctaaatcattc

SEQ ID NO: 33296 - DNA, 201 bp, Homo sapiens
tatggacatacgctgatatagttaactagtcaccaaattggaaaattgagctttttctgatttttttagtatcataaattacactgagatgagcattcaagtatgtgaatctgagaaatttcccatactcctagaagtggtgcaactgaaatacacgtatgaacattttttaatagtctaactacctgttatcaaatattt

SEQ ID NO: 33297 - DNA, 201 bp, Homo sapiens
tgttaggataggatgccattatgtattcttcatgaaaatatttacaggttaggtagactccttatttttggtacatttaaaaaatacatacagaaaagaawatttaccatagagatctaggtgcccaacagaatgcaaaagctacatttatattgaaatatatatttcaatatacacccatttacacccatttctgaggtg

SEQ ID NO: 33298 - DNA, 201 bp, Homo sapiens; identical to SEQ ID NO: 6262

SEQ ID NO: 33299 - DNA, 201 bp, Homo sapiens
tgctttctagatctcacaaatctggcttttctagtcaatcacatctctctctccttcggcttctcaccaaaccagcatccgttcagcttcaaagaaaaaasagccctactgtttcccactcatttatcatcaatctaaagtaactgccaatcacaaaagtcccatctttatttctttccttagaaacaaatttctctaggg

SEQ ID NO: 33300 - DNA, 201 bp, Homo sapiens
aatgcatggcttgcatgttgcctgggctctctttacctgacagtgacctgggagttctctgggtatcatagagccagtgagcacagcatccaaacctgccraaatccaatggaaaaggccttcatttaccaagctaacacaacttacatgagaaattatataactgaagttgaaaagatgcatttcaacaatcaggaagag

SEQ ID NO: 33301 - DNA, 201 bp, Homo sapiens; identical to SEQ ID NO: 6265

SEQ ID NO: 33302 - DNA, 201 bp, Homo sapiens
taagccacagagcttggataaaaggaatagtaagaccaaaaataggaaaagtaggaagaggtggatcctcctatgtttttaatcagggttctatctacctrtaactcttctgggaaaagaagcaggatgtgactgaaacatagctgctttctagatctcacaaatctggcttttctagtcaatcacatctctctctccttc

SEQ ID NO: 33303 - DNA, 201 bp, Homo sapiens
gatttagaccatgaaatcataagcagagagaggaaattagtgctcctcaccacttgagggcccaaatgcatggcttgcatgttgcctgggctctctttacytgacagtgacctgggagttctctgggtatcatagagccagtgagcacagcatccaaacctgccaaaatccaatggaaaaggccttcatttaccaagctaa

SEQ ID NO: 33304 - DNA, 201 bp, Homo sapiens
ttcagacctcacaggagagatacatacagtcagggccccaggaccatgttggatccactggacccagaccaaccagaggaagagggaacccaaatattagrgtgggaagcaagtcataaacagtagacagaatggtatggggcaagcccttaaccatatggattttatatagttcaggctgtatgactgtatattggagct

SEQ ID NO: 33305 - DNA, 201 bp, Homo sapiens
tctgaataactcactgatgccatcccagaaagtcggcaccaggtaaatgccttacatctacagcagtgggtctgtcagcagttttctttaatgtgtcagcrgtggggagagcgcaaaaacccacacacaccattatcttgtgaaagaagtagaggaagcagaaaataatgaaatcccagtgttaccacatcccctccaata

SEQ ID NO: 33306 - DNA, 201 bp, Homo sapiens
aaagatcatgtgcaataaatatcactgttcatgtttcctacagatgaaaaaaaactgagggtcatgttcagagaaattggatgacttacccagagccacayagatttgtacgtggcaaaggaggattccatttcaagtctttcaaccccaaattcatcttcctttctctaaggggaaatggtgctatggaattcatgtaag

SEQ ID NO: 33307 - DNA, 201 bp, Homo sapiens
caccattatcttgtgaaagaagtagaggaagcagaaaataatgaaatcccagtgttaccacatcccctccaatatacagattaagagcgtttgtatttatrtggttttaaacataaataacatcagaattactaagctatttccattcatgtactgataatgaatcatgtgagaaagtcctttggcaaggactccacatgg

SEQ ID NO: 33308 - DNA, 201 bp, Homo sapiens
aaagctgtcaaaggatataaggtaactcttacaaaagcaattgtaaaataaacgtggtttggccacaatgagccaacacctatgtttgccacagacttagrttcccacctcactcatggcaaatttattcagctgcttaagattattttttactcatacttcgaaagaacaacagcctggaatttttagacttttaatggc

SEQ ID NO: 33309 - DNA, 201 bp, Homo sapiens; identical to SEQ ID NO: 6271

SEQ ID NO: 33310 - DNA, 201 bp, Homo sapiens
atatatcaccataacctcagaatggggtatttactaaattttttttttttcagacagggtctcactctgtcccccaggctggagtgcagtggtgtgatctyggctcactgcaacctcccactgctagattcaggcaatcctcccacctcagcctcctgaatagctgggactacaggcctgctccaccactcttggctaata

SEQ ID NO: 33311 - DNA, 201 bp, Homo sapiens; identical to SEQ ID NO: 6272

SEQ ID NO: 33312 - DNA, 201 bp, Homo sapiens
tcggaaaatttttttttttttttttttttttttgagacggagtctcgctctgtcgcccaggctggagtgcagtggcgggatcttggctcactgcaagctcygcctcccgggttcacgccattctcctgcctcagcctcccaagtagctgggactacaggcgcccgccactacgcccggctaattttttgtatttttagtag

SEQ ID NO: 33313 - DNA, 201 bp, Homo sapiens; identical to SEQ ID NO: 6274

SEQ ID NO: 33314 - DNA, 201 bp, Homo sapiens
ttataaaagttcatgcttcggaaaatttttttttttttttttttttttttgagacggagtctcgctctgtcgcccaggctggagtgcagtggcgggatctyggctcactgcaagctccgcctcccgggttcacgccattctcctgcctcagcctcccaagtagctgggactacaggcgcccgccactacgcccggctaatt

SEQ ID NO: 33315 - DNA, 201 bp, Homo sapiens
aggtgcatgccaccatgcctggctaatttttgtatttttagtagagacggggtttcaccatgctggccaggctggtctcgagctcctgaccttgtgatccrcccaccttggcctcccaaagtgctgggattacaggcgtgagccaacatgcctggcctgcagtcaactgatttatgttcatcaccttcttaagttaaattg

SEQ ID NO: 33316 - DNA, 201 bp, Homo sapiens
agtctcgctctgttgcccaggctggagtgcaatggcatgatctcagctcactgcaacttccacctcctgggttcaagtgattctcctacatcagcctcccragtagatgggattacaggtgcatgccaccatgcctggctaatttttgtatttttagtagagacggggtttcaccatgctggccaggctggtctcgagctc

SEQ ID NO: 33317 - DNA, 201 bp, Homo sapiens
gatctcaatttctagagaagcgaagaagaatcccccaattctagttctaagtttcttttttcccttgctaaatcctgcagtctactgatttttttttttttagacggagtctcgctctgttgcccaggctggagtgcaatggcatgatctcagctcactgcaacttccacctcctgggttcaagtgattctcctacatcag

SEQ ID NO: 33318 - DNA, 201 bp, Homo sapiens
caagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagta

SEQ ID NO: 33319 - DNA, 201 bp, Homo sapiens
tgtcacctctattataactttaaccaggcaagctcagtctcatgcattagtttataaaattgcaacagagccttctaagactgaaaggacattagtttttwaacctatatattatgacctaattaaatgaaattttattttaaagccctcataaaagtagtaaaattggtgttttaaataaaccaaatgggaattcaacca

SEQ ID NO: 33320 - DNA, 201 bp, Homo sapiens
gcattcatgatatcttttcactcttaattctgagtgtttccgtccgtttttttaatttttgtactttatgggctttttcttcatttacccccaattatgcrggaaaggctgtgtgcctcttttgaaagctctgatgttctcaatgaagagaccttttaaatgaccttgtttgtcccccaccgagttgcatatcacaacttc

SEQ ID NO: 33321 - DNA, 201 bp, Homo sapiens
aactttcatatttaatcattttttttcttttttggtttctatggtatcaccatccatcaatccatattggttggagggggggaatatatatatatatatawgtatgtctcccaagagaaagtaattctgcaatcttcctcagcaattcagtctaacaattaagaacccttaagctaaatagaaaaattcatttcacaggca

SEQ ID NO: 33322 - DNA, 201 bp, Homo sapiens
ctatactgggctacctactttttaaggccaactaattatttgaaaatttatttaaagttttaatttgagatcaaaatctgtttccctcataaattttttttaaaaaaagcaaacaagatctattccattttgatctaatgttttcctgtcaccttacctttaagtgcaataatgggaaattctagaaattccttctttaac

SEQ ID NO: 33323 - DNA, 201 bp, Homo sapiens
tctgaggaccaaagaaaatacatacgttgttcagatttgccctgaggggtcagtttgtacccaaacatttgctgccacaagtagtaaatgtagaagcaatscaatatctactattttacttttctttcagggttaatcaagtgccttgttataattcttcaaactaaaaacattattataataatgaaaaatatttctgct

SEQ ID NO: 33324 - DNA, 201 bp, Homo sapiens
taacagccaggacattcaatagtgtgtgttaagggggaagaggtgtggagatatagacgtaccaatagtgagagggggctgaggctactacactatctacwattgcaaattattgtaaactgaagtctctccctgagatggcacaggggtaaaatacacttctgttgcatgagcaattataaaaaatatgatttagaccat

SEQ ID NO: 33325 - DNA, 201 bp, Homo sapiens
catgtctcccccaaacgggtagctgcctcaccagcctccattagagacatcccccagagtaagaaataagaaataatcatgagtagaatgagaaaaaaatrcagcttcctttatctgagaaaaacaatagtagctcaatgctgtggcctaaagggctttgaaaataatgcaatttctgataaaaataaatgccattattct

SEQ ID NO: 33326 - DNA, 201 bp, Homo sapiens
atgataaatgaattggtcctgcttacctcaggaaaaactttcaagtctttctgaaaaactaatttaattcagtagtattttctaagatttaggttatgttwttaatcaatttggaaaccaagatttacttatagaaaaaaaggaaaaggacctagataggtttattcacatagaatcccaatttcacttctctggatgata

SEQ ID NO: 33327 - DNA, 201 bp, Homo sapiens
ttggatgacttacccagagccacacagatttgtacgtggcaaaggaggattccatttcaagtctttcaaccccaaattcatcttcctttctctaaggggamatggtgctatggaattcatgtaagccacagagcttggataaaaggaatagtaagaccaaaaataggaaaagtaggaagaggtggatcctcctatgttttt

SEQ ID NO: 33328 - DNA, 201 bp, Homo sapiens
tgagagaagtttaattgtagtttagagtttcattattagacagtagtcttaaacaattcccaagaagctaaaatgtgggattaacattttactttcattgkaattcatatcctaaatataaatgttaatataaattataaagtttctgaatttcctttcataaaactgggttctttgggttcttagttattttggatgaaa

SEQ ID NO: 33329 - DNA, 201 bp, Homo sapiens
tatatgtatatctatatctctaaactgctgttaattgattaaaatctggcaaagttatatttactttaaaataaaataattttattgcaatgtatttatcktcattacttaaaatagatgctaatttattttaaaataagactaccttgaatgagtatgaatatatttttatttaaattttgatacaactgatagtttaat

SEQ ID NO: 33330 - DNA, 201 bp, Homo sapiens; identical to SEQ ID NO: 6261

SEQ ID NO: 33331 - DNA, 201 bp, Homo sapiens
gattttagttatttcttgccttctgctagcttttgaatgtgtttgctcttgcttttctagttcttttaattgtgatggtagggtgtcaattttggatcttycctgctttctcttgtgggcattgagtgctataaatttccctctacacactgctttgaatgtgtcccagagattctgttatgttgtgtctttgttctcatt

SEQ ID NO: 33332 - DNA, 201 bp, Homo sapiens; identical to SEQ ID NO: 6263

SEQ ID NO: 33333 - DNA, 201 bp, Homo sapiens
tacttacaggccttcttccaagttaggttttattttccttttctcctagtctctggagtctcctctctccagacaccctggaaagccattcatggcctttmatatttaacataagagtatttaatactaacactaacatgtcgaaggaagatgtttaaagcatgtgaattagacttgatcatatatgtttcattggcacct

SEQ ID NO: 33334 - DNA, 201 bp, Homo sapiens; identical to SEQ ID NO: 6264

SEQ ID NO: 33335 - DNA, 201 bp, Homo sapiens; identical to SEQ ID NO: 6268

SEQ ID NO: 33336 - DNA, 201 bp, Homo sapiens
aaaacccacacacaccattatcttgtgaaagaagtagaggaagcagaaaataatgaaatcccagtgttaccacatcccctccaatatacagattaagagcrtttgtatttatatggttttaaacataaataacatcagaattactaagctatttccattcatgtactgataatgaatcatgtgagaaagtcctttggcaag

SEQ ID NO: 33337 - DNA, 201 bp, Homo sapiens
tttggacacctacatgccagacactattctcagcattgagcacaaagtcgtgagcaaggtagacaaaaatgcttggcctcataaaacttacattccagtgyataaagatgagaacaatcacgtaaaatttataatatgttggatggcatggaaaatggaaataaagtggaagggaggcttcaggttaaaaagagtgtttag

SEQ ID NO: 33338 - DNA, 201 bp, Homo sapiens
ataaattttgttctcgtgatttgtgattggccattgatttccgtgtttaagattatgaaggtgtgctcagctgtctactagaaataacaggggagactcaktcttgtttcaaatggaagggctcctattcggttttctccttcatttcttaaagtgttgtgatttttttattccctggtgttatgtcttgagattttaaat

SEQ ID NO: 33339 - DNA, 201 bp, Homo sapiens
tgtgtctaaagtggtcacactgtttggttctggccacttctgtaataaccactgctcctttcccctcctcgtgagattataactcctttgacagtatggayggcacctaacgcatccttgttttcttttactaaatgttccacggagtcacttgcttgcctgtttgttgcttatttgtttgtttttggctaaaactacaga

SEQ ID NO: 33340 - DNA, 201 bp, Homo sapiens; identical to SEQ ID NO: 6273

SEQ ID NO: 33341 - DNA, 201 bp, Homo sapiens
ttttaactgctctgaaaatggtttctgtccctggtggactcttgtttcaatgcagttattttgtctggtagagtcacagagttaagctgtcattcagatcmgaaaaaataaaagagagagatgaattaatctcaatggcacagtctccttattcaaaaaataaaaataaaaataaatctcaagtccaacaatgaatcatct

SEQ ID NO: 33342 - DNA, 201 bp, Homo sapiens
taagcttttggggaaaaaaaggctagtcatttctaatgctggctctttctcattgtggaaattcatctttttggacatcagttacatcatttttcaagtayggtgagttggcttggtgaaagaaggcttttatattttatattttattttattttattttattttattttattttattttattttatttttgagatggagt

SEQ ID NO: 33343 - DNA, 201 bp, Homo sapiens
gggttttggatctccaggtgtttatttcacatagcatatgctttaacccccttataagtcttctctaaggaagaaactgccatacttcccttgtcttctcyggtgtttccctagctataaaggccccacctgcataacctgtcctcaggctgtgatgtattcccgggtgccctggtaccttctccttcctctccaccaccc

SEQ ID NO: 33344 - DNA, 201 bp, Homo sapiens
tacctcctgggttcaagcaattcttctgcctcagcctcctcctcctgagtagctggaactacaggcatgcaccaccacgcctggcttttttttttttttttcttttgcatttttagtagagacagggtttcacgatgttggccagcctggtctcgaatccctgaccttgtgattcacccacctcggcctcccaaagtgctg

SEQ ID NO: 33345 - DNA, 201 bp, Homo sapiens
tggttggtttgttttgagatggagtctcactctgtcacccaggctggagtgcagtggcacaatctcagctcacagcaacctctacctcctgggttcaagcrattcttctgcctcagcctcctcctcctgagtagctggaactacaggcatgcaccaccacgcctggcttttttttttttttttcttttgcatttttagtag

SEQ ID NO: 33346 - DNA, 201 bp, Homo sapiens
tatatgttctatacacaagtccttatcaggtatataatttgcaaatatctttgcacattcttggctttttcttttcactttcttgatacccttggaagtayagatgctgttaatattgatgaaatcaaattaatttacctactttttcttgtatttcttatgcttttggagttgtatctaagatggctttgcataacccaa

SEQ ID NO: 33347 - DNA, 201 bp, Homo sapiens
tccagggaagctaaatgactgcttcaaggtcacccagccagtgagtgggaaagctaaaattagaacctcagtccgctcccacattttccaccaatttgcargctatcgttaaagaatatttcttctgcaatcagaacattgagcaatttggaaaaacgtgtacagtatatcgaatattctagcttcatttaaaatttatgg

SEQ ID NO: 33348 - DNA, 201 bp, Homo sapiens
ttgttactatctgactttttgattatagctatcctagtaggcctaaaatcataactaattgttcctttgagttgcattttcctgctggctaataatgttgmgtttttttatgtgtttgtctaccttctttagagaaatgtatattaagatcctttgaccatttttaatggtgtttttattatctttgtgtgtgctttatta

SEQ ID NO: 33349 - DNA, 201 bp, Homo sapiens
tttatacatttcttccagattttctagtttatttgcatagaggtgtttgtagtattctctgatggtagtttgtatttctgtaggatcggtggtgatatccyctttatcattttttattgcgtctatttgattcttctctcttttcttctttattagtcttgctagcggtctatcaattttgttgatcctttcaaaaagcag

SEQ ID NO: 33350 - DNA, 201 bp, Homo sapiens
gagcctgttattcgtctattcagagagtcaatttcttcctggtttagtcttgggagggtgtatgtgtcgaggaatttatacatttcttccagattttctastttatttgcatagaggtgtttgtagtattctctgatggtagtttgtatttctgtaggatcggtggtgatatcccctttatcattttttattgcgtctatt

SEQ ID NO: 33351 - DNA, 201 bp, Homo sapiens
gactacattttttgatttgtgtatattgaatcagccttccatcccagggatgaagcccacttgatcatggtggataagctttttgatgtgctgctggattyggtttgccagtattttattgaggatttttgcatcaatgctcatcaaggatattggtctaaaattctcttttttggttgagtctctgcctggctttggtat

SEQ ID NO: 33352 - DNA, 201 bp, Homo sapiens
gccttttctgcatctattgagataatcatgtggtttttgtctttggttctgtttatatgctggactacattttttgatttgtgtatattgaatcagccttscatcccagggatgaagcccacttgatcatggtggataagctttttgatgtgctgctggatttggtttgccagtattttattgaggatttttgcatcaatg

SEQ ID NO: 33353 - DNA, 201 bp, Homo sapiens
tcaatggcacagtctccttattcaaaaaataaaaataaaaataaatctcaagtccaacaatgaatcatctttgagactctcccaagtgatctagttttaarggcaaaaactttggggaaactgttgggggagcaactggtgcccagtactgtttcacacacgtggtttttcttatctattgctcacacacttagacataac

SEQ ID NO: 33354 - DNA, 201 bp, Homo sapiens; identical to SEQ ID NO: 6249

SEQ ID NO: 33355 - DNA, 201 bp, Homo sapiens; identical to SEQ ID NO: 6250

SEQ ID NO: 33356 - DNA, 201 bp, Homo sapiens; identical to SEQ ID NO: 6251

SEQ ID NO: 33357 - DNA, 201 bp, Homo sapiens; identical to SEQ ID NO: 6252

SEQ ID NO: 33358 - DNA, 201 bp, Homo sapiens
ttgccttctgctagcttttgaatgtgtttgctcttgcttttctagttcttttaattgtgatggtagggtgtcaattttggatctttcctgctttctcttgwgggcattgagtgctataaatttccctctacacactgctttgaatgtgtcccagagattctgttatgttgtgtctttgttctcattggtttcaaagaactt

SEQ ID NO: 33359 - DNA, 201 bp, Homo sapiens; identical to SEQ ID NO: 6254

SEQ ID NO: 33360 - DNA, 201 bp, Homo sapiens
acaatatatgagggatccaatttctccacattctggacaacacttgttactatctgactttttgattatagctatcctagtaggcctaaaatcataactarttgttcctttgagttgcattttcctgctggctaataatgttgagtttttttatgtgtttgtctaccttctttagagaaatgtatattaagatcctttgac

SEQ ID NO: 33361 - DNA, 201 bp, Homo sapiens
tccttgtgcttccttccactgtttctatcgcctaaaattcttctccctttttcctccaccctcgagtaggaaaaaatttgtttctttattgggcagggagktctggtcattatacatttatgtaaaatgttcttctaattggcatattccatgctatgtccagattctttcaagcgaattctcattaaggtaataatacct

SEQ ID NO: 33362 - DNA, 201 bp, Homo sapiens
gctacttccttgtgcttccttccactgtttctatcgcctaaaattcttctccctttttcctccaccctcgagtaggaaaaaatttgtttctttattgggcrgggagttctggtcattatacatttatgtaaaatgttcttctaattggcatattccatgctatgtccagattctttcaagcgaattctcattaaggtaata

SEQ ID NO: 33363 - DNA, 201 bp, Homo sapiens
ttaaagaatatttcttctgcaatcagaacattgagcaatttggaaaaacgtgtacagtatatcgaatattctagcttcatttaaaatttatggttatgtgkcttgtataatgttaaaagctttaatctaaaatgaattgccatgtggccaataaccccaacataatactcataatgcatataaattctctaatattatcat

SEQ ID NO: 33364 - DNA, 201 bp, Homo sapiens
aaaccatagcggtgggtcctagacacgggacatcgctccaaccttggccaaactctcccaccctcagggttcccagatgtcctttgaataatcaaactgargaaggagaagcaagatgtctccacaccccaatccctacagccttagccaatgcatgtgtgtaactgagacagaattttagcaaaaggtctcctgcttcca

SEQ ID NO: 33365 - DNA, 201 bp, Homo sapiens
actacaggcgcccgccactacgcccggctaattttttgtatttttagtagagacggggtttcaccgttttagccgggatggtctcgatctcctgacctcgwgatccgcccgcctcggcctcccaaagtgctgggattacaggcgtgagccaccgcgcccggcccggaaaatttttttaagagtataaccaactccccgagg

SEQ ID NO: 33366 - DNA, 201 bp, Homo sapiens
taaatgtccaggtaaacatctccatagtgccagcctgctatagtctcccgaagacctcagcaattcttccccaaagcgtctccttctgcaccgtttttttytttgggcaaccatttgtgacctggctattgagcccacctgggcctcttctctttgtttgctgatagcctcgttaagtattaaaaacctactccccctctt

SEQ ID NO: 33367 - DNA, 201 bp, Homo sapiens
acactattctcagcattgagcacaaagtcgtgagcaaggtagacaaaaatgcttggcctcataaaacttacattccagtgcataaagatgagaacaatcamgtaaaatttataatatgttggatggcatggaaaatggaaataaagtggaagggaggcttcaggttaaaaagagtgtttagggaaggtcttcttaggaaga

SEQ ID NO: 33368 - DNA, 201 bp, Homo sapiens
tcctcaggtgattcaaatgcacattaagggaaaagaaacacagtgtaccgtacctgtggcttgtttagaataattatgaagaggtgttttcttggctcttmactaacgtttttaataaagctaatatttattgagtacataaatgtgccaaacacaacgttcagtctttctttaaattttttttatttaatcctcacaaca

SEQ ID NO: 33369 - DNA, 201 bp, Homo sapiens
gagacggagtctcgctctgtcgcccaggctggagtgcagtggcgggatcttggctcactgcaagctccgcctcccgggttcacgccattctcctgcctcarcctcccaagtagctgggactacaggcgcccgccactacgcccggctaattttttgtatttttagtagagacggggtttcaccgttttagccgggatggtc

SEQ ID NO: 33370 - DNA, 201 bp, Homo sapiens
gaactcatgaaattctattaaaaaacaacaattaccacatgttaagtcagataattcacagaagagacttatatgaatactaggggagctgtaggcaacamaatttttctctgaatcctgcattttgaaggaagtttctgtcatttaattagttgaggtttgattcaccaaccaaaggtctatagtgtgatatattttctt

SEQ ID NO: 33371 - DNA, 201 bp, Homo sapiens
tcaggtgattcaaatgcacattaagggaaaagaaacacagtgtaccgtacctgtggcttgtttagaataattatgaagaggtgttttcttggctcttaackaacgtttttaataaagctaatatttattgagtacataaatgtgccaaacacaacgttcagtctttctttaaattttttttatttaatcctcacaacaacc

SEQ ID NO: 33372 - DNA, 201 bp, Homo sapiens
agtctgggaggtgaaggctgcagtgagccatgatcacaccactgcactccagcctgagcaacagagaaagaccctgtctcgaataataataataataatamcaacttttgatatctctattttttcccataaaaatccaaaattttctgtttactttttggtgctctcatgctataaagtaaattctcccttggattggac

SEQ ID NO: 33373 - DNA, 201 bp, Homo sapiens
gttttgtgcatgtggtagatgtgtaggaagctaaggacccaaaaaacaaccacatcataaaatcaagcagaaacacacacacaccacacacacacacagargctcaaagcataagtgtcaacagatcagaagaaaacatgggagaatgtattttttcataccaaattattaaaattccatcatctaaataacttcctatca

SEQ ID NO: 33374 - DNA, 201 bp, Homo sapiens
ggaggtgccctcttagcctctttacaggcatgagtcacatggcagggcattaaactctctcacaacctgttgtggagctcagcagggttagccaggactgytttgtctatctaactcttcttacatgggcctatgtgatatttttcataacaagagtccgggatttacctaactaataagatttccccacgcccctcctta

SEQ ID NO: 33375 - DNA, 201 bp, Homo sapiens
gtgaacatctattaattggacacttactggtgtcaggcactgtgtcatgcactgtgtcaggcactgtattttcttatttaatccaacaaaaaaaaataggmtaaattatcttattggctcaattttctttacagaaactgagcctaaatttcccaaatggctaaccaatgccagggccagcaactcaaatttgggagtaat

SEQ ID NO: 33376 - DNA, 201 bp, Homo sapiens
ttattgcctttgtattgttgttgccattttataaaggaagacaaaaaagatcagacaaaataatagtgaacatctattaattggacacttactggtgtcargcactgtgtcatgcactgtgtcaggcactgtattttcttatttaatccaacaaaaaaaaataggctaaattatcttattggctcaattttctttacagaa

SEQ ID NO: 33377 - DNA, 201 bp, Homo sapiens
attactaaaattattcttgaatcctacctttgagatctatataaaacactaggcaatttgcctgcaaatacatagaaaacaatttttaaaaggattgggaygagttattttcccctctgttaaatattagcctttgaaatgaacccagctgatctgccaaataacacttggaaattgttgtgttttaataaagtgacagac

SEQ ID NO: 33378 - DNA, 201 bp, Homo sapiens
cattttataaaggaagacaaaaaagatcagacaaaataatagtgaacatctattaattggacacttactggtgtcaggcactgtgtcatgcactgtgtcargcactgtattttcttatttaatccaacaaaaaaaaataggctaaattatcttattggctcaattttctttacagaaactgagcctaaatttcccaaatgg

SEQ ID NO: 33379 - DNA, 201 bp, Homo sapiens
ttttgcccattcagtatgatattggctgtgggtttgtcatagatagctcttattattttgagatacgtcccatcaatacctaatttattgacagtttttascatgaagggttgttgaattttgtcgaaggccttttctgcatctattgagataatcatgtggtttttgtctttggttctgtttatatgctggactacattt

SEQ ID NO: 33380 - DNA, 201 bp, Homo sapiens
aatagttaattaattgattccttagggctttttaatacaagatcatgtcatctacaaatagaaattgttttactttctttctaatctggatgccatttatstttttttcttgtccaattgccctcactagaacctttagtacaaagttaaatagaaatgggaagactagacattttgtcttgttcctgatcttagacataa

SEQ ID NO: 33381 - DNA, 201 bp, Homo sapiens
taagtcatttcaacatatggtatgttgctaaataaaaacctttattttaaaaataggttttaattattaataatttatattactttcctgatccacaatgwggtctagcacagaggtgttagccattgcatgaaagataggaactgagcccctcttctctcttcagaaacttggaagcaagaaacaaaagtcagacattca

SEQ ID NO: 33382 - DNA, 201 bp, Homo sapiens
ttgagacggagtctcgctctgtcgcccaggctggagtgcagtggcgggatcttggctcactgcaagctccgcctcccgggttcacgccattctcctgcctyagcctcccaagtagctgggactacaggcgcccgccactacgcccggctaattttttgtatttttagtagagacggggtttcaccgttttagccgggatgg

SEQ ID NO: 33383 - DNA, 201 bp, Homo sapiens
gactggttaaataaactatgtgtgagtacaatgaatgaaatattgtacagccatcaaaatgaatgaggtagatttatatatgctgatgtaggaaatctgcwagccatcataagtaaaataaatgaaacaaagaagaaaatactatgatgtacaaaaagaaaaaactatagatatacatatttatatgcatgtgtatgcatt

SEQ ID NO: 33384 - DNA, 201 bp, Homo sapiens
caatggaaggattataaaagttcatgcttcggaaaatttttttttttttttttttttttttgagacggagtctcgctctgtcgcccaggctggagtgcagwggcgggatcttggctcactgcaagctccgcctcccgggttcacgccattctcctgcctcagcctcccaagtagctgggactacaggcgcccgccactacg

SEQ ID NO: 33385 - DNA, 201 bp, Homo sapiens
cctgttcaatggaaggattataaaagttcatgcttcggaaaatttttttttttttttttttttttttgagacggagtctcgctctgtcgcccaggctggaktgcagtggcgggatcttggctcactgcaagctccgcctcccgggttcacgccattctcctgcctcagcctcccaagtagctgggactacaggcgcccgcc

SEQ ID NO: 33386 - DNA, 201 bp, Homo sapiens
ggtcttcagaaaccacagagaagagtggataacaaaagtgaaatcaagtattgaagagtatgaactgacaggaactagagacatatttagaatggatgccrgaacaggagaaatgggtgggattttaaaagctaaatgatttaaagacttaaaatgctctgaagtgtagtgaaatgttccccaaactgcagattttcccag

SEQ ID NO: 33387 - DNA, 201 bp, Homo sapiens
aaatgatgcatacctgttcaatggaaggattataaaagttcatgcttcggaaaatttttttttttttttttttttttttgagacggagtctcgctctgtcscccaggctggagtgcagtggcgggatcttggctcactgcaagctccgcctcccgggttcacgccattctcctgcctcagcctcccaagtagctgggacta

SEQ ID NO: 33388 - DNA, 201 bp, Homo sapiens
agaacaggagaaatgggtgggattttaaaagctaaatgatttaaagacttaaaatgctctgaagtgtagtgaaatgttccccaaactgcagattttcccargaaaccaggtgcataatttagtcatcgatgactggttctgtggcaatgactctagtaattagacccctgcattttatgtcagttccttctggatactcag

SEQ ID NO: 33389 - DNA, 201 bp, Homo sapiens
tcaaatgatgcatacctgttcaatggaaggattataaaagttcatgcttcggaaaatttttttttttttttttttttttttgagacggagtctcgctctgwcgcccaggctggagtgcagtggcgggatcttggctcactgcaagctccgcctcccgggttcacgccattctcctgcctcagcctcccaagtagctgggac

SEQ ID NO: 33390 - DNA, 201 bp, Homo sapiens
tgggattgtgtgtgtatcatccatccacatgtaagtaggaataaaattatttaatggaaaatttcaaataggctaactctaaaaatgtacagataatctgratgagagaaaactatcctcactttgtgttatttttcaatggtagcattttctcataatccccatgcttttttcatgtcctgctattctttaagatttcct

SEQ ID NO: 33391 - DNA, 201 bp, Homo sapiens
ttctcgtcaaatgatgcatacctgttcaatggaaggattataaaagttcatgcttcggaaaatttttttttttttttttttttttttgagacggagtctckctctgtcgcccaggctggagtgcagtggcgggatcttggctcactgcaagctccgcctcccgggttcacgccattctcctgcctcagcctcccaagtagc

SEQ ID NO: 33392 - DNA, 201 bp, Homo sapiens
cttaaccttagttttttaactgctctgaaaatggtttctgtccctggtggactcttgtttcaatgcagttattttgtctggtagagtcacagagttaagcygtcattcagatcagaaaaaataaaagagagagatgaattaatctcaatggcacagtctccttattcaaaaaataaaaataaaaataaatctcaagtccaa

SEQ ID NO: 33393 - DNA, 201 bp, Homo sapiens
ccgtaacctccaactattcagccatgaatcgctgcatgtggaatggaagggggaatgtctaacaaacagagacatacttcaagtcttcagtctagttaaamcattggaatgagggtctgcaacatctttctggggcttggagtctcgtctcagttctaaaatgagatggttggcctggatcctaagtttcaaattggcagc

SEQ ID NO: 33394 - DNA, 201 bp, Homo sapiens
ttggtggtgctataatcctgtgtaggtatagctttggcaaaacatttcagataagcttgttttttgccccatgggttctgggacgaggtgagttgtctgtytgtcctataaggttcagaaaggtaaaagggcaaggtcattaattggctagagggcaacaaagaaggtagttatccctgtgtggtcaagaaaaagtggctc

SEQ ID NO: 33395 - DNA, 201 bp, Homo sapiens
tcacacacgtggtttttcttatctattgctcacacacttagacataactggaattattgcctttgtattgttgttgccattttataaaggaagacaaaaargatcagacaaaataatagtgaacatctattaattggacacttactggtgtcaggcactgtgtcatgcactgtgtcaggcactgtattttcttatttaatc

SEQ ID NO: 33396 - DNA, 201 bp, Homo sapiens
agtcaggcacatctcacgaagtgcagactatgcaagctggctgtgtgagatcaagggtagacagttgactcatcctgtcacatctctgtgttttaccgtamcctccaactattcagccatgaatcgctgcatgtggaatggaagggggaatgtctaacaaacagagacatacttcaagtcttcagtctagttaaaacattg

SEQ ID NO: 33397 - DNA, 201 bp, Homo sapiens
tcatgttcaggtttctggaaggctcagagcctgggcttctactggcagagggtagacccaaatggactactctagtgaaaatctccaggtgaacatggaaygcagtgaaaacctggggtatccaacttgcagtataggccaccagcaagtgtcacctctattataactttaaccaggcaagctcagtctcatgcattagtt

SEQ ID NO: 33398 - DNA, 201 bp, Homo sapiens
caagaacaatgaggggtaggggtgaagttcaggctgccattctgaaagcttcctcagactgagtcaggcacatctcacgaagtgcagactatgcaagctgsctgtgtgagatcaagggtagacagttgactcatcctgtcacatctctgtgttttaccgtaacctccaactattcagccatgaatcgctgcatgtggaatg

SEQ ID NO: 33399 - DNA, 201 bp, Homo sapiens
caacagatcagaagaaaacatgggagaatgtattttttcataccaaattattaaaattccatcatctaaataacttcctatcatagcatgttgtcgacctyatttttcaaatccataattttagaacttatgtcgtggggtagtctaaaagcctcttgcaaacttttaacatctagtttcaaatcaaaaataatatattaa

SEQ ID NO: 33400 - DNA, 201 bp, Homo sapiens
aaagggaaaaataagttgctagcaagaacaatgaggggtaggggtgaagttcaggctgccattctgaaagcttcctcagactgagtcaggcacatctcacraagtgcagactatgcaagctggctgtgtgagatcaagggtagacagttgactcatcctgtcacatctctgtgttttaccgtaacctccaactattcagcc

SEQ ID NO: 33401 - DNA, 201 bp, Homo sapiens
ttcatggagcatcaggtagcatactcagtaggttcttgcctcaggaatgggaaaaatttagccctagactaattgctgctctggtaccacctaagaaaccrtaaaagtcagactcaaaagaattaaattatttgcaagtaactcaactgcttttcagaaaacaactggagaaattttgtaggaatacaaaagcatccaata

SEQ ID NO: 33402 - DNA, 201 bp, Homo sapiens
ggaaggaacttacctatgataaacatttttctttactctcacgctttcttaacccatggctgttctgagtcaatgtttgccttgcattcaaaaaataatastaaagattcaagtaaaacatattcattaagcactatttgaaagatataccaagtgctttaacattatctcactttattcctacaaagatcatgtgcaata

SEQ ID NO: 33403 - DNA, 201 bp, Homo sapiens
atatgtgaatacatgagtgtggagttctttaggaggcctgctgcatatgctagggaaaggtttcatcatttctaatcaggatggctctgtaaatgggatgyctcatgttcaggtttctggaaggctcagagcctgggcttctactggcagagggtagacccaaatggactactctagtgaaaatctccaggtgaacatgga

SEQ ID NO: 33404 - DNA, 201 bp, Homo sapiens
ccccatgaaaacaatctgcagccacctcaacttgcctgtgctgttctcaggttctgtccatggggagccacacttcagtgagctcagcgattggatggctwtttagtctacatgagagggaaactccatgtgcctctagactagtgcttctcaaactctaatgaacacccaagtcatctggggaatctgcttgaaatgcag

SEQ ID NO: 33405 - DNA, 201 bp, Homo sapiens
tatgttgctaaataaaaacctttattttaaaaataggttttaattattaataatttatattactttcctgatccacaatgtggtctagcacagaggtgttrgccattgcatgaaagataggaactgagcccctcttctctcttcagaaacttggaagcaagaaacaaaagtcagacattcatgtctttactcatctacaca

SEQ ID NO: 33406 - DNA, 201 bp, Homo sapiens
agaacgaaaagggaaaaataagttgctagcaagaacaatgaggggtaggggtgaagttcaggctgccattctgaaagcttcctcagactgagtcaggcacrtctcacgaagtgcagactatgcaagctggctgtgtgagatcaagggtagacagttgactcatcctgtcacatctctgtgttttaccgtaacctccaacta

SEQ ID NO: 33407 - DNA, 201 bp, Homo sapiens
ctaagagatgtaacagtatgctttccaggatagaagaacgaaaagggaaaaataagttgctagcaagaacaatgaggggtaggggtgaagttcaggctgcyattctgaaagcttcctcagactgagtcaggcacatctcacgaagtgcagactatgcaagctggctgtgtgagatcaagggtagacagttgactcatcctg

SEQ ID NO: 33408 - DNA, 201 bp, Homo sapiens
tgttgagtgttagcatgaaaaagtgttgaattttgtccaatagtttttaaaaatttttttagacaatcatgtaggctttgtccattttttacttctttaawtttatttttattgatacacaatagatgtacactttttaggtacatgcaataatttaatgcccctcactataaattcggagctgcctcctcgccgatgatt

SEQ ID NO: 33409 - DNA, 201 bp, Homo sapiens
gattctatctcggtctggggtggggcctgaggctgtcttgttcgtaaactcccagttgatgctaacgctgcccatccagggccacccagagcagcaagccrgttctatgacagctctctttattttttagttacatattttgtttttactcatttcttctttgtttgctcttttactttaataacttctgttaaattttta

SEQ ID NO: 33410 - DNA, 201 bp, Homo sapiens
tgtgaacagagctgctagatctctgtattatatgaaacatatatttttgtacacagttttgcctcactggggctttgcttcctttgtactccagaggctcyccatgaaaacaatctgcagccacctcaacttgcctgtgctgttctcaggttctgtccatggggagccacacttcagtgagctcagcgattggatggcttt

SEQ ID NO: 33411 - DNA, 201 bp, Homo sapiens
tgtcttttcttcatgctagaaacattcaagttattttctcctagctactctgaaatatacaatagattactgtaaactacagtcaccctactcacctatcwaacattaattgatttttggtaaactaatctaatcttgctttctggcatcaacctcacttgaccatggtgtatagtccctttcatatgttattggatgcaa

SEQ ID NO: 33412 - DNA, 201 bp, Homo sapiens
aacaggaacaaggtattgcaagtccaaaatccaatccaaagcagcgttcttcctccccacctctaggcaaggccaaaatacttctgcacacagtatagacrccagaaaaaaacagagccactgtagatgaaaccagtcagggggtaagagctgtcttttgatctagagcttgcacctttgctcctcagtaatactcccagg

SEQ ID NO: 33413 - DNA, 201 bp, Homo sapiens
atctaacattaattgatttttggtaaactaatctaatcttgctttctggcatcaacctcacttgaccatggtgtatagtccctttcatatgttattggatkcaatttgcctacattttgttgagaatttttatctatactcttaagaaatattgatctgtagtctcgtgatgtctttatctggttttgttatcagggtgat

SEQ ID NO: 33414 - DNA, 201 bp, Homo sapiens
tgtgagaaagtcctttggcaaggactccacatggccacaggtgattcctttgagcagtgttcttcctgtatagggcttaagaggaccagaagggaaatgaytgtactctcttgtcagctacttcctgggcgatttgggttctttgataccccagtgctcactttcggaagtgttaagaccataaaccttaacagttgacct

SEQ ID NO: 33415 - DNA, 201 bp, Homo sapiens
ccattgatagaaatcatctcaaaaatgctccatcttccttgtgaaagccaaaggccagcagtttccacatacccagcatctgataagtagttaatgatccwgaaataaactgttaggtgcttcagggaatttctgtgtatagagaagttccatgtaaatatttctccgagaggtggatggagaatgataattcacttttac

SEQ ID NO: 33416 - DNA, 201 bp, Homo sapiens
tgcagtgagccatgatcacaccactgcactccagcctgagcaacagagaaagaccctgtctcgaataataataataataataacaacttttgatatctctrttttttcccataaaaatccaaaattttctgtttactttttggtgctctcatgctataaagtaaattctcccttggattggacaagttattttctgttttc

SEQ ID NO: 33417 - DNA, 201 bp, Homo sapiens
cctcccctctctgagtctttccaccccttgctggtactttagtttcttccacttctagcaccacgtgtagtttcccaatttctcttacccaaatttgctcrcagggaaaaaaataaattaaattagccatttacaccacagtgtgaacttaataacaccaacaaaagttccaaagctctagggtctcatagcacctccaga

SEQ ID NO: 33418 - DNA, 201 bp, Homo sapiens
atcatcctcatcgtgaacattattattattatcatcattttccagatgaagaaaatgaatcacaagtcaactgacagtccaaaggctccacagctcagagraggtaaatcatgtgcttaattcagaacttttggctcccatcactatgctcttcccactgtcttaactctggttgtcacctgagccattgtgtttcttctc

SEQ ID NO: 33419 - DNA, 201 bp, Homo sapiens
gacagccaggaccccaggcagcagcgagtgacaggactttttaggtacatgcaataatttaatgcattcatataaagatcaaatcagtgcaattggcatayccatcaccttaaatatttgtcttttcttcatgctagaaacattcaagttattttctcctagctactctgaaatatacaatagattactgtaaactacagt

SEQ ID NO: 33420 - DNA, 201 bp, Homo sapiens
ttttcataaataaacttcacagtttgaggaagttcctattcctagtttgttgagtgttagcatgaaaaagtgttgaattttgtccaatagtttttaaaaawttttttagacaatcatgtaggctttgtccattttttacttctttaaatttatttttattgatacacaatagatgtacactttttaggtacatgcaataat

SEQ ID NO: 33421 - DNA, 201 bp, Homo sapiens
gtatgctttattttacatcttaaaagtattgaacagaaggagttttgtccatgatatcccatcagcccactagcaggaaaagcaggacacttacccagggkgttcctgctggaaatgattcttggaatcagccttccttctactctatttgggaagtctttggtttctaacattcacacatttgtagcaaagcttccaaaa

SEQ ID NO: 33422 - DNA, 201 bp, Homo sapiens
ctagagctcaccacagagaggagagcatcatgtctgcagatgccacagcagatctgctgagaatcagccagcgccatgtgacacaagaacccacagatgcrgattcgtcctgactggtggctttcttctggccattgctgttacagagaagtttctaagcagtactcaatgcacacaaaactaagtagaggctatataggc

SEQ ID NO: 33423 - DNA, 201 bp, Homo sapiens
tggtgttactcaacagagataagccctcctagagctcaccacagagaggagagcatcatgtctgcagatgccacagcagatctgctgagaatcagccagcrccatgtgacacaagaacccacagatgcagattcgtcctgactggtggctttcttctggccattgctgttacagagaagtttctaagcagtactcaatgca

SEQ ID NO: 33424 - DNA, 201 bp, Homo sapiens
aggaaactatggggaatttttttttctttagattgcaaactagttttaaaaagagcttgtaatgaacaatttaattagattggttttggcttgcctaaaarcttaagaaggtattaatattctaatcaaaagtcttgggaaagcattcttagaataaaaaaaggaaagaaaatcttcattcttatgctttaagaaccagga

SEQ ID NO: 33425 - DNA, 201 bp, Homo sapiens
acagtcaaagattacaaaacctaagcagaagtccattatcaagaaacagtgtccacaagtgcaataaatataatttatacctgaggaactataaatagtaragcaattgggtaggggctcttaacagacagatattcaaaatgttaaggaaaataaaagaagaagtagacttcgtaaaataggaacagagggctaagaaat

SEQ ID NO: 33426 - DNA, 201 bp, Homo sapiens
gctctcctgaatgccaagcacaaccatgcttggcatggcagtggtgtcttatttctgctcctctttttccccagggcatgccattgcaagagaatgctcakccatgttcatctggggacctgctcctggtagagcaataggatctgtgtgcccagcaccactgcccacctagctgtcctggcctgtgcccaatgctgacct

SEQ ID NO: 33427 - DNA, 201 bp, Homo sapiens
aaattgttttactttctttctaatctggatgccatttatctttttttcttgtccaattgccctcactagaacctttagtacaaagttaaatagaaatgggragactagacattttgtcttgttcctgatcttagacataaaaacgttgtcttccgttattatgtgtgatattagttaagtttttcataaataaacttcaca

SEQ ID NO: 33428 - DNA, 201 bp, Homo sapiens
agtgagctcagcgattggatggctttttagtctacatgagagggaaactccatgtgcctctagactagtgcttctcaaactctaatgaacacccaagtcayctggggaatctgcttgaaatgcagattctatctcggtctggggtggggcctgaggctgtcttgttcgtaaactcccagttgatgctaacgctgcccatcc

SEQ ID NO: 33429 - DNA, 201 bp, Homo sapiens
tctacatgagagggaaactccatgtgcctctagactagtgcttctcaaactctaatgaacacccaagtcatctggggaatctgcttgaaatgcagattctrtctcggtctggggtggggcctgaggctgtcttgttcgtaaactcccagttgatgctaacgctgcccatccagggccacccagagcagcaagccggttcta

SEQ ID NO: 33430 - DNA, 201 bp, Homo sapiens
ttaggaagaaggaggaagctatgtggacatctgggagaagatcgctccaggcagagggtagagcaaatgcaaattccttgaggcagcaatgtgctggcatrgtcaaggcacagcgagtatgccagggtcttcagaaaccacagagaagagtggataacaaaagtgaaatcaagtattgaagagtatgaactgacaggaact

SEQ ID NO: 33431 - DNA, 201 bp, Homo sapiens
taacgctgcccatccagggccacccagagcagcaagccggttctatgacagctctctttattttttagttacatattttgtttttactcatttcttctttrtttgctcttttactttaataacttctgttaaatttttaatatttggatctgtaaaacatttaaagttctctttcacttcactatgtacaagtatctctgg

SEQ ID NO: 33432 - DNA, 201 bp, Homo sapiens
agggtgatactggcctcatagcatgagttgggagatcatccttactcttctattttttggaagagtttgtgaagaattgatattatttcttctttaaatayttattgggtttttaaaatacatttttaaaatgcaacttgggtagcatgtccaataggaacaaatgagtgtccacccttgaatttcataaccctggaatta

SEQ ID NO: 33433 - DNA, 201 bp, Homo sapiens
tgtctcttgccccatggtgccaggtggtctgccatgcttccctcttcgtggctgccaggattcccggtatagaggcaaatacaacctgtaaaggctcaaaygcttcatcaaaagccatgactataatccaaagctattaggtttaagcaacttatttggaaattatcaccttcaaataacatgtagggcaacctcagtaga

SEQ ID NO: 33434 - DNA, 201 bp, Homo sapiens
gttttgcttaggaataacaaaacatggaagaaaacattctgtgaaattttaaactttttcaaacctttaagtttcagatgaataagcaaaacatacttaaktctaagaagctattttttgtttgtcaaagaactgatgttataccagttctaatattaattagcaactttgccctggttttcctgtaaaataatctccaag

SEQ ID NO: 33435 - DNA, 201 bp, Homo sapiens; identical to SEQ ID NO: 6275

SEQ ID NO: 33436 - DNA, 201 bp, Homo sapiens
ttcataatattatttccatttgtcagatcaatgaaggtttaatgatttgtccaagatctcaatttctagagaagcgaagaagaatcccccaattctagttytaagtttcttttttcccttgctaaatcctgcagtctactgatttttttttttttagacggagtctcgctctgttgcccaggctggagtgcaatggcatga

SEQ ID NO: 33437 - DNA, 201 bp, Homo sapiens
tattttttaaattatggtacaataaaatgtgcataagctttatactaagtaatagaatcatttaagtttagctgtagattcacaagtaaaaatccaatctrttttcatattcttacatttatagacatttcttacatgtctatagaaagaaatggctaggaatgagactgcactattttaccctaaaacgttctttttctc

SEQ ID NO: 33438 - DNA, 201 bp, Homo sapiens
ccaggtgcataatttagtcatcgatgactggttctgtggcaatgactctagtaattagacccctgcattttatgtcagttccttctggatactcagctacmttatttggtgcttttggtatacttcaaatatgcattgcctatcactgacctgtaatcctgtgtctctgggcctgaaaatataacttttcatgtagtagag

SEQ ID NO: 33439 - DNA, 201 bp, Homo sapiens
gaataaaagttaagaccacattgggccagatcaggactaacactagatacacagctgagataaagttccagtgactttggcagtgtgaaagtcaggaccastaggcacatatactgaaggcaatttaagctgtgtttcctgattaaagccagggactgaaaaatcactacctattcatgatgaaagactagaaaacttctg

SEQ ID NO: 33440 - DNA, 201 bp, Homo sapiens
catcgatgactggttctgtggcaatgactctagtaattagacccctgcattttatgtcagttccttctggatactcagctacattatttggtgcttttggyatacttcaaatatgcattgcctatcactgacctgtaatcctgtgtctctgggcctgaaaatataacttttcatgtagtagagaattagggctgtgcaaca

SEQ ID NO: 33441 - DNA, 201 bp, Homo sapiens
gcattctcccatgtatctgacttaaaagcaatacttgtctcttgccccatggtgccaggtggtctgccatgcttccctcttcgtggctgccaggattcccrgtatagaggcaaatacaacctgtaaaggctcaaacgcttcatcaaaagccatgactataatccaaagctattaggtttaagcaacttatttggaaattat

SEQ ID NO: 33442 - DNA, 201 bp, Homo sapiens
cagggcatgccattgcaagagaatgctcagccatgttcatctggggacctgctcctggtagagcaataggatctgtgtgcccagcaccactgcccacctakctgtcctggcctgtgcccaatgctgaccttcacctcagagtgtggctgtaccacattcggtgatgtcactctcactgaaccttcagcctccttcctggga

SEQ ID NO: 33443 - DNA, 201 bp, Homo sapiens
cttcatatttctctgaccgttagagagtttgtgacttggataactttcaaacaactagtaccctgatggaaatccagaattttgttaacccagatcacagstgcatacttaaatgctatgcaacagtggcacttacccccaaaccgtatcctatggaaatgcctttttagcaaattaaactgaattgtgttcagagatcca

SEQ ID NO: 33444 - DNA, 201 bp, Homo sapiens
cttcctgccttaaatacagaatgccagatcacagctctgaataaaagttaagaccacattgggccagatcaggactaacactagatacacagctgagatamagttccagtgactttggcagtgtgaaagtcaggaccagtaggcacatatactgaaggcaatttaagctgtgtttcctgattaaagccagggactgaaaaa

SEQ ID NO: 33445 - DNA, 201 bp, Homo sapiens
atctggggacctgctcctggtagagcaataggatctgtgtgcccagcaccactgcccacctagctgtcctggcctgtgcccaatgctgaccttcacctcakagtgtggctgtaccacattcggtgatgtcactctcactgaaccttcagcctccttcctgggacttcctgatggactgttatccagggcagaatgtgttga

SEQ ID NO: 33446 - DNA, 201 bp, Homo sapiens
caccactgcccacctagctgtcctggcctgtgcccaatgctgaccttcacctcagagtgtggctgtaccacattcggtgatgtcactctcactgaaccttyagcctccttcctgggacttcctgatggactgttatccagggcagaatgtgttgattttctaaatcacataaatgaatagcttgactgttgattatgtaga

SEQ ID NO: 33447 - DNA, 201 bp, Homo sapiens
ctgtgtctctgggcctgaaaatataacttttcatgtagtagagaattagggctgtgcaacattgccactagattatttttaatgaaagctttgcccttttrgataaatacagcaatgtattcaaacaagtcctagggataccactgagtgcaaaatgtcatgtactagttattccatttaaattattttatcttcaagtct

SEQ ID NO: 33448 - DNA, 201 bp, Homo sapiens
ctctccctcacgacccctcgctaggcggggttcgggaccaggtgaacgctgatctgatagttgacacgggacgactgtggcatcatccttgctgccgtcartatcccgagagggaggaggttgggccgggagggtctcccggggcggggcggaggaggagggaatgcaaaacagagcctcgtccccggaacccaagaagca

SEQ ID NO: 33449 - DNA, 201 bp, Homo sapiens
aaaaaaatgttgaagaacacgaatctccgcaggaaatgatactcctgtacccccagctcgctctccctcacgacccctcgctaggcggggttcgggaccasgtgaacgctgatctgatagttgacacgggacgactgtggcatcatccttgctgccgtcaatatcccgagagggaggaggttgggccgggagggtctcccg

SEQ ID NO: 33450 - DNA, 201 bp, Homo sapiens
aaaaaaaatgttgaagaacacgaatctccgcaggaaatgatactcctgtacccccagctcgctctccctcacgacccctcgctaggcggggttcgggaccmggtgaacgctgatctgatagttgacacgggacgactgtggcatcatccttgctgccgtcaatatcccgagagggaggaggttgggccgggagggtctccc

SEQ ID NO: 33451 - DNA, 201 bp, Homo sapiens
tatatactctacatactatacagttcacccatttaaagaattaagtttatcctaaagctgcttccttacgtattttaaatttggcctaaaagtttctcagyatgtagtgaactgtaacctaactggatgctgaaaagactgaaacctactcttgtgccaatcacagagtttcagcatatctaaggtggtcagttgttcaaa

SEQ ID NO: 33452 - DNA, 201 bp, Homo sapiens
tatactgggctacctactttttaaggccaactaattatttgaaaatttatttaaagttttaatttgagatcaaaatctgtttccctcataaattttttttwaaaaaagcaaacaagatctattccattttgatctaatgttttcctgtcaccttacctttaagtgcaataatgggaaattctagaaattccttctttaact

SEQ ID NO: 33453 - DNA, 201 bp, Homo sapiens
ttatcttttgtgagggatctgtagttttccccggaagatataatgcatgaaataaaagcctccaataaaattcagtatacagttaatttatttcataaaargtgagagatataaattatcaaaggttaaaacaaaaagtaggaaccagagcagggtttttcagtagcaactctattgacattttggattagataatttttt

SEQ ID NO: 33454 - DNA, 201 bp, Homo sapiens
ctggcagagcagactctttgccaggacagcagtccagtgctttctcttccaggctgttctgctcttcctcaatttttacagcatttttatgttaatcaatmaataaataaaaagtaaagaactataatgcatacaaaactgtgatggaagaaaaggaaactatgtgataaaatcaaataaatatgacccttatagctttag

SEQ ID NO: 33455 - DNA, 201 bp, Homo sapiens
ttatgttaatcaatcaataaataaaaagtaaagaactataatgcatacaaaactgtgatggaagaaaaggaaactatgtgataaaatcaaataaatatgamccttatagctttagttttcttagaacagaggccctttaacttcagaatgttgaaaccttctcttgaagttctcttataatactctgccctcacctctgtg

SEQ ID NO: 33456 - DNA, 201 bp, Homo sapiens
gcaaaagtaaaaaagatgtaggatcatttttaaaggccaatattttcttccttactcattaccttctgtaaaattctgtaagattttctttagttttccartaatgataaacatttcaccattgcatagacataattaattgattttttaagcagttggagagccaaacaaaataaggggtagaatacttcttattttatt

SEQ ID NO: 33457 - DNA, 201 bp, Homo sapiens
tttatttcctgtgtcattctgagaagagaaagtaatagaggcaagaaatttggcaccctattgatctattttattactttgttgagcaacttgtgcttccsgctgaagatgctgcatcccaacatgattctcttattattagttaccacctgagggttttggatctccaggtgtttatttcacatagcatatgctttaacc

SEQ ID NO: 33458 - DNA, 201 bp, Homo sapiens
ccttggccactgggcagaatttccacaaagcagactatattaccttcacattcccaaatataaagtttttgtgaacaaatatggttccatatgccttatawtatttatattatttttatattatttttaatttcattaatgtaatgccagccactcaccccaaaggtcttctactattttcacaaaggatcacctcaaaaa

SEQ ID NO: 33459 - DNA, 201 bp, Homo sapiens
ttaacagtataaaagtaattaatctagctgcctcgtaccggtttggcctaaataaacatgcaataaaaaagccataggattttattatttttttactcackttactactttagtgtgttggaattttaatatgtcagaagaaagatatctttgcattaaaaaatcattttcttttcaaatgttaatgtactgattataact

SEQ ID NO: 33460 - DNA, 201 bp, Homo sapiens
cagaattcacacggtcatgatattttatagaagaaatcattttatgggaactttcttttgttaatagatccttccaatgctaacattattctgtataacartgctaaagttggtatgcctaaatgctaaacttggtatgctaaagttggtttaaaaattaacctatatacaatcttcttgaataactcttcaactttaaat

SEQ ID NO: 33461 - DNA, 201 bp, Homo sapiens
ctaggaagctttgtataataatcctttaagagtttaaagaccatgagatttacccttcaagcagtgtaataggaaaatatttatctatatgcacaagagaygtaaatttgatgaaaaaatgatgttaattttaaaactattaaaagccagtttgctattatgattattttgcttcaagtatccaaatgatgatgagccaaa

SEQ ID NO: 33462 - DNA, 201 bp, Homo sapiens
taacagtataaaagtaattaatctagctgcctcgtaccggtttggcctaaataaacatgcaataaaaaagccataggattttattatttttttactcacgwtactactttagtgtgttggaattttaatatgtcagaagaaagatatctttgcattaaaaaatcattttcttttcaaatgttaatgtactgattataacta

SEQ ID NO: 33463 - DNA, 201 bp, Homo sapiens
aaaatactatgatgtacaaaaagaaaaaactatagatatacatatttatatgcatgtgtatgcattttttatgaatatacatatttatatgcatgtgtatrcaagtcctagaaggagacataggtaactattagtagtacctctgggaagtaaatgcagagaaaagtaatagagggtaaggatatgtttacttttatttta

SEQ ID NO: 33464 - DNA, 201 bp, Homo sapiens
agcactgaactaaagaaccagaaaatagaggggtgtattagtgaactacagaaaattcaagtcccaaaagctgtaaatactctgaggaccaaagaaaatayatacgttgttcagatttgccctgaggggtcagtttgtacccaaacatttgctgccacaagtagtaaatgtagaagcaatgcaatatctactattttactt

SEQ ID NO: 33465 - DNA, 201 bp, Homo sapiens
aatagtgacccctcacatttaggtgttttggctgcttaatgcgagctcctgccctctagccgcatgcttattagtttacctagccctttttctggtcagtsatgactggagaatgccaaagagtctcccaagtaggctaccaaattaagaattgtgtttagaagtttgaagtcagtccaagtgttgtaaagattaaaacgt

SEQ ID NO: 33466 - DNA, 201 bp, Homo sapiens
caccctactcacctatctaacattaattgatttttggtaaactaatctaatcttgctttctggcatcaacctcacttgaccatggtgtatagtccctttcrtatgttattggatgcaatttgcctacattttgttgagaatttttatctatactcttaagaaatattgatctgtagtctcgtgatgtctttatctggtttt

SEQ ID NO: 33467 - DNA, 201 bp, Homo sapiens
gaaaaggctgcactctgagataagaaagaacagtggtgttttcatagtaagagaatagagttcttaatgggaaaggggagagtataatttccactgatttmgctggtctttcaaactttatgatgcttttctccttgaactagcctataagaaatttgtagggaaaataccacaggaatcaaattttgggcatagatgtct

SEQ ID NO: 33468 - DNA, 201 bp, Homo sapiens
agccaggactgttttgtctatctaactcttcttacatgggcctatgtgatatttttcataacaagagtccgggatttacctaactaataagatttccccaygcccctccttacaaaaactcagttcaaagaacaagccctcagcttctcctagtcccctccagggaaaatgaagagtagcttgtcctattctgaatatgtt

SEQ ID NO: 33469 - DNA, 201 bp, Homo sapiens
tatttgcattgctacttccttgtgcttccttccactgtttctatcgcctaaaattcttctccctttttcctccaccctcgagtaggaaaaaatttgtttcyttattgggcagggagttctggtcattatacatttatgtaaaatgttcttctaattggcatattccatgctatgtccagattctttcaagcgaattctcat

SEQ ID NO: 33470 - DNA, 201 bp, Homo sapiens
acgtggcaaaggaggattccatttcaagtctttcaaccccaaattcatcttcctttctctaaggggaaatggtgctatggaattcatgtaagccacagagyttggataaaaggaatagtaagaccaaaaataggaaaagtaggaagaggtggatcctcctatgtttttaatcagggttctatctacctgtaactcttctgg

SEQ ID NO: 33471 - DNA, 201 bp, Homo sapiens
ttctgaagaccagacagagtttcagagtggtatagttactaatctactaaatactgcaaatatatagtatctgcaaatatatatataaggttgaaaactargctcagaaatgagcattaaaaacttttccagatcaagggagtgctgtacccccaagctgaggtttcataggctaccatcatccaggcactcagtcttccc

SEQ ID NO: 33472 - DNA, 201 bp, Homo sapiens
ccgccaccatgcccagctaatttttgtatttttattagagacggggtttcaccatgttggccaggctggtctcaaactcttgacctcaaatgatccacccscctcagcctcccaaagtgctgggattacatgcatgagccaccacacccggccggagacaggttctccctgacctgtgagactgcaaaggtggtgtttcct

SEQ ID NO: 33473 - DNA, 201 bp, Homo sapiens
cctgggttcaagcgattctcctgcctcagactcccaagtagctgggattacaggcatccgccaccatgcccagctaatttttgtatttttattagagacgrggtttcaccatgttggccaggctggtctcaaactcttgacctcaaatgatccacccgcctcagcctcccaaagtgctgggattacatgcatgagccacca

SEQ ID NO: 33474 - DNA, 201 bp, Homo sapiens
attaaaaaatcattttcttttcaaatgttaatgtactgattataactaagtgaattccatatatttataattgtgggcagatgttctcaattaatagtttyattcattctacttcacagtttagtgaaaaggattattttaaattaaggtgtaaataagaacaaatgagatttttattactacaaatcacacagaatttgt

SEQ ID NO: 33475 - DNA, 201 bp, Homo sapiens
ctagtatatctcataaatgtaataatacagtgcagacctggtggaaaataattatttatctgaaactgggcctcagtgcctttcctgaatctaaacaaatrttcatctcacccagagaactgggacaacaggaacaaggtattgcaagtccaaaatccaatccaaagcagcgttcttcctccccacctctaggcaaggcca

SEQ ID NO: 33476 - DNA, 201 bp, Homo sapiens
caacctgtaaaggctcaaacgcttcatcaaaagccatgactataatccaaagctattaggtttaagcaacttatttggaaattatcaccttcaaataacaygtagggcaacctcagtagagatgaaatggacgaagcaggcatggaaactgcccttcctgccttaaatacagaatgccagatcacagctctgaataaaagt

SEQ ID NO: 33477 - DNA, 201 bp, Homo sapiens
agttcagagtaccagagagttgagagctgcacagagaacccagagatctgcaaatggtaccccttgtgcttcagtgcatgtgggcaaataatcacccaaaygtattagagagaacaagccccagaggtcatcaagagctagaaaatagttgctatttccaccagccacagtggaaagtctcataattcatggagcatcagg

SEQ ID NO: 33478 - DNA, 201 bp, Homo sapiens; identical to SEQ ID NO: 6401

SEQ ID NO: 33479 - DNA, 201 bp, Homo sapiens
ggtcagagaaattttgtgagtcttattgaaatggggcagaattgtatccttggaagcagcagcgtggtgaccaaggacaagaggcaacttttctctgatayattttgctccatcacaattgtgttttactttatgtcttgttcttttcttgtttttaatcttttaagtcccttgactttaataccctcgtggataacatat

SEQ ID NO: 33480 - DNA, 201 bp, Homo sapiens; identical to SEQ ID NO: 6402

SEQ ID NO: 33481 - DNA, 201 bp, Homo sapiens
ggagtctgactcaagctttactatagagtagcatgcctgtgagattctccaaagttaatatggtttcccaagtaaatggttgaacaagtcaacaatttccmaaagaagtttccaaaagatatttgtagtttggactgtgagacgtattttttaagccttcatatatgcatttttctgattctacccttcttttgcagaaag

SEQ ID NO: 33482 - DNA, 201 bp, Homo sapiens
ttccataattgtgctttcaaatgtaatttctagctgccaatttacactttaccacagttaagacttagtttcatttccatgaaaaatgtgcactttgctcytgattgacagatatatgctttgacaattgatacaggtttacccagtcaaggcttgttttagttgaaggtgaaaatggaagagggaaaaaaaattgcttca

SEQ ID NO: 33483 - DNA, 201 bp, Homo sapiens
ggaccaagactagatttcctgagactttaaatacgcaagacaaatgcaaacaaaatctgccaacatacccaggctgcttttcaggagtgaatcactgaagygcatttggatttcctataacactactttcttttgggaatgtacagccctcccccagctccccatcccccatcataatgtaaaccattctaagagaaaata

SEQ ID NO: 33484 - DNA, 201 bp, Homo sapiens
cactgaagtgcatttggatttcctataacactactttcttttgggaatgtacagccctcccccagctccccatcccccatcataatgtaaaccattctaakagaaaatatggatgttttggctgggggtggtggcacatgcctgtagtcccagctacttgggaagctgaagcaggaggaccacttgagcccaggagtttga

SEQ ID NO: 33485 - DNA, 201 bp, Homo sapiens
taaattatagtttgcgtgtgtaagaatgaatgaaattaatagccctcacttatttttaaggctttagaaagaatattgtttaaaataaccccatactctaygatggtcctgattcttccttagcttgcccctcgctatgtgagactgactacttaatggatttgtcacagaggttttcctggctgagagatatcagagact

SEQ ID NO: 33486 - DNA, 201 bp, Homo sapiens
gaggaccacttgagcccaggagtttgaggctgcagtaagacatgatggcaccactgcagtccagtctgggtgacagatgacagaaaaaaaaaaaaaaaaaraaaagaaaagaaaatatggacattttatttctggactttatccttaaatgcttagctttagaatagtgcacaggtacatccttaataaaaagtaaatttg

SEQ ID NO: 33487 - DNA, 201 bp, Homo sapiens
aggataaaggatatttaaatacctcatgggtctctttttccacctccctttcactttagtgtgaatgacattgtggttcttggaccagaacagttctatgmcaccagagaccactattttaccaactccctcctgtcattttttgagatgatcttggatcttcgctggacttatgttcttttctacagcccaagggaggtt

SEQ ID NO: 33488 - DNA, 201 bp, Homo sapiens
ggcacaagcactagaaatcagtggtggatttgacaaagaattatttaatccacatgggatcagtattttcatcgacaaaggtaaaacctgtatgtttaggrataagggggaaatgagggaaatagaaaccatttatctccagcccctcaatatttatgtaacaggaagagagaagatgctattttaccatacagatgtgtt

SEQ ID NO: 33489 - DNA, 201 bp, Homo sapiens
ccacctgactgagccctaccagctcatttaattacctgtcactacttaagccctcccagtgggacatctgccccgtccactctgccccatgcaaggtcttsaggggtgtactaaatgacattctttgtgggtttttctcagcacatttccttactgacatctctccacattacctaaagaatgtcattgaccactccctgg

SEQ ID NO: 33490 - DNA, 201 bp, Homo sapiens
cctcagtatttctttttattgcattcgttgtctaacaacaataatactcattggcaagaaatttatttacactaacaaattaaatttaatcacaggtattkttagattggtcagaaaacaaaagaccactgtgatattttgcttgaatgcctctgaaaaccaaagagtaaggaatgtcatttgaaactttttgaacaatct

SEQ ID NO: 33491 - DNA, 201 bp, Homo sapiens
ttgggtcaaaaaaccactttattcacagcaagattggagttactcatgattccagtgacataatatcccgtgccctacatgggctcaatttttctgagatkctgctcacagcccaggatgctgggttctctgaaagactgtcttgaaattatcaatgagtgtgatgcttagggaacacccccaacatatttcattatttag

SEQ ID NO: 33492 - DNA, 201 bp, Homo sapiens
tcagaacaggctccctgctagactgtcagcacttccatggcatgagctgtgtctgctgggtacctggtgctctccaggtgttgcgttccttgcagagctcrtgtaggagctcagtaattgtgtcttgaatgaatgggaccccaggtttctgtgtccttctcccactcccactctcatctcaggtttcatctgccgtggaat

SEQ ID NO: 33493 - DNA, 201 bp, Homo sapiens
caggtatttctgtaaaacaaaagttaaagaattttatgagaatagaacccaatgtaacagacattcaccacagaatgtcaaggctctgctctcaccagggygagactgagggcaaggccagtttcagcaacagaccaggcctgtctcccatcatgaaaaccccaaaaaggttctccatcaattgtcacattattctttctt

SEQ ID NO: 33494 - DNA, 201 bp, Homo sapiens
agtggcctgatggtaggaatgtactcatttttttctgaatgaataaatgaaagatcaatcacccccaaattcctatcattttgtaccacgtcggtaagaaktttatctagcgtgtctgttccgcctgtagcccatccgcctcctgtgagttcaagtcatcaggaggacaagtaaatttcttagcctatctgaagccaaata

SEQ ID NO: 33495 - DNA, 201 bp, Homo sapiens
tgctttcctgccataaacgcccactgcaggaagcactgtcagcgccaattgtatgactgttcctgtcagcacatctgagagactgtcatgaggggcctcaytcagagaaaattaccttaaagcaacatcaaatgtaacatcgtgtttgacattaaaaatcactggcagggctagtttggtattagctcaagtaaaatggaa

SEQ ID NO: 33496 - DNA, 201 bp, Homo sapiens
tttcttctgatctccctctcctccaccttccttccctctcctcccttttctttctcttttttcctctatgttgatggaacagccaagaaatagcctcaaattgtactttatgcagggctgctctccacaatgtttatgaagtccacgtgctcacgatggctgctaggtgacctggctgcccctcacctctctgcctttacc

SEQ ID NO: 33497 - DNA, 201 bp, Homo sapiens
tgaaaagacaggaaaggactgtgcttttctcttccattttaccttttcattctgagaccactaaggtctttgcattaagtaggtgacgtgaaccctagtgrccactgcccaccaaaatgcccctcatctccagctctgtcaggagtacctttagttactcaaatggaaatatctcagtgtaatgatggggctacaacatat

SEQ ID NO: 33498 - DNA, 201 bp, Homo sapiens
ctaatattaccagatttttactaatttagtgttttagtatttgaaaagttttgccaaattgtatcactcattaatagtggcttcttatttctcatgatgtkaaaaaataacaaagcaccagacatctcaagacattaatagagtatccaatatggcagtttcattatcatacccctaatgaagacagacagaaaaacataa

SEQ ID NO: 33499 - DNA, 201 bp, Homo sapiens
gccaaattgtatcactcattaatagtggcttcttatttctcatgatgttaaaaaataacaaagcaccagacatctcaagacattaatagagtatccaatayggcagtttcattatcatacccctaatgaagacagacagaaaaacataatggtgactttgataactgtaaaacacaatgttacttcatgtcaacgtttctg

SEQ ID NO: 33500 - DNA, 201 bp, Homo sapiens
ctcttgccttcactctgctcccagcacaacctcacaattaagtgaatatgtccaggaagttctgccccggggcctttgcacactcccagcacaacctcacwattaagtgaatatgtcccggaagttctgccccggggcctttgcacactcccagcacaacctcactattaagtgaatatgtccaggaagttctgccccagg

SEQ ID NO: 33501 - DNA, 201 bp, Homo sapiens; identical to SEQ ID NO: 17277

SEQ ID NO: 33502 - DNA, 201 bp, Homo sapiens; identical to SEQ ID NO: 17278

SEQ ID NO: 33503 - DNA, 201 bp, Homo sapiens
tgggccttgacactaaattgtcaaaccaaaagagaaacgctgtaatgcattttactcccagatactaaaagttagtgttagggctaagttcctcccatacygataaggacaactatgtcccctccttcagaaacaacttttcagagattaaacccctctgtcactgtaaactcactgagttctttcagaatttggtgtgtt

SEQ ID NO: 33504 - DNA, 201 bp, Homo sapiens
ggatgcacagtgcttagactaaccccagatctttgtggggtatgactaaagccacagggtcaggaccacactcagggcagaagaggaggaagacttctctygatccaagccaagcagcttttcttctctcatattttctctggattaaaacaaggggctgttgtccaagggctttcctgcaactttcccgagagagaactc

SEQ ID NO: 33505 - DNA, 201 bp, Homo sapiens
atgtgtgtatgttttaattgcagtttgaatgatattgttgctgtgggacctgagcacttttatggcacaaatgatcactattttcttgacccctacttacratcctgggagatgtatttgggtttagcgtggtcgtatgttgtctactatagtccaagtgaagttcgagtggtggcagaaggatttgattttgctaatgga

SEQ ID NO: 33506 - DNA, 201 bp, Homo sapiens
cagatttcttagaccaatgattgtctttaaggattgtatcggcaggactaatttcatattaattgtgttccattatagctagcacgaaggctccatcccayatcttgattttaggaatagacagtgaggaatgccagttaataatcctgtaatgttcaataccttcaccttatatattatgtgtgtatgttttaattgcag

SEQ ID NO: 33507 - DNA, 201 bp, Homo sapiens
ttgtaaggacactgaaaaccactagcattaaagtaggaattgtgcaagacattggagccttgattaggtatcatgcactacagtcaataaaagaaataatrggaaaacaaaatgtgcacaagatctgaggtctttcactttgctttcatacccttaatcagtttacatcttatgctttgtggggcaatcaaaccaaatgac

SEQ ID NO: 33508 - DNA, 201 bp, Homo sapiens
ttatgtgttccctattgtacccattaaagcagaaaaatagactcatatatcttacattttcagtaacagagaatcctaatcagaaaggaaaaaaaaaaagycatagcattctatttctgagcattcttgttcatggacatttcattcagtttagaatcacgaaatcttaaggctggaagatcaaccagtctatcatcctgc

SEQ ID NO: 33509 - DNA, 201 bp, Homo sapiens
ctgcaatagagcagagataattttctcccagatcatgccctggggaacttccatcacctcaatcagcaaagaatgactcacttatgtgttccctattgtayccattaaagcagaaaaatagactcatatatcttacattttcagtaacagagaatcctaatcagaaaggaaaaaaaaaaagtcatagcattctatttctga

SEQ ID NO: 33510 - DNA, 201 bp, Homo sapiens
gagattggagagaaattgagttactggatgaaggccaatcaactcactagtggccaagtaggaaccccagctcaggtcatcttctgccccatcaagatgartaaaagttcagagaacagcttttggtggaagagtttattcgtgcatttatttaacaaatatattttggagagagaataaggtcactgagtggagaatgtg

SEQ ID NO: 33511 - DNA, 201 bp, Homo sapiens
ataaaacactcaagaatctccaatctcagtcaacttcctcacatgccctgtgaagatttggcttgtaaggccagtgatggatttaggagaacaatccgacwctatcttctgaaacatttacctccaactgattacgattttctagaatcccaacctatttttatataatttatgtacagcatttgactacctccatatctg

SEQ ID NO: 33512 - DNA, 201 bp, Homo sapiens; identical to SEQ ID NO: 17283

SEQ ID NO: 33513 - DNA, 201 bp, Homo sapiens; identical to SEQ ID NO: 17284

SEQ ID NO: 33514 - DNA, 201 bp, Homo sapiens
atttctgtgggatcagtggtgatatcccctttatcattttttattgcacctatttgattcgtctctcatttcttctttattaatcttgctagtggtctatstattttgttgattttttcaaaagagcagctcctgcattcattgattttttgaagggtttttcatgtatctatctccttcagttctgctctgatcttagtt

SEQ ID NO: 33515 - DNA, 201 bp, Homo sapiens; identical to SEQ ID NO: 17285

SEQ ID NO: 33516 - DNA, 201 bp, Homo sapiens; identical to SEQ ID NO: 17286

SEQ ID NO: 33517 - DNA, 201 bp, Homo sapiens
tctggtagtcatcttcccactaactggtattcctctcaccatgtctgcctttatttggagctctgcaaatgtttgtggatcgaatattaaccacgttactygatttaaaactctaaacacgttccatcttgggttccctgccattcttaacaagtctttcaaagagaaatagagaacagactgcattttaattcccagtac

SEQ ID NO: 33518 - DNA, 201 bp, Homo sapiens
atgaggaagtatgtgtgagagcccttattggagcttggcacatagtaggccatgaaaagcaatttgaatgaatgaggcgtgtgtagtagcagaaaatagaytgattagagtgaatttggccccaagaagagtttgagaatcgatacggatttcttaatgcctaggcaaagatctctgcttttttctgcgagcagccagcat

SEQ ID NO: 33519 - DNA, 201 bp, Homo sapiens
gtctggttttctgtccttgtgatagtttgctgagaattatagttttcagtttcatccatgtccctgcaaaggacatgaactcatcctcttttatggctgcatagtattccatggtgtatatgtgccacattttcttaatccagtctatcactgatggacatttgggttggttccaagtcattactattgtgaacagtgctg

SEQ ID NO: 33520 - DNA, 201 bp, Homo sapiens
catgccaaactttgcgccagatgaaccaggaaaaatcttcttgatggatctgaatgaacaaaacccaagggcacaagcactagaaatcagtggtggatttracaaagaattatttaatccacatgggatcagtattttcatcgacaaaggtaaaacctgtatgtttagggataagggggaaatgagggaaatagaaaccat

SEQ ID NO: 33521 - DNA, 201 bp, Homo sapiens
tctggttttctgtccttgtgatagtttgctgagaattatagttttcagtttcatccatgtccctgcaaaggacatgaactcatcctcttttatggctgcatagtattccatggtgtatatgtgccacattttcttaatccagtctatcactgatggacatttgggttggttccaagtcattactattgtgaacagtgctgc

SEQ ID NO: 33522 - DNA, 201 bp, Homo sapiens
tctgttttggtaccagtaccatgctgttttggttactgtagccttgtagtatagtttgaagtcaggtagcaatgatgcctccagctttgttctttttcctkagaattgtcttggctatgcgggcccttatttgattccctatgaactttaaagtagttttttccaattctgtgaagaaaatcattggtagcttgatgggga

SEQ ID NO: 33523 - DNA, 201 bp, Homo sapiens
aggtgggtcaattttcaggtgcatcttccagcttttaagcagtgttctctgtagattttgcctggtcagagagctaaatgtgagctttgtgttcatacttraattccaatccctgctcagccactttataactctgtggccttagaaagccacttaatcttggtcaactataacttagggaaaataacacctcacggaggt

SEQ ID NO: 33524 - DNA, 201 bp, Homo sapiens
catgctgttttggttactgtagccttgtagtatagtttgaagtcaggtagcaatgatgcctccagctttgttctttttccttagaattgtcttggctatgygggcccttatttgattccctatgaactttaaagtagttttttccaattctgtgaagaaaatcattggtagcttgatggggatgacactgaatctataaat

SEQ ID NO: 33525 - DNA, 201 bp, Homo sapiens
ggagaccctgaatcaagtgcatctaagacctccttatactgcctccgctgctgtttgattgcacaaaatttatgcaatagcagatctgtggtaacactcarttccccctaggcaccttgttcatgtaacatatggtgaaataaaacactcaagaatctccaatctcagtcaacttcctcacatgccctgtgaagatttggc

SEQ ID NO: 33526 - DNA, 201 bp, Homo sapiens
ttttaaaaatatttttaagtacaaagaaatatagtgtttgatgtgtggatactttttaaaataaaaatgaggtaatattacacaaccccttctataaattkcttctgcattaaacactacatcatggactcctttatatatagcacatttgcagttgctttgccaaggcagttcgggattcagttgtgtgggagcactgta

SEQ ID NO: 33527 - DNA, 201 bp, Homo sapiens
ttgtctattccctaagcacttaaaattgccatattcaaatatttgctaaattaaatatacatttaatgtatactacttcacaggtcatttcaactttcacrtttttaaacaaatttcagaataagccctttaatttaaaattgttgataggtcccaattcccaattcccaagctttgaagacagaatccaccatatttgct

SEQ ID NO: 33528 - DNA, 201 bp, Homo sapiens
ggctcaactctccagctggttccaaccaaccagctttgttatttgaagacaattggtttgagatcatgcttttgtgtgctttgggtgtttctttttctttyttttttttttttttttttttgttcttttagaattattcatctcagttgattaaggctcaggaggctagatcagatgacttagtaccactaaatttcacta

SEQ ID NO: 33529 - DNA, 201 bp, Homo sapiens
ccagtccaggctgcggagtcagattgggcagatgagtaggaggctgcccatctgtcagcaactctaaaacatcaatggaataaactggaaccatgttgccrtttacccggactttccacctaggagtccttacacactgatgaaattgctcctgttcctgccaaagtacacagagccctagagaggatattatgtatctct

SEQ ID NO: 33530 - DNA, 201 bp, Homo sapiens
gactggtgactctttactctggttatacgttgggacaaactgtggcacttttacaaagcagattactaagaggcactccttgcctcttacgtcagattttyttagacagcgaaaatgatagccagtggcctgatggtaggaatgtactcatttttttctgaatgaataaatgaaagatcaatcacccccaaattcctatca

SEQ ID NO: 33531 - DNA, 201 bp, Homo sapiens
catctattcattcatctctgtatttctagtacctagactggtgactctttactctggttatacgttgggacaaactgtggcacttttacaaagcagattaytaagaggcactccttgcctcttacgtcagattttcttagacagcgaaaatgatagccagtggcctgatggtaggaatgtactcatttttttctgaatgaa

SEQ ID NO: 33532 - DNA, 201 bp, Homo sapiens
ctaagttcacatctatcaatcaggaaaccacagtctcctcacagtccaagccttcatcatctattcattcatctctgtatttctagtacctagactggtgrctctttactctggttatacgttgggacaaactgtggcacttttacaaagcagattactaagaggcactccttgcctcttacgtcagattttcttagacag

SEQ ID NO: 33533 - DNA, 201 bp, Homo sapiens
gagttatggaggattccttcttttctattgattggaatagtttcagaaggaatcgtcccagctcctctttgtacctctggtagaatttgtctgtgaatccrtctggtcctggactttcattggttggtaggctattaattattgcctcaatttcagagcctgttattggtctattcagagattcaactttttcctggttta

SEQ ID NO: 33534 - DNA, 201 bp, Homo sapiens
ttctagtttatttgtgtagaggtgtttttagtattctctgatggtagtttgtatttctgtgggatcagtggtgatatcccctttatcattttttattgcayctatttgattcgtctctcatttcttctttattaatcttgctagtggtctatctattttgttgattttttcaaaagagcagctcctgcattcattgatttt

SEQ ID NO: 33535 - DNA, 201 bp, Homo sapiens
acttttggaagtgaccaagttttaaaacaagtctaatattagttgtgataggggtaactttcttggaaattatcccttttttccatgtagacaatactgtrtatctttatgttgtgaatcatccccacatgaagtccactgtggagatatttaaatttgaggaacaacaacgttctctggtatacctgaaaactataaaac

SEQ ID NO: 33536 - DNA, 201 bp, Homo sapiens
atccagtctatcattgttggacatttgggttggttccaagtctttgctattgtgagtagtgccgcaataaacatacgtgtgcatgtgtctttatagcagcrggatttatattcctttgggtatatacccagtaatgggatggctgggtcaaatggtatttctagttctagttctagatccctgaggaatcgccacactgtc

SEQ ID NO: 33537 - DNA, 201 bp, Homo sapiens
tcttttcctaactgaataccctttatttctttctcttgtccaattgccctggccagaatttccaatactatgttgaataggagtggtgagagagggcatcsttgtcttgtgcaggttttcaaatggaatgcttccagtttttgcctattcagtatgatattggctgtggatttgtcataaatagctcttattattttgaga

SEQ ID NO: 33538 - DNA, 201 bp, Homo sapiens
tatgtcctgagtgttattgcctaggttttcttctagggtttttatggttttaggtcttacatttaagtctttaatccatcttgaattaatttttgtataargtgtgaggaagggatccagttttggctttctacatatggctagccagttttcccagcaccatttattaaatagggaatcctttccccatttcttgttttt

SEQ ID NO: 33539 - DNA, 201 bp, Homo sapiens
gtcttgtgctggttttcaaagggaatgcttccagtttttgcccattcagtatgatattggctgtgggtttgtcatagatagctcttattattttgagataygtcccatcaatacctaatttattgagagtttttagcatgaagggctgttgaattttgtcgaaggccttttctgcatctagtgagataatcatgtggtttt

SEQ ID NO: 33540 - DNA, 201 bp, Homo sapiens
ctgccaggccttggtatcaggatgatgctggcctcataaaatgagttagggaggattccctctttttctattgattgggatagtttaggaagaatggtacyagctcctccttgtacctctggtagaattcggctgtgaatccatctgatcctggactttttttggttggtaagctattaattattgtctcaatttcagagc

SEQ ID NO: 33541 - DNA, 201 bp, Homo sapiens
gaattgttccctttaccattatgtaatggccttctttgtctcttttgatatttgttagtttaaaatctgttttatcagagactaggattgcaactcctgctttttttttttttgctttttatttgcttggtagatcttcctccatccctttattttgagcctatgtgtgtctttgcacatgagatgggtctcctgaataca

SEQ ID NO: 33542 - DNA, 201 bp, Homo sapiens
aattgttccctttaccattatgtaatggccttctttgtctcttttgatatttgttagtttaaaatctgttttatcagagactaggattgcaactcctgctttttttttttttgctttttatttgcttggtagatcttcctccatccctttattttgagcctatgtgtgtctttgcacatgagatgggtctcctgaatacag

SEQ ID NO: 33543 - DNA, 201 bp, Homo sapiens
gacacgggagggaatttcctggtctgctggttgcaaagactgtgggaaaagcacagtatttgggcaggagcgtaccgttcctccaggtacagactgtcacrgcttcccttggctaggaaagggaaatcccctgaccccttgcacttcctgggtgaggtgacgccctgccccactttggcttgccctccatgggctgcaccc

SEQ ID NO: 33544 - DNA, 201 bp, Homo sapiens
ggtttcaccatgttgcccaggctggtctcgaactcctgagctcaggcaatcctcccatctcggcctcccaaagtgctgggattacagttgtgagccaccgygcccagcctacttcacctgcttttatgctgtttaccattttctcattcacaaaacttgctcttccctgatactgcagtgcacctagctgttccagttctc

SEQ ID NO: 33545 - DNA, 201 bp, Homo sapiens
aagtgattttccatccttttatctttccttctcttccccatgtgagacacacacacacacacacacacacacacacacacacacacatatacatatatatycctttcaatggactttccactcatccacccattcatcaccattatgttttattttaaaaatatttttaagtacaaagaaatatagtgtttgatgtgtgga

SEQ ID NO: 33546 - DNA, 201 bp, Homo sapiens
taatttaaacttgttattattcatatatcacaactgttattattggtcatttactgtatgccaggcatggtgtgaaggcctttgcattcattatttcattktattcttactctagcctttcaaggtatacagagaaaacagaggttcagaatagtggctcaaaatttagtgacaatgctgtggccccacattataaggata

SEQ ID NO: 33547 - DNA, 201 bp, Homo sapiens
ccttccatgccagtctttgtgttgtcctcggttatgaccatcacccttaacatcttgtacctgccctttggttccttgagggcatgctacaaatattcacyacactttccctagaccagagttttttcaaatggtgggtaacaaagtcaatttagtaaataattaccaacatttaaaaataaataaaacagaattgaacag

SEQ ID NO: 33548 - DNA, 201 bp, Homo sapiens
caaaatatataaacatatagaaggataagtgcatttagtagaaatacttacaataaaaaaatctcttaaaatctatgagccattcaatgtatacacaacgmaagaagtggcaataaggctatgattacagctccaggtcctgactgacctcgccaagttccatacacaatatattttttaatgccatgtgattgcagtgtg

SEQ ID NO: 33549 - DNA, 201 bp, Homo sapiens
tatgagagagaagcctgaattagaataggagctgaccagttctgcctttctccatcttttgtgaacccatatgtttagtgacccttgtgagtcaggcagcrtgagtattcttcccattggttttgagtctaagaaaagtgaatttgactatccttggtgtttttcacaagtcttggcccattcagtgattttatgtccttg

SEQ ID NO: 33550 - DNA, 201 bp, Homo sapiens
gatatgacatgtttgggccacaaattggaacccaaatcaacaagtgctgacttaatgcccccttgcccaccctgggctccctttaactgtgattattctaygttttccaggctagagatcatcttctatgagagagaagcctgaattagaataggagctgaccagttctgcctttctccatcttttgtgaacccatatgtt

SEQ ID NO: 33551 - DNA, 201 bp, Homo sapiens
ataactctgtggccttagaaagccacttaatcttggtcaactataacttagggaaaataacacctcacggaggtgtttgaggattaaacgcgggcatatayggtacctgaactatagtagtaatgattatcctgttgagatatgacatgtttgggccacaaattggaacccaaatcaacaagtgctgacttaatgccccct

SEQ ID NO: 33552 - DNA, 201 bp, Homo sapiens
gagatatatctcagacattgacccttatctcttaggcccagaacatttggacttaagcctttgacaagatatttcctaataaattgaaaatgaggtagaamaaatatgagttggatgataataacacaggtgggtcaattttcaggtgcatcttccagcttttaagcagtgttctctgtagattttgcctggtcagagagc

SEQ ID NO: 33553 - DNA, 201 bp, Homo sapiens
ccttttttctttatcagttgcttagcctcagatgttcctttagagtgacacaaagcagactcagacaagttcacagcaaaggctgtatggtttctgcgcaragttcagagtctagtgaatcagagatatatctcagacattgacccttatctcttaggcccagaacatttggacttaagcctttgacaagatatttcctaa

SEQ ID NO: 33554 - DNA, 201 bp, Homo sapiens
aacagcagacagcagagaagagagacatggttgtacagaggcacctcctttgggtctttactcaaatgccccattatcagtgagaacttctctgactgctrttcttcagcagagggtattccttatcccctttcttgctttatgtgttttctccataacatatgtgcatatccataacacacacatgcatcacctagagca

SEQ ID NO: 33555 - DNA, 201 bp, Homo sapiens
ttttacatagtagctcaaggcttaagagcaagtgttcagaaggagcagagagagagggcagtagttacaatgtgaggccaaagaagcttccccccagaaarctaaaggtgataagtaaagcatgttggtattggctggcaatattccacaagagatgaaaggacagatattgcagaagagagaaggtataactgggaccaa

SEQ ID NO: 33556 - DNA, 201 bp, Homo sapiens
ctattgtatccatgttatctaattcagtagttacttctctgccataagcatactcaactcatagccacattggacacagatcatcattccccctcttttcsaatactcttctcttttggattcattggttctacttcttaggtagattcttctgctccacctggtgttaaccagggtggcttagccagtggtattcagttg

SEQ ID NO: 33557 - DNA, 201 bp, Homo sapiens
aaaaactaaatattgtacccagagttccccacttgtcttgccctggccttgcctggaaaaattgcaggaaaaactctggagttgaaactcaggcaaagtayagtgaaggagaacttttgtggactgcctacctttgcaacttattataatttctgaatagttttgtgtgtgttttatttctttctcccccacagaacacga

SEQ ID NO: 33558 - DNA, 201 bp, Homo sapiens
ttttcagcaattttcagaatgtggggtacttggtgctttgttgtttttatctttgagcccttcgatgctgattctataatcacagaaaaattctcattctrtattcctttggcatcaaacaggttttagtttcaggtagcagaaaccactctatctagtttttggggaaagtgatcaaatgcaggaactaatgcttcacaa

SEQ ID NO: 33559 - DNA, 201 bp, Homo sapiens
tataggaacaaaataggtcaaaaatagtcaactatataagactggtatccttatgttaattcttagccagctatactgtttgccactacatgatataatcratgtaggaatgggaacaatacaattaaactatacaccccttctctctgctttgaggaaggttagttatagaataccaggaccggaaataatcttataatc

SEQ ID NO: 33560 - DNA, 201 bp, Homo sapiens
aagcaattctcatgcctcagcctcccaagtagctgggattacaggcatgcgccaccatgcccggctaattttttgtatttttagtagagacagggtttcascatgttggccaggctggtctcgaacttctgacctcaggtgatccacctgccttggcctcccaaagtgttaggattacaggtgtaagccaccactcccagc

SEQ ID NO: 33561 - DNA, 201 bp, Homo sapiens
ctgtgagccataacaatcttacctcctggtgttaaggacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgat

SEQ ID NO: 33562 - DNA, 201 bp, Homo sapiens
aggacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttca

SEQ ID NO: 33563 - DNA, 201 bp, Homo sapiens
gttttttaaaattatactttaagttctggggtacatgtacagaatgttcaggtttgttacataggtatacatgtgccatggtggtttggtgcacccatcarcccatcatctacattaggtatttctcctaatgctatccctcccctagtctccaccccctgacaggccccggtgtgtgatgttccccgccctgtgtccatg

SEQ ID NO: 33564 - DNA, 201 bp, Homo sapiens
gacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaag

SEQ ID NO: 33565 - DNA, 201 bp, Homo sapiens
catagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaagca

SEQ ID NO: 33566 - DNA, 201 bp, Homo sapiens
tagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaagcaat

SEQ ID NO: 33567 - DNA, 201 bp, Homo sapiens
tattactctattaccctttaaaaatttgttatttatttacttattttactacacctgggggtagtaaattttcagcaataaaaagctattgctctaaaccrttccactctgcccctttctgtgaaaaacagacaaatgatagtccagcatactaatttaagaaatttacttttaaaaaagagagagtaaaatcagattgta

SEQ ID NO: 33568 - DNA, 201 bp, Homo sapiens
ttggacttgagcaactggatggtagtgatgccatttattgaagtgtgagtttgggcaggggggattaagagttttcctttggacacattttgaaaagactrttaaacaccccagtgggcatgtcaaccaggtagcctgctgggccctgcccaaattccttatgcactgtttatgagcataagaaaatgattgtttggttta

SEQ ID NO: 33569 - DNA, 201 bp, Homo sapiens
cttcacccactccagttgagccttcagataagatggcaattcacactgacagctcagctgctaactcatgagagaccttgagccagaggtatctagctgtrccatgcctgaattcctgacccacagaaatgatgagataataaatgtttgttgtttttaatggtgagactttagtataatttgttatgcagcatacgataa

SEQ ID NO: 33570 - DNA, 201 bp, Homo sapiens
aggtatgagagggattgcaaataggcatgaagaaatttggaggcaaaggatatatttattaccttgatgcctgtgatgttttcatgggtgaatatatatgycaaaacttattgatttatatataatgacatatattgaattataaacacatataattatatttatatattataaatgtgtgcagtttattgtatataaatt

SEQ ID NO: 33571 - DNA, 201 bp, Homo sapiens
atttagtggaataaagtagttcataatatccttttgttacatatttaggatctgcggtaatatcctctttatttctcacatttagaatttgttttctttcycattttctttctgtcagtcttaccacagttttatatctttcattagtcttttcaataatcaacttttgaatgttttgtcctaagtttttattgtagtaaa

SEQ ID NO: 33572 - DNA, 201 bp, Homo sapiens
gttttaattataatagatttataataaaccttgatttttggtattaaaatcccccaaatttgttcttcctcaaaattttttatggatattcttaactcttygtattttcacttaaatttagagtcagattgccaatttgtacaaaacctttctaggatttgtgttggaattttattgagctccttatagatcaatgcgggg

SEQ ID NO: 33573 - DNA, 201 bp, Homo sapiens; identical to SEQ ID NO: 17330

SEQ ID NO: 33574 - DNA, 201 bp, Homo sapiens
ataaatcacatatatgtgcagcttttgcaagtactgtcaagcagttttccaaagtggttgtagcagcatactccttcacgaataatgttggagagttctasttgcttcatttctttgccagcacttaataatattagttttccttctttaacttttaactatttggattgttatgtaagaatatctcattgtggttttatt

SEQ ID NO: 33575 - DNA, 201 bp, Homo sapiens; identical to SEQ ID NO: 17333

SEQ ID NO: 33576 - DNA, 201 bp, Homo sapiens
caatgagattttctagaagagtgattcactagaaatgtaaatgaccatattagcacagccaagggcaagtcatccaactgagggaaaccaagaggaatgtwcttaagcagaagcagagaatgtaatgaaaatttttaacatattcagtttcatattctgtctaacagatgtatcagaaaaagctcagtcctttagggatga

SEQ ID NO: 33577 - DNA, 201 bp, Homo sapiens; identical to SEQ ID NO: 17335

SEQ ID NO: 33578 - DNA, 201 bp, Homo sapiens
tacactctatggggcattgtcattagcttcctgatcaaaattcgctcaccttcacatcagattccagccatggaaagaagaaagagaggatgagaaaacaygtcaaatatctttgggcccaatttggaaatggcacaaactacctccactgacattctattgataagagaatagttatacaattatagctaattggaagga

SEQ ID NO: 33579 - DNA, 201 bp, Homo sapiens
gggaggatgtatgtgtcgaggaatttatccatttcttctagattttctagtttatttgtgtagaggtgtttttagtattctctgatggtagtttgtatttytgtgggatcagtggtgatatcccctttatcattttttattgcacctatttgattcgtctctcatttcttctttattaatcttgctagtggtctatctatt

SEQ ID NO: 33580 - DNA, 201 bp, Homo sapiens
tatcaatgtgttgtcagtgagccattatggtccttttaaattcaataaagggtctatttggtgggacattaggagccagattgattgtcccattgtgataytgaagtcctcctcgagaataagggctgctgtacccactaccttgaggcaatgtggccaccattgtgctgctgggtctaggttctttgaaaagtaacctac

SEQ ID NO: 33581 - DNA, 201 bp, Homo sapiens
taataggattatatagaaccttgtgccaagtaattgcagatacacattatttcaagctcacaaggagcatctacaaaaattgactatatacctggctgtcwagcgagtcttgataatagtatatattgtctgactacaatgcaatcaagcttagactcaattttttaaaaacctagaaaatttgcatgttgaaaaattatg

SEQ ID NO: 33582 - DNA, 201 bp, Homo sapiens
tcaagttattttaccactttattccagaaaagttccagccagtttctccacccgaaaattaggggataataatacatattacagcatatatatatatatayacacacacacacacacacatacatatatttatatttatataaaacatataaataaaactaagtatatatatatatataaaaatcaggcatatagcagatg

SEQ ID NO: 33583 - DNA, 201 bp, Homo sapiens
ggataataatacatattacagcatatatatatatatacacacacacacacacacacatacatatatttatatttatataaaacatataaataaaactaagwatatatatatatataaaaatcaggcatatagcagatgtcctgtaaacgttagcttttatagctgtcatatgtgatctcaaaaatatagagtgatacttga

SEQ ID NO: 33584 - DNA, 201 bp, Homo sapiens
caaaacagggtaaatattcatctttttctcaaaggtggctaaaaagattaaatgaggaagtatgtgtgagagcccttattggagcttggcacatagtaggccatgaaaagcaatttgaatgaatgaggcgtgtgtagtagcagaaaatagactgattagagtgaatttggccccaagaagagtttgagaatcgatacggat

SEQ ID NO: 33585 - DNA, 201 bp, Homo sapiens
caagtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcagg

SEQ ID NO: 33586 - DNA, 201 bp, Homo sapiens
tgaggaagctattttgagggtgtcaggcataggggtgttgggacccagtgctagtttctggagtttcttccaaatcatctggggctgcctgagttaggaartggtcctttaggaccagttgcccttctggtgtctctgggtctaggttagtatatctcattagggcctcttgtagcctccctaggaaagcagaggaggttt

SEQ ID NO: 33587 - DNA, 201 bp, Homo sapiens
aagtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggc

SEQ ID NO: 33588 - DNA, 201 bp, Homo sapiens
aaagctctagtccatcaatttaaaacaaatatactaagtgtaaattttaattaaacttgttaatgaattaatatatttttaatttccatataatcgcattmatcaatttgaataaatgaaagaatgaattattctgaacctattaaagaagagtgatgtatagccccagtttcaagtgaggtgtgataaagaaatggatcc

SEQ ID NO: 33589 - DNA, 201 bp, Homo sapiens
ttgtgatattgaagtcctcctcgagaataagggctgctgtacccactaccttgaggcaatgtggccaccattgtgctgctgggtctaggttctttgaaaartaacctacagcatgtttgactggcccaaaggtttcagttagaactcctagtgctataccttgccttttcagtgatgaaaaactgaaatggtttggttagt

SEQ ID NO: 33590 - DNA, 201 bp, Homo sapiens
aaactaaaatgcaagtatccaggctgctggttcagcattttttcaatttcttatgggagttagttctatgtgagcccagatatgtgagcacatttttgccytgacaatgatttctggcttaatttaatttctactgaatttagtgtatttacacacagacacacacagatacacacacacacacacacacacacacacaca

SEQ ID NO: 33591 - DNA, 201 bp, Homo sapiens
agtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggca

SEQ ID NO: 33592 - DNA, 201 bp, Homo sapiens
tgcactgaggtccctggggacagagctttagtctctacaacttggtgatgggactctgtagcataccctgcatatctagttccatccctgacgaagctackgccatctgaaaaccatattttgtctggattatctatgggctgatcctttaagtcttcccagctggcataaattttgttaagaatctcacagcatgaatat

SEQ ID NO: 33593 - DNA, 201 bp, Homo sapiens
gtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggcag

SEQ ID NO: 33594 - DNA, 201 bp, Homo sapiens
tgcttactaacggccctactaacctgttgagttacttaggaaataaaggatggaccattgtcactttgcaatgacctgggtagctcaaaccaggaaatgcrttcctttaggaggaatttagctacctcctgtgccttctcagtctttgtggagcaggcttctacccattttgtgaaggtatctacacagaccaagaggtac

SEQ ID NO: 33595 - DNA, 201 bp, Homo sapiens
tgagcccagatatgtgagcacatttttgccctgacaatgatttctggcttaatttaatttctactgaatttagtgtatttacacacagacacacacagatacacacacacacacacacacacacacacacacacacgacgtaacactattttaagatacatataataggatttttatgttacagtgctataatcacctcct

SEQ ID NO: 33596 - DNA, 201 bp, Homo sapiens
gagcccagatatgtgagcacatttttgccctgacaatgatttctggcttaatttaatttctactgaatttagtgtatttacacacagacacacacagatacacacacacacacacacacacacacacacacacacgacgtaacactattttaagatacatataataggatttttatgttacagtgctataatcacctcctc

SEQ ID NO: 33597 - DNA, 201 bp, Homo sapiens
atcctggctaacacggtgaaaccccgtctctactaaatatacaaaaaattagctgggcgtagtggcaggcgactgtattcccagctactcgggaggctgargcaggagaatggcgggaacccagggggcagagcttgcagtgagccaagatcgcgccattgcactccagccggggtgacagagcgagactccgtctcaaaa

SEQ ID NO: 33598 - DNA, 201 bp, Homo sapiens
aggcaagattcttcccacagagggaggaccaccatccacttgagaactaaataagagcatcttaactccttctgtaagggatgcctgcactaaaaaaattrtgtaagtcatccctgaggaatttggctaatgtcagaaagccagttcactttggtgcatagatatctatgacattagtactttcatcagaagaagaacaat

SEQ ID NO: 33599 - DNA, 201 bp, Homo sapiens
gacttggaagaatttaagccagtcacatttggtgttatagaactaaagaaattttacgtatgagaaaagtaaagtttttgacaggtagggagataaggttcgttaactcttttaggccaccattaacttttcaataactcttgctgttgggaataatggaaaaacataagctcgattattcatattgacccagattgccat

SEQ ID NO: 33600 - DNA, 201 bp, Homo sapiens; identical to SEQ ID NO: 6410

SEQ ID NO: 33601 - DNA, 201 bp, Homo sapiens
atatatacacacacacacacacacacatacatatatttatatttatataaaacatataaataaaactaagtatatatatatatataaaaatcaggcatatrgcagatgtcctgtaaacgttagcttttatagctgtcatatgtgatctcaaaaatatagagtgatacttgaatatgtattataatcatacttcattgaaag

SEQ ID NO: 33602 - DNA, 201 bp, Homo sapiens
aaggtggctaaaaagattaaatgaggaagtatgtgtgagagcccttattggagcttggcacatagtaggccatgaaaagcaatttgaatgaatgaggcgtrtgtagtagcagaaaatagactgattagagtgaatttggccccaagaagagtttgagaatcgatacggatttcttaatgcctaggcaaagatctctgcttt

SEQ ID NO: 33603 - DNA, 201 bp, Homo sapiens
tgccttggtttggatgttcgtcctctccaaacctcgtatttgatctctaatgttggaggtggggcccaatgggaggtgtttgggtcatgaagatggatccytcatgaatagattaatgacctccttgggagtgagtgaattctcactctattcatttcgagagagctggttgattgaaaagagcctggtacctctcccctc

SEQ ID NO: 33604 - DNA, 201 bp, Homo sapiens
tggtttggatgttcgtcctctccaaacctcgtatttgatctctaatgttggaggtggggcccaatgggaggtgtttgggtcatgaagatggatccctcatkaatagattaatgacctccttgggagtgagtgaattctcactctattcatttcgagagagctggttgattgaaaagagcctggtacctctcccctctctta

SEQ ID NO: 33605 - DNA, 201 bp, Homo sapiens
attcaaagcctgtttaaagcacttcaagaatattaaaaatactaccccattatcttcttttactgtggtttagaaaaggattgcagtggtactttcaaggrgtgtgcatttttatacctcttctccaaaataaaagtgagtgttgtctctcattaccacttgcttaagtgtaaatgtcatttacttcaaaggtatgtctat

SEQ ID NO: 33606 - DNA, 201 bp, Homo sapiens
cgtcctctccaaacctcgtatttgatctctaatgttggaggtggggcccaatgggaggtgtttgggtcatgaagatggatccctcatgaatagattaatgmcctccttgggagtgagtgaattctcactctattcatttcgagagagctggttgattgaaaagagcctggtacctctcccctctcttacattctctctcat

SEQ ID NO: 33607 - DNA, 201 bp, Homo sapiens
ttgtttccttggactttaggttcttcccagttaaaggagggatgtggacttaaggatataaggacctcattccaaatttttacataactcttgaaacacaytttcctaacacactacaaaggaagataaatgagcaatacccctgccccttatgaaagtacaaagtatttgaccacttatgctaagttcagttacacaaaa

SEQ ID NO: 33608 - DNA, 201 bp, Homo sapiens
ttggaggtggggcccaatgggaggtgtttgggtcatgaagatggatccctcatgaatagattaatgacctccttgggagtgagtgaattctcactctattyatttcgagagagctggttgattgaaaagagcctggtacctctcccctctcttacattctctctcatcccatgatctctgtgagtactggcttctcttcat

SEQ ID NO: 33609 - DNA, 201 bp, Homo sapiens
tctggaagtgggaggcaagaggcccacagtaggcatgagctgagacactgctaggctgcccctctgggaagtacatcagacctgtgcagaactggttgaartagcagcagctggaacaaggtaggtgaggctatgaggatctaaagaggagcctgagggtacactggcacaggcattgataagcacttacaagggggcata

SEQ ID NO: 33610 - DNA, 201 bp, Homo sapiens
aaataaaccttttttctttatcagttgcttagcctcagatgttcctttagagtgacacaaagcagactcagacaagttcacagcaaaggctgtatggtttytgcgcagagttcagagtctagtgaatcagagatatatctcagacattgacccttatctcttaggcccagaacatttggacttaagcctttgacaagatat

SEQ ID NO: 33611 - DNA, 201 bp, Homo sapiens
ggttgtgttctgtgagcctcacccactgggtgttataaccaacctccagatgagccacttctttgtttaattacagctttaaagtagaattttttaaaagyccttgggcacttataaaaattacatttgttaagcattgactatgtgccaggcactatgccagaatacttaatttaacttaattctcacaaagcctttaat

SEQ ID NO: 33612 - DNA, 201 bp, Homo sapiens
aataacacctcacggaggtgtttgaggattaaacgcgggcatatatggtacctgaactatagtagtaatgattatcctgttgagatatgacatgtttgggycacaaattggaacccaaatcaacaagtgctgacttaatgcccccttgcccaccctgggctccctttaactgtgattattctatgttttccaggctagaga

SEQ ID NO: 33613 - DNA, 201 bp, Homo sapiens
aaattgctgatggatcattcgcctcctgagcttcaatttcctcaactaaatctggattctggcatttgtctgacttacctatcatgtagactgtgagggtmaaatgcaagatgtaagaagaaaacttttggaagtgaccaagttttaaaacaagtctaatattagttgtgataggggtaactttcttggaaattatccctt

SEQ ID NO: 33614 - DNA, 201 bp, Homo sapiens
tatgtttagtgacccttgtgagtcaggcagcatgagtattcttcccattggttttgagtctaagaaaagtgaatttgactatccttggtgtttttcacaartcttggcccattcagtgattttatgtccttgaatctctccttccatgccagtctttgtgttgtcctcggttatgaccatcacccttaacatcttgtacct

SEQ ID NO: 33615 - DNA, 201 bp, Homo sapiens
agcacaagtgattgttcactattgtgtctagcaaaagactgaaggtccgtgttggggctgaaatccaacccatgttctgtttgccacgccctgagccttgraacagagctggatcagaccagaaggaagatttcctctgtgagcaagcacctttccttaatttgcatcaaagtgcccagtgtgtttcagaggtcctggtta

SEQ ID NO: 33616 - DNA, 201 bp, Homo sapiens
ttcagatgtgtatgtgtatgtgtgtgcatgtgctgggtgttcgcaccatataaaatacttttcctactgtgagtctctgtctgaaaagtttgtaagccacygctttatcacttccccttttatttccttattgtcaatatttgcaattataatgtcagattttcattttgaaaatacctttccctttcttaggttatggga

SEQ ID NO: 33617 - DNA, 201 bp, Homo sapiens
agcacatagtaatattcaactttatagatggatacaatgaagtttagaggaatgcagtgaagtgtgacttcacttctgcaattagtaaatggctgatccasaactcagacagaggaggtctcacttctaatcctgtgtcttttactaaaatgagattaggactctatttaaataattttaaaactgcaactgttttgcctc

SEQ ID NO: 33618 - DNA, 201 bp, Homo sapiens
tgattaatttaatattgatgaaataaattcaagattgttgttgatatccatctgcttatcatcactcagattttgagccaaattcccactgattgaacggaaaaaaaaaaaaaaaactcaagctgtaaatttagtataaagtcataccatatttgtagtatatttactcacctggcagaaacaaacacatatcctctctgg

SEQ ID NO: 33619 - DNA, 201 bp, Homo sapiens
gccatcctaatcctatgaagctactgaactataaccctgaggaccctccaggatcagaagtaagttcctatacctctctgagctcacaggcaaagctgcargaacaaatttgttggggtgacttggaagaatttaagccagtcacatttggtgttatagaactaaagaaattttacgtatgagaaaagtaaagtttttgac

SEQ ID NO: 33620 - DNA, 201 bp, Homo sapiens
agatggcaaattttatgggaaaaaaggctcagcagagtaaaggggatcaggattactatatgcagcaggatgagcaggtcctactactaaagtcagagatsagagtaggcctcattgagaaagtacaatttgaaaaaaattaaaatgtgtgaatccacatttggtgatttgagaaactgaaattcaaattcaaacccagta

SEQ ID NO: 33621 - DNA, 201 bp, Homo sapiens
atgaagctacctgggactaaagatttctttaagggggattttaaagtatagattacatttatttaaagaatatagaaatattacaattaaatgtttctgcytgtgtatgctttgataaatttagcaattcattcttttcatttaaatttgcagatttagtggaataaagtagttcataatatccttttgttacatatttag

SEQ ID NO: 33622 - DNA, 201 bp, Homo sapiens; identical to SEQ ID NO: 6431

SEQ ID NO: 33623 - DNA, 201 bp, Homo sapiens
cactattgaatcagaaccagcgtcatggaacaaactccctgggggattagagatcatgaatctgccccagggagagaaggcaagagatgatatcatgaggyctgcatcaggagcaagccaaatccccaggatagatgcatccttttttcttcagacttggagtgtatgtgtgtgcggctcacaggaagctatatatgcctg

SEQ ID NO: 33624 - DNA, 201 bp, Homo sapiens
gagcttcaaccccaacagtcctggaaaaatacttctgatggacctgaatgaagaagatccaacagtgttggaattggggatcactggaagtaaatttgatrtatcttcatttaaccctcatgggattagcacattcacagatgaaggtaacaatatttactatttattaaaaccaaaaccaaacttaaaacaaaaacagaa

SEQ ID NO: 33625 - DNA, 201 bp, Homo sapiens
ctgatactttaatggctctaagggtgaagaggccccttcggactggagttagttgggaattcagagttccatctctccaagctttaataagaactagtgarcctggaggatacagaggctggtatttttccccttctgattttggctttctttgtaaccaaaattcctggagagcctgttggaaacctgctaaagaagaga

SEQ ID NO: 33626 - DNA, 201 bp, Homo sapiens
gggttgggattctgtcccaggggccctttggccctcagagaagtctcagatccagtggctgagcttgtggcagaggggcaagccatgcggggctttttccyatctgctccactggggctgtttgccttccagtggcctgacttctcacaccaatgtcagttatctgggagggttgtctgagggcaacctggagggggctaa

SEQ ID NO: 33627 - DNA, 201 bp, Homo sapiens
caataaatgttagttccctgcttccctttaaagtatttaataaagggttaagtgctatacaaggggggtggggatattttaagaatgtatcaaaagtttcmtaacttttaacaggagttcaaagtctacagatcatcctagtctctaaggcttagtcaacaatgccttatttactttaaagtaaaacctaataaaaattaa

SEQ ID NO: 33628 - DNA, 201 bp, Homo sapiens
tttgaaaatacctttccctttcttaggttatgggacagattccaactttcctttgaagcctgctttctaagttcacatctatcaatcaggaaaccacagtytcctcacagtccaagccttcatcatctattcattcatctctgtatttctagtacctagactggtgactctttactctggttatacgttgggacaaactgt

SEQ ID NO: 33629 - DNA, 201 bp, Homo sapiens
atgaaaggaagtacctacttacttgttatgtcattcataaattatgataaagatagttaaccaacacgaagatgattgaagtccacatttaaacatacatkttgaatgctgtgccttgacttccagggttgggttttatcttctacagagaaagggtgaatgcctctcgagaagtggagccagtagaacctgaaaactgcc

SEQ ID NO: 33630 - DNA, 201 bp, Homo sapiens
tgatagccagtggcctgatggtaggaatgtactcatttttttctgaatgaataaatgaaagatcaatcacccccaaattcctatcattttgtaccacgtcrgtaagaattttatctagcgtgtctgttccgcctgtagcccatccgcctcctgtgagttcaagtcatcaggaggacaagtaaatttcttagcctatctgaa

SEQ ID NO: 33631 - DNA, 201 bp, Homo sapiens
atgcaggccttgtgtatgattttctgaagttaaaaatcctttcaacgtacctgtatttttcaagcactacatcacaaagcagatgcccagtccaggctgcsgagtcagattgggcagatgagtaggaggctgcccatctgtcagcaactctaaaacatcaatggaataaactggaaccatgttgccatttacccggacttt

SEQ ID NO: 33632 - DNA, 201 bp, Homo sapiens
gtttggaattctttaatgctaatttaccatgctggggatttgaattactgattatggtattcgaataaaaactaaccacttctagggtttaaagttaatgwatacacacacacacacacacacacacacacatgcacacacacacacagagactcctctgcctaaagtgaagaatttttaaacaaattatagctaacacag

SEQ ID NO: 33633 - DNA, 201 bp, Homo sapiens
tacccggactttccacctaggagtccttacacactgatgaaattgctcctgttcctgccaaagtacacagagccctagagaggatattatgtatctcttakgtgtacctatccacctctgctaaataaaaactaaatattgtacccagagttccccacttgtcttgccctggccttgcctggaaaaattgcaggaaaaact

SEQ ID NO: 33634 - DNA, 201 bp, Homo sapiens
gttcctgccaaagtacacagagccctagagaggatattatgtatctcttatgtgtacctatccacctctgctaaataaaaactaaatattgtacccagagktccccacttgtcttgccctggccttgcctggaaaaattgcaggaaaaactctggagttgaaactcaggcaaagtacagtgaaggagaacttttgtggact

SEQ ID NO: 33635 - DNA, 201 bp, Homo sapiens
taacctgaggagatggcagaagaggggagggagagccagataaagcattgaataaaggtaacttttttttagaaaggctctgacaggactttgcaattacyacaaggcttctccttatgcatctctcttttgatattggacaggaaaattttttccagaagctctcagcagatttccccttagatcttatttgtcagagct

SEQ ID NO: 33636 - DNA, 201 bp, Homo sapiens
aaatagttcatttttctctagataaattgaaatgttaaaaatttacatgtacttaaagtataactaacttgaagacagtaatatttaaccgatgtttatarttagtagtaaaaattcatattcttgatcacctaaaatgtatccccattttaactcaactatttggaatttgcttatatcttcaatatggctttccaaggg

SEQ ID NO: 33637 - DNA, 201 bp, Homo sapiens
agtctttcacttaggctttctgtatacccatgcccactttcaaataaaatgaacagtcatggtttaaaagacaaattgtgtatgcatttacacttgtgctrtaattatgatcatgcgtgttctatgcatatttgtgttcttcggtctacattgaaccatattacgttagcttctattgcagcaatttttttgtgagttcag

SEQ ID NO: 33638 - DNA, 201 bp, Homo sapiens
taaaatgaacagtcatggtttaaaagacaaattgtgtatgcatttacacttgtgctataattatgatcatgcgtgttctatgcatatttgtgttcttcggyctacattgaaccatattacgttagcttctattgcagcaatttttttgtgagttcagtgtattcaagaattgttttcctctcaattgtctattccctaagc

SEQ ID NO: 33639 - DNA, 201 bp, Homo sapiens
attcttgcctcctcaaaggaaataatttacctaaggggtataaggtagagtgagagaccaaggcaagtttttgaacaggaatgagagcaggagtgaaaggaagaaagtatacttggaagagggccaagcgggcaacttaagagatccaagtgcctcatccaacccttcacttggggtttttatacattggcctggttctga

SEQ ID NO: 33640 - DNA, 201 bp, Homo sapiens
atggtttaaaagacaaattgtgtatgcatttacacttgtgctataattatgatcatgcgtgttctatgcatatttgtgttcttcggtctacattgaaccayattacgttagcttctattgcagcaatttttttgtgagttcagtgtattcaagaattgttttcctctcaattgtctattccctaagcacttaaaattgcca

SEQ ID NO: 33641 - DNA, 201 bp, Homo sapiens
ggggaaatgagggaaatagaaaccatttatctccagcccctcaatatttatgtaacaggaagagagaagatgctattttaccatacagatgtgtttttttwaaatgataaataggtataaaaccttgtaaacattgcattaaagaaggaacactagtatttttggccctatgtggcctcctcctcttccttctatccactt

SEQ ID NO: 33642 - DNA, 201 bp, Homo sapiens
gggagcaaaagaacaaaaactgacagctgtgaaactgacaactatgacaactatggtaagaaagttgacagatgtatatgtgaaggttcctgagggtaaastaaggagttattaatcccaatgcagaagactggagaagctacaaagcatcatgagtaggggtctttccagtgggtaatgggctaaagagcattctaggtg

SEQ ID NO: 33643 - DNA, 201 bp, Homo sapiens
tgtgaaggttcctgagggtaaactaaggagttattaatcccaatgcagaagactggagaagctacaaagcatcatgagtaggggtctttccagtgggtaaygggctaaagagcattctaggtgaagggaaaagtgtgagcaaataaaaagaggtatgaaagaaatacagggaagagtccttagtatcatgacacttgattt

SEQ ID NO: 33644 - DNA, 201 bp, Homo sapiens
taccctcttaaataagcaaccacatgcaatttactcagcctctcagtgcctccatttccttacctacaaaacagggtaaatattcatctttttctcaaagrtggctaaaaagattaaatgaggaagtatgtgtgagagcccttattggagcttggcacatagtaggccatgaaaagcaatttgaatgaatgaggcgtgtgt

SEQ ID NO: 33645 - DNA, 201 bp, Homo sapiens
ttttccttttggccagagtaggtatggctgttcaactctcatttctaatgatcacaaactcctccacatgctcttctgaagaaccttctgaggactcaagmccctcagagacggcccattcttttcctctcttgtttctcgagctgattggatgctggctcctggcctcaggatctccattcaagttattaccaggaaaaa

SEQ ID NO: 33646 - DNA, 201 bp, Homo sapiens
gtctacattgaaccatattacgttagcttctattgcagcaatttttttgtgagttcagtgtattcaagaattgttttcctctcaattgtctattccctaarcacttaaaattgccatattcaaatatttgctaaattaaatatacatttaatgtatactacttcacaggtcatttcaactttcacatttttaaacaaattt

SEQ ID NO: 33647 - DNA, 201 bp, Homo sapiens
gccataagcaatattctctctgtattccttgcttatatcattgaagactattattaattgcctttttggtctgctcttccatttttgatctttctcatggsctggaagctgtagtgtcgtgcacatatgactttgctgcaggggatgaaagggtttgtgtggggtggcctagtggagcatgtggcttccagaagacttctc

SEQ ID NO: 33648 - DNA, 201 bp, Homo sapiens
aaaagggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaaggtaaaacctgtatgtttagggataaggggg

SEQ ID NO: 33649 - DNA, 201 bp, Homo sapiens
attaaagtatcctggaataaagagcttcaaccccaacagtcctggaaaaatacttctgatggacctgaatgaagaagatccaacagtgttggaattggggrtcactggaagtaaatttgatgtatcttcatttaaccctcatgggattagcacattcacagatgaaggtaacaatatttactatttattaaaaccaaaacc

SEQ ID NO: 33650 - DNA, 201 bp, Homo sapiens
gatcctaatagtagaaaggaccactgtccaagttactggaataaactttttgtgatgtttgagtaaagcattcatgtcagaattttcagacatacctatakgaacaaaataggtcaaaaatagtcaactatataagactggtatccttatgttaattcttagccagctatactgtttgccactacatgatataatcgatgt

SEQ ID NO: 33651 - DNA, 201 bp, Homo sapiens
tatccagccctgatcattatagcttttccattttaaacgattttcaagactcgggcatttacaggaacagatttttctaacccaaggcatctgtaagctayaggtccagtgacagaaagtcaccatggtcagctttctgccggtcccattatcttcaatgcctcctgtccgctggttcctctgttctgtgttcaaaatgct

SEQ ID NO: 33652 - DNA, 201 bp, Homo sapiens
tgtaaggacactgaaaaccactagcattaaagtaggaattgtgcaagacattggagccttgattaggtatcatgcactacagtcaataaaagaaataatargaaaacaaaatgtgcacaagatctgaggtctttcactttgctttcatacccttaatcagtttacatcttatgctttgtggggcaatcaaaccaaatgact

SEQ ID NO: 33653 - DNA, 201 bp, Homo sapiens
cagattccaattccgttagtctgagggaggcctggatcacagtagttgttaaaagtttttcagttgataaaaatgtcaggctagggttaagaaccacgttyatacccattacctccatttcatcatcagacgatccctcattcagttcctcttctggactttccccactgtgggtggctaaaattgctaccttgagaatca

SEQ ID NO: 33654 - DNA, 201 bp, Homo sapiens
aaaccactagcattaaagtaggaattgtgcaagacattggagccttgattaggtatcatgcactacagtcaataaaagaaataataggaaaacaaaatgtkcacaagatctgaggtctttcactttgctttcatacccttaatcagtttacatcttatgctttgtggggcaatcaaaccaaatgacttttacaatttcatc

SEQ ID NO: 33655 - DNA, 201 bp, Homo sapiens
tccatgctgctctcatgctcacatcaatagctgtatagacagtgcattaatgttgtcctctggagctgccagatggatccctatgctctcatcccacctcygggtaaaccagtcaactaaaaaagccaaaacagaattttggagggctaattagaacaccacaggaatgcccagctttgactgcctcatggtgggcaactc

SEQ ID NO: 33656 - DNA, 201 bp, Homo sapiens
ttccctcttcccttccttccttccttcacctccttttgttttttgttttgttttgtttttgagatggagtcttgctctctcccaggctggagtgcagtggygcaatcttggctcactgaaaacttcacctcccgggttcaagcaattctcctgcctcagcctcctgagtagcggggaccacaggtgcatgccgccatgcct

SEQ ID NO: 33657 - DNA, 201 bp, Homo sapiens
ctctgcatttgcttgtctgtaaaggattttatttctccttcacttgtgaagcttagtttggctggatatgaaattctgggttgaaaattcttttctttaakatcgttgaatattggcccccaccctcttctggcttgtagagtttctgccaagagatcagctgttagtctgatgggcttccctttgtcggtaactggacct

SEQ ID NO: 33658 - DNA, 201 bp, Homo sapiens
tgatcttttacttcctctatattttctctattttagaactttcaaaccagtgtcacactgcctgctttctaggaggacatccccaaataggggtattattmttcttcttcttttcattagcccttcacttttaatgccgcaggtgcttactggacacttctatttggattcctttcctatagacactttaaactcaaaatg

SEQ ID NO: 33659 - DNA, 201 bp, Homo sapiens
tgtttgaatactgttctcagaaatctaacatgtaaactaaaggccctttagtttagttgtcactaaagacaactgtgagacgttaaaaaacataacataarggggaaaaaaacaaattagactcatcaaagttaaaagcttttgtgcttcaaaagacaccatcaagaaagtgaaaaacaacccaaagaatgagagatagta

SEQ ID NO: 33660 - DNA, 201 bp, Homo sapiens
aagaaatatagtgtttgatgtgtggatactttttaaaataaaaatgaggtaatattacacaaccccttctataaatttcttctgcattaaacactacatcrtggactcctttatatatagcacatttgcagttgctttgccaaggcagttcgggattcagttgtgtgggagcactgtaatatagctcatctgctaacaaat

SEQ ID NO: 33661 - DNA, 201 bp, Homo sapiens
tacctcttttttaaaatcattcattacggtggtaactaattttttttttatgagatgaagttttgctcgtctcccaagctggagtgcagtggcacaatctmagctcactgcaacccctgcctcccgggttcaagcaattctcatgcctcagcctcccaagtagctgggattacaggcatgcgccaccatgcccggctaatt

SEQ ID NO: 33662 - DNA, 201 bp, Homo sapiens
cagttgctttgccaaggcagttcgggattcagttgtgtgggagcactgtaatatagctcatctgctaacaaatatttaggttgttcccacctttatgctcwttgcaaacaatgccaaaataaactttctcgcacatgtattttctgagactatatccttaggatacatttctagaagtagaatccactgcacaaaatgtga

SEQ ID NO: 33663 - DNA, 201 bp, Homo sapiens
agtaaagaaatgaagttatgccaagtagcagtagggttgacaggctaagaagcagtaggcacctattcataagactgattttagacttagcagtgggattytaatgatagttgtgcataggctaataagtgtgtgggaaagtctcagaggaaggtatcctgggggcttttgctcccacaggtgccattgttgctgagatgc

SEQ ID NO: 33664 - DNA, 201 bp, Homo sapiens
atgccaaaataaactttctcgcacatgtattttctgagactatatccttaggatacatttctagaagtagaatccactgcacaaaatgtgaattcaggttwtaatcctcacttgaatttgatttccaacaccctccttcctcagctgtattcagggcctttggattcttcctgtcaaatgcctctcatgacctttcctgcc

SEQ ID NO: 33665 - DNA, 201 bp, Homo sapiens
gctgcacttgaaatatgaatacttcagtaggactttcactaggcaggattatcgagtaggtggcctctgtatttaatacctacgtatcttctcttccactsctttccattctatagcttcccatgtctccaatatatgcttctactccataataggttccatgtgttttcttagctggctatcagaaacttctctccaaga

SEQ ID NO: 33666 - DNA, 201 bp, Homo sapiens
attacaggcatgcgccaccatgcccggctaattttttgtatttttagtagagacagggtttcaccatgttggccaggctggtctcgaacttctgacctcargtgatccacctgccttggcctcccaaagtgttaggattacaggtgtaagccaccactcccagcctacagtagtaacttttttttttaaatgttaaaggat

SEQ ID NO: 33667 - DNA, 201 bp, Homo sapiens
atttgagttttctgccttttcttgcctctcaatttctaaaaaataaagtaatctgaaccttgcactccctagtcttagaggtggtttgtgctagcagctgkaaagcagaagaaaccaaagaaaacgcctttcctgaattgtttttaaaaacctgagccccttcaagggattctgttggagaagggatatgaatatgtggat

SEQ ID NO: 33668 - DNA, 201 bp, Homo sapiens
ggaattctttaatgctaatttaccatgctggggatttgaattactgattatggtattcgaataaaaactaaccacttctagggtttaaagttaatgtatayacacacacacacacacacacacacacatgcacacacacacacagagactcctctgcctaaagtgaagaatttttaaacaaattatagctaacacagaact

SEQ ID NO: 33669 - DNA, 201 bp, Homo sapiens
gatacaatcacatttctcctcaattaagtgaaggaaactgaacttacaaaatcttatacatttagagacaggaggttaagttcagaacacatgagtatggkacacagatatggttttttgagggccacattttttttcttgtctgcattttaaaaaccaggaattaagtgtaaacatccagttagttccctggcttacctg

SEQ ID NO: 33670 - DNA, 201 bp, Homo sapiens
taatctcacctactagttaatgccacacctgcttatttgggctccacagctccaattcttcctgacattgctaacagaaaaataaaataaaatcaggctarattgtgttccctgttctgggaatatgttctttcaccttctcacctttgcttatgaaattccctccaaacttactgattcctctgtctctgcttactaaaa

SEQ ID NO: 33671 - DNA, 201 bp, Homo sapiens
gaaatctaacatcaatatttttgtttatgaatgttgctttgaatatcctcttttaaaaatctttatgtaccccaaaattatgaaatatgcttccttgtgawcttataaaatatttatagttatttttcacatttagatttttcatccacccagaatatacttttggttgtcctgtgagtaggaatcaagattcattttggc

SEQ ID NO: 33672 - DNA, 201 bp, Homo sapiens
accctcaatcttgttcacagcagttcacattccaattgaaatgggtaggtgacatttctgaggtgggtactacctagaattagttagtttgttttatctcrcattcatatttacatgccatgtccattgagctcactaaatattgttatgttggcttgtgtcagaaattcattgtctagctgggaaatgttgcttatttta

SEQ ID NO: 33673 - DNA, 201 bp, Homo sapiens
agttcactcatgatttggctctctgtttgtctgttattggtgtataagaatgcttgtgatttttgcacattgattttgtatcctgagactttgctgaattkgcttatgagtttaaggagattttgggctgagacaatggggttttctagatatacaatcatgtcatctgcaaacagggacaatttgacttcctcttttcct

SEQ ID NO: 33674 - DNA, 201 bp, Homo sapiens
cttgcagttagacaaagagagagttgtatatggtaccatcttctttcacactgtccaacatgaagctaagattaaaggatttaaataactgtcgcctcaamataaaatgagtttttgcctgtaagttctaacatatacgatggtgttgaaaattgtcttattttcaagatatcatttgtgttattttaaaatatctcttct

SEQ ID NO: 33675 - DNA, 201 bp, Homo sapiens
ctctctgtttgtctgttattggtgtataagaatgcttgtgatttttgcacattgattttgtatcctgagactttgctgaatttgcttatgagtttaaggarattttgggctgagacaatggggttttctagatatacaatcatgtcatctgcaaacagggacaatttgacttcctcttttcctaattgaatatcctttatt

SEQ ID NO: 33676 - DNA, 201 bp, Homo sapiens
taaaatgtgtgaatccacatttggtgatttgagaaactgaaattcaaattcaaacccagtaattggcctagtgggtaaattaggacatacagttatttctrcttccagtattgctgtctttcagttaaaaatatgattatttctttttttattaatgtattagtcacagcttcttaaaaagaacacaagaaatgtaaaaag

SEQ ID NO: 33677 - DNA, 201 bp, Homo sapiens
aatttgcttatgagtttaaggagattttgggctgagacaatggggttttctagatatacaatcatgtcatctgcaaacagggacaatttgacttcctcttytcctaattgaatatcctttatttctttctcctgcctgattgccttggcgagaacttccaacactatgtagaataggagtggtgagagagggcatccctgt

SEQ ID NO: 33678 - DNA, 201 bp, Homo sapiens
cagcggaggctgcagaacagcgaatattgctgaacagcaaatgttactgtttgattgttcctctggaggtttcgtctcagaggggtacctggccatgtgargtgtcagtctgcccgtactggggtgtgcctcccagttaggctactcaggggtcagggacccacttgaggaggcagtctttctgttctcagatctcaagct

SEQ ID NO: 33679 - DNA, 201 bp, Homo sapiens
gcttagcaagctctgctttaaaagataattgaatctaacaatttttcattggtttatagtatacaaactattttcatatataatggtgtctttacttctcraaataaaatcctgggcccaaccttgacacttcctctccctggcccttttgatcaactcattataatgttttgtttaatgtatctctccaatatctctcca

SEQ ID NO: 33680 - DNA, 201 bp, Homo sapiens
tttataaagggtctcacaatctgagggaaacattttccactttttaatttcaaagcacacaaaaagtgttactccattggaaaggctatgaggatgacttytaatcttcgggactcaaatgcctcgggatagtcactcaaagcctttttttttttttttttttttttttttttttgagacaggatttctctctgtcaccca

SEQ ID NO: 33681 - DNA, 201 bp, Homo sapiens
ctactaatgagctgtatgattttgagaatatcatttaacctctctttacagatgagaaaactgaggctctgcatgcctgtctaacttgcctgagagctcaragctgcgtcagagctgatgcgctggccatgacgcctctgcaatagagcagagataattttctcccagatcatgccctggggaacttccatcacctcaatc

SEQ ID NO: 33682 - DNA, 201 bp, Homo sapiens
tgtcagttggacatttatctaaacattcaatatacaaagttataaagaaaaatacttctaagatatttaagaaaatgcaatataatagatcataaattagrtgcaaaaacaagacacttacagacatttccagtatatacatccattttcaaatattaccaaagtgtaaacataacttaagataatcatccttctatttct

SEQ ID NO: 33683 - DNA, 201 bp, Homo sapiens
acttatttttaaggctttagaaagaatattgtttaaaataaccccatactctacgatggtcctgattcttccttagcttgcccctcgctatgtgagactghctacttaatggatttgtcacagaggttttcctggctgagagatatcagagactttgatggtgaagcagcgacaggggaacaaaatgacgggcgaggaagc

SEQ ID NO: 33684 - DNA, 201 bp, Homo sapiens
ttatttttaaggctttagaaagaatattgtttaaaataaccccatactctacgatggtcctgattcttccttagcttgcccctcgctatgtgagactgactacttaatggatttgtcacagaggttttcctggctgagagatatcagagactttgatggtgaagcagcgacaggggaacaaaatgacgggcgaggaagctt

SEQ ID NO: 33685 - DNA, 201 bp, Homo sapiens
tgtattttctgagactatatccttaggatacatttctagaagtagaatccactgcacaaaatgtgaattcaggttttaatcctcacttgaatttgatttcyaacaccctccttcctcagctgtattcagggcctttggattcttcctgtcaaatgcctctcatgacctttcctgccttttattgccagtggcatcctcttg

SEQ ID NO: 33686 - DNA, 201 bp, Homo sapiens
ctgccttttattgccagtggcatcctcttggtccagtcctttctctccacattgctggattactgctgtagcctcagctcatgttactccttggttcaaayaccccagtgagcaaagcttggatcttcatcttaagccctaacaagactgattctggctccctgtggtttcagccctctcactctcccactctctcttgcc

SEQ ID NO: 33687 - DNA, 201 bp, Homo sapiens
ggccgaggggggcggatcatgaggtcaggagatcgagaccatcctggccaacatggtgaaaccccatctctactaaaaatataacaattagccgggcatgktggcggcgtgtgcctgtaatcccagctactcggaaggctgaggcaggagaatcacttgaaccagggagtcatcggaggttgcagtgagctgagatcgcgc

SEQ ID NO: 33688 - DNA, 201 bp, Homo sapiens
ggcctttgcacactttctcccctcaacctggaatgctctttccctagatatccacattattcgttctcttatttcacttaggtttttgctctaacatcccytcatcagagagaacatgcctgactcccatgaagataatacttcgttactctctattcttttatcctgttgtatttttcctttgtagcatttaacgccaac

SEQ ID NO: 33689 - DNA, 201 bp, Homo sapiens
tgtcattcataaattatgataaagatagttaaccaacacgaagatgattgaagtccacatttaaacatacattttgaatgctgtgccttgacttccagggytgggttttatcttctacagagaaagggtgaatgcctctcgagaagtggagccagtagaacctgaaaactgccaccttattgaggaacttggtatgtatgt

SEQ ID NO: 33690 - DNA, 201 bp, Homo sapiens
atcccctcatcagagagaacatgcctgactcccatgaagataatacttcgttactctctattcttttatcctgttgtatttttcctttgtagcatttaacrccaactaaaataaattaaacacttgtttgctgaatggggtaatgaaaatcattttagcagctttctctgttcaaatcttctcaattcaacctgccaaatt

SEQ ID NO: 33691 - DNA, 201 bp, Homo sapiens
ctcggcgccgcgcagtcgccgctgggcaccccgagaccatggggaagctcgtggcgctggtcctgctgggggtcggcctgtccttagtcggggagatgttyctggcgtttaggtgagtggcatcttgacagggcgtcttcgactctctttctctcctcttccaagtgaggtcaggggctgcctggcgcccccttcctagcg

SEQ ID NO: 33692 - DNA, 201 bp, Homo sapiens
gcctagaaccagaattgttaccctaaactaggaagcaatccttgcctcagatatgtacccctaagagtgatagacaaaactttcctttaaaagcccaaccrcaatgtctgtcttaaggaaatgaaatatgatacataggattattggagaattgtttaggatctttttcgtatctctattttcaagttgaattatttttaa

SEQ ID NO: 33693 - DNA, 201 bp, Homo sapiens
ataatacttcgttactctctattcttttatcctgttgtatttttcctttgtagcatttaacgccaactaaaataaattaaacacttgtttgctgaatgggktaatgaaaatcattttagcagctttctctgttcaaatcttctcaattcaacctgccaaattttgcatcttaacatggtgaaaccccatctctactaaaaa

SEQ ID NO: 33694 - DNA, 201 bp, Homo sapiens
tttccttctcccgttaactatggggacagacgcagctattcacaagtccgtctgggcagcacactccgaggtaaggcacgaaggtcaggagacaggttccsgtgccccaaatcctggagaagatgagttaaagctcttcgcttcgattgccttcgcccttcccgcgtctcgggagcaattcagtgtcgcctcacgtctggc

SEQ ID NO: 33695 - DNA, 201 bp, Homo sapiens
gatagacaaaactttcctttaaaagcccaaccacaatgtctgtcttaaggaaatgaaatatgatacataggattattggagaattgtttaggatctttttygtatctctattttcaagttgaattatttttaaaattttagataagactttttgtcacaattactgacaccctttaattttggttgaatctcatgttttgt

SEQ ID NO: 33696 - DNA, 201 bp, Homo sapiens
aaacaaaacaaaacaaaaacgccaatttgatcatgtcagaggtttcaaaagacctactctttcttaaggcaaagaccataatctaacttttacttgccagytctgatcacacattcttgaccgcttagactggtcacctttgtgttcttaaagtcccacttatccaaggaagctgcttctgtttgtttgctactatttctc

SEQ ID NO: 33697 - DNA, 201 bp, Homo sapiens
aatgaccttccccttcctcgcctctgctcctcttcccgtttcctgtcttttccttcttttctcctggtgtttccttctcccgttaactatggggacagacrcagctattcacaagtccgtctgggcagcacactccgaggtaaggcacgaaggtcaggagacaggttcccgtgccccaaatcctggagaagatgagttaaa

SEQ ID NO: 33698 - DNA, 201 bp, Homo sapiens
aatttgtcctagactgtcctttgcaaggtggaagaagttgtaaaaactcttaatgactttccattgggaggttccatttttggacccatcttttctaataycactttaatgggaatagcccctatttgcattatggctgagaagaaaaatggaatagatataggggctcttcccagtacggtttgcagtgtgactctcact

SEQ ID NO: 33699 - DNA, 201 bp, Homo sapiens
cagatgttcttctatggaatgtatcatctcacactgtgtaaattacacctgatcacaccttctcatattgggagttcccatggtttttatccctttcatcrcaactgtgcatttcgtggagaccatttgaactggaaaacttaaaggattctttggagttttagtgtcagtgatactcattcttgagaatttttttttctc

SEQ ID NO: 33700 - DNA, 201 bp, Homo sapiens
ccccctccaacctggtgttcatcaggagaggggaaagagcatttcttgcctggcaggaactcaagacctagaagaaagagggcctaccctgccaaggaaaygaccttccccttcctcgcctctgctcctcttcccgtttcctgtcttttccttcttttctcctggtgtttccttctcccgttaactatggggacagacgca

SEQ ID NO: 33701 - DNA, 201 bp, Homo sapiens
ctatttcttccttagtgtattggagaaagggcagttcactggggagagagaggaacaagtctcccatgaaggtatcatttgacatggctgcctcttcagcrtttttgtcagctaacctgtttccccatgtagtttaatagaagcccctgtggtgtccttcacaatgctctactgccacttcctggggcaaatgagcagcct

SEQ ID NO: 33702 - DNA, 201 bp, Homo sapiens
aagtactgagatatatcacatttctattttcctttagctgtagcggatagttaatccacttttagtttttccttttggccagagtaggtatggctgttcamctctcatttctaatgatcacaaactcctccacatgctcttctgaagaaccttctgaggactcaagcccctcagagacggcccattcttttcctctcttgt

SEQ ID NO: 33703 - DNA, 201 bp, Homo sapiens
ctgtccgtaaataaaaatagatcatgcttgaatgtgctactttgcccgaactccccaagtcttcccgcatcttcagttcctccccctccaacctggtgttyatcaggagaggggaaagagcatttcttgcctggcaggaactcaagacctagaagaaagagggcctaccctgccaaggaaatgaccttccccttcctcgcc

SEQ ID NO: 33704 - DNA, 201 bp, Homo sapiens
tacttgcctcagcctcccaaagtgctgggattacaggcatcagccactgcacctggccccacacaaagcctctaaatacaccctcttaaggtagatgactrgtgaggtcatgtaggttgcaaataaagacaggccaaaacatgctcaggctcagataaagttatgggttatgtgatacatgtggctaattattggaaaggg

SEQ ID NO: 33705 - DNA, 201 bp, Homo sapiens
gaattagaaacacagacccaagaggagaccctgaatcaagtgcatctaagacctccttatactgcctccgctgctgtttgattgcacaaaatttatgcaayagcagatctgtggtaacactcaattccccctaggcaccttgttcatgtaacatatggtgaaataaaacactcaagaatctccaatctcagtcaacttcct

SEQ ID NO: 33706 - DNA, 201 bp, Homo sapiens
ttttggagtctgctgcttgacagctgcctgacctacagcaagccacataagcaatctgtgctgcaggtctcacctgtaaaattggggtaaggctacccacrctccagagattgtgttgataattaaatgcgttaacataggtgtcagcacaggcaaagcacacagtcagtactgcataagcggtgggcttcattattcatc

SEQ ID NO: 33707 - DNA, 201 bp, Homo sapiens
catctgctcaggttctggtgaggacctcaggaagcttaaaatcatgggggaaggtgatgggcatcactagcatgtcacatggcaagagagggagtgggggkggggggaggtgctatagtcttttaaacaaccaaatctcacgtgaactcagagcaagagaactcactcattaccatgaggatggcaccaagacaattcaga

SEQ ID NO: 33708 - DNA, 201 bp, Homo sapiens
ctgtttccccatgtagtttaatagaagcccctgtggtgtccttcacaatgctctactgccacttcctggggcaaatgagcagcctccagtagctctaagayttgagacccatacttaataggagcatcctgagctgttaggtaccttctttccttccagatagccatgtgggcatgaagcaccaagaaggcatatttggaa

SEQ ID NO: 33709 - DNA, 201 bp, Homo sapiens
gcatctaagacctccttatactgcctccgctgctgtttgattgcacaaaatttatgcaatagcagatctgtggtaacactcaattccccctaggcaccttsttcatgtaacatatggtgaaataaaacactcaagaatctccaatctcagtcaacttcctcacatgccctgtgaagatttggcttgtaaggccagtgatgg

SEQ ID NO: 33710 - DNA, 201 bp, Homo sapiens
tgctccacctggtgttaaccagggtggcttagccagtggtattcagttggtggccaggctgtggtggctgggcttgtctaatagcccacttcattcatttstgcttccttggtgccgatggttaagaggttggcttcagctgaccactttccctctccatatgttcatggcctttcatgtgaatgctccagtggagtggtc

SEQ ID NO: 33711 - DNA, 201 bp, Homo sapiens
tgttattgtctcaggtctacttggtgcagtctccaaggttttattcacccctgtgagccaccatcagggccagctgagagatcagctatggggaccagagmtactgtgactgagaggaaccattttgggggttagttaataagcaggagaatgaaaggggagaaggaaaccatgtatgggtatgggggttggatgcctcca

SEQ ID NO: 33712 - DNA, 201 bp, Homo sapiens; identical to SEQ ID NO: 17280

SEQ ID NO: 33713 - DNA, 201 bp, Homo sapiens
tgtcctgcatatagatcgctatggtagctgatatagtgcaaaacaaaagaagtccaccatctggcctagggatcataacataacagagttgataggaaacracagacaatcatccagccatttaaaaacctttgctaccccttgtaatttacttagtccagttttctcttacaaagatgatagactagtcatcctgcaaag

SEQ ID NO: 33714 - DNA, 201 bp, Homo sapiens
cttcagggaaagctgtcaagggaaggtacaggggaggcttctgggttgttagtaatattatattttaacctggatggtgatttacattggtgtttgttttrtaactgtcctatagaaggatatatgtattttatacactctcaggtatatatgatgtatgtcacaattttctaatggatatgagagagcaaagtcagcttc

SEQ ID NO: 33715 - DNA, 201 bp, Homo sapiens
tttctctcctcttccaagtgaggtcaggggctgcctggcgcccccttcctagcgggtaggaaagagcagctttggaacctcactcctccatctcacccagyaaaccgccccttgagactcgcttatggggaaagtgagctacttgcgtttccaaagactgccgagccgaattagtcccatttattttttgaaggttatgat

SEQ ID NO: 33716 - DNA, 201 bp, Homo sapiens
tgtgcttgatttttctcctccatggtttataagggattaaagtatcctggaataaagagcttcaaccccaacagtcctggaaaaatacttctgatggaccygaatgaagaagatccaacagtgttggaattggggatcactggaagtaaatttgatgtatcttcatttaaccctcatgggattagcacattcacagatgaa

SEQ ID NO: 33717 - DNA, 201 bp, Homo sapiens
taagacctccttatactgcctccgctgctgtttgattgcacaaaatttatgcaatagcagatctgtggtaacactcaattccccctaggcaccttgttcaygtaacatatggtgaaataaaacactcaagaatctccaatctcagtcaacttcctcacatgccctgtgaagatttggcttgtaaggccagtgatggattta

SEQ ID NO: 33718 - DNA, 201 bp, Homo sapiens
tatggtgaaataaaacactcaagaatctccaatctcagtcaacttcctcacatgccctgtgaagatttggcttgtaaggccagtgatggatttaggagaamaatccgactctatcttctgaaacatttacctccaactgattacgattttctagaatcccaacctatttttatataatttatgtacagcatttgactacct

SEQ ID NO: 33719 - DNA, 201 bp, Homo sapiens; identical to SEQ ID NO: 17291

SEQ ID NO: 33720 - DNA, 201 bp, Homo sapiens
gaaataaaacactcaagaatctccaatctcagtcaacttcctcacatgccctgtgaagatttggcttgtaaggccagtgatggatttaggagaacaatccractctatcttctgaaacatttacctccaactgattacgattttctagaatcccaacctatttttatataatttatgtacagcatttgactacctccatat

SEQ ID NO: 33721 - DNA, 201 bp, Homo sapiens; identical to SEQ ID NO: 17294

SEQ ID NO: 33722 - DNA, 201 bp, Homo sapiens
tgaagatttggcttgtaaggccagtgatggatttaggagaacaatccgactctatcttctgaaacatttacctccaactgattacgattttctagaatccyaacctatttttatataatttatgtacagcatttgactacctccatatctgtaaatctagatttgtactctttgcaggtacctagctaagggcctggtatg

SEQ ID NO: 33723 - DNA, 201 bp, Homo sapiens
gaaggagttttgcatttcctcaacatgttaaacatagagttaccacacaatccagcaactctgcaccttggtgtatgctcaagagaattgaaaacctatcyatgcaaaaacccatatacaaatgttcatagcagcattactcctaatacaaaaggtggaaataacccaaatgtctatcaactgatgcattcataaacaaaa

SEQ ID NO: 33724 - DNA, 201 bp, Homo sapiens
tttcttatctggtggtttgaggatgaggaaaatgagattggagagaaattgagttactggatgaaggccaatcaactcactagtggccaagtaggaacccyagctcaggtcatcttctgccccatcaagatgaataaaagttcagagaacagcttttggtggaagagtttattcgtgcatttatttaacaaatatattttg

SEQ ID NO: 33725 - DNA, 201 bp, Homo sapiens
aaacctctacaaaatagtgaaaaaaattatgtgttttaacatttaatcttggaaatctcagattggtctacgttaccggattggagtatttttttcttgakccagttgcaaaaatattggtcttaggcagcattggagactgaaaataaccacggtgccgtaattaactagagttctgctctctcaatccaaggattagct

SEQ ID NO: 33726 - DNA, 201 bp, Homo sapiens
tgaattattactttacctctctaagcctcaaagcctcactttccttctttttagtcccatcaaacttgcagcaagcaattcactttacttctttgtaggtraggttaataagaagtaatgtgacaaggcatgcaaacgctgagtgaaataataatatgactattattatttcattattcattccatttattttttattctt

SEQ ID NO: 33727 - DNA, 201 bp, Homo sapiens
attcccactgcaactccacaaattaagatcctgacccttagttttctactaatgagctgtatgattttgagaatatcatttaacctctctttacagatgaraaaactgaggctctgcatgcctgtctaacttgcctgagagctcagagctgcgtcagagctgatgcgctggccatgacgcctctgcaatagagcagagata

SEQ ID NO: 33728 - DNA, 201 bp, Homo sapiens
tttaacctctctttacagatgagaaaactgaggctctgcatgcctgtctaacttgcctgagagctcagagctgcgtcagagctgatgcgctggccatgacrcctctgcaatagagcagagataattttctcccagatcatgccctggggaacttccatcacctcaatcagcaaagaatgactcacttatgtgttccctatt

SEQ ID NO: 33729 - DNA, 201 bp, Homo sapiens
tacagtgctataatcacctcctcagatttcttagaccaatgattgtctttaaggattgtatcggcaggactaatttcatattaattgtgttccattatagstagcacgaaggctccatcccatatcttgattttaggaatagacagtgaggaatgccagttaataatcctgtaatgttcaataccttcaccttatatatta

SEQ ID NO: 33730 - DNA, 201 bp, Homo sapiens
tatatataatgacatatattgaattataaacacatataattatatttatatattataaatgtgtgcagtttattgtatataaattatatctcaataaagaygtttgtattttaaaatggggaataaaaagcttatggaaagacagtgtttcaggcaaaagagcaaatgaaaacaaaagcccagagcaagagctccagaaaa

SEQ ID NO: 33731 - DNA, 201 bp, Homo sapiens
tatgttttaattgcagtttgaatgatattgttgctgtgggacctgagcacttttatggcacaaatgatcactattttcttgacccctacttacaatcctgrgagatgtatttgggtttagcgtggtcgtatgttgtctactatagtccaagtgaagttcgagtggtggcagaaggatttgattttgctaatggaatcaaca

SEQ ID NO: 33732 - DNA, 201 bp, Homo sapiens
tggaacaaactccctgggggattagagatcatgaatctgccccagggagagaaggcaagagatgatatcatgaggcctgcatcaggagcaagccaaatccycaggatagatgcatccttttttcttcagacttggagtgtatgtgtgtgcggctcacaggaagctatatatgcctgggctggagggaacttaaggaagcac

SEQ ID NO: 33733 - DNA, 201 bp, Homo sapiens
tttcaagttattttaccactttattccagaaaagttccagccagtttctccacccgaaaattaggggataataatacatattacagcatatatatatatayacacacacacacacacacacatacatatatttatatttatataaaacatataaataaaactaagtatatatatatatataaaaatcaggcatatagcaga

SEQ ID NO: 33734 - DNA, 201 bp, Homo sapiens
aagaaagttgacagatgtatatgtgaaggttcctgagggtaaactaaggagttattaatcccaatgcagaagactggagaagctacaaagcatcatgagtmggggtctttccagtgggtaatgggctaaagagcattctaggtgaagggaaaagtgtgagcaaataaaaagaggtatgaaagaaatacagggaagagtcct

SEQ ID NO: 33735 - DNA, 201 bp, Homo sapiens
gtttgatcttttacttcctctatattttctctattttagaactttcaaaccagtgtcacactgcctgctttctaggaggacatccccaaataggggtattvttattcttcttcttttcattagcccttcacttttaatgccgcaggtgcttactggacacttctatttggattcctttcctatagacactttaaactcaaa

SEQ ID NO: 33736 - DNA, 201 bp, Homo sapiens
catgtacctcctggtggtgaaccatccagatgccaagtccacagtggagttgtttaaatttcaagaagaagaaaaatcgcttttgcatctaaaaaccatcrgacataaacttctgcctaagtactgagatatatcacatttctattttcctttagctgtagcggatagttaatccacttttagtttttccttttggccaga

SEQ ID NO: 33737 - DNA, 201 bp, Homo sapiens
gttcctcccatactgataaggacaactatgtcccctccttcagaaacaacttttcagagattaaacccctctgtcactgtaaactcactgagttctttcaraatttggtgtgtttgaggtgggttccattttccattccttaagcaaagttcttccctatgaataggtattacaacttcatcttaatctctcaagttgtgt

SEQ ID NO: 33738 - DNA, 201 bp, Homo sapiens
agtttcagcaacagaccaggcctgtctcccatcatgaaaaccccaaaaaggttctccatcaattgtcacattattctttcttttgaaagaccgtattaatwaatatcagttaattaatgcccgagagtgccaagtaatttgataaactagctgaggctattcttaaatttgtgatgaggtgtggatgggtttatgtccaat

SEQ ID NO: 33739 - DNA, 201 bp, Homo sapiens
acacctctcagtgtccttcctcttttaaaatattgtgattgagctttatggtcatttgatactttttttcaagcactagtttttagaagtatatacacttytggccttgtaagagatccacttaccttcattcaatttaaggaaaaagttgtgacttcgaagtaataagattgagcctatatatgtcatctagaaacacca

SEQ ID NO: 33740 - DNA, 201 bp, Homo sapiens
ttcaacttgttctcagtcaaaacttacttattatatgtctctttccatagaaaaaaatgctgaaaactagctcttactgagaaaaaagatctaactaaacwttcatattaatattcagtaatctttcatattcatttatactcattagtttattactcaataatttcccaatatgattgtataatgtagcgttttaggctt

SEQ ID NO: 33741 - DNA, 201 bp, Homo sapiens
cccgggctcaactctccagctggttccaaccaaccagctttgttatttgaagacaattggtttgagatcatgcttttgtgtgctttgggtgtttctttttytttcttttttttttttttttttttgttcttttagaattattcatctcagttgattaaggctcaggaggctagatcagatgacttagtaccactaaatttc

SEQ ID NO: 33742 - DNA, 201 bp, Homo sapiens
actgcattttgggtagcattggtatatacatgaaatatctatatccatccacatatatgccctttctcatcttgtgtcatcatcaaggattttagagtccrtaacatatgcttagagaaagcaacaggggccaggtgtggtggttcatgcctgtaatcctagcacttcgggaggccaaggtgggtggatcacctgaggtca

SEQ ID NO: 33743 - DNA, 201 bp, Homo sapiens
acaccagggacagcatttcggtaaacaaacaaaaaaatgtgtatttatgagatgttgaaatttttcatatattaatatttgttaaatcaattgcattttgraatggggatatgattttgaaaaagtatatttaccacattttcaatgtgaattctgattgctggaattggatgtctaatattccatttggggcaataaaat

SEQ ID NO: 33744 - DNA, 201 bp, Homo sapiens
cactgcactccagcgtgggtgacagagcaagactctgtttttttttaaaaaaaaaaaaaagaaagaaagaaagaaaagaaaaagcaagcaagcaagcaagygagagcaacagggacagggacagcttttaattattcatatcatagaccagttttcaaaaaatagaagataattgagcagtaatttcttttttttgttggg

SEQ ID NO: 33745 - DNA, 201 bp, Homo sapiens
tccttgatataaaggaaatacctgaatctttatgtataagatctgcaaggaaagagtatagagtgagaagggaggagggatcgataaaaacagaaggaggyataaatccaagagtcaggaagaggagcaggatttctatctgggaactcaacttttgacgttttgataagaaagaagaaggtatactgtagtgtcaaatgc

SEQ ID NO: 33746 - DNA, 201 bp, Homo sapiens
actccagcgtgggtgacagagcaagactctgtttttttttaaaaaaaaaaaaaagaaagaaagaaagaaaagaaaaagcaagcaagcaagcaagtgagagsaacagggacagggacagcttttaattattcatatcatagaccagttttcaaaaaatagaagataattgagcagtaatttcttttttttgttggggggatg

SEQ ID NO: 33747 - DNA, 201 bp, Homo sapiens
caatgtgtggggagtcaaaaacaaaattacatgaggctgtggaaaaaataagttctgttacacttcatggttttagctttttcagaattggaacaggataragtggaaagaacttagtcttttgctaatggacatgtgattagtatcttttattccttgttctgtggctaagaccaatggactattaagttggttttctcc

SEQ ID NO: 33748 - DNA, 201 bp, Homo sapiens
caagtgagagcaacagggacagggacagcttttaattattcatatcatagaccagttttcaaaaaatagaagataattgagcagtaatttcttttttttgktggggggatgcacagtgcttagactaaccccagatctttgtggggtatgactaaagccacagggtcaggaccacactcagggcagaagaggaggaagact

SEQ ID NO: 33749 - DNA, 201 bp, Homo sapiens
accacactcagggcagaagaggaggaagacttctcttgatccaagccaagcagcttttcttctctcatattttctctggattaaaacaaggggctgttgtycaagggctttcctgcaactttcccgagagagaactcactagcccctgaaatgcagaacctgggccttgacactaaattgtcaaaccaaaagagaaacgct

SEQ ID NO: 33750 - DNA, 201 bp, Homo sapiens
aagacttctcttgatccaagccaagcagcttttcttctctcatattttctctggattaaaacaaggggctgttgtccaagggctttcctgcaactttcccragagagaactcactagcccctgaaatgcagaacctgggccttgacactaaattgtcaaaccaaaagagaaacgctgtaatgcattttactcccagatact

SEQ ID NO: 33751 - DNA, 201 bp, Homo sapiens
acgtattttccctcgcctttcctgctttatttttccattcagcacgtattgctaacatactatatattttattcataccctttattacctgattccccaastagggtgtaagctccacaaggacaggctgtttttctatttgcttctggtacaattcacattgactagttggcacttaacaaatacttgttaaattactgc

SEQ ID NO: 33752 - DNA, 201 bp, Homo sapiens
gacaccaaaaaacttggccctggagcatagcataaacgaaatgcatatggtaagtcataaggagctggcagagtcagggttctggtaagtgtctgtcctaraaatgagccaacagacatccacaaggaagcccatttctttgctgctatgcaaacagcaagagcttcaggcatataaataacaaactgggagtgtgtgttt

SEQ ID NO: 33753 - DNA, 201 bp, Homo sapiens
tggtcatctgaaggttggagtcaaaatgggtgaaaacacaaaggagaggaaaaagagaccaagagcaaactagagccctaagaaagcagccctctacctcygaaaaacagcaagacgttgctttcctgccataaacgcccactgcaggaagcactgtcagcgccaattgtatgactgttcctgtcagcacatctgagagac

SEQ ID NO: 33754 - DNA, 201 bp, Homo sapiens
cacgatagaaataattctctcctctctccaaaaaaagattccaggacttagtcaatgaattagtcacacttcaatgaacctcaatgcgcaaaaacctggartatttgttaacagagaatactctgtttttcccaaagagaataatttattatgttttcttgaccaaggaatgcgaatttttcgagttgcctttgtgggagt

SEQ ID NO: 33755 - DNA, 201 bp, Homo sapiens
tggaatttcacacgctcatactggctaagggaataaaaaacaagctgcggttttaacaacaggtatttctgtaaaacaaaagttaaagaattttatgagamtagaacccaatgtaacagacattcaccacagaatgtcaaggctctgctctcaccagggtgagactgagggcaaggccagtttcagcaacagaccaggcct

SEQ ID NO: 33756 - DNA, 201 bp, Homo sapiens; identical to SEQ ID NO: 6403

SEQ ID NO: 33757 - DNA, 201 bp, Homo sapiens
tttgggaaatggtgaatgaataggtatcacatacttgtgttcatcaagctccaggctttgcataccagaggagttctgtggtttctgacagctaactggtraatcacataaaccatagaatgtaattgattctatcaagaagtaaaatcaaatgaagtatagatggagcattctgtggactgctatcaattttctctaaag

SEQ ID NO: 33758 - DNA, 201 bp, Homo sapiens
gcaaggccagtttcagcaacagaccaggcctgtctcccatcatgaaaaccccaaaaaggttctccatcaattgtcacattattctttcttttgaaagaccrtattaattaatatcagttaattaatgcccgagagtgccaagtaatttgataaactagctgaggctattcttaaatttgtgatgaggtgtggatgggttta

SEQ ID NO: 33759 - DNA, 201 bp, Homo sapiens; identical to SEQ ID NO: 6405

SEQ ID NO: 33760 - DNA, 201 bp, Homo sapiens
aaaccacctattgtatccatgttatctaattcagtagttacttctctgccataagcatactcaactcatagccacattggacacagatcatcattcccccycttttcgaatactcttctcttttggattcattggttctacttcttaggtagattcttctgctccacctggtgttaaccagggtggcttagccagtggtat

SEQ ID NO: 33761 - DNA, 201 bp, Homo sapiens
cctttcatgtgaatgctccagtggagtggtcaggttttttacatagtagctcaaggcttaagagcaagtgttcagaaggagcagagagagagggcagtagytacaatgtgaggccaaagaagcttccccccagaaaactaaaggtgataagtaaagcatgttggtattggctggcaatattccacaagagatgaaaggaca

SEQ ID NO: 33762 - DNA, 201 bp, Homo sapiens
agcatgttggtattggctggcaatattccacaagagatgaaaggacagatattgcagaagagagaaggtataactgggaccaaaagccttgagaaggaaasagacatggagcaaatcattcacagtaacagcagacagcagagaagagagacatggttgtacagaggcacctcctttgggtctttactcaaatgccccatt

SEQ ID NO: 33763 - DNA, 201 bp, Homo sapiens
acagtaggcggtctgcaagcctgaggagcaaggagagccagtctgagtctcaaaactgaagaatttggagtctgatgtttgagggcaggaagcatcagcaygggagaaagatgtaggctgggagggtaggccagtctctcctcttcatgtttttctgcctgctttatattcgctggcagctgattagattgtgcccaccca

SEQ ID NO: 33764 - DNA, 201 bp, Homo sapiens
attcttcagcagagggtattccttatcccctttcttgctttatgtgttttctccataacatatgtgcatatccataacacacacatgcatcacctagagcrttatatatgccacagtgacatgttttgctgatttctcaattgactccccccattggaatgaacgtaagcttgaggaagacgttttgtcctgttctgtagc

SEQ ID NO: 33765 - DNA, 201 bp, Homo sapiens
  misc_feature (1)...(201): n = A,T,C or G, or insertion/deletion polymorphism (see Tables 1-2)
aatgttaaaaatttacatgtacttaaagtataactaacttgaagacagtaatatttaaccgatgtttataattagtagtaaaaattcatattcttgatcanctaaaatgtatccccattttaactcaactatttggaatttgcttatatcttcaatatggctttccaagggtttaattgatttggaagtattaagtatcaa

SEQ ID NO: 33766 - DNA, 201 bp, Homo sapiens
atcctatgcagtggataaacagcatcaaaagacaccaaaaaacttggccctggagcatagcataaacgaaatgcatatggtaagtcataaggagctggcaragtcagggttctggtaagtgtctgtcctagaaatgagccaacagacatccacaaggaagcccatttctttgctgctatgcaaacagcaagagcttcaggc

SEQ ID NO: 33767 - DNA, 201 bp, Homo sapiens
gaggacttggggcttggaagaataagggtttgcaaatggcaaaggaagaattttccttcctccctaaggattgcttactcaaaaaaaaaaaaaaaaaaaargtgggggggcagtggtagtaggtggggtccttaaaaagccacagagtgagatcctatgcagtggataaacagcatcaaaagacaccaaaaaacttggccc

SEQ ID NO: 33768 - DNA, 201 bp, Homo sapiens
tcccagcacaacctcacaattaagtgaatatgtccaggaagttctgccccggggcctttgcacactcccagcacaacctcactattaagtgaatatgtccmggaagttctgccccggggcctttgcacactcccagcacaacctcactattaagtgaatatgtccaggaagttctgccccagggcctttgcacactttctc

SEQ ID NO: 33769 - DNA, 201 bp, Homo sapiens
gtcacaaagaaagctgccactggaaggcctagtggtgtacaagttagggttaaaatagtgataataatcagagcaattgcaagtaagatttctaatattargatcatcttactctgaagagaaaggatgttgaggggcattacttatcttttcacttaaagaggaatcacagattttccagtgcctctcaagtgtgttctg

SEQ ID NO: 33770 - DNA, 201 bp, Homo sapiens
ttctccaaaagttagtgtaaaatttagcattttttcttccttaagtgtttggaataattcacttatgaagctacctgggactaaagatttctttaaggggrattttaaagtatagattacatttatttaaagaatatagaaatattacaattaaatgtttctgcttgtgtatgctttgataaatttagcaattcattcttt

SEQ ID NO: 33771 - DNA, 201 bp, Homo sapiens
tgtgatacgcaggggtcttgcatgagttagcatggagaggaattatttatttgcaaggcaaagagttcattgctggactcagaacaggctccctgctagaytgtcagcacttccatggcatgagctgtgtctgctgggtacctggtgctctccaggtgttgcgttccttgcagagctcatgtaggagctcagtaattgtgt

SEQ ID NO: 33772 - DNA, 201 bp, Homo sapiens
tattgcagaagagagaaggtataactgggaccaaaagccttgagaaggaaagagacatggagcaaatcattcacagtaacagcagacagcagagaagagasacatggttgtacagaggcacctcctttgggtctttactcaaatgccccattatcagtgagaacttctctgactgctattcttcagcagagggtattcctt

SEQ ID NO: 33773 - DNA, 201 bp, Homo sapiens
tctgtgtccttctcccactcccactctcatctcaggtttcatctgccgtggaattcaccaattggctgtactgcttccaaagataagagcaaagccctgaracaaacattttcctcattcaaagacattatggtatcagagtggtgtgctgacactgggatggacaggggtttagggatggagaaagcaagcatggagccg

SEQ ID NO: 33774 - DNA, 201 bp, Homo sapiens
ggcacctattctctgtcttctctctttacagttggaaggagcaaaatgggacttttggctgaaagtgctgagctcctgcggtgggggctgaccgcaagccrcgccttctgtgcacctggtcggcccagctagctgcggacccggcggggaggggcggggcgggccaatcggcgctgccccagcagggctgcggctgcaggc

SEQ ID NO: 33775 - DNA, 201 bp, Homo sapiens
atctgccgtggaattcaccaattggctgtactgcttccaaagataagagcaaagccctgaaacaaacattttcctcattcaaagacattatggtatcagartggtgtgctgacactgggatggacaggggtttagggatggagaaagcaagcatggagccgcctgtcttgcctgtctctggggtaagaaagactgatggct

SEQ ID NO: 33776 - DNA, 201 bp, Homo sapiens; identical to SEQ ID NO: 6420

SEQ ID NO: 33777 - DNA, 201 bp, Homo sapiens
taagagcaaagccctgaaacaaacattttcctcattcaaagacattatggtatcagagtggtgtgctgacactgggatggacaggggtttagggatggagmaagcaagcatggagccgcctgtcttgcctgtctctggggtaagaaagactgatggctctgcatggtggcgagactgaggctctgccatgatgcttgagcc

SEQ ID NO: 33778 - DNA, 201 bp, Homo sapiens
gacgttttgtcctgttctgtagcatctagaacagcgcctggcacatagtaggtactcaataaatgccagctgcatgaggaaatgaatgagctgtgtggggratgtacttgagtgaactctaaagtcagagtggtgttgagagaaaaatgcttgaaatccagatgttggaaggtgacacagagtagtagcctggtgagaaca

SEQ ID NO: 33779 - DNA, 201 bp, Homo sapiens
attagaagcttacattcagaatgggtttttactatttattgtggatgtttttctaatttttttaagttacagagtgcagaaaaaaagtaagaagcagttgktattcttggcttttaaatcatgtaaaaattacagtttgtgagtttttattaatcacagtgctggtggctgccaaaggagattataggtatagataaaaat

SEQ ID NO: 33780 - DNA, 201 bp, Homo sapiens
tgagccctctaatccctccttgggcatgtgaggaacagctctcattttgagtaggaggcacagggaaacgttggttttctgcagctgtctgcttatgccckggctttttcaatgagtcatgaccagttatttacaggttctctgggcactgaggtatgctggcctctgaggtacatggtagatattatttctccaactgag

SEQ ID NO: 33781 - DNA, 201 bp, Homo sapiens
tctgcgggggtttcataaatgtttgtccagccgtcatgtgtcacttgaaaacaaactcttgctcatggcctgagacatgggataaggaggcaattgccagsggtgtgagtgcccaggttgtcagcatacacgaattaatttttcatgaagatttgtgtgccctggctacagattcacttctcaacctggaaagaaacaaac

SEQ ID NO: 33782 - DNA, 201 bp, Homo sapiens
agtttattgtttaaatctcttggttgtgctaacgtcgtctgtttctttcaaatgcagcatcagtagcttcgctctgctcaggcagccggctggcacttccytctcacatctgttcatttttcctttgtcctttactcagacattttctatggtgtttatgcactcatatctaataagtcgctcctgtgtatgtgtgtgagt

SEQ ID NO: 33783 - DNA, 201 bp, Homo sapiens
tagaagatctcatcttccaccttagttacagtactcaaaggtcccattttttgtccacggtctttattcagtgaactattttgggtacaagtaagaatttkcaacctacttcaatataggtatttgcacatttactgagttttcagtatctactaaggatacttattacttacatcatatatatgatatcatcttgacata

SEQ ID NO: 33784 - DNA, 201 bp, Homo sapiens
tgccttatttactttaaagtaaaacctaataaaaattaaatataaaaaaattatatgagcttatggactaattagaagcttacattcagaatgggtttttrctatttattgtggatgtttttctaatttttttaagttacagagtgcagaaaaaaagtaagaagcagttggtattcttggcttttaaatcatgtaaaaatt

SEQ ID NO: 33785 - DNA, 201 bp, Homo sapiens
tttagctattagggttgctgaatggtatgtttaatagaattgaagaaatgtatgctgtggagtgttcagtgctcagaactgagcagaatgttagattctartttgttcttgcttgttagctcatttagtaaccttgggtcatttgctatagcatggacttggtttgttgttctggagaaaatacttcatttctaatgattg

SEQ ID NO: 33786 - DNA, 201 bp, Homo sapiens
tatggactaattagaagcttacattcagaatgggtttttactatttattgtggatgtttttctaatttttttaagttacagagtgcagaaaaaaagtaagragcagttggtattcttggcttttaaatcatgtaaaaattacagtttgtgagtttttattaatcacagtgctggtggctgccaaaggagattataggtata

SEQ ID NO: 33787 - DNA, 201 bp, Homo sapiens
cagaactgagcagaatgttagattctaatttgttcttgcttgttagctcatttagtaaccttgggtcatttgctatagcatggacttggtttgttgttctkgagaaaatacttcatttctaatgattgatctgcaaaggagtagcaaaaagtagtaacaattccttatccaatgcactgcccctagatgagtgatttagtt

SEQ ID NO: 33788 - DNA, 201 bp, Homo sapiens
tcaagtgaggtgtgataaagaaatggatccacatcctgcaataatatgaaacaacctgtactttctgttctcttttctggcagaaactggctctgaagacwtggagatactgcctaatggactggctttcattagctctgtgagtgttttctttcacttttctgtgttctagaacgttttctaggactggcagtttaagtc

SEQ ID NO: 33789 - DNA, 201 bp, Homo sapiens
ttattgtggatgtttttctaatttttttaagttacagagtgcagaaaaaaagtaagaagcagttggtattcttggcttttaaatcatgtaaaaattacagyttgtgagtttttattaatcacagtgctggtggctgccaaaggagattataggtatagataaaaatatatagataaaggatgggttgctgagcctcctgga

SEQ ID NO: 33790 - DNA, 201 bp, Homo sapiens
tcatactaagttgaatcacacgctattgctattttttacagtcagaatgatcagatattggctatttcatatggttggcttaacatgatactacactgttrttattgatacaatcacatttctcctcaattaagtgaaggaaactgaacttacaaaatcttatacatttagagacaggaggttaagttcagaacacatgag

SEQ ID NO: 33791 - DNA, 201 bp, Homo sapiens
ctcgtggcgctggtcctgctgggggtcggcctgtccttagtcggggagatgttcctggcgtttaggtgagtggcatcttgacagggcgtcttcgactctcyttctctcctcttccaagtgaggtcaggggctgcctggcgcccccttcctagcgggtaggaaagagcagctttggaacctcactcctccatctcacccagc

SEQ ID NO: 33792 - DNA, 201 bp, Homo sapiens
taaaaattacagtttgtgagtttttattaatcacagtgctggtggctgccaaaggagattataggtatagataaaaatatatagataaaggatgggttgcygagcctcctggagtgacccagacagaggaaggaagggaaattttacccactgttggaaacccctaaaacctagctactcaactgggtctggggaccagat

SEQ ID NO: 33793 - DNA, 201 bp, Homo sapiens
tattgctattttttacagtcagaatgatcagatattggctatttcatatggttggcttaacatgatactacactgttattattgatacaatcacatttctyctcaattaagtgaaggaaactgaacttacaaaatcttatacatttagagacaggaggttaagttcagaacacatgagtatggtacacagatatggttttt

SEQ ID NO: 33794 - DNA, 201 bp, Homo sapiens
gaaggaagggaaattttacccactgttggaaacccctaaaacctagctactcaactgggtctggggaccagatgcctgagcatcacctaggggctccctgyacaggcagaatctcaagccctaccccacactattgaatcagaaccagcgtcatggaacaaactccctgggggattagagatcatgaatctgccccaggga

SEQ ID NO: 33795 - DNA, 201 bp, Homo sapiens
aagcacacaagggatgcctcaagagatttctgagtttcccaggtgggagcagtacagagaaaagaactgagagagttcccctagaccacgagtctcccacmcacgagtctcccacctttgtagtcggctgtatgtgccgcacaagtccagggaatgccttggatgatggtagaaacagctcccctcccctaccccaacttg

SEQ ID NO: 33796 - DNA, 201 bp, Homo sapiens
ctgtatgtgccgcacaagtccagggaatgccttggatgatggtagaaacagctcccctcccctaccccaacttgggctatggaatgttgcagcatctgtayggcaacttccttgtccctacattgctaattgcaatacgtgagtccactgagtttcccttctcagaaggaaaccacaaagctaacgttgggcctctcgatg

SEQ ID NO: 33797 - DNA, 201 bp, Homo sapiens
ggaatgttgcagcatctgtatggcaacttccttgtccctacattgctaattgcaatacgtgagtccactgagtttcccttctcagaaggaaaccacaaagytaacgttgggcctctcgatgcatttctgccattccatgcttactgtaggcaacacacagttgtgggaagagagtagttgtggattcctgatgacctgggt

SEQ ID NO: 33798 - DNA, 201 bp, Homo sapiens
taacaggagttcaaagtctacagatcatcctagtctctaaggcttagtcaacaatgccttatttactttaaagtaaaacctaataaaaattaaatataaamaaattatatgagcttatggactaattagaagcttacattcagaatgggtttttactatttattgtggatgtttttctaatttttttaagttacagagtgc

SEQ ID NO: 33799 - DNA, 201 bp, Homo sapiens
atagggtatcagagtgatttaatttgattttaaaaataaggaaatgtgacatttactcatttgtttactgttttgtggtgtagtagtattcatattcactmtacaaataactgtcaaaatatataagcctgcaaataatcaagaggtataattagactagatgattggtagggtctagtctgactcgaattgtatcactca

SEQ ID NO: 33800 - DNA, 201 bp, Homo sapiens
ctcatatctaataagtcgctcctgtgtatgtgtgtgagtgcacctgtgtgtgtgaaatgcctttttacatgcaggccttgtgtatgattttctgaagttamaaatcctttcaacgtacctgtatttttcaagcactacatcacaaagcagatgcccagtccaggctgcggagtcagattgggcagatgagtaggaggctgc

SEQ ID NO: 33801 - DNA, 201 bp, Homo sapiens
ttgagtatattatgattcacagcttatcttatttgtttgtcatctcccttaattatgtatttaattcataaggccaaaatattacatatagaaatagagayggaatgaggagatggagaagaaaagtactctcactaagtatatcttatttggaaagagggattcagtagatgcactagaagaaatgaaatcaggctagca

SEQ ID NO: 33802 - DNA, 201 bp, Homo sapiens
cagattgggcagatgagtaggaggctgcccatctgtcagcaactctaaaacatcaatggaataaactggaaccatgttgccatttacccggactttccacytaggagtccttacacactgatgaaattgctcctgttcctgccaaagtacacagagccctagagaggatattatgtatctcttatgtgtacctatccacct

SEQ ID NO: 33803 - DNA, 201 bp, Homo sapiens
aactctaaaacatcaatggaataaactggaaccatgttgccatttacccggactttccacctaggagtccttacacactgatgaaattgctcctgttcctrccaaagtacacagagccctagagaggatattatgtatctcttatgtgtacctatccacctctgctaaataaaaactaaatattgtacccagagttcccca

SEQ ID NO: 33804 - DNA, 201 bp, Homo sapiens
tgcattttaaaaaccaggaattaagtgtaaacatccagttagttccctggcttacctgaaaatacatgaaaacggaccttaattactgcatggcaacagtytggctattgctgagtgtattagtcaaggttccctagagggacagaactaataggatatatatatatgtaaagggggtttattaagtattaacttacctga

SEQ ID NO: 33805 - DNA, 201 bp, Homo sapiens; identical to SEQ ID NO: 6398

SEQ ID NO: 33806 - DNA, 201 bp, Homo sapiens; identical to SEQ ID NO: 6399

SEQ ID NO: 33807 - DNA, 201 bp, Homo sapiens
ctggagtgcagtggtgcgatcttggctcactgcaacttctacctccgaggttcaagagattcttgtgcctcagcctcccggatagctgggactacaggcamacaccaccatgcccggctaatttttgtatttttagtagagacggggtttcaccatgttggccagcctggtctcgaacacctgacctcaggtgatccaccc

SEQ ID NO: 33808 - DNA, 201 bp, Homo sapiens
gatgctgggaaagtaattatcaagcctccaatgtgggaggcaggccctgtcagcaaagataaaacggtaggagaatagcagctgggaggcaaccaacaagragagtccccgggctcaactctccagctggttccaaccaaccagctttgttatttgaagacaattggtttgagatcatgcttttgtgtgctttgggtgttt

SEQ ID NO: 33809 - DNA, 201 bp, Homo sapiens
cttggccttccaaagtgctgggattacaggtgcgagccaccacacccagccagaaacgaagtttttctaaggcacttgttatgatgatagtctggcatttycgggaaaatgttttgccaataaattgagaaccaccaacagttgtttaagaatcactgacttgaagtaataaacaggaacattttgtttgggtcaaaaaac

SEQ ID NO: 33810 - DNA, 201 bp, Homo sapiens
ctttctgtatacccatgcccactttcaaataaaatgaacagtcatggtttaaaagacaaattgtgtatgcatttacacttgtgctataattatgatcatgygtgttctatgcatatttgtgttcttcggtctacattgaaccatattacgttagcttctattgcagcaatttttttgtgagttcagtgtattcaagaattg

SEQ ID NO: 33811 - DNA, 201 bp, Homo sapiens
tctttcttgttcttgatgatagataagcaaattccactgaagaaacaaaagcctatccaatttgacacagcacatactcaagatcactcaaaaagggacayggcttggttagaaatttcataacatacattgtgaaaaagaggaaaacagcttaattcatgtattctgtgattcccagatctaaattttcgcactgacata

SEQ ID NO: 33812 - DNA, 201 bp, Homo sapiens
ataacagagttgataggaaacgacagacaatcatccagccatttaaaaacctttgctaccccttgtaatttacttagtccagttttctcttacaaagatgrtagactagtcatcctgcaaagcaatgtcttgcaaactttcttgagcaacataaggtgtatttcaagcaaaatcttatatgggaacacaatatataaaaca

SEQ ID NO: 33813 - DNA, 201 bp, Homo sapiens
gcttaggtttagaacccaccacttaaaatgatttcataaccctaacagacaaacccagtaatgactcagattggattttccatcaacttagtggaataggrtatcagagtgatttaatttgattttaaaaataaggaaatgtgacatttactcatttgtttactgttttgtggtgtagtagtattcatattcactatacaa

SEQ ID NO: 33814 - DNA, 201 bp, Homo sapiens
gcaatttactcagcctctcagtgcctccatttccttacctacaaaacagggtaaatattcatctttttctcaaaggtggctaaaaagattaaatgaggaartatgtgtgagagcccttattggagcttggcacatagtaggccatgaaaagcaatttgaatgaatgaggcgtgtgtagtagcagaaaatagactgattaga

SEQ ID NO: 33815 - DNA, 201 bp, Homo sapiens
atttcaagcaaaatcttatatgggaacacaatatataaaacaacagctttattgttttgattgaaggctaagaaaggagtagttcctctggcccaccaaamctctgtctttgagatgcttccaaggacctaccagggaacagtttaaaagccataagcaatattctctctgtattccttgcttatatcattgaagactatt

SEQ ID NO: 33816 - DNA, 201 bp, Homo sapiens
accctttgtgccttttgctagtttttagctattagggttgctgaatggtatgtttaatagaattgaagaaatgtatgctgtggagtgttcagtgctcagamctgagcagaatgttagattctaatttgttcttgcttgttagctcatttagtaaccttgggtcatttgctatagcatggacttggtttgttgttctggaga

SEQ ID NO: 33817 - DNA, 201 bp, Homo sapiens
gatgaaagggtttgtgtggggtggcctagtggagcatgtggcttccagaagacttctcctggggacccattacagaagctaactaagaggcttcctatgtrgccatctggctagccctgtggtttggagcagtcaacatgaacccatgggccatgcagcgcctctattagcatttgaagtactggtattgtgcttgatttt

SEQ ID NO: 33818 - DNA, 201 bp, Homo sapiens
agcccagatatgtgagcacatttttgccctgacaatgatttctggcttaatttaatttctactgaatttagtgtatttacacacagacacacacagatacmcacacacacacacacacacacacacacacacacgacgtaacactattttaagatacatataataggatttttatgttacagtgctataatcacctcctca

SEQ ID NO: 33819 - DNA, 201 bp, Homo sapiens
acacacacacgacgtaacactattttaagatacatataataggatttttatgttacagtgctataatcacctcctcagatttcttagaccaatgattgtctttaaggattgtatcggcaggactaatttcatattaattgtgttccattatagctagcacgaaggctccatcccatatcttgattttaggaatagacagtg

SEQ ID NO: 33820 - DNA, 201 bp, Homo sapiens
tccaggaagttctgccccagggcctttgcacactttctcccctcaacctggaatgctctttccctagatatccacattattcgttctcttatttcacttargtttttgctctaacatcccctcatcagagagaacatgcctgactcccatgaagataatacttcgttactctctattcttttatcctgttgtatttttcct

SEQ ID NO: 33821 - DNA, 201 bp, Homo sapiens
cacacacacgacgtaacactattttaagatacatataataggatttttatgttacagtgctataatcacctcctcagatttcttagaccaatgattgtctttaaggattgtatcggcaggactaatttcatattaattgtgttccattatagctagcacgaaggctccatcccatatcttgattttaggaatagacagtga

SEQ ID NO: 33822 - DNA, 201 bp, Homo sapiens
cattcttgagaatttttttttctcctgtggagttttgagttttcagagactgtcactggttcttccttgagccacttttgtttggaacaggagcaatcacmaatgcttctctctacaaagagatgaaaatattccatctgcctgacatcctaactactagctggaggtgggttgaaattggtttttggagagagggctgac

SEQ ID NO: 33823 - DNA, 201 bp, Homo sapiens
ggtggctcacacctgtaatcccagcactgtgggaggctgaggtgggtggatcacgaggtcaagagttcaagaccagcctggccaatatggtgaaaccccgyctctactaaaggtacaaaaaattagccagacatggtggcacatgcctataatcccagctacctgggagactgaggcaggagaatcacttgaacctgggag

SEQ ID NO: 33824 - DNA, 201 bp, Homo sapiens
ataggtatttgcacatttactgagttttcagtatctactaaggatacttattacttacatcatatatatgatatcatcttgacatatttgtctactgctgkgtattgttaaagctcagttttaagagtccatttcacctgcccaacaggaaaaaaaaaagtgttaaagcccgtatctcttgggttaaaaaaaaaagaaaca

SEQ ID NO: 33825 - DNA, 201 bp, Homo sapiens
aaatgaaccagataagtgactttattcccagctactgttttttcagttgacaacataattctcaattcttggtttttttttttttttttttttttttttgkgacagagtatcgctctgtcgcccaggctggagtgcagtggcgcaatcttggctcactgcaagctccgcctcccgggttcacaccattctcctgcctcagc

SEQ ID NO: 33826 - DNA, 201 bp, Homo sapiens
gcaagctccgcctcccgggttcacaccattctcctgcctcagcctcccaagtagttgggaccacaggcgcatgccaccatgcctggctaattttttgtattttttttttttttttagtagagacagggtttcatcctgttggccaggatggtcttgatctgctgaccttgtgatccacccgcctcggcctcccaaagtgcc

SEQ ID NO: 33827 - DNA, 201 bp, Homo sapiens
actgactcaaatgttaatctcctttggcaacacgctcacagacacccaggatcaatactttgcatccttcaatccaatcaagttgactctcagtattaacyatcatactgagtaacagcttcctccctccacatttactgaaatccccactgctccctaatgtcccacatccaggatgcgctgctcatttgcatttcctgc

SEQ ID NO: 33828 - DNA, 201 bp, Homo sapiens; identical to SEQ ID NO: 6406

SEQ ID NO: 33829 - DNA, 201 bp, Homo sapiens
aaatgctgaaaactagctcttactgagaaaaaagatctaactaaactttcatattaatattcagtaatctttcatattcatttatactcattagtttattrctcaataatttcccaatatgattgtataatgtagcgttttaggctttacgttggaagagaaggaatgcttggcagagaggcctgtaataaaagaccttca

SEQ ID NO: 33830 - DNA, 201 bp, Homo sapiens
ttttaggaataagaatttgatttataacattgtcagttggacatttatctaaacattcaatatacaaagttataaagaaaaatacttctaagatatttaaraaaatgcaatataatagatcataaattaggtgcaaaaacaagacacttacagacatttccagtatatacatccattttcaaatattaccaaagtgtaaac

SEQ ID NO: 33831 - DNA, 201 bp, Homo sapiens
gccagagtaggtatggctgttcaactctcatttctaatgatcacaaactcctccacatgctcttctgaagaaccttctgaggactcaagcccctcagagayggcccattcttttcctctcttgtttctcgagctgattggatgctggctcctggcctcaggatctccattcaagttattaccaggaaaaaaatcctcttct

SEQ ID NO: 33832 - DNA, 201 bp, Homo sapiens; identical to SEQ ID NO: 6473

SEQ ID NO: 33833 - DNA, 201 bp, Homo sapiens
cccaggaggcagctgttgcagtgagccaagatcacgccattgcactccagcctgggtgacagaacgagactccacctcaagaaaaaaaaaaaaaacacggytgggcacgatggctcacgcctgtaatctgagcacattgggaggctgaggcaggtggatcacctgaggtcgggagttcgagaccagcctggccaacatagt

SEQ ID NO: 33834 - DNA, 201 bp, Homo sapiens
ttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacagggga

SEQ ID NO: 33835 - DNA, 201 bp, Homo sapiens
cactgtgggtccaagctaggggccctgcctagtgatgagcaggggggacaggtgggtcacaggggtgacagactggcctcttctccttagggcagtttgcyggaggtgtggttgaagcactcagagtctttgctccttccccagtctgagggcagcaaggccagtaccaccgcagtggcagcggcagagtgaccttccgtt

SEQ ID NO: 33836 - DNA, 201 bp, Homo sapiens
ggcaggggtgggtggagtcacccacttcaccatctgggtgctttccagggaagcatgcagccacgaccccgggcagagttcaggcagaagctgggccactrtgctggaaactggccttgagccttgtggagtaacggcaggtggagccatctcactgctcccacgcaccatgcccgtggcctctgcgggggctgtggtaac

SEQ ID NO: 33837 - DNA, 201 bp, Homo sapiens
gcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggctt

SEQ ID NO: 33838 - DNA, 201 bp, Homo sapiens
aggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggcttag

SEQ ID NO: 33839 - DNA, 201 bp, Homo sapiens
gagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggcttagct

SEQ ID NO: 33840 - DNA, 201 bp, Homo sapiens
atgcagacttgtttgtgtggttgttttatagtgtcactggtttatgtacgtaagtgtgttttctattggctggtgatggtcttttctttccatatttagcrttcctcttaggacctcttgtaaggcaggcctgatggtaataaattccctcagcatttgcttgtctgtaaaggatcttatttctccttcacttatgaaact

SEQ ID NO: 33841 - DNA, 201 bp, Homo sapiens
ggggatatgatggcttagcttgggctcagaggcctgacattcctgtcttcttatattaataagaaaaataaaacgaaatagtggtaaagtgttgggatggygaaaattttggggggtggtatggagagagaatgggcgatgtttctcagggctgcttcgagcgggattaggggcggcgtgggaacctagagtgggagagat

SEQ ID NO: 33842 - DNA, 201 bp, Homo sapiens
ggggtttcactgcgttagccaggatggtctcgatctcctgacctcatgatccgccagccttggcttcccaaagtgctgggattacaggtgtgagccaccgygcccagcctgctaaggattgctgtatgtctgattgtatgattgactttagagtatgtgccatgaggcaatgaaaacaatgtagattctgttgttttgggg

SEQ ID NO: 33843 - DNA, 201 bp, Homo sapiens
aggcctgacattcctgtcttcttatattaataagaaaaataaaacgaaatagtggtaaagtgttgggatggtgaaaattttggggggtggtatggagagakaatgggcgatgtttctcagggctgcttcgagcgggattaggggcggcgtgggaacctagagtgggagagattaagctgaaggaagattttgtgttaaggg

SEQ ID NO: 33844 - DNA, 201 bp, Homo sapiens
gctaaggattgttttttttttttttgaaatggagtcttgctctgtcgcccaggctggagtgcagtggcgcaatctaggctcactgcaagctccgcctcccrggttcacaccattctcctgcctcagcctcctgagtagctgagactacaggtgcccgccaccccgcccggctaattttttttgtatttttagtaaagacgg

SEQ ID NO: 33845 - DNA, 201 bp, Homo sapiens
tggtgaaaattttggggggtggtatggagagagaatgggcgatgtttctcagggctgcttcgagcgggattaggggcggcgtgggaacctagagtgggagmgattaagctgaaggaagattttgtgttaaggggtgatattgtgggattgttagaagaaacatttttcatttagaattactggtgatggcctggatgcagt

SEQ ID NO: 33846 - DNA, 201 bp, Homo sapiens
gagagagaatgggcgatgtttctcagggctgcttcgagcgggattaggggcggcgtgggaacctagagtgggagagattaagctgaaggaagattttgtgktaaggggtgatattgtgggattgttagaagaaacatttttcatttagaattactggtgatggcctggatgcagttttgtatgaattgaaaaactaaatgg

SEQ ID NO: 33847 - DNA, 201 bp, Homo sapiens
gaagaaacatttttcatttagaattactggtgatggcctggatgcagttttgtatgaattgaaaaactaaatggaataaggaaaggagaaaaacaggtatwaaaggtctaagaattgggacgactcaggacatctgattagagagtgcctaaggaggttcagcatagccttgccagcaaagattatttatttacttcaaga

SEQ ID NO: 33848 - DNA, 201 bp, Homo sapiens
cagtgtaaacaagagcagggcatgtgtgagtagttgagaatggtgaataggagtatgactagacagaagatagtagggatgacaagttttttggggcacawtctaagttggtctggtgtctggaatgagactggggcttaataaaaagcagtgtctatacaggagctcaaatgtgctgtaccttgtagcattctgaggaca

SEQ ID NO: 33849 - DNA, 201 bp, Homo sapiens
aggagtatgactagacagaagatagtagggatgacaagttttttggggcacaatctaagttggtctggtgtctggaatgagactggggcttaataaaaagsagtgtctatacaggagctcaaatgtgctgtaccttgtagcattctgaggacaggcctgaattctgagaaaagaaagtggtaaaagtattgtccagtcttt

SEQ ID NO: 33850 - DNA, 201 bp, Homo sapiens
gcagctgctctgcactcccgagctgggggctctgcctggtaaagtgggggtgggagctcacggggaagagagactggactcctctctgtctgatggctgtrgcataatgaccgggcccccacacatgaaaaagaattctgggaactcaaaaagccagtgtgtccccaccatggaccccttggattgtgtttcaaatttctc

SEQ ID NO: 33851 - DNA, 201 bp, Homo sapiens
tcctttcttcctatttggatgccttttatttctctcttgcctgattgctctagctaggacctccagtactatgttgaacagaagtagtgagagacggcatscatgtcttttgccagttttcaaggggaatacttccagcttttgcccattcaatatgatgttgactgtgagtttgtcatacatcattcttattattttgaa

SEQ ID NO: 33852 - DNA, 201 bp, Homo sapiens
ggactacaggtgcccaccaccacgcccagctaattttttatatttttttagtagagatggggtttcaccatgttagccaggatggtctcaatctcctgacstcgtgatccgcccgccttggtctcccaaagtgctgggattacaggcgtgagccaccgcgcccggccgacatttctttctttcatttctaccttgaagaat

SEQ ID NO: 33853 - DNA, 201 bp, Homo sapiens
gcctgaattctgagaaaagaaagtggtaaaagtattgtccagtcttttttaagttggtggctgagcttggtgaggtgtgtttttaatagaccattagtccrttctacttttcctgaagactgaggactgtaagggatataaaggtttcactgaataccaagagcctgaaaaactgcttggctgatttgactaataaaggcc

SEQ ID NO: 33854 - DNA, 201 bp, Homo sapiens
ctgccaggctggagtgcaatggcgtgatctcggctcactgcaagctccgcctcccggattcacgccattctcctgcctcagcctccccagtagctgggacwacaggtgcccaccaccacgcccagctaattttttatatttttttagtagagatggggtttcaccatgttagccaggatggtctcaatctcctgacctcgt

SEQ ID NO: 33855 - DNA, 201 bp, Homo sapiens
tcataagaacattaaatataggcccccaatctcttctggattgtagagtttctgctgaaaggtctgctgttagctcgatggcattccctttgtaggtgacmtgccccttcttttttgctgccttttcacattttttttttttttttgagactgagtcttgctctgttgcccaggctgccaggctggagtgcaatggcgtga

SEQ ID NO: 33856 - DNA, 201 bp, Homo sapiens
tgatctcaggagggtgtatgtgtccaggaatttctccatttattctggattttctagtttgtgtgcatagaggtgttcataatattctctgatgattgtayttctgtggggtgagtggtaatataccctttgttgtttctaattgtgtttatccggatcatctctcttttcttctttattagtctaactagtcatctgtct

SEQ ID NO: 33857 - DNA, 201 bp, Homo sapiens
ggatcatctctcttttcttctttattagtctaactagtcatctgtcttactaattttttcaaaaattctactcctcgatttgctgatcttctgaatgcttkttcgtgtctcaatctccttcagctcagctctgattttggttatttcttgtttcctatgagctttggggttgatttcctcttggttctcttagttcctctt

SEQ ID NO: 33858 - DNA, 201 bp, Homo sapiens
actcctcgatttgctgatcttctgaatgctttttcgtgtctcaatctccttcagctcagctctgattttggttatttcttgtttcctatgagctttggggytgatttcctcttggttctcttagttcctcttgttatgatgttaggttgttaatttgaactttttctagctttttgaagtgggagtttagtgctataaact

SEQ ID NO: 33859 - DNA, 201 bp, Homo sapiens
tgtcacagcttctcagatgttgctggttttccatgaccttgtcagttttgagggtagtggtccattattttcaagggtactcccactactggaaattgtcygatgttttgctcatgactagactgagttatgggtcattgcaggcaagaccacagaagcaaagtgccatttcatctcctcatagcaaaggtttaaactgtc

SEQ ID NO: 33860 - DNA, 201 bp, Homo sapiens
tcatatcacctgcaaacagggatagtttgacttcctttcttcctatttggatgccttttatttctctcttgcctgattgctctagctaggacctccagtamtatgttgaacagaagtagtgagagacggcatccatgtcttttgccagttttcaaggggaatacttccagcttttgcccattcaatatgatgttgactgtg

SEQ ID NO: 33861 - DNA, 201 bp, Homo sapiens
cgcaatctaggctcactgcaagctccgcctcccgggttcacaccattctcctgcctcagcctcctgagtagctgagactacaggtgcccgccaccccgccyggctaattttttttgtatttttagtaaagacggggtttcactgcgttagccaggatggtctcgatctcctgacctcatgatccgccagccttggcttccc

SEQ ID NO: 33862 - DNA, 201 bp, Homo sapiens
aggccaaggcaggcggatcacaaggtcaggagatcaaaaccatcctggccaacatggtgaaaccctgtctctactaaaaatacaaaaaaattagccaggcrtggtggcgggcgcctgtagtcccagctactcgtgcggctgaggcaggagaatggcatgaacctgggaggcagagcttgcagtgagccaagatcatgccac

SEQ ID NO: 33863 - DNA, 201 bp, Homo sapiens
tttcctgtcatcatgttgttagctggtttggttattatgcagacttgtttgtgtggttgttttatagtgtcactggtttatgtacgtaagtgtgttttctwttggctggtgatggtcttttctttccatatttagcgttcctcttaggacctcttgtaaggcaggcctgatggtaataaattccctcagcatttgcttgtc

SEQ ID NO: 33864 - DNA, 201 bp, Homo sapiens
ggctgaggcaggagaatggcatgaacctgggaggcagagcttgcagtgagccaagatcatgccactgcactccagcttgggcgacacagcgagactctgtstcaaaaaaaaaaaaaaatgccagctcttctttatatatctggtgggattgagctgtgaatccatctggtactggtctttttctggtctgtcattacagag

SEQ ID NO: 33865 - DNA, 201 bp, Homo sapiens
gagggtggggctgttgtgccgcggaatcaagctggggcttggtgaagagcagggggttgagggctcacagggagaggagactgagctcctctccgtatggmgactgcggtgtgctggaagcatgaatgaaggccgggcgcggtggactcacgctcggaatcccagcactttgggaggccgaggcgggcggatcacgaggtc

SEQ ID NO: 33866 - DNA, 201 bp, Homo sapiens
agtatgactagacagaagatagtagggatgacaagttttttggggcacaatctaagttggtctggtgtctggaatgagactggggcttaataaaaagcagygtctatacaggagctcaaatgtgctgtaccttgtagcattctgaggacaggcctgaattctgagaaaagaaagtggtaaaagtattgtccagtctttttt

SEQ ID NO: 33867 - DNA, 201 bp, Homo sapiens
gggttgagggctcacagggagaggagactgagctcctctccgtatggcgactgcggtgtgctggaagcatgaatgaaggccgggcgcggtggactcacgcycggaatcccagcactttgggaggccgaggcgggcggatcacgaggtcgggagatcgagaccatcctggctaatctggtgaaaccccgtctctactaaaaa

SEQ ID NO: 33868 - DNA, 201 bp, Homo sapiens
tgaggacaggcctgaattctgagaaaagaaagtggtaaaagtattgtccagtcttttttaagttggtggctgagcttggtgaggtgtgtttttaatagacyattagtccattctacttttcctgaagactgaggactgtaagggatataaaggtttcactgaataccaagagcctgaaaaactgcttggctgatttgacta

SEQ ID NO: 33869 - DNA, 201 bp, Homo sapiens; identical to SEQ ID NO: 6443

SEQ ID NO: 33870 - DNA, 201 bp, Homo sapiens
tcttttgccagttttcaaggggaatacttccagcttttgcccattcaatatgatgttgactgtgagtttgtcatacatcattcttattattttgaaatatrtttcttcaatgcctagtttgtcgaggttttttagcataaagggatgttgaattttatcaaaagctctattgagaggattatgtgtgtggggagggttgtt

SEQ ID NO: 33871 - DNA, 201 bp, Homo sapiens
tagggaagccgaggcgggtggatcacccaaggtcaggagttcgagaccagcctggccaacatggtgaattccccgtctctactgaaaatgcaacaatcgcygggcgcggtggctcacgcctgtaatcccaacactttgggtggctgaggtgggtggatcacctgaggtcaggagttcgagaccagcctggccaacacagtg

SEQ ID NO: 33872 - DNA, 201 bp, Homo sapiens
ctgtctgggccagaggattcaggcacaggaaggtaagtgtcctgtaaatctctcccagcccctttagaccctcttgggagctctaggataaagaaattgargaatagcctgaagcaccattcttattttaatccccattctagttgtttctgctgtgcttctcttgcataatttctatctcactttgttatctccaaaccc

SEQ ID NO: 33873 - DNA, 201 bp, Homo sapiens
ttcttaccattaatgaacaaatatcgacacattcccagctacagtctacagtttatttacattttcttagtttttacctgatagtctttctctgttccagratcccattcaagatttcacattgcggctgggagtggtggctcacgcctgtaatcccaacacttagggaagccgaggcgggtggatcacccaaggtcagga

SEQ ID NO: 33874 - DNA, 201 bp, Homo sapiens
aggtaagtgtcctgtaaatctctcccagcccctttagaccctcttgggagctctaggataaagaaattgaagaatagcctgaagcaccattcttattttartccccattctagttgtttctgctgtgcttctcttgcataatttctatctcactttgttatctccaaacccttcagactcattaatgctcaggcctggatt

SEQ ID NO: 33875 - DNA, 201 bp, Homo sapiens
ggttgagggctcacagggagaggagactgagctcctctccgtatggcgactgcggtgtgctggaagcatgaatgaaggccgggcgcggtggactcacgctyggaatcccagcactttgggaggccgaggcgggcggatcacgaggtcgggagatcgagaccatcctggctaatctggtgaaaccccgtctctactaaaaac

SEQ ID NO: 33876 - DNA, 201 bp, Homo sapiens
gaagttttcatgaacaatacactgaaatatgttttccatgttccttgctttctccccatctctttcggggatgccaatgggctatttggtctcttttcatratcccatatttcttagaggttttgttcattaatttttattctttttcttcatttttgtctgactgaattagttcagagagccagtattcatgctctgaga

SEQ ID NO: 33877 - DNA, 201 bp, Homo sapiens
attctataaccctcgtttcattcatctcaatgtagctaagaaccagatttctggggaactatcgagttgccagagttcttgtgttgattcttttttttttyttttttgtggcagagtcttactctgtcgcccaggctggagtgcagtggcacgatctcagctcactgctgcaaccttcacctcccgggttcaagcgattct

SEQ ID NO: 33878 - DNA, 201 bp, Homo sapiens
ggcctgaattctgagaaaagaaagtggtaaaagtattgtccagtcttttttaagttggtggctgagcttggtgaggtgtgtttttaatagaccattagtcyattctacttttcctgaagactgaggactgtaagggatataaaggtttcactgaataccaagagcctgaaaaactgcttggctgatttgactaataaaggc

SEQ ID NO: 33879 - DNA, 201 bp, Homo sapiens
accaggctggtctcaaactcctgggctcaagcaatctgcctgccttggccccctaactcttgtattttgacaaagtcggcagtagtgctctgtggttgtgrggaggggtgactccctcgcctggtccattcttgggccttggaggagcctcctacagtcactggctctgcacccactgtttcctttgttaggattgttctg

SEQ ID NO: 33880 - DNA, 201 bp, Homo sapiens
aggattgttctgcccacggggctccctcaggcagggcatggtgggcagacaggctgtatccttccccggccagccctatggagggaggaccaccccgcacytctgcaggctgatgaaatcaggtgtttcacccctctgaacgttctgagaatgagggctcctcacggcttggtcgccacctaacgtggtgagtccttctca

SEQ ID NO: 33881 - DNA, 201 bp, Homo sapiens
ggattgttctgcccacggggctccctcaggcagggcatggtgggcagacaggctgtatccttccccggccagccctatggagggaggaccaccccgcaccwctgcaggctgatgaaatcaggtgtttcacccctctgaacgttctgagaatgagggctcctcacggcttggtcgccacctaacgtggtgagtccttctcag

SEQ ID NO: 33882 - DNA, 201 bp, Homo sapiens
gggctccctcaggcagggcatggtgggcagacaggctgtatccttccccggccagccctatggagggaggaccaccccgcacctctgcaggctgatgaaakcaggtgtttcacccctctgaacgttctgagaatgagggctcctcacggcttggtcgccacctaacgtggtgagtccttctcagcaagggtgattggagcc

SEQ ID NO: 33883 - DNA, 201 bp, Homo sapiens
ggaagacccagcaagcctggcccgtctggctgcaagtggcaggggtgggtggagtcacccacttcaccatctgggtgctttccagggaagcatgcagccaygaccccgggcagagttcaggcagaagctgggccactatgctggaaactggccttgagccttgtggagtaacggcaggtggagccatctcactgctcccac

SEQ ID NO: 33884 - DNA, 201 bp, Homo sapiens
tggagtgcagtggcacaatctcggctcactgcaagctccaacctcccgggttcacgccattctcctgcctcagcctcccgagtagctgggactacaggcgyccgccaccacgcctggctaattttttgtatttttagtagagatagggtttcactgtgttagccaggatggtctcaatcttctgacctcgtgatccgcccg

SEQ ID NO: 33885 - DNA, 201 bp, Homo sapiens
aagacactgttgctttttgagttgatggagttcttgctcagttctttctcatccatgtgggctaatgttcctttgagtgtgctgcaatttgaatttttttyttttttcttttaaccgtgatgtaatttgagcacagtcagtagacttcttttctggatggtttcagagggctggggcttcgcacagggtctttatttatag

SEQ ID NO: 33886 - DNA, 201 bp, Homo sapiens
gccaccacgcccggcccccgaaaatgctgggattacaggcatgagccaccgcacctggcctcccaaagtgctgggattccaggcgtgagccaccgtgcccrgcaggtgtcatgtatctttaggtttgtcttggctgtcacagcttctcagatgttgctggttttccatgaccttgtcagttttgagggtagtggtccatta

SEQ ID NO: 33887 - DNA, 201 bp, Homo sapiens
tggatcacctgaggtcagggattcaagaccagcctgaccaacatggggaaacctcatctttactaaaaatacaaaaattagctgggcgtggtggcgggtgyctgtaatcccagctactcgggaggctgaggcaggagactcacttgaacctcggaggtggaggttgcagtgagcggagatcatgccactgcactgcagcct

SEQ ID NO: 33888 - DNA, 201 bp, Homo sapiens
tcccacagagaaggaaaggaatggcttccccatggcgagccacctcagtctgggctttcttttcttccaggggactttcccatgcctttcatatctgccamatcgagtcctgtgattcccttggatggatctgtgaaaatccagtgccaggccattcgtgaagcttacctgacccagctgatgatcataaaaaactccacg

SEQ ID NO: 33889 - DNA, 201 bp, Homo sapiens; identical to SEQ ID NO: 6490

SEQ ID NO: 33890 - DNA, 201 bp, Homo sapiens; identical to SEQ ID NO: 6491

SEQ ID NO: 33891 - DNA, 201 bp, Homo sapiens
tgagactgatcctgagttcgtcattgaccacatggacgcaaacaaggcagggcgctatcagtgccaatataggatagggcactacaggttccggtacagtracaccctggagctggtagtgacaggtaaggaaacatccagggtccacagccctggtgtgatttttttcttatttttaatagagtatttttcaagaagttt

SEQ ID NO: 33892 - DNA, 201 bp, Homo sapiens
cctcggaggtggaggttgcagtgagcggagatcatgccactgcactgcagcctcagtgacagagcgagactccatctcaaaaaacaataataggctgggcrcagttgctcatgcctgtaatcccagcactttgggaggccaaggtgggcaaatcacctgaggtcaggagttcgagaccagcctgaccaacatggagagacc

SEQ ID NO: 33893 - DNA, 201 bp, Homo sapiens
tgaagttttggaatgagactgatcctgagttcgtcattgaccacatggacgcaaacaaggcagggcgctatcagtgccaatataggatagggcactacagrttccggtacagtgacaccctggagctggtagtgacaggtaaggaaacatccagggtccacagccctggtgtgatttttttcttatttttaatagagtatt

SEQ ID NO: 33894 - DNA, 201 bp, Homo sapiens
catctctatttaaaaaaatatacatatatatgtcttctcttgggctccacccaagagcaacctggaactaagttattcggcaacgaactgttccactttgytgtgaggcaatagatgtggaaattccctgacgaggggctctgtcctcatacttcctgcggagcttattgtcgtaagaatatctgtcatcctgctaatgtg

SEQ ID NO: 33895 - DNA, 201 bp, Homo sapiens
gagacggaggttgcagtgagctgagatcacgccactgcactccagcttgggcaataagagcgaaactccatctcaaaaaaatatataataataacaataakaagaagaagaaaagaataaaggagaaaaggtctttctaatagctcactcttttctctcttaggcttgtatggcaaacccttcctctctgcagatcggggt

SEQ ID NO: 33896 - DNA, 201 bp, Homo sapiens
cggcctaaatttttttttaaataaagaatggtaggttcttcacaccctaatgtatttttacttctcccacagagaaggaaaggaatggcttccccatggcragccacctcagtctgggctttcttttcttccaggggactttcccatgcctttcatatctgccaaatcgagtcctgtgattcccttggatggatctgtgaa

SEQ ID NO: 33897 - DNA, 201 bp, Homo sapiens; identical to SEQ ID NO: 6444

SEQ ID NO: 33898 - DNA, 201 bp, Homo sapiens
aggcgtggtggtggtgggcgcctgtaatcccagctacttgggaggctgaggcaggagaatcacttgaccagggaggcggaggttgcagtgagccgagatcrcgccactgcactccagcctgggcaacagagtgagactccatctcaaaaaaaaaaaaaaaaaaaacacacacaacctgcccataatcacctccttcccagt

SEQ ID NO: 33899 - DNA, 201 bp, Homo sapiens
cttgggaggctgaggcaggagaatcacttgaccagggaggcggaggttgcagtgagccgagatcacgccactgcactccagcctgggcaacagagtgagamtccatctcaaaaaaaaaaaaaaaaaaaacacacacaacctgcccataatcacctccttcccagtttatagcacttccctgggaagcacagttccttgccc

SEQ ID NO: 33900 - DNA, 201 bp, Homo sapiens
gaccagggaggcggaggttgcagtgagccgagatcacgccactgcactccagcctgggcaacagagtgagactccatctcaaaaaaaaaaaaaaaaaaaamacacacaacctgcccataatcacctccttcccagtttatagcacttccctgggaagcacagttccttgcccgtgaacacagtcttgctgactgatcagtg

SEQ ID NO: 33901 - DNA, 201 bp, Homo sapiens
attgctatttacttcattgtccagtagcttatgtatgaaaatataattataaaatgtaagggtcctacttccagtgaaactgaagggacttaggcccactkttatcctttactgagagcttatctctacttgataaaatttctactgtattcttggcttaactcaggtcctgtgattaaaaaaaaaatgcaaagtatttct

SEQ ID NO: 33902 - DNA, 201 bp, Homo sapiens
gctaagatggtaaattgtatgttatgtttttactacaatttttttttttttttttctgagacagagtctcactcttgttgcccaggctggagtgcaatggygcggtctcggctcaccgcaacctccgcctcctgggctcaagccattctcctgcctcagcctccagagcagctgggattacaggcatgcgccaccacgcct

SEQ ID NO: 33903 - DNA, 201 bp, Homo sapiens
cattctgaggacaggcctgaattctgagaaaagaaagtggtaaaagtattgtccagtcttttttaagttggtggctgagcttggtgaggtgtgtttttaawagaccattagtccattctacttttcctgaagactgaggactgtaagggatataaaggtttcactgaataccaagagcctgaaaaactgcttggctgattt

SEQ ID NO: 33904 - DNA, 201 bp, Homo sapiens
gaaggccaaactgtggaattatgtctgacagaagggaagaaatgacctcggtggccttctcagaccctgtgggaaaggcctctacccatccagtgaaagtktctacccagaccaagaggtattttagtttcctgactcagggcatgtgagtaaagtcaatttgccagtcctgggcgggggcaaatccccgagcctgatgtg

SEQ ID NO: 33905 - DNA, 201 bp, Homo sapiens
tgtaaacaagagcagggcatgtgtgagtagttgagaatggtgaataggagtatgactagacagaagatagtagggatgacaagttttttggggcacaatcyaagttggtctggtgtctggaatgagactggggcttaataaaaagcagtgtctatacaggagctcaaatgtgctgtaccttgtagcattctgaggacaggc

SEQ ID NO: 33906 - DNA, 201 bp, Homo sapiens; identical to SEQ ID NO: 6484

SEQ ID NO: 33907 - DNA, 201 bp, Homo sapiens; identical to SEQ ID NO: 6439

SEQ ID NO: 33908 - DNA, 201 bp, Homo sapiens
aagcatgagctcattgaggggatgcttgagggagtcccattttggcaagcgaaaaggaaaatgagctcccgtttcagggctctggggttgggatggaatgraacacaaccaccaaccattcatctccttgaattgtgtctccagactccatccaccaagattacacgacgcagaacttgatccgcatggccgtggcaggac

SEQ ID NO: 33909 - DNA, 201 bp, Homo sapiens
ataaatagaaatataggtcttaggcaggaggatttcttgatgccagaagttagagactaccctggccaacatagaaagaccccatctctatttaaaaaaayatacatatatatgtcttctcttgggctccacccaagagcaacctggaactaagttattcggcaacgaactgttccactttgttgtgaggcaatagatgtg

SEQ ID NO: 33910 - DNA, 201 bp, Homo sapiens
ggcctttaaaactgcagagagtggctgggtgcagtggctcacgcctataatcccagcactttgggaggcggaggtgggcagatcacgaggtcaggagttcragatcagcctggccaacatggtgaaactctgtctctactaaaaatacaaaaaatagctgggcatggtggcaggtgcctgtaaatctgagatactcaggag

SEQ ID NO: 33911 - DNA, 201 bp, Homo sapiens
tgtagcatctggttcaaagatgaatttgaacaccattagacactggcttaatgaaaattcacttctcattcgtttctcatctgaaacataaatagaaatayaggtcttaggcaggaggatttcttgatgccagaagttagagactaccctggccaacatagaaagaccccatctctatttaaaaaaatatacatatatatg

SEQ ID NO: 33912 - DNA, 201 bp, Homo sapiens
ggaaaggcctctacccatccagtgaaagtgtctacccagaccaagaggtattttagtttcctgactcagggcatgtgagtaaagtcaatttgccagtcctrggcgggggcaaatccccgagcctgatgtgtagggaagggaggggacctgagcaatccctgaggggtagtagaatagcagatggaacactgataagtggtt

SEQ ID NO: 33913 - DNA, 201 bp, Homo sapiens
tgagacaggagaatcgtttgaactggggaggcagaggttgcagtgagccgagatcctgccattgcactccagcctgggcgacagggtgagactccatctcaaaaaaaaaaaaaatactgcagagagttaaggccctcactggacactctccggtacctctgaggtcagtggatagagaagcagctccccttcttcttcctc

SEQ ID NO: 33914 - DNA, 201 bp, Homo sapiens
aagtggaagctaaataatagaactcatgaacacaaaaaagggaaaaacagacaatggggtctcctttagggtggagggtgggaggcgggaaaggagcaggmaaagtaactattaggtaccaagcttattacctaggtgatgaaataatctgtacaacaaacccccatgacacaagtttacctgtataacaaaccttcccat

SEQ ID NO: 33915 - DNA, 201 bp, Homo sapiens
gtggctcacgcttgtaatcccagcactttgggaggccgaggcaggtggatcacttgaagtcaggagttcaagaccagcctggccaacatggtgaaaccccrtttctactaaaaatacaaaaattatccaggcatggtggtgggcacctgtaatcccagctactcggaaggctgaggcagcagaattgcttgaacccgggag

SEQ ID NO: 33916 - DNA, 201 bp, Homo sapiens
ccagtcctgggcgggggcaaatccccgagcctgatgtgtagggaagggaggggacctgagcaatccctgaggggtagtagaatagcagatggaacactgakaagtggtttccatgaggatagatttccaggatggaaaggaaatgagaggttctaagagatgggctagcagcttgtaacctacatggaagaggctatgaaa

SEQ ID NO: 33917 - DNA, 201 bp, Homo sapiens
atgagccgggcgtggtggcgggcgcctgtagtcccagctactcgggaggaggatgaggctgaggcaggagaatggcgtgaacccgggaggcgcagcttgcrgtgagccgagatcgggccactgcactgcagcgtgggcgacagagcgagactccgtctcaaataaataaataaataaatagaagcatgaatgaaggcccca

SEQ ID NO: 33918 - DNA, 201 bp, Homo sapiens
gggggcaaatccccgagcctgatgtgtagggaagggaggggacctgagcaatccctgaggggtagtagaatagcagatggaacactgataagtggtttccwtgaggatagatttccaggatggaaaggaaatgagaggttctaagagatgggctagcagcttgtaacctacatggaagaggctatgaaatatcaaccgaat

SEQ ID NO: 33919 - DNA, 201 bp, Homo sapiens
aaacatcaagtgtaatacaccttaaatatatacaatttccatttgtcaatcatatctcaataaagctaaaagaaacctctaagtttcaactttattttcaraaagctgtgccatgcttacctcagtgcctaagtatactctaattcatggaaatggcctttaaaactgcagagagtggctgggtgcagtggctcacgccta

SEQ ID NO: 33920 - DNA, 201 bp, Homo sapiens
acgctcggaatcccagcactttgggaggccgaggcgggcggatcacgaggtcgggagatcgagaccatcctggctaatctggtgaaaccccgtctctactraaaacacaaaaaatgagccgggcgtggtggcgggcgcctgtagtcccagctactcgggaggaggatgaggctgaggcaggagaatggcgtgaacccggga

SEQ ID NO: 33921 - DNA, 201 bp, Homo sapiens
ggtttccatgaggatagatttccaggatggaaaggaaatgagaggttctaagagatgggctagcagcttgtaacctacatggaagaggctatgaaatatcraccgaatagaatgggcctgtgaggctggaaggaggtattttccttggtctaagaaccatttgccttgtgtgggaagagattgatgggtggaagtttcagt

SEQ ID NO: 33922 - DNA, 201 bp, Homo sapiens
ggagattttagtggctgccaaggagattctgatctccttagtggaaaggccgtctttgtcaatgtatctataactttgtctctacccaagcccaagctagsttgtggggctcaaggtttaatatttgtattaaacctatagtgtgttatctgggattcatgatggtcccaaggttcttatcaaggagagacttagaggctg

SEQ ID NO: 33923 - DNA, 201 bp, Homo sapiens
ataatgaccgggcccccacacatgaaaaagaattctgggaactcaaaaagccagtgtgtccccaccatggaccccttggattgtgtttcaaatttctcctyaatttcgaagagcgtcctggccatccagattctgaattctataaccctcgtttcattcatctcaatgtagctaagaaccagatttctggggaactatcga

SEQ ID NO: 33924 - DNA, 201 bp, Homo sapiens
tttccatgttccttgctttctccccatctctttcggggatgccaatgggctatttggtctcttttcatgatcccatatttcttagaggttttgttcattawtttttattctttttcttcatttttgtctgactgaattagttcagagagccagtattcatgctctgagattctttccttattttgctttattttgccatta

SEQ ID NO: 33925 - DNA, 201 bp, Homo sapiens
tacttttcctgaagactgaggactgtaagggatataaaggtttcactgaataccaagagcctgaaaaactgcttggctgatttgactaataaaggccggtstgctatcagactgtatagaggtgggaaggccaaactgtggaattatgtctgacagaagggaagaaatgacctcggtggccttctcagaccctgtgggaaa

SEQ ID NO: 33926 - DNA, 201 bp, Homo sapiens
caggatcaatcgtactccaaacctcagcatcacaaattatttaaatttttctctttttttaattttttttgttgttgttgttgagacgaagtctcactctkttgcccaggctggagtgcagtggtgtgatctcggctcactgcaagctctgcctcccgggttcacgccattctcctgccccaatctcccgagtagctggga

SEQ ID NO: 33927 - DNA, 201 bp, Homo sapiens
ggtggatcacgaggtcaggagatcgagaccatcctggctaacacggtgaaaccccgtttctactgaaaatacaaaaaaaattagccgggcgtggtggcggrtgcctgtagtcccagctactcgggaggctgaggcaggagaatagcatgaacccgggaagtggagcttgcagtgagctgagatcacgccactgcactccag

SEQ ID NO: 33928 - DNA, 201 bp, Homo sapiens
actgtgttagccaggatggtctcaatcttctgacctcgtgatccgcccgcctggcctcccaaagtgctgggattactggcgtgagccaccacgcccggccyccgaaaatgctgggattacaggcatgagccaccgcacctggcctcccaaagtgctgggattccaggcgtgagccaccgtgcccggcaggtgtcatgtatc

SEQ ID NO: 33929 - DNA, 201 bp, Homo sapiens
ctgaaatatgggacaagctcaggacttcaaaatacttcggcgttggaagggctaagttatgatgtattaaaatgaaaataaagtggggcgcggtggctcaygcctgtaatcccagcactttgggggaccgaagtgggtggatcacgaggtcaggagatcgagaccatcctggctaacacggtgaaaccccgtttctactga

SEQ ID NO: 33930 - DNA, 201 bp, Homo sapiens
ggaccttagcagcggttgtggcagacggcctttcacttgtcccttggaactccaccccagagagatgtggagccactatcagtgcgatgagccaagagtgrggcgactgcactgtgggtccaagctaggggccctgcctagtgatgagcaggggggacaggtgggtcacaggggtgacagactggcctcttctccttaggg

SEQ ID NO: 33931 - DNA, 201 bp, Homo sapiens
tttaattttttttgttgttgttgttgagacgaagtctcactctgttgcccaggctggagtgcagtggtgtgatctcggctcactgcaagctctgcctcccrggttcacgccattctcctgccccaatctcccgagtagctgggactacacgcgcccgccaccacgtcctgctaattttttgtattttcagtagacacgggg

SEQ ID NO: 33932 - DNA, 201 bp, Homo sapiens
gggtgactccctcgcctggtccattcttgggccttggaggagcctcctacagtcactggctctgcacccactgtttcctttgttaggattgttctgcccayggggctccctcaggcagggcatggtgggcagacaggctgtatccttccccggccagccctatggagggaggaccaccccgcacctctgcaggctgatgaa

SEQ ID NO: 33933 - DNA, 201 bp, Homo sapiens
tgagaacaaaggaatgaataaataaggcataagtaacaaaacaacaaaaaaagaaaattagaatgcggtcaatttcatgcaatcatcaacaccaaatttcyagaacgtagtatttccaaatttcccgaacgtaaatatgtatgtggaaattaacaaaatgtggcaaaacaaaaggtcacttaaatttgcacaaatgaaaca

SEQ ID NO: 33934 - DNA, 201 bp, Homo sapiens
gttcattaatttttattctttttcttcatttttgtctgactgaattagttcagagagccagtattcatgctctgagattctttccttattttgctttattytgccattaatacttgtgatcgcattatgaaatctcgtagtgtgtttttcagctccatcagatccgtttggttctttcaaaatgaccatctcatagattag

SEQ ID NO: 33935 - DNA, 201 bp, Homo sapiens
tctgcagaacagatcccccccgcacccaagaagctgggattacaggcacccgccgccacgcccagctcatttttgtatttttagtagagacagggtttcaycatgttggtcaggccggtctcgaactcccggcctcaggtgatctgcccgcctcagcctcccaaaagtgcttggattacaggcatgagccactgcgcctgg

SEQ ID NO: 33936 - DNA, 201 bp, Homo sapiens
cgaactcccggcctcaggtgatctgcccgcctcagcctcccaaaagtgcttggattacaggcatgagccactgcgcctggccttagaaaacttctttttctttttttttttttttttttttgagacagagtttcactctgtcgctacgctggtgtgatctgggctcactgcaatctccgcctcccaggttcaagtgattcc

SEQ ID NO: 33937 - DNA, 201 bp, Homo sapiens
tccgcctcccaggttcaagtgattcccctgcctcagcctcccgagtagctggaactacaggtgcgcaccgccacgcccggctaatttcttgtattttcgtrgagacggggtttcaccatgttggctaggctggtctgtttcatgcgcgtccgtgtgaagagaccaccaaacaggctctgtgtgagcaacaaggctgtttat

SEQ ID NO: 33938 - DNA, 201 bp, Homo sapiens
cttgtattttcgtggagacggggtttcaccatgttggctaggctggtctgtttcatgcgcgtccgtgtgaagagaccaccaaacaggctctgtgtgagcarcaaggctgtttatttcacctgggtgcaggcaggctgagtccgacaagagagtcagcgaagggggataggggtggggccgttttataggatttgggtaggt

SEQ ID NO: 33939 - DNA, 201 bp, Homo sapiens
atgttggctaggctggtctgtttcatgcgcgtccgtgtgaagagaccaccaaacaggctctgtgtgagcaacaaggctgtttatttcacctgggtgcaggyaggctgagtccgacaagagagtcagcgaagggggataggggtggggccgttttataggatttgggtaggtaaaggaaaattacagtcaaaggggggttgt

SEQ ID NO: 33940 - DNA, 201 bp, Homo sapiens
tgttggctaggctggtctgtttcatgcgcgtccgtgtgaagagaccaccaaacaggctctgtgtgagcaacaaggctgtttatttcacctgggtgcaggcrggctgagtccgacaagagagtcagcgaagggggataggggtggggccgttttataggatttgggtaggtaaaggaaaattacagtcaaaggggggttgtt

SEQ ID NO: 33941 - DNA, 201 bp, Homo sapiens
attacagtcaaaggggggttgttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgt

SEQ ID NO: 33942 - DNA, 201 bp, Homo sapiens
ttacagtcaaaggggggttgttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtg

SEQ ID NO: 33943 - DNA, 201 bp, Homo sapiens
cgtttctactgaaaatacaaaaaaaattagccgggcgtggtggcggatgcctgtagtcccagctactcgggaggctgaggcaggagaatagcatgaacccrggaagtggagcttgcagtgagctgagatcacgccactgcactccagcctgggcgacagagcaagactccgtctcaaaaaaaaaaaaagaataaataaaat

SEQ ID NO: 33944 - DNA, 201 bp, Homo sapiens
ttttttttttttattagagatgggatttcatcacattggccaggctaatgtcgaactcctgacctcaaatgatccacccacctcagcctcccaaagtgccrgggttacaggcgtgagccactgcacctggcctcttgcttctttatccaacttgccactctctgcattttaattaggacaattagtccatttacattcaaa

SEQ ID NO: 33945 - DNA, 201 bp, Homo sapiens
ctcttctggattgtagagtttctgctgaaaggtctgctgttagctcgatggcattccctttgtaggtgacctgccccttcttttttgctgccttttcacattttttttttttttttgagactgagtcttgctctgttgcccaggctgccaggctggagtgcaatggcgtgatctcggctcactgcaagctccgcctcccgg

SEQ ID NO: 33946 - DNA, 201 bp, Homo sapiens
atattctgtcccaagcccgtctatttggatgtagcatctggttcaaagatgaatttgaacaccattagacactggcttaatgaaaattcacttctcattcrtttctcatctgaaacataaatagaaatataggtcttaggcaggaggatttcttgatgccagaagttagagactaccctggccaacatagaaagaccccat

SEQ ID NO: 33947 - DNA, 201 bp, Homo sapiens
tcatcatgttgttagctggtttggttattatgcagacttgtttgtgtggttgttttatagtgtcactggtttatgtacgtaagtgtgttttctattggctrgtgatggtcttttctttccatatttagcgttcctcttaggacctcttgtaaggcaggcctgatggtaataaattccctcagcatttgcttgtctgtaaag

SEQ ID NO: 33948 - DNA, 201 bp, Homo sapiens
aggttcaagtgattcccctgcctcagcctcccgagtagctggaactacaggtgcgcaccgccacgcccggctaatttcttgtattttcgtggagacggggyttcaccatgttggctaggctggtctgtttcatgcgcgtccgtgtgaagagaccaccaaacaggctctgtgtgagcaacaaggctgtttatttcacctggg

SEQ ID NO: 33949 - DNA, 201 bp, Homo sapiens
attggtgtctgaggacgtgtctcatctgtcgtacagctgggatctgcagaacagatcccccccgcacccaagaagctgggattacaggcacccgccgccaygcccagctcatttttgtatttttagtagagacagggtttcaccatgttggtcaggccggtctcgaactcccggcctcaggtgatctgcccgcctcagcct

SEQ ID NO: 33950 - DNA, 201 bp, Homo sapiens; identical to SEQ ID NO: 6471

SEQ ID NO: 33951 - DNA, 201 bp, Homo sapiens
tatctcaaaaaaacaaacaaacaaaaaaagctggcaggcttaacatctaaagagtcaatgttttagtgagagttcaagagccagaaaagactgatgtccargcaaaaggaacttcatcttacattaccagttcaatgttttgttctattcaggtcccacctgattgaatgaggccgactcacattagggagagcaatctgc

SEQ ID NO: 33952 - DNA, 201 bp, Homo sapiens
ggttgttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcaca

SEQ ID NO: 33953 - DNA, 201 bp, Homo sapiens
gttgttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacag

SEQ ID NO: 33954 - DNA, 201 bp, Homo sapiens
gttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacagggg

SEQ ID NO: 33955 - DNA, 201 bp, Homo sapiens
ctactcgggaggaggatgaggctgaggcaggagaatggcgtgaacccgggaggcgcagcttgcagtgagccgagatcgggccactgcactgcagcgtgggmgacagagcgagactccgtctcaaataaataaataaataaatagaagcatgaatgaaggccccaggctccttgcttcttccccagatcacgggcagcagag

SEQ ID NO: 33956 - DNA, 201 bp, Homo sapiens
tctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggat

SEQ ID NO: 33957 - DNA, 201 bp, Homo sapiens
ctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggata

SEQ ID NO: 33958 - DNA, 201 bp, Homo sapiens
tttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatat

SEQ ID NO: 33959 - DNA, 201 bp, Homo sapiens
tggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatga

SEQ ID NO: 33960 - DNA, 201 bp, Homo sapiens
ggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgat

SEQ ID NO: 33961 - DNA, 201 bp, Homo sapiens
gggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggc

SEQ ID NO: 33962 - DNA, 201 bp, Homo sapiens
ggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggct

SEQ ID NO: 33963 - DNA, 201 bp, Homo sapiens
tttctcctcaatttcgaagagcgtcctggccatccagattctgaattctataaccctcgtttcattcatctcaatgtagctaagaaccagatttctggggractatcgagttgccagagttcttgtgttgattcttttttttttcttttttgtggcagagtcttactctgtcgcccaggctggagtgcagtggcacgatct

SEQ ID NO: 33964 - DNA, 201 bp, Homo sapiens
cgattctcctgtctcagcctcctgagtagctgggattacaggtgtgtgccaccacgcccggctaatttttgtatgtttagtagagcccgggttttgtcacrttggtcaggctggtctcaaactcttgacctccggtgatctgcccacttcagcctcccaaagtgctgggattacaggtgtgagccaccgcgcccggccttg

SEQ ID NO: 33965 - DNA, 201 bp, Homo sapiens; identical to SEQ ID NO: 6474

SEQ ID NO: 33966 - DNA, 201 bp, Homo sapiens
tgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatgg

SEQ ID NO: 33967 - DNA, 201 bp, Homo sapiens; identical to SEQ ID NO: 6719

SEQ ID NO: 33968 - DNA, 201 bp, Homo sapiens
tgggcctcgattctccccacaaggaaacctagtacacaaaatactagttagcacatatattagtctgttctcacactactgataaatacataccaagagtrgataatttatacagggaagaagtttaattgactcacagttctgcagagctgggaaggcctcaggaaacttacaatcaaggcagaaggggaagcaaatatg

SEQ ID NO: 33969 - DNA, 201 bp, Homo sapiens
attaaatattaactaaggaaaggtaaccatttctgaagtcattcctagcagaggactcagatatatataggattgaagatctctcagttaagtctacatgraaaggatggtttcttggagcttccacaaacttaaaaccatgaaacatctattattgctactattgtgtgtttttctagttaagtcccaaggtgtcaacga

SEQ ID NO: 33970 - DNA, 201 bp, Homo sapiens; identical to SEQ ID NO: 6768

SEQ ID NO: 33971 - DNA, 201 bp, Homo sapiens
cgcccatcagtggaggtggctatcgggctcgtccagccaaagcagctgccactcaaaagaaagtagaaagaaaagcccctgatgctggaggctgtcttcaygctgacccagacctggtgggtgcactgatgtttcttgcagtggtggctctctcatgcagagaaagcctgtagtcatggcagtctgctaatgtttcactga

SEQ ID NO: 33972 - DNA, 201 bp, Homo sapiens
gtggctcccatctgcaaacccagcactttgctgggatgaggtgggaagattgcttcagaccaggagttagaggccagcttggcaacatagtgagaccctgkctctactataaaacttgtaaaaacaaacgaaaatacagtaacgaaaaaagaaatgcactttcttaaggtgtcatttggtaagaaatgttatgtgtctgat

SEQ ID NO: 33973 - DNA, 201 bp, Homo sapiens; identical to SEQ ID NO: 6734

SEQ ID NO: 33974 - DNA, 201 bp, Homo sapiens
aaatgaaatattgcttttttcagatgaaaagttcaaattagagttagtgtgtattgttattattaatagttatgaaacacggttcagtctaatttatttayttgtagaacagtttgtcctcaactattatttttgctgacttattgctgttaatttgcagttactaaaaatacagaaatgcatttaggacaatggatattt

SEQ ID NO: 33975 - DNA, 201 bp, Homo sapiens
cagtgtctctactaaaaatacaaaaattagctgggtgtggtggtgtgcacctgtaatcccagctactcgggaggctgaggcaggagaatcacttgaacccrggaggcagaggttacagtgagctgagatcacgccactgcactccagcctgggcataagactgagactccaagtcaaaaaaaaaaatgcagatttcttggt

SEQ ID NO: 33976 - DNA, 201 bp, Homo sapiens
tgaaatattgcttttttcagatgaaaagttcaaattagagttagtgtgtattgttattattaatagttatgaaacacggttcagtctaatttatttatttrtagaacagtttgtcctcaactattatttttgctgacttattgctgttaatttgcagttactaaaaatacagaaatgcatttaggacaatggatatttaag

SEQ ID NO: 33977 - DNA, 201 bp, Homo sapiens; identical to SEQ ID NO: 6591

SEQ ID NO: 33978 - DNA, 201 bp, Homo sapiens
ctcagctcacatttctgtttaagcattacacacataatatcctgtatgctgatcatttaaacttactgacgcttgtaatcccagcactttgggaggccgarggggggtgaatcatgaggtcaggaaattgagaccatcctggacaacatggtgaaatcgaaacagtgtctctactaaaaatacaaaaattagctgggtgtg

SEQ ID NO: 33979 - DNA, 201 bp, Homo sapiens
tttagagagttccagaagaactcacacaccaaaaataagagaacaacaacaacaacaaaaatgctaagtggattttcccaacagatcataatgacattacrgtacatcataaaaatatccttagccagttgtgttttggactggcctggtgcatttgctggttttgatgagcaggatggggcacaggtagtcccaggggtg

SEQ ID NO: 33980 - DNA, 201 bp, Homo sapiens
acatatagcatagtatcattaaactagaaataagaatacacaataatatttaaatgaagtgattcatttcggatcattattgagtttcaagggaacttgartgttgtacttatcagactctacatgtaagaacatatagttaatctggttgtgtgtgtaaaaacatatggttaatctggttaagtctggttaatcatatta

SEQ ID NO: 33981 - DNA, 201 bp, Homo sapiens; identical to SEQ ID NO: 6592

SEQ ID NO: 33982 - DNA, 201 bp, Homo sapiens
cacattttctttcaggttaacatcagatcccagaaaacagtgttctaaagaagacggtggtggatggtggtataatagatgtcatgcagccaatccaaacrgcagatactactggggtggacagtacacctgggacatggcaaagcatggcacagatgatggtgtagtatggatgaattggaaggggtcatggtactcaat

SEQ ID NO: 33983 - DNA, 201 bp, Homo sapiens
gaatctttacatattaagaatgtatatagtcaactggttaaacaggaaaatctggaaccagcctggctgggttttaatcttagcaccatcctactaaatgytaaataatattataatctaatgaataaatgacaatgcaattccaaatagagttcatctgatgacttctagactcacaaaattgcaagagagctcagttgt

SEQ ID NO: 33984 - DNA, 201 bp, Homo sapiens
gtatcggcaagtctttgcccttcaagccagagagctgctgggcaggacagattatctctgttttctctgtcactgatttactacccttgacttatgcaatracatcagctaatatgaagaacactgcactgatgacctcaaaataactgaacaaatagtactccctttcccctccaccaatggcatcaacattctaaaaaa

SEQ ID NO: 33985 - DNA, 201 bp, Homo sapiens
gaaagacctgtggcaaaagaggcagaagcaagtaaaaggtagatatccttgtgctttccattcgattttcagctataaaattggaaccgttagactgccaygagaatgcatggttgtgagaagattaacatttctgggttagtgaatagcattcatacgcttttgggcaccttcccctgcaacttgccagataagcactat

SEQ ID NO: 33986 - DNA, 201 bp, Homo sapiens
agaaaatcaaaattgtatagttaaatacattagttttatgaggcaaaaatgctaactatttctacataatttcatttttccagataatgaaaatgtagtcmatgagtactcctcagaactggaaaagcaccaattatatatagatgagactgtgaatagcaatatcccaactaaccttcgtgtgcttcgttcaatcctgga

SEQ ID NO: 33987 - DNA, 201 bp, Homo sapiens
taaacatatttttagagagttccagaagaactcacacaccaaaaataagagaacaacaacaacaacaaaaatgctaagtggattttcccaacagatcatartgacattacagtacatcataaaaatatccttagccagttgtgttttggactggcctggtgcatttgctggttttgatgagcaggatggggcacaggtagt

SEQ ID NO: 33988 - DNA, 201 bp, Homo sapiens; identical to SEQ ID NO: 6749

SEQ ID NO: 33989 - DNA, 201 bp, Homo sapiens; identical to SEQ ID NO: 6750

SEQ ID NO: 33990 - DNA, 201 bp, Homo sapiens; identical to SEQ ID NO: 6751

SEQ ID NO: 33991 - DNA, 201 bp, Homo sapiens
ttctgcagagctgggaaggcctcaggaaacttacaatcaaggcagaaggggaagcaaatatgcccttcttcacatgacagcaggaaggagaagtgcggaaygaaacagggaaatccctttataaaaccattcaatcttgtgagaactcactcactatcacaagaacagtatgagggtaactgcacccatgattcaattacc

SEQ ID NO: 33992 - DNA, 201 bp, Homo sapiens
tggaggctgtcttcacgctgacccagacctggtgggtgcactgatgtttcttgcagtggtggctctctcatgcagagaaagcctgtagtcatggcagtctsctaatgtttcactgacccacattaccatcactgttattttgtttgtttattttggaaataaaattcaaaacataaacatattgggcctttggtttaggct

SEQ ID NO: 33993 - DNA, 201 bp, Homo sapiens
cgtatcgctgaattttcctatgtgctattttaacaaatgtccatgacccaaatccttcatctaatgcctgctattttctttgtttttagggggtgttgtgycctacaggatgtcagttgcaagaggctttgctacaacaggaaaggccaatcagaaatagtgttgatgagttaaataacaatgtggaagctgtttcccaga

SEQ ID NO: 33994 - DNA, 201 bp, Homo sapiens
acataatgttgtcttacatttgcagaatgtgaggaaattatcaggaaaggaggtgaaacatctgaaatgtatctcattcaacctgacagttctgtcaaacygtatagagtatactgtgacatgaatacagaaaatggaggtaagctttcgacagttgttgacctgttgatctgtaattatttggataccgtaaaatgccag

SEQ ID NO: 33995 - DNA, 201 bp, Homo sapiens
tggaatggacaggggattcagatattattttcaaagtgacattatttgctgttggttaatatatgctctttttgtttctgtcaaccaaaggatggacagtkattcagaaccgtcaagacggtagtgttgactttggcaggaaatgggatccatataaacagggatttggaaatgttgcaaccaacacagatgggaagaatt

SEQ ID NO: 33996 - DNA, 201 bp, Homo sapiens; identical to SEQ ID NO: 6574

SEQ ID NO: 33997 - DNA, 201 bp, Homo sapiens; identical to SEQ ID NO: 6756

SEQ ID NO: 33998 - DNA, 201 bp, Homo sapiens
taggctcaacactaattattgtaagtagttttcattttctgtctttccttttagacttaaggcttcgccaaggtctccccggcccccagcaaactacctgstatgaagtagatgctctgtaaatagttgttaagcacaaattgccttgtgctatggagactgggcctgacatgagttgtaaaagtatcaacaagtgtattg

SEQ ID NO: 33999 - DNA, 201 bp, Homo sapiens; identical to SEQ ID NO: 6773

SEQ ID NO: 34000 - DNA, 201 bp, Homo sapiens; identical to SEQ ID NO: 6776

SEQ ID NO: 34001 - DNA, 201 bp, Homo sapiens
agagctgctgggcaggacagattatctctgttttctctgtcactgatttactacccttgacttatgcaatgacatcagctaatatgaagaacactgcactratgacctcaaaataactgaacaaatagtactccctttcccctccaccaatggcatcaacattctaaaaaaatttaagcatcttaataagcggtgtctctg

SEQ ID NO: 34002 - DNA, 201 bp, Homo sapiens
cttcagtgcccgtggtcatcgaccccttgacaagaagagagaagaggctcccagcctgaggcctgccccaccgcccatcagtggaggtggctatcgggctygtccagccaaagcagctgccactcaaaagaaagtagaaagaaaagcccctgatgctggaggctgtcttcacgctgacccagacctggtgggtgcactgat

SEQ ID NO: 34003 - DNA, 201 bp, Homo sapiens
tgtgacaaaagcagaagagcatctctatcttttcttagctcttgtgatctccatcctgttgtaggagaaaatgtcctattatcccttattaccatgctctrtgtcagctcccataagaaatggaaactgacatctaagccagtagagggagacattccacaagagatggcgtcatctcctatttcttccccaccatatgct

SEQ ID NO: 34004 - DNA, 201 bp, Homo sapiens
acctcccccaatcttaggctcaacactaattattgtaagtagttttcattttctgtctttccttttagacttaaggcttcgccaaggtctccccggccccyagcaaactacctgctatgaagtagatgctctgtaaatagttgttaagcacaaattgccttgtgctatggagactgggcctgacatgagttgtaaaagtat

SEQ ID NO: 34005 - DNA, 201 bp, Homo sapiens
tataatctaatgaataaatgacaatgcaattccaaatagagttcatctgatgacttctagactcacaaaattgcaagagagctcagttgttgctcagttgktccaaatcatgtcgtttgttaatttgtaattaagctccaaaggatgtatagctactgacaaaaaaaaaaatgagaatgtagttaatccaaatcaaaactt

SEQ ID NO: 34006 - DNA, 201 bp, Homo sapiens
ttgttgatagaagataagactaaaagtgaaattcgaagtggagaggacacttaaactgtagtacttgttatgtgtgattccagtaaaaatagtaatgagcrcttattattgccaagtactgttctgagggtaccatatgcaataagttatttaatccttacaataatcttgtaaggcagattcaaactatcattacactta

SEQ ID NO: 34007 - DNA, 201 bp, Homo sapiens
cccgtaattatgtattgaacgcctactatgtctgtcttgctcaccaatgcattcccagcccctatcacactacccgtcactgaggagactctcaagaactrtttgtaagatgaatgttaagtctgtgctgttatggtgcatgcatgctggattgaatccatcctccttctgaccatgggaagaatgccaatcagagtagaa

SEQ ID NO: 34008 - DNA, 201 bp, Homo sapiens
aatccttacaataatcttgtaaggcagattcaaactatcattacacttattttacagatgagaaaactggggcacagataaagcaacttgcccaaggtctyatagctgtaagtcaaccctacggtcaagacctacaagtagccgagctccagagtacattatgagggtcaaagattgtcttattacaaataaattccaagt

SEQ ID NO: 34009 - DNA, 201 bp, Homo sapiens
gctgagatgggagatcacctgagcccacaacctggagtcttgatcatgctactgaactgtagcctgggcaacagaggatagtgagatcctgtctcaaaaaraaaaattaattaaaaagccaggaaacaagacttagctctaacatctaacatagctgacaaagagtaatttgatgtggaattcaacctgatatttaaaaag

SEQ ID NO: 34010 - DNA, 201 bp, Homo sapiens
actgttattttgtttgtttattttggaaataaaattcaaaacataaacatattgggcctttggtttaggctttctttcttgttttctttggtctgggcccmaaatttcaaattaggatatgtgggtgccacctttccatttgtattttgccactgcctttgtttagttggtaaaattttcatagcccaattatattttttc

SEQ ID NO: 34011 - DNA, 201 bp, Homo sapiens
aaattttcatagcccaattatattttttctggggtaagtaatattttaaatctctatgagagtatgatgatgactttcgaatttctggtcttacagaaaaycaaataataaatttttatgttggctaatcgtatcgctgaattttcctatgtgctattttaacaaatgtccatgacccaaatccttcatctaatgcctgct

SEQ ID NO: 34012 - DNA, 201 bp, Homo sapiens
tgagccctgactgtgctactgctactgcactacagcctagatgacagagtgagaacctgcctcaaaaaaaatgtttttggcattttaaacttaaaaaaaawatatatatatatatatagccaagtaactctccagaaagattgtaccaatttacctttgatgcacagaataacatatttaatttttattttgcttctccat

SEQ ID NO: 34013 - DNA, 201 bp, Homo sapiens
acaaatttggaaagactcaagtgaatattttttcttaatttaaactgagtactttgtctctattaagctaagttaaaagaatttgggaggacaacctatgytaccaagagaataatttgtttctaggaatctgagttaaaagaatttgggaatgcaatctctgctacctggagaagaaagaaatgtcgtgggtcccacacc

SEQ ID NO: 34014 - DNA, 201 bp, Homo sapiens
cttagccagttgtgttttggactggcctggtgcatttgctggttttgatgagcaggatggggcacaggtagtcccaggggtggctgatgtgtgcatctgcrtactggcttgaacagatggcagaaccacagatagatgtagaagtttctccattttgtgtgttctgggagctcatggatattccaggacacaaaaggtgga

SEQ ID NO: 34015 - DNA, 201 bp, Homo sapiens
gtgagccctgactgtgctactgctactgcactacagcctagatgacagagtgagaacctgcctcaaaaaaaatgtttttggcattttaaacttaaaaaaaatatatatatatatatatagccaagtaactctccagaaagattgtaccaatttacctttgatgcacagaataacatatttaatttttattttgcttctcca

SEQ ID NO: 34016 - DNA, 201 bp, Homo sapiens
aaaagaatttgggaggacaacctatgctaccaagagaataatttgtttctaggaatctgagttaaaagaatttgggaatgcaatctctgctacctggagargaaagaaatgtcgtgggtcccacaccattctcaagactctgtttcaaagcattgtttcaatacgctgatccaaaccctgataacctgccatctttttaat

SEQ ID NO: 34017 - DNA, 201 bp, Homo sapiens
aaaaaaaaaattaattaaaaagccaggaaacaagacttagctctaacatctaacatagctgacaaagagtaatttgatgtggaattcaacctgatatttawaaagttataaaatatctataattcacaatttggggtaagataaagcacttgcagtttccaaagattttacaagtttacctctcatatttatttccttatt

SEQ ID NO: 34018 - DNA, 201 bp, Homo sapiens
cattgtttcaatacgctgatccaaaccctgataacctgccatctttttaataaaataatttataaatttaatgagaatgtttcactttccatacaaaaaayagaaaaatgctttgaatcaatgcacttactgggatttggattactgactggtgttcctattgattcttgtaggagttattaatcctgattgcaacacaca

SEQ ID NO: 34019 - DNA, 201 bp, Homo sapiens
tactaagcttagatttgttttctcacatattctttcggagcttgtgtagtttccacattaatttaccagaaacaagatacacatctctctttgaggagtgycctaacttcccatcattttgtccaattaaatgaattgaagaaatttaatgtttctaaactagaccaacaaagaataatagttgtatgacaagtaaataag

SEQ ID NO: 34020 - DNA, 201 bp, Homo sapiens
tagaatagggtatgaatttgttattttgttattttgattaatgtctaaaacaaaagataaacacattatgatataacattactattgattttaatggcccyttttgaaatagaattatgtcattgtcagaaaacataagcatttatggtatatcattaatgagtcacgattttagtggttgccttgtgagtaggtcaaatt

SEQ ID NO: 34021 - DNA, 201 bp, Homo sapiens
gcccatcagtggaggtggctatcgggctcgtccagccaaagcagctgccactcaaaagaaagtagaaagaaaagcccctgatgctggaggctgtcttcacrctgacccagacctggtgggtgcactgatgtttcttgcagtggtggctctctcatgcagagaaagcctgtagtcatggcagtctgctaatgtttcactgac

SEQ ID NO: 34022 - DNA, 201 bp, Homo sapiens
ctacataatttcatttttccagataatgaaaatgtagtcaatgagtactcctcagaactggaaaagcaccaattatatatagatgagactgtgaatagcartatcccaactaaccttcgtgtgcttcgttcaatcctggaaaacctgagaagcaaaatacaaaagttagaatctgatgtctcagctcaaatggaatattgt

SEQ ID NO: 34023 - DNA, 201 bp, Homo sapiens
tccagataatgaaaatgtagtcaatgagtactcctcagaactggaaaagcaccaattatatatagatgagactgtgaatagcaatatcccaactaaccttygtgtgcttcgttcaatcctggaaaacctgagaagcaaaatacaaaagttagaatctgatgtctcagctcaaatggaatattgtcgcaccccatgcactgt

SEQ ID NO: 34024 - DNA, 201 bp, Homo sapiens
ggggattcagatattattttcaaagtgacattatttgctgttggttaatatatgctctttttgtttctgtcaaccaaaggatggacagtgattcagaaccrtcaagacggtagtgttgactttggcaggaaatgggatccatataaacagggatttggaaatgttgcaaccaacacagatgggaagaattactgtggccta

SEQ ID NO: 34025 - DNA, 201 bp, Homo sapiens
attttattttgtttttcttttaggtgaatattggcttggaaatgataaaattagccagcttaccaggatgggacccacagaacttttgatagaaatggagkactggaaaggagacaaagtaaaggctcactatggaggattcactgtacagaatgaagccaacaaataccagatctcagtgaacaaatacagaggaacagc

SEQ ID NO: 34026 - DNA, 201 bp, Homo sapiens
ctccccacaaggaaacctagtacacaaaatactagttagcacatatattagtctgttctcacactactgataaatacataccaagagtggataatttatamagggaagaagtttaattgactcacagttctgcagagctgggaaggcctcaggaaacttacaatcaaggcagaaggggaagcaaatatgcccttcttcaca

SEQ ID NO: 34027 - DNA, 201 bp, Homo sapiens; identical to SEQ ID NO: 6729

SEQ ID NO: 34028 - DNA, 201 bp, Homo sapiens; identical to SEQ ID NO: 6580

SEQ ID NO: 34029 - DNA, 201 bp, Homo sapiens; identical to SEQ ID NO: 6581

SEQ ID NO: 34030 - DNA, 201 bp, Homo sapiens
gacaaagtaaaggctcactatggaggattcactgtacagaatgaagccaacaaataccagatctcagtgaacaaatacagaggaacagccggtaatgccckcatggatggagcatctcagctgatgggagaaaacaggaccatgaccattcacaacggcatgttcttcagcacgtatgacagagacaatgacggctggtat

SEQ ID NO: 34031 - DNA, 201 bp, Homo sapiens; identical to SEQ ID NO: 6584

SEQ ID NO: 34032 - DNA, 201 bp, Homo sapiens
cgtaacttgaccaccgtagttctgtttctaataacgccaaacacattttctttcaggttaacatcagatcccagaaaacagtgttctaaagaagacggtgrtggatggtggtataatagatgtcatgcagccaatccaaacggcagatactactggggtggacagtacacctgggacatggcaaagcatggcacagatgat

SEQ ID NO: 34033 - DNA, 201 bp, Homo sapiens; identical to SEQ ID NO: 6586

SEQ ID NO: 34034 - DNA, 201 bp, Homo sapiens; identical to SEQ ID NO: 6587

SEQ ID NO: 34035 - DNA, 201 bp, Homo sapiens
taatttcatttttccagataatgaaaatgtagtcaatgagtactcctcagaactggaaaagcaccaattatatatagatgagactgtgaatagcaatatcscaactaaccttcgtgtgcttcgttcaatcctggaaaacctgagaagcaaaatacaaaagttagaatctgatgtctcagctcaaatggaatattgtcgcac

SEQ ID NO: 34036 - DNA, 201 bp, Homo sapiens; identical to SEQ ID NO: 6589

SEQ ID NO: 34037 - DNA, 201 bp, Homo sapiens
ctgggagctcatggatattccaggacacaaaaggtggagaagagctttgttcatcctcttagcagataaacgtcctcaaaactgggttggacttactaaaktaaaatgaaaatctaatatttgttatattattttcaaaggtctataataacacactccttagtaacttatgtaatgttattttaaagaattggtgactaa

SEQ ID NO: 34038 - DNA, 201 bp, Homo sapiens
atatatacatatataattatatatatgtatatataattatacaattaggactgaaagtctgcaacaaactataatggatgtatgcacttgggacataagcytctagttcctctttatttatgaaccaagagaaacagctaactcagggattgtttttaaactgactacagattcccaccatggggcaaaaatatgggtgac

SEQ ID NO: 34039 - DNA, 201 bp, Homo sapiens
ttctacataatttcatttttccagataatgaaaatgtagtcaatgagtactcctcagaactggaaaagcaccaattatatatagatgagactgtgaatagyaatatcccaactaaccttcgtgtgcttcgttcaatcctggaaaacctgagaagcaaaatacaaaagttagaatctgatgtctcagctcaaatggaatatt

SEQ ID NO: 34040 - DNA, 201 bp, Homo sapiens
ttttcccaacagatcataatgacattacagtacatcataaaaatatccttagccagttgtgttttggactggcctggtgcatttgctggttttgatgagcwggatggggcacaggtagtcccaggggtggctgatgtgtgcatctgcgtactggcttgaacagatggcagaaccacagatagatgtagaagtttctccatt

SEQ ID NO: 34041 - DNA, 201 bp, Homo sapiens
tatggaacttttggggcaatactgagagtcgcaaaagttcactgaatgaaaaatgcgggttgggaagactgcagtcatcagacctttgctcactccttacrtgttcacagaggatcaaatgaatccctagagcttgaagtaatgccatagaagaaaaaccactaaagtagataatctgatggtcaattcttagttaatgta

SEQ ID NO: 34042 - DNA, 201 bp, Homo sapiens
cctaacttcccatcattttgtccaattaaatgaattgaagaaatttaatgtttctaaactagaccaacaaagaataatagttgtatgacaagtaaataagytttgctgggaagatgttgcttaaatgataaaatggttcagccaacaagtgaaccaaaaattaaatattaactaaggaaaggtaaccatttctgaagtcat

SEQ ID NO: 34043 - DNA, 201 bp, Homo sapiens; identical to SEQ ID NO: 6742

SEQ ID NO: 34044 - DNA, 201 bp, Homo sapiens; identical to SEQ ID NO: 6744

SEQ ID NO: 34045 - DNA, 201 bp, Homo sapiens; identical to SEQ ID NO: 6743

SEQ ID NO: 34046 - DNA, 201 bp, Homo sapiens
gatgtgtttttctcacttgctattctgagtactgtgattttcatttacttctagcaatacaggattacaattaagaggacaagatctgaaaatctcacaarctataaaataataaaagagcagaattttaagataaaagaaactggtggtaggtagattgttctttggtgaaggaaggtaatatatattgttactgagatt

SEQ ID NO: 34047 - DNA, 201 bp, Homo sapiens; identical to SEQ ID NO: 6746

SEQ ID NO: 34048 - DNA, 201 bp, Homo sapiens
gcccaaggtctcatagctgtaagtcaaccctacggtcaagacctacaagtagccgagctccagagtacattatgagggtcaaagattgtcttattacaaawaaattccaagtagaatcaacctttaataagtctttaatgtctcttaaatatgtttatataggagtctaatcaccaattcacaaaaatgaaagtagggaaa

SEQ ID NO: 34049 - DNA, 201 bp, Homo sapiens
attcacaaaaatgaaagtagggaaatgattaacaataatcataggaatctaacaatccaagtggcttgagaatattcattcttcttgacagtatagattcyttacaatttcgtaagttccaatgtatgttttaggaatatgaggtcattactattcataatctgatacagctttatcctaaggcctctctttaaaaactac

SEQ ID NO: 34050 - DNA, 201 bp, Homo sapiens
ccctttcctcaattttccattagcaaagtcatcttttatatgaattactcatttcataatatgtaggatagcaatcagaaacatggtattttcctctatayaaatattttaatttgtaagtaattacactgggagtcatatacttatgcaaataatcttaactggtacggatattcaccatcagacactttcttttcttct

SEQ ID NO: 34051 - DNA, 201 bp, Homo sapiens
tcttgacagtatagattctttacaatttcgtaagttccaatgtatgttttaggaatatgaggtcattactattcataatctgatacagctttatcctaagrcctctctttaaaaactacactgcatcatagcttttttgtgcagttggtctttctactgttactgaacagtaagcaacctacagattcactatcaccaacc

SEQ ID NO: 34052 - DNA, 201 bp, Homo sapiens
gaagccaacaaataccagatctcagtgaacaaatacagaggaacagccggtaatgccctcatggatggagcatctcagctgatgggagaaaacaggaccaygaccattcacaacggcatgttcttcagcacgtatgacagagacaatgacggctggtatgtgtggcactctttgctcctgctttaaaaatcacactaatat

SEQ ID NO: 34053 - DNA, 201 bp, Homo sapiens
ttccccttccccttcttcttctcctcctcctcctccttcttcttccagcaaatatcaaatttggagagacaatctggtagatttagcttgcgtaaagggtytgtctacccctagcttggtcacctgtggttagagggtcagggtgttgtagtactgacaggaccactggagcttcatacctccattttaggggtcattcca

SEQ ID NO: 34054 - DNA, 201 bp, Homo sapiens
cagccactgtcctaagctctttatgcatcactcgaaagcatttcaactataaggtagacattcttattctcattttacagatgagatttagagagattacrtgatttgtccaatgtcacacaactacccagagataaaactagaatttgagcacagttactttctgaataatgagcatttagataaatacctatatctcta

SEQ ID NO: 34055 - DNA, 201 bp, Homo sapiens
aagcctcacctcccccaatcttaggctcaacactaattattgtaagtagttttcattttctgtctttccttttagacttaaggcttcgccaaggtctcccyggcccccagcaaactacctgctatgaagtagatgctctgtaaatagttgttaagcacaaattgccttgtgctatggagactgggcctgacatgagttgta

SEQ ID NO: 34056 - DNA, 201 bp, Homo sapiens
tccatcatagtaggtaagggtatagagtcagaatgccatgattcaactccttctctgcaagttacctgcagcatcatcttgggtaactttcttctttttgkacttcaattctcccatctgtaaaatgggaataatagtactactctacctcatagagttattgtaagaattaagtgtaacgtactagtaacagtgaccggc

SEQ ID NO: 34057 - DNA, 201 bp, Homo sapiens
tctgacttattgtatttaaagaatgtttcatagtatttcttatataaaaacaaagtaatttcttgttttctagtttatcacctttgttttcttaagatgargatggcttagctaatgtaagatgtgtttttctcacttgctattctgagtactgtgattttcatttacttctagcaatacaggattacaattaagaggaca

SEQ ID NO: 34058 - DNA, 201 bp, Homo sapiens
tttcatagaatagggtatgaatttgttattttgttattttgattaatgtctaaaacaaaagataaacacattatgatataacattactattgattttaatrgccccttttgaaatagaattatgtcattgtcagaaaacataagcatttatggtatatcattaatgagtcacgattttagtggttgccttgtgagtaggtc

SEQ ID NO: 34059 - DNA, 201 bp, Homo sapiens
gattactgactggtgttcctattgattcttgtaggagttattaatcctgattgcaacacacaagtgaacagacaagagagataaattttgtggcttgtggraaatgaaggaaaatgggcctcatttagtctgtgagcatactaattgaaatagatgtatgaagacttcaccagtgttaaaataacattgtttttataaatc

SEQ ID NO: 34060 - DNA, 201 bp, Homo sapiens
actaaaataaaatcctgtctagattattaaaataaactttgttatcagttatattttcatggaaaatattcctgtatatattttaattaatagccacataratatttgctttttctgtcagatcatgtatccctttaaaaaccattaaagctaaagaaaaaaatcttaaaatataatatttactcattgctaataaaggga

SEQ ID NO: 34061 - DNA, 201 bp, Homo sapiens
ggcttcgccaaggtctccccggcccccagcaaactacctgctatgaagtagatgctctgtaaatagttgttaagcacaaattgccttgtgctatggagacygggcctgacatgagttgtaaaagtatcaacaagtgtattgacaatgggtatcggcaagtctttgcccttcaagccagagagctgctgggcaggacagatt

SEQ ID NO: 34062 - DNA, 201 bp, Homo sapiens
aagtcaaccctacggtcaagacctacaagtagccgagctccagagtacattatgagggtcaaagattgtcttattacaaataaattccaagtagaatcaayctttaataagtctttaatgtctcttaaatatgtttatataggagtctaatcaccaattcacaaaaatgaaagtagggaaatgattaacaataatcatagg

SEQ ID NO: 34063 - DNA, 201 bp, Homo sapiens
tatgaggtcattactattcataatctgatacagctttatcctaaggcctctctttaaaaactacactgcatcatagcttttttgtgcagttggtctttctrctgttactgaacagtaagcaacctacagattcactatcaccaaccagccagttgatggatcttaagcaaattatcaagcttgtgataacctaaattataa

SEQ ID NO: 34064 - DNA, 201 bp, Homo sapiens
cagtggaggtggctatcgggctcgtccagccaaagcagctgccactcaaaagaaagtagaaagaaaagcccctgatgctggaggctgtcttcacgctgacycagacctggtgggtgcactgatgtttcttgcagtggtggctctctcatgcagagaaagcctgtagtcatggcagtctgctaatgtttcactgacccacat

SEQ ID NO: 34065 - DNA, 201 bp, Homo sapiens
ccacgagaatgcatggttgtgagaagattaacatttctgggttagtgaatagcattcatacgcttttgggcaccttcccctgcaacttgccagataagcaytattcagctcttattcccagtctgacatcagcaagtgtgattttctatgaaaaattctactatgactccttattttaagtatacaagaaacttgtgactc

SEQ ID NO: 34066 - DNA, 201 bp, Homo sapiens
gccagataagcactattcagctcttattcccagtctgacatcagcaagtgtgattttctatgaaaaattctactatgactccttattttaagtatacaagwaacttgtgactcagaagataatatttacagagtggaaaaaaacccctagcatttatagttttaacatttgaggttttgaatgagagagttatccataata

SEQ ID NO: 34067 - DNA, 201 bp, Homo sapiens
ggtagacattcttattctcattttacagatgagatttagagagattacgtgatttgtccaatgtcacacaactacccagagataaaactagaatttgagcrcagttactttctgaataatgagcatttagataaatacctatatctctatattctaaagtgtgtgtgaaaactttcattttcatttccagggttctctgat

SEQ ID NO: 34068 - DNA, 201 bp, Homo sapiens; identical to SEQ ID NO: 6761

SEQ ID NO: 34069 - DNA, 201 bp, Homo sapiens; identical to SEQ ID NO: 6762

SEQ ID NO: 34070 - DNA, 201 bp, Homo sapiens; identical to SEQ ID NO: 6890

SEQ ID NO: 34071 - DNA, 201 bp, Homo sapiens
agaaatcaggaacaatgatccaatattatcggcttccgtgagataagggcatcttgcctggaggctgccacccaggccggtcatggcagctgctcatgaargacagtaacaatttggcagtttgttaaatgaacaaaatgtagaaataaagtaagcagaatttttagtttttctgaaggtagggcttttggccagatatgc

SEQ ID NO: 34072 - DNA, 201 bp, Homo sapiens; identical to SEQ ID NO: 6891

SEQ ID NO: 34073 - DNA, 201 bp, Homo sapiens
gcccatttaatgattgattatatcattttgtggatatagttataatctgatgggcctggctgggagtggaagaagggaagccttttgcaaatagtagagtrtcagttgcaggtgccaatgactaactttttgaattctatgttggcattaacaataaagcattttgcaaacactggttataactgtctttatggaggcagc

SEQ ID NO: 34074 - DNA, 201 bp, Homo sapiens
tgaggtattttgttacagcagccagagaagactgatacactggggtgccatgcccccgagactccttccaaatctctcctttcaaaacgcaccaccctcastcctgattccttcagagctctttctgcatggcagtgggagtcatgagttacctcagactttcccccaaattctcaagacattccttaagatgtaagcttg

SEQ ID NO: 34075 - DNA, 201 bp, Homo sapiens
agggggtgaggcttgcccagggtgacctagtagctgaatagatgggagaatggaggccagggcctcactgagactctctggtcagctgcccctgggctgtrtccaataaggaaactcccctgcttctgaagctgttctcgaaattatcagctcagtgtgaccctgtggggggttgagccacattgtttctttagaagcatc

SEQ ID NO: 34076 - DNA, 201 bp, Homo sapiens
gcctggaggctgccacccaggccggtcatggcagctgctcatgaaggacagtaacaatttggcagtttgttaaatgaacaaaatgtagaaataaagtaagmagaatttttagtttttctgaaggtagggcttttggccagatatgcagcaataaaagagcaaactgcttccttgggccagtgtccttgctcatagatcagg

SEQ ID NO: 34077 - DNA, 201 bp, Homo sapiens
gactggtcagttcattcattcattcattctacaaaggtttatggagcatctctcctgactgcaagctcttgaaggtgagagcagcacaaatgagggtcccwtggagagagaggccggaatgaaaaatgtcaatgacaaatgcatatataaaggcacatgtgtaattgaaagagctttgagagaaagagtcaagggactgtt

SEQ ID NO: 34078 - DNA, 201 bp, Homo sapiens
tatccttcatgtaatgggaagccatatccaccactgttccttgagttaaggagtcctgttttaaacaatcaaaactaagaaggcacttcctagctatgtgrtctccaaaaaatacttgactctctgagcttcctttctctcttctataaaattgaagaattacaccttgctcaaagatgccatgagaattcaatgacagac

SEQ ID NO: 34079 - DNA, 201 bp, Homo sapiens
gcagggagagcgtatatgggacctctctgtattgtttttataacttttctgtaaatccaaaactgtcttaaaatagtttttttaaattatactttaagttmtggggtacaggtgcagaatatgcaggtttgttacataggtatacatgtaccatggtggtttgctgcaccccctttttttaagaaaatgtttcaaaaagaa

SEQ ID NO: 34080 - DNA, 201 bp, Homo sapiens
gtccggcatcagcaaccactcaaatatccaggtgtctgaggtgggttcagaagctcctatgcatctgcttcccaagatctattctgttctattctttctaktctactctaccccatttcattccattccattccactcaactccactccactccactccactccagttcactctattcaattccactccactccactccag

SEQ ID NO: 34081 - DNA, 201 bp, Homo sapiens
atccaagtcctgggggcctagcccagttggagggacaagagctggaaactgggttccttagggtggtgccagagtgggcagagacctctgggcagcccacrtccaagtccagagcaaggggaggctcatcctagaaaagaggccagaggagccataaccaccattgttccttgggttaaggagtccttttttaaaaccatc

SEQ ID NO: 34082 - DNA, 201 bp, Homo sapiens
taaaagccctatctccagatatagtcacattctggggtattgaaggtaaggacttcagtatatgcattttgggggcacaattcagccagaacaggaggacrgtggggatgtccacatgaagaggttcaggcagaattcctttaggaggggaagatgtctctctgtgggacaagggtggcatggagcagcccctgggggaag

SEQ ID NO: 34083 - DNA, 201 bp, Homo sapiens
gccgtcacaaagtcccaggggctagggggcttcaacaacagaaatttctttctttacaactctggaagctggaagtctgagattaaggcaccagcaggatwtgttccttccaaggcccctctccttggctcacaggtggctgccttctccctgtcttcacctggtcttccctctgtgcatgtctctatcctgatctcctct

SEQ ID NO: 34084 - DNA, 201 bp, Homo sapiens
agaacaaggcaagagcctaatgactcgagtagccaactcatcccagtttgccaaggtctttgccagttttagcactgaatatcccacaccatcggaaattmctcagtcccagcaaattggaatggttggtcaccctactagtaattaagaccagtgccccacttcagagcagaagcatcagccaggccctgagtgacatct

SEQ ID NO: 34085 - DNA, 201 bp, Homo sapiens
cataaccttccatgatcacggccatgcacaacacaccatgtcccccaggcaaggggaccttagaaacataaccaggcttgagacagcactctgcaccggtrtcttggaaatgctcttaagagtgtatggctgagttagggaaccaggatttcaaagtagaaagggagaatctacccaagcccatagaaatcctgaatccac

SEQ ID NO: 34086 - DNA, 201 bp, Homo sapiens
gtgcttcaatgcatgaaacgcatcaatgacttgcagcagaggccacactcagcccccctctgccctttgagtttttgcagctcttgccaagatcattcttkttcttagaaagcccaccattattttcctttctagccatatggattctaaaagttcctcttgtgagctgtaatcagaatgcagagaagtaatacaaggtta

SEQ ID NO: 34087 - DNA, 201 bp, Homo sapiens
cttgcagcagaggccacactcagcccccctctgccctttgagtttttgcagctcttgccaagatcattcttgttcttagaaagcccaccattattttcctytctagccatatggattctaaaagttcctcttgtgagctgtaatcagaatgcagagaagtaatacaaggttagggcccaggactctttctcccacctctcc

SEQ ID NO: 34088 - DNA, 201 bp, Homo sapiens
gtggccgtgccggcggttcagtgacagagatcctaaatgggaggccaatcctaaatgggatgatctctttcatcccaatttcagggtagtttggtcatccrcgccacattccaagtgtcccctgggccctttctctccctcacccccctgtctgcacatgagtagatgcctccatgcagccctcccaggacgctcacctct

SEQ ID NO: 34089 - DNA, 201 bp, Homo sapiens
gcaaacagtcacaaagcagctcctgtgtggggggtcaggggtgggctcactgtggtctctgctgcatgtcacacattgaagcactgtgctgggggtcatcrcaggctgtttaactcaattgtcacatgagcctgggtgcacaaaatggtagagcagctcagagagagatggacagacagcatgaacctctgaggagtcagg

SEQ ID NO: 34090 - DNA, 201 bp, Homo sapiens
gagagaccctgaaataaggccatggggacaaaatgtcggctggataggaggtgctcagtaagtggcagcttctgttgttttctgtgcctggagtcttgggsctttagaaatcaggaacaatgatccaatattatcggcttccgtgagataagggcatcttgcctggaggctgccacccaggccggtcatggcagctgctca

SEQ ID NO: 34091 - DNA, 201 bp, Homo sapiens
tattccacttcacttagcctcagtctattcaatctgtaaaatagagtgagtttacttttggaaaactctgtaaaatagagagcttacttttggtgaaggtyaaacatagtaatatttatggagtgtctagtatgtctttaataattagtggttttactgaaaagtagagagagttggcccagagggagcaagatttctggg

SEQ ID NO: 34092 - DNA, 201 bp, Homo sapiens; identical to SEQ ID NO: 6912

SEQ ID NO: 34093 - DNA, 201 bp, Homo sapiens
gaaggaaaagtcccacgaaaagtccaagaatgtgcccaatgttataaagagacttgccttcatattcaagaggttcaacagtcactgctctggggctgccrtaaagatggtctccgctggctatctttactgtcttcactccttttatttgcagctgagaatttctaattctgacacaaaattctttttcatttttccctt

SEQ ID NO: 34094 - DNA, 201 bp, Homo sapiens
gaaggatggtagaagaaaggtagtaccagtatgctttagctcatgcaggcaaacagatgatgggcagagggaagcatggtggctgattacaggaggatcayagcagatgtttaaggcaagattgacagccccacaaagactgagaagagaagataagaaaaatgggaaagttattaagacacaagacctagatcaggagct

SEQ ID NO: 34095 - DNA, 201 bp, Homo sapiens
gttcacccagatatcaggtagcattcacagccagccacatttttcaccctcttcacttggagatttggtcttgagtaaaacgttagagaatcagagaacaycaggggtccagggcctctgaagatgtgaaaaccaacctccttgttttgcaaatgtggaaggaaaagtcccacgaaaagtccaagaatgtgcccaatgtta

SEQ ID NO: 34096 - DNA, 201 bp, Homo sapiens
tgggataccccacaaaggcctccctgagaagcgctagagacaaagatgagtgcctcctcatctggaagatgaaaagatgtctttgcctgcatgggctgccrtcacaaagtcccaggggctagggggcttcaacaacagaaatttctttctttacaactctggaagctggaagtctgagattaaggcaccagcaggatttgt

SEQ ID NO: 34097 - DNA, 201 bp, Homo sapiens
ggaggtgaggtcgaggaggaacgaggtatcactcctcagagccactcagagagaggctgtgcacgagtcagaggaacctggattttaattccggttccatyactcagtagctgaaacaagctattccacttcacttagcctcagtctattcaatctgtaaaatagagtgagtttacttttggaaaactctgtaaaatagag

SEQ ID NO: 34098 - DNA, 201 bp, Homo sapiens
ggcaagacttctacccgtagccagatggggaggcatgggcacaggaacggctcttgggtgaagtggagggaggaagaggaggactgaaggcgaaggccacrtcaggagtgatgggataccccacaaaggcctccctgagaagcgctagagacaaagatgagtgcctcctcatctggaagatgaaaagatgtctttgcctgc

SEQ ID NO: 34099 - DNA, 201 bp, Homo sapiens
gtgaacctggggccctctccaaacagatcctgggggagactcagtgcacacccggagaagcagctcctccccatcggatctctagtgcttggcagggggcrgggtcttgagggggtgtccacaacacatggcagactgcagatgaagaaactgaggcccagagggggtgaggcttgcccagggtgacctagtagctgaata

SEQ ID NO: 34100 - DNA, 201 bp, Homo sapiens
ttcagagcctgagctgtttcctactgcagagggaggaggcaagacttctacccgtagccagatggggaggcatgggcacaggaacggctcttgggtgaagyggagggaggaagaggaggactgaaggcgaaggccacgtcaggagtgatgggataccccacaaaggcctccctgagaagcgctagagacaaagatgagtgc

SEQ ID NO: 34101 - DNA, 201 bp, Homo sapiens
tcaatccctctcatttccactagaatctaactgttgggatctatgacccagtcagcatagcaggcctgtggggagctctcaggttcaagcatatgcccccyctaatctacaagaaattagctgcagaaaaccaaggaatagaacctggaaaaagagagggtttgctagagctgtccctttccctgtctctggaatgccaac

SEQ ID NO: 34102 - DNA, 201 bp, Homo sapiens
ggtttgctagagctgtccctttccctgtctctggaatgccaacaatagggaggctctttggtcttgtctctcaggagtgcccatgccattccaggaaaatkatggcccagctggtggtgtaaggcttggggggcagcgagtgggcatcgtggtgaaagcctcgggatcagggagctgcgtctgcaggcaggcctgctggcc

SEQ ID NO: 34103 - DNA, 201 bp, Homo sapiens
cctttccctgtctctggaatgccaacaatagggaggctctttggtcttgtctctcaggagtgcccatgccattccaggaaaatgatggcccagctggtggygtaaggcttggggggcagcgagtgggcatcgtggtgaaagcctcgggatcagggagctgcgtctgcaggcaggcctgctggccggaaacctgccaggaaa

SEQ ID NO: 34104 - DNA, 201 bp, Homo sapiens
aggctctttggtcttgtctctcaggagtgcccatgccattccaggaaaatgatggcccagctggtggtgtaaggcttggggggcagcgagtgggcatcgtkgtgaaagcctcgggatcagggagctgcgtctgcaggcaggcctgctggccggaaacctgccaggaaaggaaggggctgtcccggggcggggccagggagg

SEQ ID NO: 34105 - DNA, 201 bp, Homo sapiens
ctctttggtcttgtctctcaggagtgcccatgccattccaggaaaatgatggcccagctggtggtgtaaggcttggggggcagcgagtgggcatcgtggtsaaagcctcgggatcagggagctgcgtctgcaggcaggcctgctggccggaaacctgccaggaaaggaaggggctgtcccggggcggggccagggaggggt

SEQ ID NO: 34106 - DNA, 201 bp, Homo sapiens
atccagggcagagcaggtccaggccaggtgcagccaggtcacagcagccctagtgggttagagcacaaatcaaagtttagcatttatctgaaacacaggakttggccatgagtttcttaggcgaggaagcgctgtgaccatatttatgattgaaggagattcttttatatgctgtatatagaaagcctttcagggcaaaga

SEQ ID NO: 34107 - DNA, 201 bp, Homo sapiens
agggcttcacctgtctctgtcaaagccatgtatttccaccagaggcccaagagtgcgatggcaaaccctggatttgaaactaagaaacgtaaaacaagcaytgaggactccactgcctcttgagtgacctctctgaccctctgtttcttctgcactgttaggataatgatactaactccatgttgttgtagagaagtataa

SEQ ID NO: 34108 - DNA, 201 bp, Homo sapiens
atctgcagattagggctattgttggtggctactaagtcagggatttcaaaatcaggaagatgcagccaggaaaagaggaggcaggactctgcagaggaggyaggactctgcagagtcagagtgataaccgagtctgagtccaagctttgccagtgttagcaagcgactccatctctctgaacctcggattacccatctgta

SEQ ID NO: 34109 - DNA, 201 bp, Homo sapiens
ggggcccactctagtgacctcattctaactcagtcccctctttaaaagccctatctccagatatagtcacattctggggtattgaaggtaaggacttcagyatatgcattttgggggcacaattcagccagaacaggaggacggtggggatgtccacatgaagaggttcaggcagaattcctttaggaggggaagatgtct

SEQ ID NO: 34110 - DNA, 201 bp, Homo sapiens
tgtacctttttgggtggtgcagggctgaaggagttggcacagtgcctgaaagagggtgcgggcaatgcgcccaactgctgtggctgctgggtttggtgccrggttcgattctgcaggcagaaacttctacatgaggctccttctcggaaggagctcaggacacaatttggaggctgggctggcaagggtgacctgctggag

SEQ ID NO: 34111 - DNA, 201 bp, Homo sapiens
gtagccagatggggaggcatgggcacaggaacggctcttgggtgaagtggagggaggaagaggaggactgaaggcgaaggccacgtcaggagtgatgggakaccccacaaaggcctccctgagaagcgctagagacaaagatgagtgcctcctcatctggaagatgaaaagatgtctttgcctgcatgggctgccgtcaca

SEQ ID NO: 34112 - DNA, 201 bp, Homo sapiens
ggcacagtgcctgaaagagggtgcgggcaatgcgcccaactgctgtggctgctgggtttggtgccaggttcgattctgcaggcagaaacttctacatgagsctccttctcggaaggagctcaggacacaatttggaggctgggctggcaagggtgacctgctggagctattcaacttcacttaaagacaggcctgcagtcc

SEQ ID NO: 34113 - DNA, 201 bp, Homo sapiens
atcccaagttcagggacatttggcaaaatagcccaccactcctacttaaaagtgtcgaggtcttgaaaggcaaggaaaccctgggaaatcgtctttggccrgaggaaactcagcagacatgacgactaaatgcaatgtagaatcctcggacagaaaaggacattagtaggacagctggtgaaacccaagtaagtccaggct

SEQ ID NO: 34114 - DNA, 201 bp, Homo sapiens
caagccagcggaggtcagccctcaccagccctggctggctctctggctgcagagttgctgagcagggctggagaacagaccaaatggggccagccaagttygcacatcctcagagccacccgctcaagtgtttagctctcctggggtgattgacttcagtgggagcgtggctctgccatgattcagacttctggcctccag

SEQ ID NO: 34115 - DNA, 201 bp, Homo sapiens
tcactttccaggtattacctctgatttgctctaccaactccacaccccacctgcagccacataaccttccatgatcacggccatgcacaacacaccatgtyccccaggcaaggggaccttagaaacataaccaggcttgagacagcactctgcaccggtgtcttggaaatgctcttaagagtgtatggctgagttagggaa

SEQ ID NO: 34116 - DNA, 201 bp, Homo sapiens
gagggaggaggcaagacttctacccgtagccagatggggaggcatgggcacaggaacggctcttgggtgaagtggagggaggaagaggaggactgaaggcsaaggccacgtcaggagtgatgggataccccacaaaggcctccctgagaagcgctagagacaaagatgagtgcctcctcatctggaagatgaaaagatgtc

SEQ ID NO: 34117 - DNA, 201 bp, Homo sapiens
ggaaggtcagagaagggtcattgaagacttcccaatgggaaaaaccattcatttccaggatccatactaacttctttctaaaatttaaatcaaaatattgsaatgaaagtgcaaacagagaagttcacccagatatcaggtagcattcacagccagccacatttttcaccctcttcacttggagatttggtcttgagtaaa

SEQ ID NO: 34118 - DNA, 201 bp, Homo sapiens
cactccactcatccactccactcttccattccactccattccactcctccactccactcttccactccactccattccactcctccactccactccactcyattctattctattccattccattctactctattctattccattccattgcagtcaactccactccactctctactattctattccactcctctcccctcc

SEQ ID NO: 34119 - DNA, 201 bp, Homo sapiens
gaacccaggcagtggcttcagagcctgagctgtttcctactgcagagggaggaggcaagacttctacccgtagccagatggggaggcatgggcacaggaayggctcttgggtgaagtggagggaggaagaggaggactgaaggcgaaggccacgtcaggagtgatgggataccccacaaaggcctccctgagaagcgctag

SEQ ID NO: 34120 - DNA, 201 bp, Homo sapiens
gggcaggactgtcctgttcagtgcactgtgacccggacgctcaggcccacggaactcccctactccccctgctccctgcggtgccacccacctagctttcrtgcctgagggtggtcctcagactcctcctagaacaggcccagaggctcttagctatgtaagtattcattcctccaatcactgcagagcactcaccaggta

SEQ ID NO: 34121 - DNA, 201 bp, Homo sapiens
gtttttctgaaggtagggcttttggccagatatgcagcaataaaagagcaaactgcttccttgggccagtgtccttgctcatagatcaggaaaccgaagcwtgaagaatacaggcggcagatgcctgaaggtaacggacgtgttcatggtgctgacggtgatgataagtgacagatgtagactcatctccaaacttgtcag

SEQ ID NO: 34122 - DNA, 201 bp, Homo sapiens
aaagagggtgcgggcaatgcgcccaactgctgtggctgctgggtttggtgccaggttcgattctgcaggcagaaacttctacatgaggctccttctcggarggagctcaggacacaatttggaggctgggctggcaagggtgacctgctggagctattcaacttcacttaaagacaggcctgcagtccaagcctgcccaat

SEQ ID NO: 34123 - DNA, 201 bp, Homo sapiens
gggcaatgcgcccaactgctgtggctgctgggtttggtgccaggttcgattctgcaggcagaaacttctacatgaggctccttctcggaaggagctcaggrcacaatttggaggctgggctggcaagggtgacctgctggagctattcaacttcacttaaagacaggcctgcagtccaagcctgcccaattcctgagacca

SEQ ID NO: 34124 - DNA, 201 bp, Homo sapiens
gtcttcacctcccatgctgatctgtccggcatcagcaaccactcaaatatccaggtgtctgaggtgggttcagaagctcctatgcatctgcttcccaagakctattctgttctattctttctattctactctaccccatttcattccattccattccactcaactccactccactccactccactccagttcactctattc

SEQ ID NO: 34125 - DNA, 201 bp, Homo sapiens; identical to SEQ ID NO: 8326

SEQ ID NO: 34126 - DNA, 201 bp, Homo sapiens
gcagtcaactccactccactctctactattctattccactcctctcccctccactccattccattgcagtccactccactgcactccactcctttattctrttctgttctattctattctattctattctattctattctattctattctattctattctattctattctctccctctccctctcttttcccacaagtagt

SEQ ID NO: 34127 - DNA, 201 bp, Homo sapiens
ggagctagtgcaagcacaatgataagagtgagcctggcagacactgaccccagcaataatcaggtaaacaaataaacagaactacaaactatgatgacaasaattcatccatccacagatattcactgaatggccactgtgtgcctggcactgttccaagtgctgaagaaaaatgaagaaaacaaaaatccctgcccttat

SEQ ID NO: 34128 - DNA, 201 bp, Homo sapiens
gtgcgggctggtggcaggggagatggcagcaaccagactcagacatttctctgcagttgtgctgtgggctcagggtggctctttatgaaggggccccttcrtggggtcatgcactcctgtgtgttttcccttgcatcatgccttgcctgtcttggcaaatatttctctggagtttacccagccagtccaaggtcacaggga

SEQ ID NO: 34129 - DNA, 201 bp, Homo sapiens
atgggataccccacaaaggcctccctgagaagcgctagagacaaagatgagtgcctcctcatctggaagatgaaaagatgtctttgcctgcatgggctgcygtcacaaagtcccaggggctagggggcttcaacaacagaaatttctttctttacaactctggaagctggaagtctgagattaaggcaccagcaggatttg

SEQ ID NO: 34130 - DNA, 201 bp, Homo sapiens
tcattctaacttaataacctctttaaagtctctatctccaaatacagtcacattttgaaatattgagggttaggacttcagtgtatgaattttgggaggaygcaactcagccaggctcactcttatcattacagctgcactagtgccatgcctggttcccagtggacaccccaggaacagccatccatccagagtgatatt

SEQ ID NO: 34131 - DNA, 201 bp, Homo sapiens
gagagagcccagcagaaagggattccctccaaggcgacacacagggcaaagctcacatcagaagccaggcaggccctctgcacctggtaattagccggccygggtgctgtcaggctcacacgtgtgtgtgtgtgtgtgtgtgtgtgtgtgtaaagcatgtaccctatggtacagttgagaatatggaggcctcagatgggg

SEQ ID NO: 34132 - DNA, 201 bp, Homo sapiens
tgtggaggagacaaggaggagggaggtggccgtgccggcggttcagtgacagagatcctaaatgggaggccaatcctaaatgggatgatctctttcatccyaatttcagggtagtttggtcatccacgccacattccaagtgtcccctgggccctttctctccctcacccccctgtctgcacatgagtagatgcctccatg

SEQ ID NO: 34133 - DNA, 201 bp, Homo sapiens
gtgcctgagttctaacttcctctcctctcctcatctccaccagtcttatagaattagggccccccaatgacctcattctaacttaataacctctttaaagkctctatctccaaatacagtcacattttgaaatattgagggttaggacttcagtgtatgaattttgggaggatgcaactcagccaggctcactcttatcat

SEQ ID NO: 34134 - DNA, 201 bp, Homo sapiens
cagatgatgggcagagggaagcatggtggctgattacaggaggatcatagcagatgtttaaggcaagattgacagccccacaaagactgagaagagaagayaagaaaaatgggaaagttattaagacacaagacctagatcaggagctagaagctggatcccagaacaaggcaagagcctaatgactcgagtagccaactc

SEQ ID NO: 34135 - DNA, 201 bp, Homo sapiens
gagcagctcagagagagatggacagacagcatgaacctctgaggagtcaggttttcttggatgaagggacactaagatggctttggagcgtgagaaggacytcacctagcaaatgtgggaaaggagtgagacctccaggcagagggactggctggagacgagcgtgatgtggtgagccatggagtgtatgggtccccacag

SEQ ID NO: 34136 - DNA, 201 bp, Homo sapiens
tggcagcaaccagactcagacatttctctgcagttgtgctgtgggctcagggtggctctttatgaaggggccccttcatggggtcatgcactcctgtgtgytttcccttgcatcatgccttgcctgtcttggcaaatatttctctggagtttacccagccagtccaaggtcacagggaagccctgtctgtgtctcacacag

SEQ ID NO: 34137 - DNA, 201 bp, Homo sapiens
gcccagatcgcacatgtgcgggctggtggcaggggagatggcagcaaccagactcagacatttctctgcagttgtgctgtgggctcagggtggctctttaygaaggggccccttcatggggtcatgcactcctgtgtgttttcccttgcatcatgccttgcctgtcttggcaaatatttctctggagtttacccagccagt

SEQ ID NO: 34138 - DNA, 201 bp, Homo sapiens
cctgcttctaccatcacatcaccttcttctgactccaatctcctgcctctttcttgcaaggatccttgtgattgtaattaggacccagctggataatccaygacaatctcttcaagatccttaacttaatcacatctgcaaagtcccttttgtcatagaacgataacattcacaggttctgggtattaggacacggataac

SEQ ID NO: 34139 - DNA, 201 bp, Homo sapiens
ggctgtatccaataaggaaactcccctgcttctgaagctgttctcgaaattatcagctcagtgtgaccctgtggggggttgagccacattgtttctttagmagcatctccatacatggctggttccaacccttggcaggagggaccatattgtgctgtaaaatagactcatttagagaagccggagattaaagcacccacc

SEQ ID NO: 34140 - DNA, 201 bp, Homo sapiens
ccatgcccccgagactccttccaaatctctcctttcaaaacgcaccaccctcagtcctgattccttcagagctctttctgcatggcagtgggagtcatgarttacctcagactttcccccaaattctcaagacattccttaagatgtaagcttgggaaacggcatgtgatgtctttccctcgtgggtggtcagagcacaga

SEQ ID NO: 34141 - DNA, 201 bp, Homo sapiens
ggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttg

SEQ ID NO: 34142 - DNA, 201 bp, Homo sapiens
gctctcctctccctatgtcttcacatggtcctcctctgcatgtgcctgagttctaacttcctctcctctcctcatctccaccagtcttatagaattagggccccccaatgacctcattctaacttaataacctctttaaagtctctatctccaaatacagtcacattttgaaatattgagggttaggacttcagtgtatga

SEQ ID NO: 34143 - DNA, 201 bp, Homo sapiens
caccattattttcctttctagccatatggattctaaaagttcctcttgtgagctgtaatcagaatgcagagaagtaatacaaggttagggcccaggactcyttctcccacctctccctgcagagactcagatttttttaaaaaatgaccttggtcttcgggggaagaacttcccaccacagtgaacagccatgcccagcct

SEQ ID NO: 34144 - DNA, 201 bp, Homo sapiens
tagagaagtataaatgagctaatacaggtgaaccgcctggggataccaggaggtgaggtcgaggaggaacgaggtatcactcctcagagccactcagagasaggctgtgcacgagtcagaggaacctggattttaattccggttccatcactcagtagctgaaacaagctattccacttcacttagcctcagtctattcaa

SEQ ID NO: 34145 - DNA, 201 bp, Homo sapiens; identical to SEQ ID NO: 8337

SEQ ID NO: 34146 - DNA, 201 bp, Homo sapiens; identical to SEQ ID NO: 8338

SEQ ID NO: 34147 - DNA, 201 bp, Homo sapiens
cccattgagtgttgggtggggacatctctggaaagtcagcacctggaccagctccacccctctctgaggacaccttctttccctttcagaacaaagaacakccaccatgcagctcttcctcctcttgtgcctggtgcttctcagccctcagggggcctcccttcaccgccaccacccccgggagatgaagaagagagtcga

SEQ ID NO: 34148 - DNA, 201 bp, Homo sapiens; identical to SEQ ID NO: 6913

SEQ ID NO: 34149 - DNA, 201 bp, Homo sapiens
aggctgtgccccaccctctgattctagagtctggactgtatcagaggtgagtgcctactagaggtaacaaggtcaggaccccaaaccttgtccatcccccraagtactgagcccccaccatgcaccagcccatgccagatgctttgcacttgtgatatcacccatcccttgacaacccagcaagttctattattgttccca

SEQ ID NO: 34150 - DNA, 201 bp, Homo sapiens
taggtggcttacccagtcacatatcttctaagtggtgcagccagaatttggcggggggagtgcgaccaagaaccctacactcagtcctgtgctctgtgctrtggaggagagatgaccaggagcagaaacttcattcagggacatctcaggcaccagctcccccatgagccagctaagttccctccctcccttcaccaagca

SEQ ID NO: 34151 - DNA, 201 bp, Homo sapiens; identical to SEQ ID NO: 6920

SEQ ID NO: 34152 - DNA, 201 bp, Homo sapiens
ataattagtggttttactgaaaagtagagagagttggcccagagggagcaagatttctgggtctcaaacatgtagcccaggagagcctaagtgaacctggrgccctctccaaacagatcctgggggagactcagtgcacacccggagaagcagctcctccccatcggatctctagtgcttggcagggggcggggtcttgag

SEQ ID NO: 34153 - DNA, 201 bp, Homo sapiens; identical to SEQ ID NO: 6893

SEQ ID NO: 34154 - DNA, 201 bp, Homo sapiens
tcaaaaagaagaaaaaaagaaaaaaaagaaaaaaagaaataaaataaaataaaaagaagttggaaacaatcacttgtagcgttttgttcagaagttcccawaggaaggtcagagaagggtcattgaagacttcccaatgggaaaaaccattcatttccaggatccatactaacttctttctaaaatttaaatcaaaatatt

SEQ ID NO: 34155 - DNA, 201 bp, Homo sapiens; identical to SEQ ID NO: 6895

SEQ ID NO: 34156 - DNA, 201 bp, Homo sapiens
tctccctatgtcttcacatggtcctcctctgcatgtgcctgagttctaacttcctctcctctcctcatctccaccagtcttatagaattagggccccccartgacctcattctaacttaataacctctttaaagtctctatctccaaatacagtcacattttgaaatattgagggttaggacttcagtgtatgaattttgg

SEQ ID NO: 34157 - DNA, 201 bp, Homo sapiens
tcccttgatgtggatgggtagacaggattcctgccctggcagccagacccctgccttgggtctgcacctcctctccctccttcctctccccgtcatccctraatcttgtcctcgagccactgccaccctgtgtaaaccctcatgcccagtcttgcgggtgccatcccttctctttgaagctgaatggaccaaacataccca

SEQ ID NO: 34158 - DNA, 201 bp, Homo sapiens
gaaccgcctggggataccaggaggtgaggtcgaggaggaacgaggtatcactcctcagagccactcagagagaggctgtgcacgagtcagaggaacctggrttttaattccggttccatcactcagtagctgaaacaagctattccacttcacttagcctcagtctattcaatctgtaaaatagagtgagtttacttttgg

SEQ ID NO: 34159 - DNA, 201 bp, Homo sapiens
cctctccccttggtttgcaggtggctctcctctccctatgtcttcacatggtcctcctctgcatgtgcctgagttctaacttcctctcctctcctcatctmcaccagtcttatagaattagggccccccaatgacctcattctaacttaataacctctttaaagtctctatctccaaatacagtcacattttgaaatattg

SEQ ID NO: 34160 - DNA, 201 bp, Homo sapiens
agacccctgccttgggtctgcacctcctctccctccttcctctccccgtcatccctaaatcttgtcctcgagccactgccaccctgtgtaaaccctcatgyccagtcttgcgggtgccatcccttctctttgaagctgaatggaccaaacatacccattgagtgttgggtggggacatctctggaaagtcagcacctggac

SEQ ID NO: 34161 - DNA, 201 bp, Homo sapiens
ccaatttcagggtagtttggtcatccacgccacattccaagtgtcccctgggccctttctctccctcacccccctgtctgcacatgagtagatgcctccaygcagccctcccaggacgctcacctctatccacagatgcttctccaaaacccaccaggccctcccatggaacgagctcacctacagggtaaaatcaggtca

SEQ ID NO: 34162 - DNA, 201 bp, Homo sapiens
ctaatcaactcccaaaggccccctgtcctaataccaccaccttgggggttaggtttcaacatatgaacaatgtggggacacaaacattgagaccacagcastgagtgtcgaacttggactctgagatttcctatcccctggtgcagggcagtccccattacaccagattgctgagggcagctgggaaataagctaaggacg

SEQ ID NO: 34163 - DNA, 201 bp, Homo sapiens
catggagagagcccagcagaaagggattccctccaaggcgacacacagggcaaagctcacatcagaagccaggcaggccctctgcacctggtaattagccrgcccgggtgctgtcaggctcacacgtgtgtgtgtgtgtgtgtgtgtgtgtgtgtaaagcatgtaccctatggtacagttgagaatatggaggcctcagat

SEQ ID NO: 34164 - DNA, 201 bp, Homo sapiens
tatcattttgtggatatagttataatctgatgggcctggctgggagtggaagaagggaagccttttgcaaatagtagagtatcagttgcaggtgccaatgrctaactttttgaattctatgttggcattaacaataaagcattttgcaaacactggttataactgtctttatggaggcagctctgggaatggtgacattga

SEQ ID NO: 34165 - DNA, 201 bp, Homo sapiens
ttaccttcccaaattctccattgagggctcctatcagctggagaaagtcctccccagtctggggatcagtaacgtcttcacctcccatgctgatctgtccsgcatcagcaaccactcaaatatccaggtgtctgaggtgggttcagaagctcctatgcatctgcttcccaagatctattctgttctattctttctattcta

SEQ ID NO: 34166 - DNA, 201 bp, Homo sapiens
cagggacatttggcaaaatagcccaccactcctacttaaaagtgtcgaggtcttgaaaggcaaggaaaccctgggaaatcgtctttggccggaggaaactmagcagacatgacgactaaatgcaatgtagaatcctcggacagaaaaggacattagtaggacagctggtgaaacccaagtaagtccaggctgtaccaatgt

SEQ ID NO: 34167 - DNA, 201 bp, Homo sapiens
catttcctacttgctccatggctcagttgaacagatacttagaggttgatgcccataggcagaagctttgccatttgctatgatgacttcacctgcccctrgtggcctggtgatgcctggtgtctcccctgcagatggtgcacaaagctgtggtggaggtggacgagtcgggaaccagagcagcggcagccacggggacaa

SEQ ID NO: 34168 - DNA, 201 bp, Homo sapiens
aggcaaggaaaccctgggaaatcgtctttggccggaggaaactcagcagacatgacgactaaatgcaatgtagaatcctcggacagaaaaggacattagtrggacagctggtgaaacccaagtaagtccaggctgtaccaatgtccacttcccagttctgaggaacatgctgtggtctgtccacatttacattaggagaag

SEQ ID NO: 34169 - DNA, 201 bp, Homo sapiens
tgacattgatagcttaccatgctccaggccgggtgcctggcccttcacctggatggtcgcatttgcccctcataagactcccatgaagaaaggcaccactrttatcccatctgttattcacagatgggaaaggcaaggcttgaagtggttaggtggcttacccagtcacatatcttctaagtggtgcagccagaatttggc

SEQ ID NO: 34170 - DNA, 201 bp, Homo sapiens
taagtccaggctgtaccaatgtccacttcccagttctgaggaacatgctgtggtctgtccacatttacattaggagaagcagggagagcgtatatgggacytctctgtattgtttttataacttttctgtaaatccaaaactgtcttaaaatagtttttttaaattatactttaagttctggggtacaggtgcagaatatg

SEQ ID NO: 34171 - DNA, 201 bp, Homo sapiens
ctaccccatttcattccattccattccactcaactccactccactccactccactccagttcactctattcaattccactccactccactccagttcactytattcaattccactccactccactccagttcactctattcagttccactccactccactccactccagttcactctattccattccactccattccactc

SEQ ID NO: 34172 - DNA, 201 bp, Homo sapiens
ttaagctccccctcgggattcaaatgcacacagatttttggtgctttgccgcctacagtacaagagagggcaggactgtcctgttcagtgcactgtgaccyggacgctcaggcccacggaactcccctactccccctgctccctgcggtgccacccacctagctttcgtgcctgagggtggtcctcagactcctcctagaa

SEQ ID NO: 34173 - DNA, 201 bp, Homo sapiens
ctcacacttccatagcacgtgcccccaagcaccccatggtgtaggtgctgttattatcactatcttacagttatggagcagtggctcaaggtgtaactgayttgcccaaaatcacactacaaggacacagcagggctgagatttgaacccaggcagtggcttcagagcctgagctgtttcctactgcagagggaggaggca

SEQ ID NO: 34174 - DNA, 201 bp, Homo sapiens; identical to SEQ ID NO: 6907

SEQ ID NO: 34175 - DNA, 201 bp, Homo sapiens; identical to SEQ ID NO: 6914

SEQ ID NO: 34176 - DNA, 201 bp, Homo sapiens; identical to SEQ ID NO: 6916

SEQ ID NO: 34177 - DNA, 201 bp, Homo sapiens
cttgggtctgcacctcctctccctccttcctctccccgtcatccctaaatcttgtcctcgagccactgccaccctgtgtaaaccctcatgcccagtcttgsgggtgccatcccttctctttgaagctgaatggaccaaacatacccattgagtgttgggtggggacatctctggaaagtcagcacctggaccagctccacc

SEQ ID NO: 34178 - DNA, 201 bp, Homo sapiens
ggggtgggctcactgtggtctctgctgcatgtcacacattgaagcactgtgctgggggtcatcacaggctgtttaactcaattgtcacatgagcctgggtrcacaaaatggtagagcagctcagagagagatggacagacagcatgaacctctgaggagtcaggttttcttggatgaagggacactaagatggctttggag

SEQ ID NO: 34179 - DNA, 201 bp, Homo sapiens
cctccttcctctccccgtcatccctaaatcttgtcctcgagccactgccaccctgtgtaaaccctcatgcccagtcttgcgggtgccatcccttctctttraagctgaatggaccaaacatacccattgagtgttgggtggggacatctctggaaagtcagcacctggaccagctccacccctctctgaggacaccttctt

SEQ ID NO: 34180 - DNA, 201 bp, Homo sapiens
ccagtcccccgtatccctcagatcttggcccctctgccctcatagaggccaagactccctcagacaaatgcttgttcctctgaaatgcctcctcctgactyctcagcaagagctgacctctgcttatctccccgacactccttgtaagcattcctgctcgcctctgcagctcctgccagttgctgaccctggggaaagcaa

SEQ ID NO: 34181 - DNA, 201 bp, Homo sapiens
atctttggccatttgggtggctataacaaaataccataaactgggtggcttagcaacaacaaacatatatttctcatagttctggaggctgagaagtccakgatcaaggcactggcagatgcagtgcccattccttggttcatagagagtgccttcttagtatatccttgctggaaggaggaaggcagctctctgtggtct

SEQ ID NO: 34182 - DNA, 201 bp, Homo sapiens
gaaggtaagatgaatgccttcttgctgtggatgggattagtgaggctgagatgctgtttcctccacggaggaagagctggttgctgtcttcgggcccctgrggacatctgaagccccagctttctacaggctctgaagtatgaacccattgtggccaccatggcaaagacaccaacaccttagccactcagggcaggacac

SEQ ID NO: 34183 - DNA, 201 bp, Homo sapiens
ccttggtgggagtaaggggctctaaggtgacaacacacacaggagccacagacacaagacacaagacacttttgactcccaggagaacctagtatgggcawccacacacccttcctgatggtgactttttatgtagacatgcagagtgcagttaaccagctgttcctgcacacatctggattgctactcacacatctgtgc

SEQ ID NO: 34184 - DNA, 201 bp, Homo sapiens
atataaaggcacatgtgtaattgaaagagctttgagagaaagagtcaagggactgttccagagaatagccatggaaggggaaaaggtccagtgtgataagrtattgcaaagaagtgacatttaagcaaaagcctgcagcctatgcagaagttggcctcagtgagaaaggttgggggagggttccagtagagagggaaggta

SEQ ID NO: 34185 - DNA, 201 bp, Homo sapiens; identical to SEQ ID NO: 6894

SEQ ID NO: 34186 - DNA, 201 bp, Homo sapiens; identical to SEQ ID NO: 6896

SEQ ID NO: 34187 - DNA, 201 bp, Homo sapiens; identical to SEQ ID NO: 6897

SEQ ID NO: 34188 - DNA, 201 bp, Homo sapiens; identical to SEQ ID NO: 6898

SEQ ID NO: 34189 - DNA, 201 bp, Homo sapiens
aggtgacaacacacacaggagccacagacacaagacacaagacacttttgactcccaggagaacctagtatgggcatccacacacccttcctgatggtgaytttttatgtagacatgcagagtgcagttaaccagctgttcctgcacacatctggattgctactcacacatctgtgcacacacacacacagcctcctggag

SEQ ID NO: 34190 - DNA, 201 bp, Homo sapiens
ccagaatttggcggggggagtgcgaccaagaaccctacactcagtcctgtgctctgtgctgtggaggagagatgaccaggagcagaaacttcattcagggrcatctcaggcaccagctcccccatgagccagctaagttccctccctcccttcaccaagcaccatgtgtttcctcatgtgccgaatgaagaggattagata

SEQ ID NO: 34191 - DNA, 201 bp, Homo sapiens
cagaaacttcattcagggacatctcaggcaccagctcccccatgagccagctaagttccctccctcccttcaccaagcaccatgtgtttcctcatgtgccraatgaagaggattagatactcaagaatggaatgagtgggtgagtgagtccttcgctgcacccaagtctgattttctgtgcgcctgctcaccccaccctgc

SEQ ID NO: 34192 - DNA, 201 bp, Homo sapiens
cttgcatcatgccttgcctgtcttggcaaatatttctctggagtttacccagccagtccaaggtcacagggaagccctgtctgtgtctcacacagaaggtyaacgtccagcactgtccaaactttactcagcaaacagtcacaaagcagctcctgtgtggggggtcaggggtgggctcactgtggtctctgctgcatgtca

SEQ ID NO: 34193 - DNA, 201 bp, Homo sapiens; identical to SEQ ID NO: 6899

SEQ ID NO: 34194 - DNA, 201 bp, Homo sapiens; identical to SEQ ID NO: 6900

SEQ ID NO: 34195 - DNA, 201 bp, Homo sapiens
tggtgtctcccctgcagatggtgcacaaagctgtggtggaggtggacgagtcgggaaccagagcagcggcagccacggggacaatattcactttcaggtcrgcccgcctgaactctcagaggctagtgttcaacaggccctttctgatgttcattgtggataacaacatcctcttccttggcaaagtgaaccgcccctgag

SEQ ID NO: 34196 - DNA, 201 bp, Homo sapiens
cgtcttcacctcccatgctgatctgtccggcatcagcaaccactcaaatatccaggtgtctgaggtgggttcagaagctcctatgcatctgcttcccaagrtctattctgttctattctttctattctactctaccccatttcattccattccattccactcaactccactccactccactccactccagttcactctatt

SEQ ID NO: 34197 - DNA, 201 bp, Homo sapiens
cacaaaattctttttcatttttcccttttttcatctttagctaagtgggagacaagcttcaaccacaaaggcacccaagagcaagacttctacgtgacctyggagactgtggtgcgggtacccatgatgagccgcgaggatcagtatcactacctcctggaccggaacctctcctgcagggtggtgggggtcccctaccaa

SEQ ID NO: 34198 - DNA, 201 bp, Homo sapiens
tttatttgcagctgagaatttctaattctgacacaaaattctttttcatttttcccttttttcatctttagctaagtgggagacaagcttcaaccacaaasgcacccaagagcaagacttctacgtgacctcggagactgtggtgcgggtacccatgatgagccgcgaggatcagtatcactacctcctggaccggaacct

SEQ ID NO: 34199 - DNA, 201 bp, Homo sapiens
caagatctattctgttctattctttctattctactctaccccatttcattccattccattccactcaactccactccactccactccactccagttcactytattcaattccactccactccactccagttcactttattcaattccactccactccactccagttcactctattcagttccactccactccactccactc

SEQ ID NO: 34200 - DNA, 201 bp, Homo sapiens
caactccactccactctctactattctattccactcctctcccctccactccattccattgcagtccactccactgcactccactcctttattctgttctrttctattctattctattctattctattctattctattctattctattctattctattctattctctccctctccctctcttttcccacaagtagtgaaag

SEQ ID NO: 34201 - DNA, 201 bp, Homo sapiens; identical to SEQ ID NO: 6909

SEQ ID NO: 34202 - DNA, 201 bp, Homo sapiens; identical to SEQ ID NO: 6915

SEQ ID NO: 34203 - DNA, 201 bp, Homo sapiens
tccctaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaaggtaaggcccttgggcccaaacctgcactttctttggcttttctgctgcttttat

SEQ ID NO: 34204 - DNA, 201 bp, Homo sapiens
ccagatatcaggtagcattcacagccagccacatttttcaccctcttcacttggagatttggtcttgagtaaaacgttagagaatcagagaacatcagggrtccagggcctctgaagatgtgaaaaccaacctccttgttttgcaaatgtggaaggaaaagtcccacgaaaagtccaagaatgtgcccaatgttataaaga

SEQ ID NO: 34205 - DNA, 201 bp, Homo sapiens
atgggtagacaggattcctgccctggcagccagacccctgccttgggtctgcacctcctctccctccttcctctccccgtcatccctaaatcttgtcctcragccactgccaccctgtgtaaaccctcatgcccagtcttgcgggtgccatcccttctctttgaagctgaatggaccaaacatacccattgagtgttgggt

SEQ ID NO: 34206 - DNA, 201 bp, Homo sapiens
gtagctggacttagctctagatacccagtgctcatctctagactgggctgagatcagtgtctcccttgaagggttattgtaaggatgaaaaaagataatgygtttaaagcacttggtgtagtaggtggtctttttaaaagtgtgaataaatactagttcttattatttctgtggatatccaacagccacataattgggccc

SEQ ID NO: 34207 - DNA, 201 bp, Homo sapiens
aaggccagcagtgctgatggtcccaggcatgtagctggtctgagttcatagaaggaccacagcgccctgccatgtgccaaaccaggacaccagagtgaagrccagaagctcacatggaagcagcttagttccctggtaacctcgagatgctgatgagacagagcagagcagagggaaccctctccctccatatcccatcct

SEQ ID NO: 34208 - DNA, 201 bp, Homo sapiens
agaaggggacagtttgcatactggtattctgcctaccccagggtggacactcactcagcgtttgctgaatgaacagggcaaggccagcagtgctgatggtsccaggcatgtagctggtctgagttcatagaaggaccacagcgccctgccatgtgccaaaccaggacaccagagtgaaggccagaagctcacatggaagca

SEQ ID NO: 34209 - DNA, 201 bp, Homo sapiens
cacatgaagaggttcaggcagaattcctttaggaggggaagatgtctctctgtgggacaagggtggcatggagcagcccctgggggaaggagaaggggacwgtttgcatactggtattctgcctaccccagggtggacactcactcagcgtttgctgaatgaacagggcaaggccagcagtgctgatggtcccaggcatgt

SEQ ID NO: 34210 - DNA, 201 bp, Homo sapiens; identical to SEQ ID NO: 6903

SEQ ID NO: 34211 - DNA, 201 bp, Homo sapiens
atgaggatattggcagggctccactctttctggaggctctaggggaggatccattcctttccctctccagcttctagaagcttcctcactccttggcaccyggctccgacatcacattgacttttcccttcctgcttctaccatcacatcaccttcttctgactccaatctcctgcctctttcttgcaaggatccttgtga

SEQ ID NO: 34212 - DNA, 201 bp, Homo sapiens
aggaacggctcttgggtgaagtggagggaggaagaggaggactgaaggcgaaggccacgtcaggagtgatgggataccccacaaaggcctccctgagaagmgctagagacaaagatgagtgcctcctcatctggaagatgaaaagatgtctttgcctgcatgggctgccgtcacaaagtcccaggggctagggggcttcaa

SEQ ID NO: 34213 - DNA, 201 bp, Homo sapiens
tggcctggtgatgcctggtgtctcccctgcagatggtgcacaaagctgtggtggaggtggacgagtcgggaaccagagcagcggcagccacggggacaatmttcactttcaggtcggcccgcctgaactctcagaggctagtgttcaacaggccctttctgatgttcattgtggataacaacatcctcttccttggcaaag

SEQ ID NO: 34214 - DNA, 201 bp, Homo sapiens
ctgggaggtccttttcatgcttcaaagccagctcagtgtcctcctttgtacaaaaaaatgtcctgacctctcagaacttcattctttctctctttctgtcratctttgtctgaactcctctatcattttgtgcacccaggaacgtgtgacaattgagttgaacaggctgcaaaaacgaaaaagaagaaagaaatgctgagt

SEQ ID NO: 34215 - DNA, 201 bp, Homo sapiens; identical to SEQ ID NO: 6921

SEQ ID NO: 34216 - DNA, 201 bp, Homo sapiens; identical to SEQ ID NO: 6889

SEQ ID NO: 34217 - DNA, 201 bp, Homo sapiens
tggttcccaacccagcaggacttccaagccctccatctggccctgatctggcttctctctgtcctcccttcctcctctctgatgggctcccggtgccccaycacccccttagcctgtactgctatcactcctgtggttctctcagcccaaaatgcagcctcccactgctgtgctgtaagctattctgtctgttcactcctc

SEQ ID NO: 34218 - DNA, 201 bp, Homo sapiens
tggggtggggagagggcaggcactttccctgcgcgaccccgtttaaccctctctgccccactgatgtggtccctgttgtccccgatgcacagaggaagaayctgtgtcaggacccccagagcggtgtctccactaagcagaagtctctgtttctctcctggcctctcccagaggggctgctctgaagcatgtggatttgat

SEQ ID NO: 34219 - DNA, 201 bp, Homo sapiens
agatgtttaaggcaagattgacagccccacaaagactgagaagagaagataagaaaaatgggaaagttattaagacacaagacctagatcaggagctagargctggatcccagaacaaggcaagagcctaatgactcgagtagccaactcatcccagtttgccaaggtctttgccagttttagcactgaatatcccacacc

SEQ ID NO: 34220 - DNA, 201 bp, Homo sapiens
cactccactcatccactccactcctccactccactcctccactccactcctccactccactccactcatccactccactcttccattccactccattccaytcctccactccactcttccactccactccattccactcctccactccactccactctattctattctattccattccattctactctattctattccatt

SEQ ID NO: 34221 - DNA, 201 bp, Homo sapiens
caatcctaaatgggatgatctctttcatcccaatttcagggtagtttggtcatccacgccacattccaagtgtcccctgggccctttctctccctcacccycctgtctgcacatgagtagatgcctccatgcagccctcccaggacgctcacctctatccacagatgcttctccaaaacccaccaggccctcccatggaac

SEQ ID NO: 34222 - DNA, 201 bp, Homo sapiens
tcagaatgcagagaagtaatacaaggttagggcccaggactctttctcccacctctccctgcagagactcagatttttttaaaaaatgaccttggtcttcrggggaagaacttcccaccacagtgaacagccatgcccagcctacacttgactgtgcggcttacttagctcatccatccaaaggctattcctgggttgcct

SEQ ID NO: 34223 - DNA, 201 bp, Homo sapiens
ttactcagcaaacagtcacaaagcagctcctgtgtggggggtcaggggtgggctcactgtggtctctgctgcatgtcacacattgaagcactgtgctgggrgtcatcacaggctgtttaactcaattgtcacatgagcctgggtgcacaaaatggtagagcagctcagagagagatggacagacagcatgaacctctgagg

SEQ ID NO: 34224 - DNA, 201 bp, Homo sapiens
atgactttgaaaattcccctcattcttctgagccccaattcagtgattggtgcaatcacaggcttggctacagtgacccattcattgcaggcatggtgagwctctcaatccctctcatttccactagaatctaactgttgggatctatgacccagtcagcatagcaggcctgtggggagctctcaggttcaagcatatgcc

SEQ ID NO: 34225 - DNA, 201 bp, Homo sapiens
ctgctcccaccttcccacccagatcaccctggtggattccatggaccagtgaccatcctcatctacttgaatgttctgctgcatctgacactgacagtgayatcccttgtcctcccttgtttactgccctggtcctcctccttcccagccatcatcacctttgtgagctctctccctctctgctcaggcttatgccgaggg

SEQ ID NO: 34226 - DNA, 201 bp, Homo sapiens
agaagataagaaaaatgggaaagttattaagacacaagacctagatcaggagctagaagctggatcccagaacaaggcaagagcctaatgactcgagtagycaactcatcccagtttgccaaggtctttgccagttttagcactgaatatcccacaccatcggaaattactcagtcccagcaaattggaatggttggtcac

SEQ ID NO: 34227 - DNA, 201 bp, Homo sapiens
ggcagcgagtgggcatcgtggtgaaagcctcgggatcagggagctgcgtctgcaggcaggcctgctggccggaaacctgccaggaaaggaaggggctgtcycggggcggggccagggaggggtggagacagggccggctgtggtcagtgacaaatgctggctgcaatccagccagccctctgccctttctgagcccgaggg

SEQ ID NO: 34228 - DNA, 201 bp, Homo sapiens
ttaagaccagtgccccacttcagagcagaagcatcagccaggccctgagtgacatcttgtaggctcttgaactggtctcactcaatccccatgaggcccartaccatggaacagagggcagggaggctgagggccaagcagaggagcacctgtgctcagcagggcaaggcatcacaggggccaacattggtttccctgccc

SEQ ID NO: 34229 - DNA, 201 bp, Homo sapiens
gccacataaccttccatgatcacggccatgcacaacacaccatgtcccccaggcaaggggaccttagaaacataaccaggcttgagacagcactctgcacyggtgtcttggaaatgctcttaagagtgtatggctgagttagggaaccaggatttcaaagtagaaagggagaatctacccaagcccatagaaatcctgaat

SEQ ID NO: 34230 - DNA, 201 bp, Homo sapiens; identical to SEQ ID NO: 6910

SEQ ID NO: 34231 - DNA, 201 bp, Homo sapiens
gagacagggccggctgtggtcagtgacaaatgctggctgcaatccagccagccctctgccctttctgagcccgagggactgccacctccactgtgtgcacrctcagctacgggacacagtaagtaccgatgccgcaaagggaggtccccagggcttgagggcatgtgaggcgaggagaggatggactctagagttttgggg

SEQ ID NO: 34232 - DNA, 201 bp, Homo sapiens
aaatgctggctgcaatccagccagccctctgccctttctgagcccgagggactgccacctccactgtgtgcacactcagctacgggacacagtaagtaccratgccgcaaagggaggtccccagggcttgagggcatgtgaggcgaggagaggatggactctagagttttggggtttggggtctgcaaagctctgaaggag

SEQ ID NO: 34233 - DNA, 201 bp, Homo sapiens; identical to SEQ ID NO: 6917

SEQ ID NO: 34234 - DNA, 201 bp, Homo sapiens
tgcaatccagccagccctctgccctttctgagcccgagggactgccacctccactgtgtgcacactcagctacgggacacagtaagtaccgatgccgcaamgggaggtccccagggcttgagggcatgtgaggcgaggagaggatggactctagagttttggggtttggggtctgcaaagctctgaaggagtctcatctct

SEQ ID NO: 34235 - DNA, 201 bp, Homo sapiens
aatgggaagccatatccaccactgttccttgagttaaggagtcctgttttaaacaatcaaaactaagaaggcacttcctagctatgtgatctccaaaaaayacttgactctctgagcttcctttctctcttctataaaattgaagaattacaccttgctcaaagatgccatgagaattcaatgacagacacatgcgaagtc

SEQ ID NO: 34236 - DNA, 201 bp, Homo sapiens
gtgcctggagtcttgggcctttagaaatcaggaacaatgatccaatattatcggcttccgtgagataagggcatcttgcctggaggctgccacccaggccrgtcatggcagctgctcatgaaggacagtaacaatttggcagtttgttaaatgaacaaaatgtagaaataaagtaagcagaatttttagtttttctgaagg

SEQ ID NO: 34237 - DNA, 201 bp, Homo sapiens
tagaaatcaggaacaatgatccaatattatcggcttccgtgagataagggcatcttgcctggaggctgccacccaggccggtcatggcagctgctcatgarggacagtaacaatttggcagtttgttaaatgaacaaaatgtagaaataaagtaagcagaatttttagtttttctgaaggtagggcttttggccagatatg

SEQ ID NO: 34238 - DNA, 201 bp, Homo sapiens
ctggataatcgtgggcaggcccattcctcttcttgtgcctcattttcttcttttgtaaaacaatggctgtaccatttgcatcttagggtcattgcagatgwaagtgttgctgtccagagcctgggtgcaggacctagatgtaggattctggttctgctacttcctcagtgacattgaatagctgacctaatctctctggct

SEQ ID NO: 34239 - DNA, 201 bp, Homo sapiens
ggtaagcactacgtacattttgctattcttctgattctttcagtgttactgatgtcggcaagtacttggcacaggctggtttaataatccctaggcacttycacgtggtgtcaatccctgatcactgggagtcatcatgtgccttgactcggggcctggcccccccatctctgtcttgcaggacaatgccgtcttctgtct

SEQ ID NO: 34240 - DNA, 201 bp, Homo sapiens
tctatggagacagaagtcagaacagaagttaccttcgggaggcattgatagaaagaggactttgtggatgggagaatttgctctgtcttgctcagaatggyggttacacagatgcacacacatgtaaaaatgtattgagctgtgtatttaggagttacagttttactacatgcaaataacacgtccataaaaagtaaatcg

SEQ ID NO: 34241 - DNA, 201 bp, Homo sapiens
gactcagcaagaagcataagcgcactgctgatattggtgacaacatagatcaatctcagaaacatgatgttgaactaaagaagacagacacaaaaacatargtagtgtattatcccatttacatgctcttctagaaggggaaaaaccagtctatggagacagaagtcagaacagaagttaccttcgggaggcattgataga

SEQ ID NO: 34242 - DNA, 201 bp, Homo sapiens
tcctccagacaggttctgcaggacgcagcctaggactcattatccccaaagtacacatggggaaactcaggcccagcaggtcaaatgctctgtccagtgtrggcctggaaggcaggtcttctccactgttaggcctggctgtccccaacagcacatacttcctcagtccatatgggatcacgataaacaactccatcctcc

SEQ ID NO: 34243 - DNA, 201 bp, Homo sapiens
ctgaaccataccacctcaccacactctccccttcgagggtcacgctaaacttctgcagaggtaattcctccttaaaccagaagggttgctggtggcccacwgctcacgcctagcacacttcatgagaaaaacaccctgtgcccagtgtggagcaggcattgagctgaaggtggtgagcagaagctcatccaccagatgttg

SEQ ID NO: 34244 - DNA, 201 bp, Homo sapiens
agaggctactggtctcccacaatgtcacacagctcataagtggcaaagctggcttgatgggctacttgttcctctgaaccataccacctcaccacactctycccttcgagggtcacgctaaacttctgcagaggtaattcctccttaaaccagaagggttgctggtggcccacagctcacgcctagcacacttcatgagaa

SEQ ID NO: 34245 - DNA, 201 bp, Homo sapiens; identical to SEQ ID NO: 7059

SEQ ID NO: 34246 - DNA, 201 bp, Homo sapiens; identical to SEQ ID NO: 7060

SEQ ID NO: 34247 - DNA, 201 bp, Homo sapiens; identical to SEQ ID NO: 7061

SEQ ID NO: 34248 - DNA, 201 bp, Homo sapiens
ttacttggcccagggccactggcacacctcacccccttacccgattccttgctgcagaccccaaatctcgactctcacatccctatccagcccataccacsaggctcccatctccaggcagggccctgtggtggggcagggcctcccccagatgccccttactcatgaccagctcacaggatcttcccatgatgcatttcc

SEQ ID NO: 34249 - DNA, 201 bp, Homo sapiens
cactgcttaaatacggacgaggacagggccctgtctcctcagcttcaggcaccaccactgacctgggacagtgaatcgtaagtatgcctttcactgcgagrggttctggagaggcttctgagctccccatggcccaggcaggcagcaggtctggggcaggaggggggttgtggagtgggtatccgcctgctgaggtgcagg

SEQ ID NO: 34250 - DNA, 201 bp, Homo sapiens
aaattacagatattcacaagtttgttaccaatgaccctgagctaggaatcagcctgggatcttttcccaggtctaccactaatgtgccacctaacactgcrgacatcctctcctctccctgagccccagtttcctcaccagagaatgtgagcattgaggtccctggagtcctgacattccatagagctctgagggcttcag

SEQ ID NO: 34251 - DNA, 201 bp, Homo sapiens
agcagaagtggatgagggtgtctaggtctgcagtcctggcaccccaggatgggggacaccagccaagatacagcaacagcaacaaagcgcagccatttctytctgtttgcacagctcctctgtctgtcgggggctcctgtctgttgtctcctataagcctcaccacctctcctactgcttgggcatgcatctttctcccct

SEQ ID NO: 34252 - DNA, 201 bp, Homo sapiens
ccgtgctctgtcagggaactaacagaggaataaattacagatattcacaagtttgttaccaatgaccctgagctaggaatcagcctgggatcttttcccargtctaccactaatgtgccacctaacactgcggacatcctctcctctccctgagccccagtttcctcaccagagaatgtgagcattgaggtccctggagtc

SEQ ID NO: 34253 - DNA, 201 bp, Homo sapiens
tcccattttacagatgaggaagatggggacagagaggtgaataactggccccaaatcacacaccatccataattcgggctcaggcacctggctccagtccycaaactcttgaacctggccctagtgtcactgtttctcttgggtctcaggcgctggatggggaacaggaaacctgggctggacttgaggcctctctgatgc

SEQ ID NO: 34254 - DNA, 201 bp, Homo sapiens
ctggacttgaggcctctctgatgctcggtgacttcagacagttgctcaacctctctgttctcttgggcaaaacatgataacctttgacttctgtcccctcycctcaccccacccgaccttgatctctgaagtgttggaaggatttaatttttcctgcactgagttttggagacaggtcaaaaagatgaccaaggccaaggt

SEQ ID NO: 34255 - DNA, 201 bp, Homo sapiens; identical to SEQ ID NO: 7066

SEQ ID NO: 34256 - DNA, 201 bp, Homo sapiens; identical to SEQ ID NO: 7067

SEQ ID NO: 34257 - DNA, 201 bp, Homo sapiens; identical to SEQ ID NO: 7068

SEQ ID NO: 34258 - DNA, 201 bp, Homo sapiens; identical to SEQ ID NO: 7072

SEQ ID NO: 34259 - DNA, 201 bp, Homo sapiens
tggataagtttttggaggatgttaaaaagttgtaccactcagaagccttcactgtcaacttcggggacaccgaagaggccaagaaacagatcaacgattasgtggagaagggtactcaagggaaaattgtggatttggtcaaggagcttgacagagacacagtttttgctctggtgaattacatcttctttaaaggtaagg

SEQ ID NO: 34260 - DNA, 201 bp, Homo sapiens
ttagagtgggggtcattgtgcagatgggaaaacaaaggcccagagaggggaagaaatgcccaggagctaccgagggcaggcgacctcaaccacagcccagygctggagctgtgagtggatgtagagcagcggaatatccattcagccagctcaggggaaggacaggggccctgaagccaggggatggagctgcagggaagg

SEQ ID NO: 34261 - DNA, 201 bp, Homo sapiens
agcatcaggaggggctttctgggcacacccagtacccgtctctgagctttccttgaactgttgcattttaatcctcacagcagctcaacaaggtacatacmgtcaccatccccattttacagatagggaaattgaggctcggagcggttaaacaactcacctgaggcctcacagccagtaagtgggttccctggtctgaat

SEQ ID NO: 34262 - DNA, 201 bp, Homo sapiens
gcttttaggagtgcagggtgctgcctctgatagaagggccaggagagagcaggttttggagtcctgatgttataaggaacagcttgggaggcataatgaayccaacatgatgcttgagaccaatgtcacagcccaattctgacattcatcatctgagatctgaggacacagctgtctcagttcatgatctgagtgctggga

SEQ ID NO: 34263 - DNA, 201 bp, Homo sapiens
ctggtagagccccaaggtggaggcataaatgggactggtgaatgacagaaggggcaaaaatgcactcatccattcactctgcaagtatctacggcacgtaygccagctcccaagcaggtttgcgggttgcacagcgggcgatgcaatctgatttaggcttttaaagggattgcaatcaagtggggccccactagcctcaac

SEQ ID NO: 34264 - DNA, 201 bp, Homo sapiens
cgtacaccatggggtacttggccagatggcgactttctcctctccagtcgccctcccaggcactagcttttaggagtgcagggtgctgcctctgatagaarggccaggagagagcaggttttggagtcctgatgttataaggaacagcttgggaggcataatgaacccaacatgatgcttgagaccaatgtcacagcccaa

SEQ ID NO: 34265 - DNA, 201 bp, Homo sapiens
aaccctgtacctcccctcccctccacccccagcagtctccaaaggcctccaacaaccccagagtgggggccatgtatccaaagaaactccaagctgtatayggatcacactggttttccaggagcaaaaacagaaacaggcctgaggctggtcaaaattgaacctcctcctgctctgagcagcctggggggcagactaagc

SEQ ID NO: 34266 - DNA, 201 bp, Homo sapiens
gacagggccctgtctcctcagcttcaggcaccaccactgacctgggacagtgaatcgtaagtatgcctttcactgcgaggggttctggagaggcttctgarctccccatggcccaggcaggcagcaggtctggggcaggaggggggttgtggagtgggtatccgcctgctgaggtgcagggcagatggagaggctgcagct

SEQ ID NO: 34267 - DNA, 201 bp, Homo sapiens
aggaacagacctgtgccaggcctcagccttacatcaaaatgggcctccccatgcaccgtggacctctgggccctcctgtcccagtggaggacaggaagctrtgaggggcactgtcacccagggctcaagctggcattcctgaataatcgctctgcaccaggccacggctaagctcagtgcgtgattaagcctcataaccct

SEQ ID NO: 34268 - DNA, 201 bp, Homo sapiens
ggctcaggcacctggctccagtccccaaactcttgaacctggccctagtgtcactgtttctcttgggtctcaggcgctggatggggaacaggaaacctggrctggacttgaggcctctctgatgctcggtgacttcagacagttgctcaacctctctgttctcttgggcaaaacatgataacctttgacttctgtcccctc

SEQ ID NO: 34269 - DNA, 201 bp, Homo sapiens
acttcctcagtccatatgggatcacgataaacaactccatcctccaggaccacactgcatcaacctgctgtgccctaacatcagctgaaggccaagctgcrgggcaccctgggtgttccaagtcactttccctctgcaggcaggaacctcatcctgctctgaaacagatgagagggaaacgcagaaaacagcttccagctc

SEQ ID NO: 34270 - DNA, 201 bp, Homo sapiens
catttactcactgtagcagcactgcgatgtgtgagtatatctgctgtgctcttaaactccaaatctgaggaaactgaggctcagagaggctactggtctcycacaatgtcacacagctcataagtggcaaagctggcttgatgggctacttgttcctctgaaccataccacctcaccacactctccccttcgagggtcacg

SEQ ID NO: 34271 - DNA, 201 bp, Homo sapiens
gctagtaagacctgcctttgagttggtatgatgttcaagttagataacaaaatgtttatacccattagaacagagaataaatagaactacatttcttgcayttatgagctttctgtgaatcagacatccctatgaagtacctcccctggctgtttctcatttactcactgtagcagcactgcgatgtgtgagtatatctgc

SEQ ID NO: 34272 - DNA, 201 bp, Homo sapiens; identical to SEQ ID NO: 7081

SEQ ID NO: 34273 - DNA, 201 bp, Homo sapiens; identical to SEQ ID NO: 7083

SEQ ID NO: 34274 - DNA, 201 bp, Homo sapiens; identical to SEQ ID NO: 7085

SEQ ID NO: 34275 - DNA, 201 bp, Homo sapiens
ctctccaggcaaatgggagagaccctttgaagtcaaggacaccgaggaagaggacttccacgtggaccaggcgaccaccgtgaaggtgcctatgatgaagygtttaggcatgtttaacatccagcactgtaagaagctgtccagctgggtgctgctgatgaaatacctgggcaatgccaccgccatcttcttcctgcctga

SEQ ID NO: 34276 - DNA, 201 bp, Homo sapiens; identical to SEQ ID NO: 7089

SEQ ID NO: 34277 - DNA, 201 bp, Homo sapiens; identical to SEQ ID NO: 7093

SEQ ID NO: 34278 - DNA, 201 bp, Homo sapiens; identical to SEQ ID NO: 7095

SEQ ID NO: 34279 - DNA, 201 bp, Homo sapiens
ggtgtatggccttttgtggtgtctgtgtggtccaggaagagaggggctgcaccgtgtgtgtgtgtgtgtgtgtgtgtgtgtgtgtgtgtgtgtgtgtgtgwttgtgtgtgtgcatctgagtatccgtgtctctgtgtgatgctatatgtcaatgtgtctttgtgtgtgtgtgtgtgtgtgtgtctctgtgtgttggcatgt

SEQ ID NO: 34280 - DNA, 201 bp, Homo sapiens
tgatgcccaccttcccctctctccaggcaaatgggagagaccctttgaagtcaaggacaccgaggaagaggacttccacgtggaccaggcgaccaccgtgwaggtgcctatgatgaagcgtttaggcatgtttaacatccagcactgtaagaagctgtccagctgggtgctgctgatgaaatacctgggcaatgccaccgc

SEQ ID NO: 34281 - DNA, 201 bp, Homo sapiens
tgaccaaggccaaggtggccagtttcctatagaacgcctctaaaagacctgcagcaatagcagcaagaactggtattctcgagaacttgctgcgcagcagkcacttcttggcattttatgtgtatttaatttcacaatagctctatgacaaagtccacctttctcatctccaggaaactgaggttcagagaggttaagtaa

SEQ ID NO: 34282 - DNA, 201 bp, Homo sapiens
ttggtttcttcatctgtaaaagaaggatattagcattagcacctcacgggattgttacaagaaagcaatgaattaacacatgtgagcacggagaacagtgyttggcatatggtaagcactacgtacattttgctattcttctgattctttcagtgttactgatgtcggcaagtacttggcacaggctggtttaataatccc

SEQ ID NO: 34283 - DNA, 201 bp, Homo sapiens
cgtttaggcatgtttaacatccagcactgtaagaagctgtccagctgggtgctgctgatgaaatacctgggcaatgccaccgccatcttcttcctgcctgwtgaggggaaactacagcacctggaaaatgaactcacccacgatatcatcaccaagttcctggaaaatgaagacagaaggtgattccccaacctgagggtg

SEQ ID NO: 34284 - DNA, 201 bp, Homo sapiens
ggtttatttattgcccagttcaacaggttgtttgaccataggcgagattctcttccctgcaccctgccgggttgctcttggtcccttattttatgctcccrggtagaaatggtgtgagattaggcagggagtggctcgcttccctgtccctggccccgcaaagagtgctcccacctgccccgatcccagaaatgtcaccat

SEQ ID NO: 34285 - DNA, 201 bp, Homo sapiens
gcaaagagtgctcccacctgccccgatcccagaaatgtcaccatgaagccttcattcttttggtttaaagcttggcctcagtgtccgtacaccatggggtmcttggccagatggcgactttctcctctccagtcgccctcccaggcactagcttttaggagtgcagggtgctgcctctgatagaagggccaggagagagca

SEQ ID NO: 34286 - DNA, 201 bp, Homo sapiens
tggcgactttctcctctccagtcgccctcccaggcactagcttttaggagtgcagggtgctgcctctgatagaagggccaggagagagcaggttttggagwcctgatgttataaggaacagcttgggaggcataatgaacccaacatgatgcttgagaccaatgtcacagcccaattctgacattcatcatctgagatctg

SEQ ID NO: 34287 - DNA, 201 bp, Homo sapiens
acagtaaagccataaggagttaagtaacttgtccacagtaaactgagcctagctctaactctcccaaatctcataatcttgccatagtctacactatttcrggtggtgtcagggccatcattttttccagagcccttaaaataaggaaggagacccccaaaagtcttatgtggggatgttagtgtgtgtatgcacatgtgt

SEQ ID NO: 34288 - DNA, 201 bp, Homo sapiens
atttccataagccatgaaggactgcacaaagttcagttgggaagtgaaagagaaattaaagggagatggaaatatacagcactaattttagcaccgtcttyagttctaacaacactagctagctgaagaaaaatacaaacatgtattatgtaatgtgtggtctgttccatttggattacttagaggcacgagggccaggag

SEQ ID NO: 34289 - DNA, 201 bp, Homo sapiens
taaaataaggaaggagacccccaaaagtcttatgtggggatgttagtgtgtgtatgcacatgtgtgcaaactgtttgtcttcagcaccctaagtgccttgycctgccctccctggtaaacctgagggctccatcccaagagagcagggcacttctccaagtgtgtcctcagctccctgaatcccatccacacagcttccag

SEQ ID NO: 34290 - DNA, 201 bp, Homo sapiens; identical to SEQ ID NO: 7106

SEQ ID NO: 34291 - DNA, 201 bp, Homo sapiens
tgaaagagtaaggaaatactatttattcaaccaggcactttctgtaatcctcactgcagccccaccatgtcaggactatcatctccattccacagataaargagatgaagtcgctggctctgggttcttggtggttaatggcagatctgggatttgaactatgtccaacttcttttccacttaattcctggaatccttcca

SEQ ID NO: 34292 - DNA, 201 bp, Homo sapiens
tagaactatagaacaaattgtaatacactgcataaagggatagtttcatggaacatactttacacgactctagtgtcccagaatcagtatcagttttgcartctgaaagacctgggttcaaatcctgcctctaacacaattagcttttgacaaaaacaatgcattctacctctttgaggtgctaatttctcatcttagcat

SEQ ID NO: 34293 - DNA, 201 bp, Homo sapiens; identical to SEQ ID NO: 7054

SEQ ID NO: 34294 - DNA, 201 bp, Homo sapiens
cgggaggcattgatagaaagaggactttgtggatgggagaatttgctctgtcttgctcagaatggcggttacacagatgcacacacatgtaaaaatgtatygagctgtgtatttaggagttacagttttactacatgcaaataacacgtccataaaaagtaaatcgataaagacagggaagggatggtggcacaggggaga

SEQ ID NO: 34295 - DNA, 201 bp, Homo sapiens
ggcatacagcaggtgatggactcttctgtatctcaggctgccttcctgcccctgaggggttaaaatgccagggtcctgggggccccagggcattctaagcyagctcccactgtcccaggaaaacagcataggggaggggaggtgggaggcaaggccaggggctgcttcctccactctgaggctcccttgctcttgaggcaa

SEQ ID NO: 34296 - DNA, 201 bp, Homo sapiens
atgacccttgattaactcagttcatgaagcaacctttgatcacctattctgtgctcagtacaaagccacagagatggaaaaaacacagtccctgccctccrgttacttgcagcctggtgatgccaccgagctttggggtcatgcgcctcacagcctggttagaatctgccctccaccacttgccagctctgtgacccaggg

SEQ ID NO: 34297 - DNA, 201 bp, Homo sapiens
gccaggcacagtggctcacacctgtaattccagcactttgggaggccgaggcgggcagataacttgaggccaggagtttgagaccagcctggccaacatgstgaaaccctgtcactactaaaaatacaaaaattaactggaattggtagcacatgcctgtaatgccagctactctggaggctgaggcacgagaatcgctcg

SEQ ID NO: 34298 - DNA, 201 bp, Homo sapiens
aacacacaggaagtggctcaggagattacacacagaaggaaagtgtgtctgctggggttttgcaagttggctaatttgaaaggtgactggaggaggtgaamaaatggtgcaaacttcattcattcattaaatgagttataagaagacagacacaagtgtccattatgctaacagagctctgtgttaaacaccccaccagca

SEQ ID NO: 34299 - DNA, 201 bp, Homo sapiens
agcctcagaagagctatgtgggaaagaaacttttatccctattttatagatgaggaaaccaaggctcagagaactgagggcctcccccggatccaagtccrcctagctgcagtcaccccacatcctctgcatgtcacaggtgctcagaaagatgctgaaggcacctggcccttcaccttcggaaagccaaaatgagcacgg

SEQ ID NO: 34300 - DNA, 201 bp, Homo sapiens
cgagggatgtgtgtcgtcaagggggctcagggcttctcagggaggggactcatggtttctttattctgctacactcttccaaaccttcactcacccctggkgatgcccaccttcccctctctccaggcaaatgggagagaccctttgaagtcaaggacaccgaggaagaggacttccacgtggaccaggcgaccaccgtga

SEQ ID NO: 34301 - DNA, 201 bp, Homo sapiens
aaagccccagctccccactgcaatcccttctgcacccagccaggtcctatgacacacacctccccagtgcacacagacctgcccaactgtggggctgcccrctgggcatttcataggtggctcagtcctcttccctctgcagctggccccagaaacctgccagttattggtgccaggtctgtgccaggagggcgaggcctg

SEQ ID NO: 34302 - DNA, 201 bp, Homo sapiens
ttggaggggcggcaacctcctgccagccttcaggccactctcctgtgcctgccagaagagacagagcttgaggagagcttgaggagagcaggaaaggtggracattgctgctgctgctcactcagttccacaggtgggagggacagcagggcttagagtgggggtcattgtgcagatgggaaaacaaaggcccagagaggg

SEQ ID NO: 34303 - DNA, 201 bp, Homo sapiens
cctgtgcctgccagaagagacagagcttgaggagagcttgaggagagcaggaaaggtgggacattgctgctgctgctcactcagttccacaggtgggaggracagcagggcttagagtgggggtcattgtgcagatgggaaaacaaaggcccagagaggggaagaaatgcccaggagctaccgagggcaggcgacctcaac

SEQ ID NO: 34304 - DNA, 201 bp, Homo sapiens
gctccatcccaagagagcagggcacttctccaagtgtgtcctcagctccctgaatcccatccacacagcttccagtacctgagcctaagtcgcttcacagrgtcttccctatctgcttcccacgtagccccgctggagaacagaggtagagggaagagggcagagaagtccagaacacacacgtcctcattgtttgctagg

SEQ ID NO: 34305 - DNA, 201 bp, Homo sapiens
agaggtggagtttgcagtaagccaagattgcgccactgtactccagcctgggtgactgagtgagactctgtctcaaaaaaaaaaaaaaaaagaagaagctrtgagtaggccacatagttccagaaaatgcagaaatcccccctcccctccccaacacacaggaagtggctcaggagattacacacagaaggaaagtgtgtc

SEQ ID NO: 34306 - DNA, 201 bp, Homo sapiens; identical to SEQ ID NO: 7062

SEQ ID NO: 34307 - DNA, 201 bp, Homo sapiens; identical to SEQ ID NO: 7063

SEQ ID NO: 34308 - DNA, 201 bp, Homo sapiens; identical to SEQ ID NO: 7065

SEQ ID NO: 34309 - DNA, 201 bp, Homo sapiens; identical to SEQ ID NO: 7064

SEQ ID NO: 34310 - DNA, 201 bp, Homo sapiens
gcctggttagaatctgccctccaccacttgccagctctgtgacccagggctaggtgctcgacgtctatgaacctcagtttcctcatctgtaaaatgggatracagaaatatcgacttcataggcttgatgtgaggacgaggagttaatctgtaaccaatgcttggaatggctctggcatgagccacgtgctcactgttacc

SEQ ID NO: 34311 - DNA, 201 bp, Homo sapiens; identical to SEQ ID NO: 7075

SEQ ID NO: 34312 - DNA, 201 bp, Homo sapiens
taatcccagctatttgggaagctgagacagaagaatttcttgaacccgggaggtggaggtttcagtgagccgagatcacgccactgcactccaccctggcrgataaagcgagactctgtctcaaaaaaaacccaaaaacctatgttagtgtacagagggccccagtgaagtcttctcccagccccactttgcacaactggg

SEQ ID NO: 34313 - DNA, 201 bp, Homo sapiens; identical to SEQ ID NO: 7078

SEQ ID NO: 34314 - DNA, 201 bp, Homo sapiens; identical to SEQ ID NO: 7079

SEQ ID NO: 34315 - DNA, 201 bp, Homo sapiens
tgtcgggggctcctgtctgttgtctcctataagcctcaccacctctcctactgcttgggcatgcatctttctccccttctatagatgaggaggttaaggtycagagaggggtggggaggaacgccggctcacattctccatcccctccagatatgaccaggaacagacctgtgccaggcctcagccttacatcaaaatggg

SEQ ID NO: 34316 - DNA, 201 bp, Homo sapiens
caggcacctggctccagtccccaaactcttgaacctggccctagtgtcactgtttctcttgggtctcaggcgctggatggggaacaggaaacctgggctgracttgaggcctctctgatgctcggtgacttcagacagttgctcaacctctctgttctcttgggcaaaacatgataacctttgacttctgtcccctcccct

SEQ ID NO: 34317 - DNA, 201 bp, Homo sapiens
ccagttcaacaggttgtttgaccataggcgagattctcttccctgcaccctgccgggttgctcttggtcccttattttatgctcccgggtagaaatggtgygagattaggcagggagtggctcgcttccctgtccctggccccgcaaagagtgctcccacctgccccgatcccagaaatgtcaccatgaagccttcattct

SEQ ID NO: 34318 - DNA, 201 bp, Homo sapiens
gttcagagaggttaagtaacttgtccaaggtcacacagctaatagcaagttgacgtggagcaatctggcctcagagcctttaattttagccacagactgaygctcccctcttcatttagccaggctgcctctgaagttttctgattcaagacttctggcttcagctttgtacacagagatgattcaatgtcaggttttgga

SEQ ID NO: 34319 - DNA, 201 bp, Homo sapiens; identical to SEQ ID NO: 7086

SEQ ID NO: 34320 - DNA, 201 bp, Homo sapiens; identical to SEQ ID NO: 7091

SEQ ID NO: 34321 - DNA, 201 bp, Homo sapiens
gaccataggcgagattctcttccctgcaccctgccgggttgctcttggtcccttattttatgctcccgggtagaaatggtgtgagattaggcagggagtgrctcgcttccctgtccctggccccgcaaagagtgctcccacctgccccgatcccagaaatgtcaccatgaagccttcattcttttggtttaaagcttggcc

SEQ ID NO: 34322 - DNA, 201 bp, Homo sapiens
ctcacccctggtgatgcccaccttcccctctctccaggcaaatgggagagaccctttgaagtcaaggacaccgaggaagaggacttccacgtggaccaggygaccaccgtgaaggtgcctatgatgaagcgtttaggcatgtttaacatccagcactgtaagaagctgtccagctgggtgctgctgatgaaatacctgggc

SEQ ID NO: 34323 - DNA, 201 bp, Homo sapiens; identical to SEQ ID NO: 7098

SEQ ID NO: 34324 - DNA, 201 bp, Homo sapiens; identical to SEQ ID NO: 7100

SEQ ID NO: 34325 - DNA, 201 bp, Homo sapiens
agaggaatgctgtgccatgccttgaatttcttttctgcacgacaggtctgccagcttacatttacccaaactgtccattactggaacctatgatctgaagwgcgtcctgggtcaactgggcatcactaaggtcttcagcaatggggctgacctctccggggtcacagaggaggcacccctgaagctctccaaggtgagatc

SEQ ID NO: 34326 - DNA, 201 bp, Homo sapiens
gaggacagggccctgtctcctcagcttcaggcaccaccactgacctgggacagtgaatcgtaagtatgcctttcactgcgaggggttctggagaggcttcygagctccccatggcccaggcaggcagcaggtctggggcaggaggggggttgtggagtgggtatccgcctgctgaggtgcagggcagatggagaggctgca

SEQ ID NO: 34327 - DNA, 201 bp, Homo sapiens
cagtatcactgggacaaggtcagggtgtcaggaaagccgagtgtccttggaggctctaggggatgtgccacttcttcctcttccaatttctggtggctgcyggcattccttgacttgttgcccctccagtcacggcctctgttgtcacactgccccctctttctccatctgtgtcaggtctccctccccctccccctcagg

SEQ ID NO: 34328 - DNA, 201 bp, Homo sapiens; identical to SEQ ID NO: 7057

SEQ ID NO: 34329 - DNA, 201 bp, Homo sapiens
ctagtagttaacaatgtggctgccgggcatattctcctcagctaggacctcagttttcccatctgtgaagacggcaggttctacctagggggctgcaggcwggtggtccgaagcctgggcatatctggagtagaaggatcactgtggggcagggcaggttctgtgttgctgtggatgacgttgactttgaccattgctcgg

SEQ ID NO: 34330 - DNA, 201 bp, Homo sapiens; identical to SEQ ID NO: 7058

SEQ ID NO: 34331 - DNA, 201 bp, Homo sapiens
tttcccttctgtgcagcagtttccctggccactaaatagtgggattagatagaagccctccaagggcttccagcttgacatgattcttgattctgatctgrcccgattcctggataatcgtgggcaggcccattcctcttcttgtgcctcattttcttcttttgtaaaacaatggctgtaccatttgcatcttagggtcat

SEQ ID NO: 34332 - DNA, 201 bp, Homo sapiens
cactaaggtcttcagcaatggggctgacctctccggggtcacagaggaggcacccctgaagctctccaaggtgagatcaccctgacgaccttgttgcaccmtggtatctgtagggaagaatgtgtgggggctgcagctctgtcctgaggctgaggaaggggccgagggaaacaaatgaagacccaggctgagctcctgaag

SEQ ID NO: 34333 - DNA, 201 bp, Homo sapiens
ccgctcacaccagaccctgctcagggtggcattgtctccccatggaaaaccagagaggagcactcagcctggtgtggtcactcttctcttatccactaaayggttgtcactgggcactgccaccagccccgtgtttctctgggtgtagggccctggggatgttacaggctgggggccaggtgacccaacactacagggcaa

SEQ ID NO: 34334 - DNA, 201 bp, Homo sapiens
gtttaggcatgtttaacatccagcactgtaagaagctgtccagctgggtgctgctgatgaaatacctgggcaatgccaccgccatcttcttcctgcctgaygaggggaaactacagcacctggaaaatgaactcacccacgatatcatcaccaagttcctggaaaatgaagacagaaggtgattccccaacctgagggtga

SEQ ID NO: 34335 - DNA, 201 bp, Homo sapiens
ttcctgggaggtgtccacgtgagccttgctcgaggcctgggatcagccttacaacgtgtctctgcttctctcccctccaggccgtgcataaggctgtgctkaccatcgacgagaaagggactgaagctgctggggccatgtttttagaggccatacccatgtctatcccccccgaggtcaagttcaacaaaccctttgtct

SEQ ID NO: 34336 - DNA, 201 bp, Homo sapiens
  misc_feature (1)...(201): n = A,T,C or G, or insertion/deletion polymorphism (see Tables 1-2)
tcattgcagatgtaagtgttgctgtccagagcctgggtgcaggacctagatgtaggattctggttctgctacttcctcagtgacattgaatagctgacctnatctctctggctttggtttcttcatctgtaaaagaaggatattagcattagcacctcacgggattgttacaagaaagcaatgaattaacacatgtgagca

SEQ ID NO: 34337 - DNA, 201 bp, Homo sapiens
gcctcggcgccctcacctgcaagacaggtaaaataaaactcctaggttactttcatgaataatatgcaaagcatcaccctaaaaaagtgctgctacttaawtgaccaccaaacattaatgaatactgtggattccaaaaatattagttaatgtgagtggtgtggctaccttcccccagtgccccgtgctctgtcagggaac

SEQ ID NO: 34338 - DNA, 201 bp, Homo sapiens
gaggcctgggatcagccttacaacgtgtctctgcttctctcccctccaggccgtgcataaggctgtgctgaccatcgacgagaaagggactgaagctgctkgggccatgtttttagaggccatacccatgtctatcccccccgaggtcaagttcaacaaaccctttgtcttcttaatgattgaacaaaataccaagtctcc

SEQ ID NO: 34339 - DNA, 201 bp, Homo sapiens
tcccctccaggccgtgcataaggctgtgctgaccatcgacgagaaagggactgaagctgctggggccatgtttttagaggccatacccatgtctatccccyccgaggtcaagttcaacaaaccctttgtcttcttaatgattgaacaaaataccaagtctcccctcttcatgggaaaagtggtgaatcccacccaaaaata

SEQ ID NO: 34340 - DNA, 201 bp, Homo sapiens
actccaagctgtatacggatcacactggttttccaggagcaaaaacagaaacaggcctgaggctggtcaaaattgaacctcctcctgctctgagcagcctrgggggcagactaagcagagggctgtgcagacccacataaagagcctactgtgtgccaggcacttcacccgaggcacttcacaagcatgcttgggaatgaa

SEQ ID NO: 34341 - DNA, 201 bp, Homo sapiens
gctgctcactcagttccacaggtgggagggacagcagggcttagagtgggggtcattgtgcagatgggaaaacaaaggcccagagaggggaagaaatgccyaggagctaccgagggcaggcgacctcaaccacagcccagtgctggagctgtgagtggatgtagagcagcggaatatccattcagccagctcaggggaagg

SEQ ID NO: 34342 - DNA, 201 bp, Homo sapiens
tgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccaggtacaatgactcctttcggtaagtgcagtggaagctgtacactgc

SEQ ID NO: 34343 - DNA, 201 bp, Homo sapiens
gtgagcgcttcctgggaggtgtccacgtgagccttgctcgaggcctgggatcagccttacaacgtgtctctgcttctctcccctccaggccgtgcataagrctgtgctgaccatcgacgagaaagggactgaagctgctggggccatgtttttagaggccatacccatgtctatcccccccgaggtcaagttcaacaaacc

SEQ ID NO: 34344 - DNA, 201 bp, Homo sapiens
aggaggtaaaggtctcgtccctggggacttcccactccagtgtggacactgtcccttcccaatatccagtgcccagggcagggacagcagcaccaccacaygttctggcagaaccaaaaaggaacagatgggcttcctggcaaaggcagcagtggagtgtggagttcaagggtagaatgtccctggggggacgggggaaga

SEQ ID NO: 34345 - DNA, 201 bp, Homo sapiens
aggtgtatggccttttgtggtgtctgtgtggtccaggaagagaggggctgcaccgtgtgtgtgtgtgtgtgtgtgtgtgtgtgtgtgtgtgtgtgtgtgtgattgtgtgtgtgcatctgagtatccgtgtctctgtgtgatgctatatgtcaatgtgtctttgtgtgtgtgtgtgtgtgtgtgtctctgtgtgttggcatg

SEQ ID NO: 34346 - DNA, 201 bp, Homo sapiens
ctctgcttctctcccctccaggccgtgcataaggctgtgctgaccatcgacgagaaagggactgaagctgctggggccatgtttttagaggccatacccakgtctatcccccccgaggtcaagttcaacaaaccctttgtcttcttaatgattgaacaaaataccaagtctcccctcttcatgggaaaagtggtgaatccc

SEQ ID NO: 34347 - DNA, 201 bp, Homo sapiens
gtcacagaggaggcacccctgaagctctccaaggtgagatcaccctgacgaccttgttgcaccctggtatctgtagggaagaatgtgtgggggctgcagcwctgtcctgaggctgaggaaggggccgagggaaacaaatgaagacccaggctgagctcctgaagatgcccgtgattcactgacacgggacgtggtcaaaca

SEQ ID NO: 34348 - DNA, 201 bp, Homo sapiens
atgaggaggacagtacccaggggtgaggaggtaaaggtctcgtccctggggacttcccactccagtgtggacactgtcccttcccaatatccagtgcccarggcagggacagcagcaccaccacacgttctggcagaaccaaaaaggaacagatgggcttcctggcaaaggcagcagtggagtgtggagttcaagggtaga

SEQ ID NO: 34349 - DNA, 201 bp, Homo sapiens
caggtgtatggccttttgtggtgtctgtgtggtccaggaagagaggggctgcaccgtgtgtgtgtgtgtgtgtgtgtgtgtgtgtgtgtgtgtgtgtgtgtgattgtgtgtgtgcatctgagtatccgtgtctctgtgtgatgctatatgtcaatgtgtctttgtgtgtgtgtgtgtgtgtgtgtctctgtgtgttggcat

SEQ ID NO: 34350 - DNA, 201 bp, Homo sapiens
tcaggtgtatggccttttgtggtgtctgtgtggtccaggaagagaggggctgcaccgtgtgtgtgtgtgtgtgtgtgtgtgtgtgtgtgtgtgtgtgtgtgtgattgtgtgtgtgcatctgagtatccgtgtctctgtgtgatgctatatgtcaatgtgtctttgtgtgtgtgtgtgtgtgtgtgtctctgtgtgttggca

SEQ ID NO: 34351 - DNA, 201 bp, Homo sapiens
agttcaggcagcgccatccatgctccatgaggaggacagtacccaggggtgaggaggtaaaggtctcgtccctggggacttcccactccagtgtggacacygtcccttcccaatatccagtgcccagggcagggacagcagcaccaccacacgttctggcagaaccaaaaaggaacagatgggcttcctggcaaaggcagc

SEQ ID NO: 34352 - DNA, 201 bp, Homo sapiens
gtcaggtgtatggccttttgtggtgtctgtgtggtccaggaagagaggggctgcaccgtgtgtgtgtgtgtgtgtgtgtgtgtgtgtgtgtgtgtgtgtgtgtgattgtgtgtgtgcatctgagtatccgtgtctctgtgtgatgctatatgtcaatgtgtctttgtgtgtgtgtgtgtgtgtgtgtctctgtgtgttggc

SEQ ID NO: 34353 - DNA, 201 bp, Homo sapiens
cacgtgagccttgctcgaggcctgggatcagccttacaacgtgtctctgcttctctcccctccaggccgtgcataaggctgtgctgaccatcgacgagaargggactgaagctgctggggccatgtttttagaggccatacccatgtctatcccccccgaggtcaagttcaacaaaccctttgtcttcttaatgattgaac

SEQ ID NO: 34354 - DNA, 201 bp, Homo sapiens
ctcccctcttcatttagccaggctgcctctgaagttttctgattcaagacttctggcttcagctttgtacacagagatgattcaatgtcaggttttggagygaaatctgtttaatcccagacaaaacatttaggattacatctcagttttgtaagcaagtagctctgtgatttttagtgagttatttaatgctctttgggg

SEQ ID NO: 34355 - DNA, 201 bp, Homo sapiens
gcttccagaatgaggccaccactgagttcaggcagcgccatccatgctccatgaggaggacagtacccaggggtgaggaggtaaaggtctcgtccctgggracttcccactccagtgtggacactgtcccttcccaatatccagtgcccagggcagggacagcagcaccaccacacgttctggcagaaccaaaaaggaaca

SEQ ID NO: 34356 - DNA, 201 bp, Homo sapiens
ctgggaggtgtccacgtgagccttgctcgaggcctgggatcagccttacaacgtgtctctgcttctctcccctccaggccgtgcataaggctgtgctgacsatcgacgagaaagggactgaagctgctggggccatgtttttagaggccatacccatgtctatcccccccgaggtcaagttcaacaaaccctttgtcttct

SEQ ID NO: 34357 - DNA, 201 bp, Homo sapiens
gaaccccacatccctgggtcactgctactctgtataaacttggcttccagaatgaggccaccactgagttcaggcagcgccatccatgctccatgaggagracagtacccaggggtgaggaggtaaaggtctcgtccctggggacttcccactccagtgtggacactgtcccttcccaatatccagtgcccagggcaggga

SEQ ID NO: 34358 - DNA, 201 bp, Homo sapiens
agggggagtgagcgcttcctgggaggtgtccacgtgagccttgctcgaggcctgggatcagccttacaacgtgtctctgcttctctcccctccaggccgtscataaggctgtgctgaccatcgacgagaaagggactgaagctgctggggccatgtttttagaggccatacccatgtctatcccccccgaggtcaagttca

SEQ ID NO: 34359 - DNA, 201 bp, Homo sapiens; identical to SEQ ID NO: 7094

SEQ ID NO: 34360 - DNA, 201 bp, Homo sapiens
ccaattaacaaggggcagggagccttagacagaaggtaccaaatatgcctgatgctccaacattttatttgtaatatccaagacaccctcaaataaacatrtgattccaataaaaatgcacagccacgatggcatctcttagcctgacatcgccacgatgtagaaattctgcatcttcctctagttttgaattatccccac

SEQ ID NO: 34361 - DNA, 201 bp, Homo sapiens
gatccactgcttaaatacggacgaggacagggccctgtctcctcagcttcaggcaccaccactgacctgggacagtgaatcgtaagtatgcctttcactgygaggggttctggagaggcttctgagctccccatggcccaggcaggcagcaggtctggggcaggaggggggttgtggagtgggtatccgcctgctgaggtg

SEQ ID NO: 34362 - DNA, 201 bp, Homo sapiens
ttccatcgggaccatcaagagggtgtttgtgtctaaggctgactgggtaactttggatgagcggtctctccgctctgagcctgtttcctcatctgtcaaaygggctctaacccactctgatctcccagggcggcagtaagtcttcagcatcaggcattttggggtgactcagtaaatggtagatcttgctaccagtggaac

SEQ ID NO: 34363 - DNA, 201 bp, Homo sapiens
ccactctgaggctcccttgctcttgaggcaaaggagggcagtggagagcagccaggctgcagtcagcacagctaaagtcctggctctgctgtggccttagkgggggcccaggtccctctccagccccagtctcctccttctgtccaatgagaaagctgggatcaggggtccctgaggcccctgtccactctgcatgcctcg

SEQ ID NO: 34364 - DNA, 201 bp, Homo sapiens
tccactctgaggctcccttgctcttgaggcaaaggagggcagtggagagcagccaggctgcagtcagcacagctaaagtcctggctctgctgtggccttastgggggcccaggtccctctccagccccagtctcctccttctgtccaatgagaaagctgggatcaggggtccctgaggcccctgtccactctgcatgcctc

SEQ ID NO: 34365 - DNA, 201 bp, Homo sapiens
agatgagagggaaacgcagaaaacagcttccagctcagccaggaaccttagagtcctgaccttttacctcgcctaggagtttgcaggggagagaacacacraatttcagattttaagcctaaataaaggaagccttagtttgaagtgcaagctctgccggacagggggcaccctgtgagccccatttgttaagaggacaat

SEQ ID NO: 34366 - DNA, 201 bp, Homo sapiens
gagggaaacgcagaaaacagcttccagctcagccaggaaccttagagtcctgaccttttacctcgcctaggagtttgcaggggagagaacacacgaatttyagattttaagcctaaataaaggaagccttagtttgaagtgcaagctctgccggacagggggcaccctgtgagccccatttgttaagaggacaatagtcag

SEQ ID NO: 34367 - DNA, 201 bp, Homo sapiens; identical to SEQ ID NO: 7055

SEQ ID NO: 34368 - DNA, 201 bp, Homo sapiens; identical to SEQ ID NO: 7056

SEQ ID NO: 34369 - DNA, 201 bp, Homo sapiens
agggaaacgcagaaaacagcttccagctcagccaggaaccttagagtcctgaccttttacctcgcctaggagtttgcaggggagagaacacacgaatttcrgattttaagcctaaataaaggaagccttagtttgaagtgcaagctctgccggacagggggcaccctgtgagccccatttgttaagaggacaatagtcaga

SEQ ID NO: 34370 - DNA, 201 bp, Homo sapiens
tgccggacagggggcaccctgtgagccccatttgttaagaggacaatagtcagagagcttccaggctctcacaccagaaacaggaaatacagatttcacaytgatctccttcccaggagcaacttgatcctctccataaatccgagcgggaagcatttatccaaacaacaaacaagcaaacatgagctgtgtatgggggat

SEQ ID NO: 34371 - DNA, 201 bp, Homo sapiens
tgtgctcctcccagctgtcaccccctcgccaccctccctgcaccagcctctccacctcctttgagcccagaattcccctgtctaggagggcacctgtctcrtgcctagccatgggaattctccatctgttttgctacattgaacccagatgccattctaaccaagaatcctggctgggtgcaggggctctcgcctgtaacc

SEQ ID NO: 34372 - DNA, 201 bp, Homo sapiens
ccagagggctgaggagggtgaaccccacatccctgggtcactgctactctgtataaacttggcttccagaatgaggccaccactgagttcaggcagcgccrtccatgctccatgaggaggacagtacccaggggtgaggaggtaaaggtctcgtccctggggacttcccactccagtgtggacactgtcccttcccaatat

SEQ ID NO: 34373 - DNA, 201 bp, Homo sapiens
aacaagcaaacatgagctgtgtatgggggatagagagaatgaaacccaggtccatcccggggagaatgctggtctatggcagtggggagcagtgaataaakgaggcgtacatccatggatctgggtggagagggtcagggtgtaacccaggacctttccagaggcatgagaaacagtcagcctacacccacagatgacctc

SEQ ID NO: 34374 - DNA, 201 bp, Homo sapiens
atcagtatcagttttgcaatctgaaagacctgggttcaaatcctgcctctaacacaattagcttttgacaaaaacaatgcattctacctctttgaggtgcyaatttctcatcttagcatggacaaaataccattcttgctgtcaggtttttttaggattaaacaaatgacaaagactgtggggatggtgtgtggcatacag

SEQ ID NO: 34375 - DNA, 201 bp, Homo sapiens
tgtctgcctcagtcatgctccatttttccatcgggaccatcaagagggtgtttgtgtctaaggctgactgggtaactttggatgagcggtctctccgctcygagcctgtttcctcatctgtcaaatgggctctaacccactctgatctcccagggcggcagtaagtcttcagcatcaggcattttggggtgactcagtaaa

SEQ ID NO: 34376 - DNA, 201 bp, Homo sapiens
gttgtgtcctgtttcccagtcctgcccggtcccccctcggtacctcctggtggatacactggttcctgtaagcagaagtggatgagggtgtctaggtctgyagtcctggcaccccaggatgggggacaccagccaagatacagcaacagcaacaaagcgcagccatttctttctgtttgcacagctcctctgtctgtcggg

SEQ ID NO: 34377 - DNA, 201 bp, Homo sapiens
caacccctccctcaaaagagttgccctctcagatccttttgatgtaaggtttggtgttgagacttatttcactaaattctcatacataaacatcactttaygtatgaggcaaaatgaggaccagggagatgaatgacttgtcctggctcatacacctggaaagtgacagagtcagattagatcccaggtctatctgaagtt

SEQ ID NO: 34378 - DNA, 201 bp, Homo sapiens
gggtttatttattgcccagttcaacaggttgtttgaccataggcgagattctcttccctgcaccctgccgggttgctcttggtcccttattttatgctccygggtagaaatggtgtgagattaggcagggagtggctcgcttccctgtccctggccccgcaaagagtgctcccacctgccccgatcccagaaatgtcacca

SEQ ID NO: 34379 - DNA, 201 bp, Homo sapiens; identical to SEQ ID NO: 7076

SEQ ID NO: 34380 - DNA, 201 bp, Homo sapiens
cactgtaagaagctgtccagctgggtgctgctgatgaaatacctgggcaatgccaccgccatcttcttcctgcctgatgaggggaaactacagcacctggwaaatgaactcacccacgatatcatcaccaagttcctggaaaatgaagacagaaggtgattccccaacctgagggtgaccaagaagctgcccacacctctt

SEQ ID NO: 34381 - DNA, 201 bp, Homo sapiens
gaagcagcagaggtgaggaccccgtgtgagtcccctgtggctgccgtagctgatttagctgattaccatgagctccgtggtttccaatagaatgcattctyttacagttctggaggccagaagtccagaacagtatcactgggacaaggtcagggtgtcaggaaagccgagtgtccttggaggctctaggggatgtgccac

SEQ ID NO: 34382 - DNA, 201 bp, Homo sapiens
cccattttacagatgaggaagatggggacagagaggtgaataactggccccaaatcacacaccatccataattcgggctcaggcacctggctccagtcccyaaactcttgaacctggccctagtgtcactgtttctcttgggtctcaggcgctggatggggaacaggaaacctgggctggacttgaggcctctctgatgct

SEQ ID NO: 34383 - DNA, 201 bp, Homo sapiens
tggattgtcttctcctaccaagacccttaacgacatctgcaaggacatttcttccatagttggtaacatatctctggggggcgctgttgagcctgtagaaygccctactttaccagtgaggggatgatggggctggaagagggaaggaatgaaaggagtgtgaaggaagcgccaccaaggagagctgtggaagcccaaccc

SEQ ID NO: 34384 - DNA, 201 bp, Homo sapiens
gctccagtccccaaactcttgaacctggccctagtgtcactgtttctcttgggtctcaggcgctggatggggaacaggaaacctgggctggacttgaggcytctctgatgctcggtgacttcagacagttgctcaacctctctgttctcttgggcaaaacatgataacctttgacttctgtcccctcccctcaccccaccc

SEQ ID NO: 34385 - DNA, 201 bp, Homo sapiens
gaaaggagggtggtacctactcccttcacagggtaactgaatgagagactgcctggaggaaagctcttcaagtgtggcccaccccaccccagtgacaccagcccctgacacgggggagggagggcagcatcaggaggggctttctgggcacacccagtacccgtctctgagctttccttgaactgttgcattttaatcctc

SEQ ID NO: 34386 - DNA, 201 bp, Homo sapiens
gtgtatggccttttgtggtgtctgtgtggtccaggaagagaggggctgcaccgtgtgtgtgtgtgtgtgtgtgtgtgtgtgtgtgtgtgtgtgtgtgtgaktgtgtgtgtgcatctgagtatccgtgtctctgtgtgatgctatatgtcaatgtgtctttgtgtgtgtgtgtgtgtgtgtgtctctgtgtgttggcatgta

SEQ ID NO: 34387 - DNA, 201 bp, Homo sapiens
ggccggccccacgtcagtctttcacctgtgtgccctgtgcccactgctgatctggggcagaggaggcacagggaaagggcccaggctgctcttaaaaatcrcatctcacattgagaccgacgcatggagactgcggcagaagcagcagaggtgaggaccccgtgtgagtcccctgtggctgccgtagctgatttagctgat

SEQ ID NO: 34388 - DNA, 201 bp, Homo sapiens
tatggtaagcactacgtacattttgctattcttctgattctttcagtgttactgatgtcggcaagtacttggcacaggctggtttaataatccctaggcayttccacgtggtgtcaatccctgatcactgggagtcatcatgtgccttgactcggggcctggcccccccatctctgtcttgcaggacaatgccgtcttctg

SEQ ID NO: 34389 - DNA, 201 bp, Homo sapiens
tcagggtgtaacccaggacctttccagaggcatgagaaacagtcagcctacacccacagatgacctcaaacaccccaagtgctccttgaaaggctgaggcytttgtgttgctcttggttggattattcacaggcaatgaagtaaacaaggcacaccacaggactcagaaccagggacagcttccgcaggaacctgggtcag

SEQ ID NO: 34390 - DNA, 201 bp, Homo sapiens
atttgttaagaggacaatagtcagagagcttccaggctctcacaccagaaacaggaaatacagatttcacactgatctccttcccaggagcaacttgatcytctccataaatccgagcgggaagcatttatccaaacaacaaacaagcaaacatgagctgtgtatgggggatagagagaatgaaacccaggtccatcccgg

SEQ ID NO: 34391 - DNA, 201 bp, Homo sapiens; identical to SEQ ID NO: 7250

SEQ ID NO: 34392 - DNA, 201 bp, Homo sapiens; identical to SEQ ID NO: 7099

SEQ ID NO: 34393 - DNA, 201 bp, Homo sapiens
ggtttttcagagccaggacacatccccaaaggtcatggcctttggtggttagcattgacttggggcccatcacatgccagaggctgcccgaagtgcttaartgttattatctcattcgatcttcacagtcctgatggaagtgactcttcttagagtcttcctatctcacagatgaggaaaccgaggcacagagaggttaag

SEQ ID NO: 34394 - DNA, 201 bp, Homo sapiens; identical to SEQ ID NO: 7101

SEQ ID NO: 34395 - DNA, 201 bp, Homo sapiens
ttcagctcccatgaagtccactgttgttctcctgaccagccactcagtcttgatttacttggcccagggccactggcacacctcacccccttacccgattycttgctgcagaccccaaatctcgactctcacatccctatccagcccataccacgaggctcccatctccaggcagggccctgtggtggggcagggcctccc

SEQ ID NO: 34396 - DNA, 201 bp, Homo sapiens; identical to SEQ ID NO: 7103

SEQ ID NO: 34397 - DNA, 201 bp, Homo sapiens
cataaacatcactttatgtatgaggcaaaatgaggaccagggagatgaatgacttgtcctggctcatacacctggaaagtgacagagtcagattagatccyaggtctatctgaagttaaaagaggtgtcttttcacttcccacctcctccatctactttaaagcagcacaaacccctgctttcaaggagagatgagcgtct

SEQ ID NO: 34398 - DNA, 201 bp, Homo sapiens
tccacttaatgctaccagtcttgctttatttcatgagaatgagaatataataatatggcatacgttcatttgggggaaagattgatgtcttataacataakttataattacagaaaacatgtgagttcactgggaataaataaattttgaagataataagatactttcacttatgtcgtaatttctatgtcatttggtgta

SEQ ID NO: 34399 - DNA, 201 bp, Homo sapiens
gaataaataaattttgaagataataagatactttcacttatgtcgtaatttctatgtcatttggtgtaggatgtagagatattaacgtttacacctaactyaagtttgtcatctaagacctgaaggggttttgtctatcagctgcacccctgggtagagacacaaccttggggaaggcctcagccccatccctcgtacagc

SEQ ID NO: 34400 - DNA, 201 bp, Homo sapiens
aagattgatgtcttataacataatttataattacagaaaacatgtgagttcactgggaataaataaattttgaagataataagatactttcacttatgtcrtaatttctatgtcatttggtgtaggatgtagagatattaacgtttacacctaacttaagtttgtcatctaagacctgaaggggttttgtctatcagctgc

SEQ ID NO: 34401 - DNA, 201 bp, Homo sapiens
tgtctgcccactgctggtttctcaatctgcctccaccttctgtcccctttaatgaactgggccatgaggtgagtcagagaggataaagggagtggtaagartttgaggagagaagagagtgaggctaaaataggaaatcaggaaaagcgattcggtccccctgtccctcacatggggccaccctcttgttgcccagtgtgg

SEQ ID NO: 34402 - DNA, 201 bp, Homo sapiens
ttttttttcccagagtactttctcaagcacatcaacatgagccccctaagagacatttcacattaaaaataaaatgtctgcccactgctggtttctcaatytgcctccaccttctgtcccctttaatgaactgggccatgaggtgagtcagagaggataaagggagtggtaagaatttgaggagagaagagagtgaggcta

SEQ ID NO: 34403 - DNA, 201 bp, Homo sapiens; identical to SEQ ID NO: 7449

SEQ ID NO: 34404 - DNA, 201 bp, Homo sapiens
gatggacagatggacaataagcacctgaaaaaatgctcaacattttagccatcaaagatataagaattataaccatcacaagatgtcaccaacacttaatkggcatgggtatcattaagaagacacaacaataagtgctgtcactgatgtggagcgaggatgtgcagctctcgcatacgctggttaaagtacagtatgctg

SEQ ID NO: 34405 - DNA, 201 bp, Homo sapiens; identical to SEQ ID NO: 7425

SEQ ID NO: 34406 - DNA, 201 bp, Homo sapiens
ctagagaaggctcagggaggaggtgggaactgagctgggtttggagttgagagagctcttgacaagcaccaggaaggcaggggaagatgcggccctgcacyttctgagggggaccattaagagatgaagttgactaaagcagagactttgtgtaggtgacgggcttgggaaggtagctatggaatccagactgagcaccca

SEQ ID NO: 34407 - DNA, 201 bp, Homo sapiens
gggtgtggcctcatagctccttttgaacaggggcacaggaaggacggctttagagcattcaaaaaataactttgccaaaataataataataataatagaarggaagaagaggctgagcatggtggctcacacctgtaatccctacactttgggaggctgagacaagcagatcacctgaggtcaggagttcgagactagcct

SEQ ID NO: 34408 - DNA, 201 bp, Homo sapiens; identical to SEQ ID NO: 7426

SEQ ID NO: 34409 - DNA, 201 bp, Homo sapiens
aagatgccctttatgaaatttaagtcagatttttcgagaaaaaatttggatgggccatcaggtcaccatgggacttcccttagcctcatgcattctctgckatggtttactttggggcctatgaatagggaagactgagatataggaaaaaccaaagtgtctgtgttcccccactctcacacccatgcagcataacacttc

SEQ ID NO: 34410 - DNA, 201 bp, Homo sapiens; identical to SEQ ID NO: 7428

SEQ ID NO: 34411 - DNA, 201 bp, Homo sapiens
atggcatttctcaaagtatgctctggagaaacctgaagtctcttgagatcccttcagagacagtctatgaggttaaaacacctttaaatttaaaaaaaaaagattttatttgctatttcacttttatttcctgataagtgtacagtggagttttccagaggctacataatgtttgatcacattatctctctgatggctaat

SEQ ID NO: 34412 - DNA, 201 bp, Homo sapiens
tgctgcagtttctcagaggtgctaggagggcattaggagtctgaagccctggaagtgtgttctgactttgccactagctagatagacctggactaggcacrttacctctttgtaccactcagctctaacccctcattcaaaaacccagcattttcaagtggtgtttttcacatcagcctttgcataagttttcatttgaag

SEQ ID NO: 34413 - DNA, 201 bp, Homo sapiens
ctgggtttcattagctgtacgcattgtacttccttccttaccactatttatctcgaattcttgagattaaagtgcagattaaatctaaactttatctggtraagttattagttcttacaagtagcaagcaaacggtaaactaaataggatcacctaattgtaccagattttaaaaaaaaaaaaccctgattctcctgattc

SEQ ID NO: 34414 - DNA, 201 bp, Homo sapiens
gaggatgatttgccatattgtgtctagtattacggcaaaactctaagtagcattttaaatagtatttatttgggttggaattatttctatgcattgactcwtcttcctgggtttcattagctgtacgcattgtacttccttccttaccactatttatctcgaattcttgagattaaagtgcagattaaatctaaactttat

SEQ ID NO: 34415 - DNA, 201 bp, Homo sapiens
gcccttctgatatatgaagcaaacactgacagaactgaagagacaaacagataagcccacaattagagtgggagatatcctaatgtctctctccgtatggwtatacatcttcccaaacaaaatataatagaaaaaatacacaaaaaaatcagaaagaatatatatgttttaaaggaaattgtcaacctatttaacactatg

SEQ ID NO: 34416 - DNA, 201 bp, Homo sapiens; identical to SEQ ID NO: 7526

SEQ ID NO: 34417 - DNA, 201 bp, Homo sapiens
aagcatttactgtgatccataaccaggagaaaaagcactcaaaacaaataaaccccaaaatgaagaaattggcaagaagatttgaaatatatatatatcayaattgtgttcaaggatttaaataaaacatgaacatggaagaaacaaatggataatatcaaaaaagaaaaattataaaataaccaaatagaaattaaataa

SEQ ID NO: 34418 - DNA, 201 bp, Homo sapiens
ttccaacccaaaaacaaaaattaagaagatgagtgaagaagaagtaaagcagttgaaacaggaagaaagggaaaattatgagggagggaaggtaagggcarataagatttgctgccacgttggtgtattttgttcagtacttcatcgatgccatgcccaaataactgaaagaggcagcaattctgagctctctggtccctc

SEQ ID NO: 34419 - DNA, 201 bp, Homo sapiens
ggagatgggaggggtcaggggccagggtggggtggaatgtggagcagaggttcaggggaactgatcagagttgggaggtcatggagacggactatcttggygaatgggttcaaagcaaccagagttgcttctttccaacccaaaaacaaaaattaagaagatgagtgaagaagaagtaaagcagttgaaacaggaagaaag

SEQ ID NO: 34420 - DNA, 201 bp, Homo sapiens
gggcttgggaaggtagctatggaatccagactgagcacccatagcaggaccacgggatggagatgggaggggtcaggggccagggtggggtggaatgtggrgcagaggttcaggggaactgatcagagttgggaggtcatggagacggactatcttggcgaatgggttcaaagcaaccagagttgcttctttccaacccaa

SEQ ID NO: 34421 - DNA, 201 bp, Homo sapiens
gtggaaagatgttagtggaattcctggcagatagttcacatggacaaaatggtattaactacaaaaatttttacagagaaaacggtaactgacaaaagcasgtgtttggaatgaattaagaccatggcagccttttgaggcctttatatttctcctgactgtgcaataaaaatattttggctctctaagacttggctgtca

SEQ ID NO: 34422 - DNA, 201 bp, Homo sapiens
gacaagcaccaggaaggcaggggaagatgcggccctgcaccttctgagggggaccattaagagatgaagttgactaaagcagagactttgtgtaggtgacrggcttgggaaggtagctatggaatccagactgagcacccatagcaggaccacgggatggagatgggaggggtcaggggccagggtggggtggaatgtgga

SEQ ID NO: 34423 - DNA, 201 bp, Homo sapiens
aaatagggataataacaccttcctcaaatggttttattaggactaaaagagagaatgtgtggaaagatgttagtggaattcctggcagatagttcacatgracaaaatggtattaactacaaaaatttttacagagaaaacggtaactgacaaaagcaggtgtttggaatgaattaagaccatggcagccttttgaggcct

SEQ ID NO: 34424 - DNA, 201 bp, Homo sapiens
tttatgtccaaatgcccgactgtgtgttcttaactaaacattttgattcatagctacccattctacttccagtaaacagaaagttttatttggttaatgcwaaccaaatagattaaaaggaagtcatgacaattagacattgacattgatttactgaccatttattccacttggatctcccacctctaggtcaaggagagc

SEQ ID NO: 34425 - DNA, 201 bp, Homo sapiens
tgaattcttgatctgcttcttcatagctatttacacttaggcaagttttgttttgttttgttttacgttgccactcagttttctcatctgtaaaatagggrtaataacaccttcctcaaatggttttattaggactaaaagagagaatgtgtggaaagatgttagtggaattcctggcagatagttcacatggacaaaatg

SEQ ID NO: 34426 - DNA, 201 bp, Homo sapiens
ctaaataggtagtttttcagcccttgccttgctccctctctcccttctctggtagtccccagtgtctttagttgccatctttatttatgtccaaatgcccractgtgtgttcttaactaaacattttgattcatagctacccattctacttccagtaaacagaaagttttatttggttaatgctaaccaaatagattaaaa

SEQ ID NO: 34427 - DNA, 201 bp, Homo sapiens
tgaggtctcggggggtgggggttatcccaaataggttcacagaagaaccagaaataaaacctgcctttctagactgtaagtcttgtgattttcatctaaayggttgtctctatacagcaactcatctctagaactgaaaataagcttaaatccctcctccatccccaataattcaagctgcatttcagagaaaaccaggac

SEQ ID NO: 34428 - DNA, 201 bp, Homo sapiens
ttcaccatgctggccaggctggtctcaaactcctgacctcgtgatccacctgccttggcctcccaaagtactgggattacaggcatgagccaccgcgcccrgcctatttgaacgttcctatgcctgctacaagtgcagcagcagaatctccacacatcttgcgtgcgaaagtttcctgtagttcctttagcatagagaggc

SEQ ID NO: 34429 - DNA, 201 bp, Homo sapiens
accaaatggcaaagtcagagactatcgggggccatggagacactctgggccatttttatgaggtagtctaggctcatctttatgagggaactgaggtctcrgggggtgggggttatcccaaataggttcacagaagaaccagaaataaaacctgcctttctagactgtaagtcttgtgattttcatctaaatggttgtctc

SEQ ID NO: 34430 - DNA, 201 bp, Homo sapiens
actaaataggtagtttttcagcccttgccttgctccctctctcccttctctggtagtccccagtgtctttagttgccatctttatttatgtccaaatgccygactgtgtgttcttaactaaacattttgattcatagctacccattctacttccagtaaacagaaagttttatttggttaatgctaaccaaatagattaaa

SEQ ID NO: 34431 - DNA, 201 bp, Homo sapiens; identical to SEQ ID NO: 7440

SEQ ID NO: 34432 - DNA, 201 bp, Homo sapiens; identical to SEQ ID NO: 7442

SEQ ID NO: 34433 - DNA, 201 bp, Homo sapiens; identical to SEQ ID NO: 7445

SEQ ID NO: 34434 - DNA, 201 bp, Homo sapiens
attttatattgtttccttgaatatttcctgtaacccccctgcctgattccactagaatgtaagctccatgacggccaagcctctggctgcactgtgccccrtgtgtccccagcatcctggtggggctcgatacacagagagctcataagtagcatttgaatacatgaatcaaagaatggctcagtttactgcagccttttt

SEQ ID NO: 34435 - DNA, 201 bp, Homo sapiens
tcactctgtctcatcatgtatgtaatatgtatcatcattaagtgatctcattttatattgtttccttgaatatttcctgtaacccccctgcctgattccaytagaatgtaagctccatgacggccaagcctctggctgcactgtgccccgtgtgtccccagcatcctggtggggctcgatacacagagagctcataagtag

SEQ ID NO: 34436 - DNA, 201 bp, Homo sapiens
ttagtacaagtctcctcgctggtatgccctaatacactaaaacagcagtaaaaacaatctgcacattggcatcgaaggcacagataaacttgccgaggacycttaccacggcagagggatgctttatatgagtccttagtagattaattaagttcttgctagttccatttggaaatgatgctgtcctcttggggctatgca

SEQ ID NO: 34437 - DNA, 201 bp, Homo sapiens
agtccgagttctgcaccctgagttaggaactctataactttagactttccctgagctttgggagttctcttaactagtgtgaaagcagttacatcatcctrggtcctcctaaaatagacacatgtatccaaatataggcacatgtattgcaaacataacatgtatgtatatatgtaaatatatacatataatttttgtttt

SEQ ID NO: 34438 - DNA, 201 bp, Homo sapiens
tgactatgtttgggactgaagtaagcatatcaagttagaactctcatcacatgttcgactcaaattgtggagcaaaagagtaaataagatataaaaatgamaatgaagatacgtgaaattcaaatgttgcaacttgcctattatttattttagtgcatttttttgtacttttcccagtttggtgttaggtggcattaagtt

SEQ ID NO: 34439 - DNA, 201 bp, Homo sapiens
cagttatgtggcatccacaatgtgtgacctaaatttataactttaccagacatacaaaaagcatttactgtgatccataaccaggagaaaaagcactcaawacaaataaaccccaaaatgaagaaattggcaagaagatttgaaatatatatatatcataattgtgttcaaggatttaaataaaacatgaacatggaagaa

SEQ ID NO: 34440 - DNA, 201 bp, Homo sapiens; identical to SEQ ID NO: 7430

SEQ ID NO: 34441 - DNA, 201 bp, Homo sapiens
aaatgactcgttgtaagcacataactcacgtggggggaacagacatgggtgggcacactagcaaacacctgccagctgcatgtggacccaggtgggcaccrgactgttttaaacacaggagagggcccgttgtctaactggtgagttggttgagtggaagctggttgagaacttttactgcaaaccatttacagtagacca

SEQ ID NO: 34442 - DNA, 201 bp, Homo sapiens
acacagtggatcctgagcaccagtggcctgaaaggatatgggttgctgggacatgaagaacaaaagcaggatacgcagatgctgaacagcgaaagaggccrttagatgaacagaaaaccaggtctaacaaggacagcttttcttccataaatgagtacacaatatatggaaaaaactatttttacatattggagaacagat

SEQ ID NO: 34443 - DNA, 201 bp, Homo sapiens
accaaacaaaaaagagctttgtttcttttcacattcatttctcagtttagatcatctttaattaaatataaatgtaagaaagttggaaaatgcaaagaaaygactcgttgtaagcacataactcacgtggggggaacagacatgggtgggcacactagcaaacacctgccagctgcatgtggacccaggtgggcaccggac

SEQ ID NO: 34444 - DNA, 201 bp, Homo sapiens
atagtgtgtatatatatgtacacatatatgtgtgtatatatatgtacacatatatgtgtgtatattagaatatatataacataaatatgtatatatatatwttctgacctgtataaacacagtggatcctgagcaccagtggcctgaaaggatatgggttgctgggacatgaagaacaaaagcaggatacgcagatgctga

SEQ ID NO: 34445 - DNA, 201 bp, Homo sapiens
ctcaatctctctttcttttctctgtctacttacctctattacctatctatcatctattatctatttatccattcatcaatccttctacccattatctatcmtctgtgtctatctatctatctatctatctatctatctatctatctatcatctatcatccatctacctattatctgcctatctaccatttgtgtgtcatct

SEQ ID NO: 34446 - DNA, 201 bp, Homo sapiens
cagttgtttaattttaatgcagctgatgtggtagaagagtcctggtctcaaaggactccctcttcctccatttcttcctgatgagtttgcaaatctgactrattctgattgaatcaagaatgaatgcatcactctcagtgtgtaaacaggcagcagtcaatggagtagaatcaaagggaagaaagattttcctcaggattt

SEQ ID NO: 34447 - DNA, 201 bp, Homo sapiens
atacctactaaataggtagtttttcagcccttgccttgctccctctctcccttctctggtagtccccagtgtctttagttgccatctttatttatgtccamatgcccgactgtgtgttcttaactaaacattttgattcatagctacccattctacttccagtaaacagaaagttttatttggttaatgctaaccaaatag

SEQ ID NO: 34448 - DNA, 201 bp, Homo sapiens
agataaattccattgcccacataacgaattggttttgacctacagtccatgtgacaaaatgatcattttggagaaagctgtgcaaattcctatccatgaawgtggtccaccccactcctgattttgcctgggcacctgtctatgtcttaatcagtcttcaaggcacatgatcaaagggaggaaaactgtgtctttgagtct

SEQ ID NO: 34449 - DNA, 201 bp, Homo sapiens
tcctccaccaccaccacaggaaagaagtgtcagtcttggtcatctatgacaccacaccggcaccagaagaccccagaaaactacccaaatgcgtatgtctytgatttttactgtaagaggggcatcagccaactgaaatttctgttaaaagagccatgcttcatgcttcaagccaacttcctaggaccaaatttctcttag

SEQ ID NO: 34450 - DNA, 201 bp, Homo sapiens
aacattcatgtgcatgtgtctttagggtagaatgatttatattcctctaggtatatcgccagtagtaggattgctgggttgaaagttagttctgcttttakctctttgagaatcaccatactgctttctacagtggatgaactaatttacagtcccaccagctgttagtgttctcttttctctgcaaccttgccagcatct

SEQ ID NO: 34451 - DNA, 201 bp, Homo sapiens
tcccatcacccaggtagtgagctaaatacctactaaataggtagtttttcagcccttgccttgctccctctctcccttctctggtagtccccagtgtcttyagttgccatctttatttatgtccaaatgcccgactgtgtgttcttaactaaacattttgattcatagctacccattctacttccagtaaacagaaagttt

SEQ ID NO: 34452 - DNA, 201 bp, Homo sapiens
aaatagaaagctgcatatgcacagggagaggttccagagagaaaataggataaagaacagctactggggaaagaaaaactgcaggggaacagtgagctcartggagatgccagagctcacatagcactgggggatatttgagttctgaccagcctgaggagagacctcgctgaacatcttgggcattcagtagtcaccaca

SEQ ID NO: 34453 - DNA, 201 bp, Homo sapiens
gataaattccattgcccacataacgaattggttttgacctacagtccatgtgacaaaatgatcattttggagaaagctgtgcaaattcctatccatgaatrtggtccaccccactcctgattttgcctgggcacctgtctatgtcttaatcagtcttcaaggcacatgatcaaagggaggaaaactgtgtctttgagtctc

SEQ ID NO: 34454 - DNA, 201 bp, Homo sapiens
aactaaattgcgtgacactgagctttggggtacaaatgatcccatcacccaggtagtgagctaaatacctactaaataggtagtttttcagcccttgcctygctccctctctcccttctctggtagtccccagtgtctttagttgccatctttatttatgtccaaatgcccgactgtgtgttcttaactaaacattttgat

SEQ ID NO: 34455 - DNA, 201 bp, Homo sapiens
ctccgttttctcatgtggaaaaagagttgaaatgaggtactctgttactcctagaactcacttaatgttcaccagttcatacacattcatgatcagagaaygattcagttattccaggctgacaattcccccttcatcataatatgtttaagagaatcatataagactatatttgtttcaaagcactttaaaaaccacaag

SEQ ID NO: 34456 - DNA, 201 bp, Homo sapiens
atgaaactgtttttctttgttttataatttcaacttttagagtcaggggtacatgtgcaggtgtgttacataactaaattgcgtgacactgagctttgggrtacaaatgatcccatcacccaggtagtgagctaaatacctactaaataggtagtttttcagcccttgccttgctccctctctcccttctctggtagtccc

SEQ ID NO: 34457 - DNA, 201 bp, Homo sapiens
ttaatcttttactatcttgcaatctgctaatgaaactgtttttctttgttttataatttcaacttttagagtcaggggtacatgtgcaggtgtgttacatmactaaattgcgtgacactgagctttggggtacaaatgatcccatcacccaggtagtgagctaaatacctactaaataggtagtttttcagcccttgcctt

SEQ ID NO: 34458 - DNA, 201 bp, Homo sapiens
tcaatccagttaatcttttactatcttgcaatctgctaatgaaactgtttttctttgttttataatttcaacttttagagtcaggggtacatgtgcaggtktgttacataactaaattgcgtgacactgagctttggggtacaaatgatcccatcacccaggtagtgagctaaatacctactaaataggtagtttttcagc

SEQ ID NO: 34459 - DNA, 201 bp, Homo sapiens
aaaagcattagtttgctgtaggtatgttaggagcactttccccatgtgattgatcaattaattaaaaaatggctaaagtgggtaaccttaaatgatggtgyaaatataccttaaacattttatattttcattgaaaacacaagtgtacttgacaccttttgacgtagagcagaggcttttcttcttcgaatatggggtcac

SEQ ID NO: 34460 - DNA, 201 bp, Homo sapiens
aagttccatttctacccagggatgaacaaatcaacatcaatcttggtaacacaactgccactgatggtgccttactcttctctcatgacatggcacaatcratagcaaacataaaatttgttcttgtttaaggatttatatccactaatatggtaacatagtagtggttccatagttctaacctgtttgtcaatccagtta

SEQ ID NO: 34461 - DNA, 201 bp, Homo sapiens
agtgcagattaaatctaaactttatctggtgaagttattagttcttacaagtagcaagcaaacggtaaactaaataggatcacctaattgtaccagatttwaaaaaaaaaaaaccctgattctcctgattctctctacaaaatgctaacatttaaatatgtcatttgtaaattgttaaccagaaggaacatgggaatgact

SEQ ID NO: 34462 - DNA, 201 bp, Homo sapiens
caagttccatttctacccagggatgaacaaatcaacatcaatcttggtaacacaactgccactgatggtgccttactcttctctcatgacatggcacaatyaatagcaaacataaaatttgttcttgtttaaggatttatatccactaatatggtaacatagtagtggttccatagttctaacctgtttgtcaatccagtt

SEQ ID NO: 34463 - DNA, 201 bp, Homo sapiens
ggaaggtaagggcagataagatttgctgccacgttggtgtattttgttcagtacttcatcgatgccatgcccaaataactgaaagaggcagcaattctgarctctctggtccctcaagatattcaatgatctttagcatgtctcacttattaataaacatttgttttctttaaataaagaaaaatacttattggatttcct

SEQ ID NO: 34464 - DNA, 201 bp, Homo sapiens
tgtgttttgaagtcacactgtgagctatatagaattaaccaaaacacaactcttcttgaaaatgagagttcaagttggcagaaagtgcggggtaaagacayggatatgggcctaaagcatctatttctttgtgatcttttgatatatctctcaagtgctttttagtggattagctttagaatgcatcagccaactcctgct

SEQ ID NO: 34465 - DNA, 201 bp, Homo sapiens
tcagttcttgtttatttccaccatcatctatgcaccaaaatttatgtttctcaaggagggaccattcagaggatgcttcccaccggttcaagtgacagtgycagaaccaaagcgcatattgtaggaaatcaaacaatggcctccaagttccatttctacccagggatgaacaaatcaacatcaatcttggtaacacaactg

SEQ ID NO: 34466 - DNA, 201 bp, Homo sapiens
atatttcctagggacatgagctggggaggggatctcagcagcgatgcgctatgaagcatagtaacataacacagagaacttaattgaagggggaaataaayggaagttttctttttttgaatatcagttgtagcctgctctgctatacttcaaaaaaactcttcagaaagtttaactgaactcactgtaggacacactttg

SEQ ID NO: 34467 - DNA, 201 bp, Homo sapiens
ggcaacataatttagttcagttcttgtttatttccaccatcatctatgcaccaaaatttatgtttctcaaggagggaccattcagaggatgcttcccaccrgttcaagtgacagtgccagaaccaaagcgcatattgtaggaaatcaaacaatggcctccaagttccatttctacccagggatgaacaaatcaacatcaat

SEQ ID NO: 34468 - DNA, 201 bp, Homo sapiens
ccaggactgctaccatggtgatggacagagctaccgaggcacatcctccaccaccaccacaggaaagaagtgtcagtcttggtcatctatgacaccacacyggcaccagaagaccccagaaaactacccaaatgcgtatgtctttgatttttactgtaagaggggcatcagccaactgaaatttctgttaaaagagccatg

SEQ ID NO: 34469 - DNA, 201 bp, Homo sapiens
ttctaaaatgctataaatctatttttatgttaatctgtctgctaatacagaaaagagaacagtcataattctcagaggctaccgtactgtttttgtcatarattgcttcatgcttcttttttttcagtaattgttaagcttgatttcttttattttaatttcagcaccacctgagctaacccctgtggtccaggactgcta

SEQ ID NO: 34470 - DNA, 201 bp, Homo sapiens
tggggaaggcctcagccccatccctcgtacagcaggaatgagaacagccctgcctgttgggaagcttgagggaggctatggacgtgcagcgcttggcagarggtctcgtcatggaaggttccagcaaatgtgagatacttttatgatttcattttctccaaaagaaagggaataagagaagaggggaggaaataagactaa

SEQ ID NO: 34471 - DNA, 201 bp, Homo sapiens
catctgccctcgtgttctcatgaacactcagtagggacccataaaaaagagcttgcatgtaagtgcaatttccaattataagtactctatctgttctttcmcacccaggttttaaatgaaatattactaggaacttattaatgttctaaaatgctataaatctatttttatgttaatctgtctgctaatacagaaaagaga

SEQ ID NO: 34472 - DNA, 201 bp, Homo sapiens
tgaacactaaaatagaagttttacagcatatatactacctggttgctctagacttaagccagggaaaagtacagattcaacatttaaaattgagatagacrctttccacttaatgctaccagtcttgctttatttcatgagaatgagaatataataatatggcatacgttcatttgggggaaagattgatgtcttataaca

SEQ ID NO: 34473 - DNA, 201 bp, Homo sapiens
cactcaccacccacagcctgcactgccgaatgcatcctcctctcatctgccctcgtgttctcatgaacactcagtagggacccataaaaaagagcttgcaygtaagtgcaatttccaattataagtactctatctgttctttcacacccaggttttaaatgaaatattactaggaacttattaatgttctaaaatgctata

SEQ ID NO: 34474 - DNA, 201 bp, Homo sapiens
gagccccctaagagacatttcacattaaaaataaaatgtctgcccactgctggtttctcaatctgcctccaccttctgtcccctttaatgaactgggccaygaggtgagtcagagaggataaagggagtggtaagaatttgaggagagaagagagtgaggctaaaataggaaatcaggaaaagcgattcggtccccctgtc

SEQ ID NO: 34475 - DNA, 201 bp, Homo sapiens
caaggtgccttatccaagaggaactgctacaataatattttaagtggaaataaatacatgctggaagcattatatattagtagagtatttttttttcccaragtactttctcaagcacatcaacatgagccccctaagagacatttcacattaaaaataaaatgtctgcccactgctggtttctcaatctgcctccacctt

SEQ ID NO: 34476 - DNA, 201 bp, Homo sapiens
tttagtgatacatttaacacaatatgcacaagaattatgtactgcatactaaaaaacattgttaaggaaggaatcaaaagatctaaataaagatatatcaygcttatatattaagagtcaatatcacttctcaccaaattgatctttggattcagcccatacccaattgttaaggaagaaattacaagatctaaataaaga

SEQ ID NO: 34477 - DNA, 201 bp, Homo sapiens
ggtgaaactctgtgttctacgttgctctgtgtcagtgaagcaaggcagtgccagttcagagggctctggggcctcaagacagggatgactggttgtgggtrctgcagctgcgagcagagcagtcaaacataactgctgatgcttttctttcagtcctgccgtcatcactgacaaagtaatcccagcttgtctgccatcccc

SEQ ID NO: 34478 - DNA, 201 bp, Homo sapiens
tattaagctgaataaaaatcaaagcccaattatgttctttttactatacatgctctttaattgtaaagagctagtccaaaaaccaagtgtggaaaatgacrtatcatgaaaataagaatcagaagaaagctggagtggtaatgttaatcccaaagtaatctacaagaaataataccacgatgaaaaagttatttcttaagt

SEQ ID NO: 34479 - DNA, 201 bp, Homo sapiens
gcattatggtacacttaaactgaactgaaaatatatttaatatactcctaagcatattaaatataaagggattaaacattgcacagaaaaggcagagattrttaagctgaataaaaatcaaagcccaattatgttctttttactatacatgctctttaattgtaaagagctagtccaaaaaccaagtgtggaaaatgacat

SEQ ID NO: 34480 - DNA, 201 bp, Homo sapiens
tttatccaaaagaaggaaagaaaggaagaaaaaagaatgaagaagatatggcaaagagagaaaatacacagcattatggtacacttaaactgaactgaaartatatttaatatactcctaagcatattaaatataaagggattaaacattgcacagaaaaggcagagattattaagctgaataaaaatcaaagcccaatta

SEQ ID NO: 34481 - DNA, 201 bp, Homo sapiens
tgttaccgtgtccgggcacacctgtcagcactggagtgcacagacccctcacacacataacaggacaccagaaaacttcccctgcaagtaagtcccctccrgtctcattctgctgctatggaatgtgaaatcccattgactttgccttagttttagttactgtaggaacgcaggataaagtattctggaagaaaaactgat

SEQ ID NO: 34482 - DNA, 201 bp, Homo sapiens
tgccctctgtggatttgatagcaattttttaaatgattcatgtttcaacttgttaaaaacatttaatttagttaaaaaccaaacaaaaaagagctttgttycttttcacattcatttctcagtttagatcatctttaattaaatataaatgtaagaaagttggaaaatgcaaagaaatgactcgttgtaagcacataactc

SEQ ID NO: 34483 - DNA, 201 bp, Homo sapiens
aaaactatcgcgggaatgtggctgttaccgtgtccgggcacacctgtcagcactggagtgcacagacccctcacacacataacaggacaccagaaaacttyccctgcaagtaagtcccctccggtctcattctgctgctatggaatgtgaaatcccattgactttgccttagttttagttactgtaggaacgcaggataaa

SEQ ID NO: 34484 - DNA, 201 bp, Homo sapiens
aaaacctttagatttttatgaattcctcctcaagctttatagtcaactatatgagtggattgccctctgtggatttgatagcaattttttaaatgattcaygtttcaacttgttaaaaacatttaatttagttaaaaaccaaacaaaaaagagctttgtttcttttcacattcatttctcagtttagatcatctttaatta

SEQ ID NO: 34485 - DNA, 201 bp, Homo sapiens
aattattcattgtagggctgggcacggtggctcacgcctgtaatcccagcacttccggaggccgaggtgggcggatcacgaggtcaggagttcaagaccarcctggccaatatgatgaaaccccacctctactaaaaatacaaaaaaattagccagttgtggtgacacgcacctgtagtctgagctactcgggaggctgag

SEQ ID NO: 34486 - DNA, 201 bp, Homo sapiens
acatttattaatcaatctgaatgtgtaaaacctttagatttttatgaattcctcctcaagctttatagtcaactatatgagtggattgccctctgtggatytgatagcaattttttaaatgattcatgtttcaacttgttaaaaacatttaatttagttaaaaaccaaacaaaaaagagctttgtttcttttcacattcat

SEQ ID NO: 34487 - DNA, 201 bp, Homo sapiens
aaatctgtggctctaggtgtccactaaaggagagccaaaaatgtcccgaataatctcaggaccacagcatcattttatgaataacagaaccaagacctcakattgtacaacagattggttcttattgctggaatggggcataaaccatgcctggaaccccagatgctacagagaaggtagatgggagagacttctgacctg

SEQ ID NO: 34488 - DNA, 201 bp, Homo sapiens
ttaccctccagtgttttgcccaatttttgtccaaggtggcaacataatttagttcagttcttgtttatttccaccatcatctatgcaccaaaatttatgtktctcaaggagggaccattcagaggatgcttcccaccggttcaagtgacagtgccagaaccaaagcgcatattgtaggaaatcaaacaatggcctccaagt

SEQ ID NO: 34489 - DNA, 201 bp, Homo sapiens
aacatccatctgtgcattctctattttaaaattattcattgtagggctgggcacggtggctcacgcctgtaatcccagcacttccggaggccgaggtgggyggatcacgaggtcaggagttcaagaccaacctggccaatatgatgaaaccccacctctactaaaaatacaaaaaaattagccagttgtggtgacacgcac

SEQ ID NO: 34490 - DNA, 201 bp, Homo sapiens
caggtcctgcttttttacaatttcctccgaaatccagatacctgtcaacaccttggaaaaactgacttctccccaattagtagtgttgtgtgactgtcatmagcccagtacaaaaatggccttctttgttggggagcttcttaccctccagtgttttgcccaatttttgtccaaggtggcaacataatttagttcagttct

SEQ ID NO: 34491 - DNA, 201 bp, Homo sapiens
tgttggccagactggtctcaaacttctgacctcagacggtccatcaccttggccttccaaagtgctgacagtacaggtgtgagcaaccgtgcccagcctarattgttgattttcattgtccttgtaaaattcatagccattatctgttcaaacgtttctttttgcacttttctctctctgtattttccttttgggactcta

SEQ ID NO: 34492 - DNA, 201 bp, Homo sapiens
tccttgtgaaagggtctcacaggcatagatgctactaaattgatttcatctgaaaacatgaaacaattctcaagtgccaaattccaagagaggctgagcaraagccaagacaggccagaacaccctgcagccatcctccttaacatccatctgtgcattctctattttaaaattattcattgtagggctgggcacggtggc

SEQ ID NO: 34493 - DNA, 201 bp, Homo sapiens
tctccaagtgcagtcttgctgggtttttatggaggcttcattacagaggcacagttgaatacatcgttggccattggagaccagctcaccttcagctcctrttccctccctggaagttggacgtggggggctgaacagttccaaccctgcaatcacatggttggttcctttggcaaccagccccatcctgagactatccaa

SEQ ID NO: 34494 - DNA, 201 bp, Homo sapiens
ctattcatacccccaaaaacgcactccactctccttagctgttacccccaatctgcagcttctggcaaccactaatctactttctgtatttatatctttgycattttgaacatttcatacaaacggaatcatacgatttgctagtagttcttcatgtaaataatgtacgcttgaaattcaatctataaattaccagataaa

SEQ ID NO: 34495 - DNA, 201 bp, Homo sapiens
aggtaggaagaactgagcaaagagaacatagaaagaagcacctacccaagggtctttctctgaaggagttccttgtgaaagggtctcacaggcatagatgstactaaattgatttcatctgaaaacatgaaacaattctcaagtgccaaattccaagagaggctgagcaaaagccaagacaggccagaacaccctgcagcc

SEQ ID NO: 34496 - DNA, 201 bp, Homo sapiens
atgctacacgagaaatcaagtgtttttagagggtctgccatgtggaaggaagcctcagtgcactctctcaaggaggcagaggtgtgacttttggcacaacrtgagtgggctgtgcctttaggacaggtgcaaaccctccaaggtgctcaacttaaccactcaccttgttctaaaatgggttatctcagtatcccagtccaa

SEQ ID NO: 34497 - DNA, 201 bp, Homo sapiens
tatagaattcacccatttaggcatacaatccaatggatttcaagatattgagagttgtgcagccaccatcagaataaattttaaaactattcatacccccmaaaacgcactccactctccttagctgttacccccaatctgcagcttctggcaaccactaatctactttctgtatttatatctttgccattttgaacattt

SEQ ID NO: 34498 - DNA, 201 bp, Homo sapiens
gaccatattttcctcttgacatcctcatcttttctaggtccccaaggccttcatcctacaaggtcatcctgggtgcacaccaagaagtgaatctcgaaccrcatgttcaggaaatagaagtgtctaggctgttcttggagcccacacgaaaagatattgccttgctaaagctaagcaggtactcgttcacctgtggtcttc

SEQ ID NO: 34499 - DNA, 201 bp, Homo sapiens
ggcctgacaatgaactactgcaggaatccagatgccgataaaggcccctggtgttttaccacagaccccagcgtcaggtgggagtactgcaacctgaaaawatgctcaggaacagaagcgagtgttgtagcacctccgcctgttgtcctgcttccagatgtagagactccttccgaagaaggtaagaaatctgtggctgga

SEQ ID NO: 34500 - DNA, 201 bp, Homo sapiens
agctaattatgcaaaggacggctaagctctttgcctggttctcagtttgactaatttatatcatctctgttacggtgtcatgctcccctcacttgcaagtyaaaacagtgaaatatctctttgaatatattccgttctctcaccagttcatggtggcggcagggtcggggactcagcatttctccctttgttatggcctga

SEQ ID NO: 34501 - DNA, 201 bp, Homo sapiens
acatgctagctgtgctcttgagaaaggcagcaggactccgttttctcatgtggaaaaagagttgaaatgaggtactctgttactcctagaactcacttaaygttcaccagttcatacacattcatgatcagagaacgattcagttattccaggctgacaattcccccttcatcataatatgtttaagagaatcatataaga

SEQ ID NO: 34502 - DNA, 201 bp, Homo sapiens
gaatacataaatcccagaatatgtgcaacctgatcatagtacacagagatctctctatatatctcttttcttagttcatgctgttctttcaggtagaaagygccttattttgaattagttgtctttagagcaaaaatccctccaagagtgctgtgtggtttcctatgcacaacctggaatagtccattgcttcatgcctac

SEQ ID NO: 34503 - DNA, 201 bp, Homo sapiens
ttcatgaaacttccagttgaaaatcttgtataagattgaggaattcttcaagaaataagtttaagtttcctgtgaagattgtcagggtgctggaatgaatrggcagagaaaataatgggtgatttttcaaatctaaatgagtgcacccacataatggccagtctaattgaaaaagagccaatgtagctaattatgcaaagg

SEQ ID NO: 34504 - DNA, 201 bp, Homo sapiens
gctctgctcaacgtccctctgtgctttcacgatgctgatggattatgaaggtagggaagaatgtacagccaggaggccattaggagggcaactaatttatraaatcacatttgtagaatttaatgcatccaacaactaccaggggaaaggtgggcaaaagctataccaacaccacccaagtcaaaaccaaaacaacaggaa

SEQ ID NO: 34505 - DNA, 201 bp, Homo sapiens
taccacagaccccagcgtcaggtgggagtactgcaacctgaaaaaatgctcaggaacagaagcgagtgttgtagcacctccgcctgttgtcctgcttccaratgtagagactccttccgaagaaggtaagaaatctgtggctggacatctacacacttggacgctgggatgaaaagccatggaaaatctcactgatgcaga

SEQ ID NO: 34506 - DNA, 201 bp, Homo sapiens
ttgattcatagctacccattctacttccagtaaacagaaagttttatttggttaatgctaaccaaatagattaaaaggaagtcatgacaattagacattgrcattgatttactgaccatttattccacttggatctcccacctctaggtcaaggagagcctctggatgactatgtgaatacccagggggcttcactgttca

SEQ ID NO: 34507 - DNA, 201 bp, Homo sapiens
aaaatacatatgccatggctttatgtgcaattcatttaatttttgattcatgaaacttccagttgaaaatcttgtataagattgaggaattcttcaagaartaagtttaagtttcctgtgaagattgtcagggtgctggaatgaatgggcagagaaaataatgggtgatttttcaaatctaaatgagtgcacccacataat

SEQ ID NO: 34508 - DNA, 201 bp, Homo sapiens
agatgcggccctgcaccttctgagggggaccattaagagatgaagttgactaaagcagagactttgtgtaggtgacgggcttgggaaggtagctatggaakccagactgagcacccatagcaggaccacgggatggagatgggaggggtcaggggccagggtggggtggaatgtggagcagaggttcaggggaactgatca

SEQ ID NO: 34509 - DNA, 201 bp, Homo sapiens
gcatgtaacacagccatgcttattaatgatgaggagacagccaatgaaaattaattttttcaaagatgaatagatatctagattttttcaagcacaactcrtttaagaaaatatcacctcactgagccccaaatgagttaggtctcacttagaaagtgtcccctagtgccaggtaaagtgcctcatatttgcaatcccagc

SEQ ID NO: 34510 - DNA, 201 bp, Homo sapiens
aacagaagcgagtgttgtagcacctccgcctgttgtcctgcttccagatgtagagactccttccgaagaaggtaagaaatctgtggctggacatctacacrcttggacgctgggatgaaaagccatggaaaatctcactgatgcagaaaccttccatgctacacgagaaatcaagtgtttttagagggtctgccatgtgga

SEQ ID NO: 34511 - DNA, 201 bp, Homo sapiens
gtaagtcaacaacatcctgggattgggacccactttctgggcactgctggccagtcccaaaatggaacataaggaagtggttcttctacttcttttatttytgaaatcaggtaagacatagtttttttaaattataagaattattttttctcccacaatgtagtaaaaatacatatgccatggctttatgtgcaattcatt

SEQ ID NO: 34512 - DNA, 201 bp, Homo sapiens
gcttgagggaggctatggacgtgcagcgcttggcagagggtctcgtcatggaaggttccagcaaatgtgagatacttttatgatttcattttctccaaaaraaagggaataagagaagaggggaggaaataagactaattgcgagagataaagtacaagggtgagggaaggaataaggagacatgacggcagcgtggagca

SEQ ID NO: 34513 - DNA, 201 bp, Homo sapiens
gacacaaccttggggaaggcctcagccccatccctcgtacagcaggaatgagaacagccctgcctgttgggaagcttgagggaggctatggacgtgcagcrcttggcagagggtctcgtcatggaaggttccagcaaatgtgagatacttttatgatttcattttctccaaaagaaagggaataagagaagaggggaggaa

SEQ ID NO: 34514 - DNA, 201 bp, Homo sapiens
aaccaatgcgctctgcagtgtgtcatctttcagaacctcccctgaccgcatgttccctggagggctcgctgtcttcagagccaggcttgtctcctgctgcmgcctccactgttctcctagtcactctgtaacccaccccctctgcctgcggcccccaccacgcccctcaaagtggtcaaggttgtcctgttgtctaattcc

SEQ ID NO: 34515 - DNA, 201 bp, Homo sapiens
acatgaaaggaaacattgtggaggaaagcagctccaggaatgtccatagaaaagtcctcaagtctttggctaaatagaaagctgcatatgcacagggagargttccagagagaaaataggataaagaacagctactggggaaagaaaaactgcaggggaacagtgagctcaatggagatgccagagctcacatagcactgg

SEQ ID NO: 34516 - DNA, 201 bp, Homo sapiens
cactagcattctgtgccaaggacggagctggcatctccaggcttggaatagagctaccaaagctcagccagatgtctggaagagcctcaggacaaggggayaccctgtagccttgtggtgggagcacagctgaggcccccttggccaccctctgccacgaccaggcagaaagcagctttcggacagattcgttgtctcaga

SEQ ID NO: 34517 - DNA, 201 bp, Homo sapiens
aacttagtgcttgttactcacctttatccattcccccaacactcaacaaattgcctttgctatatccctatgagatgagcagatcaaatattccccgtgasttaatgaaaactgattcaaccaaatggcaaagtcagagactatcgggggccatggagacactctgggccatttttatgaggtagtctaggctcatcttta

SEQ ID NO: 34518 - DNA, 201 bp, Homo sapiens
tgtaggtatgttaggagcactttccccatgtgattgatcaattaattaaaaaatggctaaagtgggtaaccttaaatgatggtgtaaatataccttaaacdttttatattttcattgaaaacacaagtgtacttgacaccttttgacgtagagcagaggcttttcttcttcgaatatggggtcaccagtagaaggtctctg

SEQ ID NO: 34519 - DNA, 201 bp, Homo sapiens
tttagtgcatttttttgtacttttcccagtttggtgttaggtggcattaagttctcagtaatgacgcttatcaaataggaacttagtgcttgttactcacytttatccattcccccaacactcaacaaattgcctttgctatatccctatgagatgagcagatcaaatattccccgtgagttaatgaaaactgattcaacc

SEQ ID NO: 34520 - DNA, 201 bp, Homo sapiens
atgagtgtcttatgtctactgtaatactatgtcccaatgaagatgtacttgcaatcataatacgcagtattgggttaaaagcattagtttgctgtaggtaygttaggagcactttccccatgtgattgatcaattaattaaaaaatggctaaagtgggtaaccttaaatgatggtgtaaatataccttaaacattttatat

SEQ ID NO: 34521 - DNA, 201 bp, Homo sapiens
atcaagttagaactctcatcacatgttcgactcaaattgtggagcaaaagagtaaataagatataaaaatgaaaatgaagatacgtgaaattcaaatgttrcaacttgcctattatttattttagtgcatttttttgtacttttcccagtttggtgttaggtggcattaagttctcagtaatgacgcttatcaaataggaa

SEQ ID NO: 34522 - DNA, 201 bp, Homo sapiens
cttttgatgagtgtcttatgtctactgtaatactatgtcccaatgaagatgtacttgcaatcataatacgcagtattgggttaaaagcattagtttgctgyaggtatgttaggagcactttccccatgtgattgatcaattaattaaaaaatggctaaagtgggtaaccttaaatgatggtgtaaatataccttaaacatt

SEQ ID NO: 34523 - DNA, 201 bp, Homo sapiens
aagctacaaaaattaatatatgtatatatacatatatatttttataggttctctactgtgaaaatgacaaaaattgctgtctttttcttgatctgggcagytccatcaaaatctgtaggcacagtgatttgcaccaagttccaatattgctggaaaatactgaagatgctctgaggatttctatggatatccattgtctca

SEQ ID NO: 34524 - DNA, 201 bp, Homo sapiens
aatgtggagcagaggttcaggggaactgatcagagttgggaggtcatggagacggactatcttggcgaatgggttcaaagcaaccagagttgcttctttcyaacccaaaaacaaaaattaagaagatgagtgaagaagaagtaaagcagttgaaacaggaagaaagggaaaattatgagggagggaaggtaagggcagata

SEQ ID NO: 34525 - DNA, 201 bp, Homo sapiens
aggaccacgggatggagatgggaggggtcaggggccagggtggggtggaatgtggagcagaggttcaggggaactgatcagagttgggaggtcatggagayggactatcttggcgaatgggttcaaagcaaccagagttgcttctttccaacccaaaaacaaaaattaagaagatgagtgaagaagaagtaaagcagttga

SEQ ID NO: 34526 - DNA, 201 bp, Homo sapiens
tgccccaaccccgttagaccaaagactccctgagggcaaagatggcctcttatttactcttgattccctagcacccagcacagcactaagcattgtacccwctgaaagaacatctgaaggatgagcgtttatagcaaaagtggtttccactgacgttcccttctctcttccccaactttggattgaggagcccaggagctg

SEQ ID NO: 34527 - DNA, 201 bp, Homo sapiens
ctctctgtgctaaagggaaatcagacccatgctctctgacacatggatttcattttcaaccagagttctaatagttgttttgtaaacaaagagtgtctttstttacaatgttcaggtctgtgggtgtccagtttttccaccttggggagcagagggtgagtggtgggggtggggaagagttcaagaggagaagatgaaatg

SEQ ID NO: 34528 - DNA, 201 bp, Homo sapiens
ttccaaacaagaacctgaagaagaattactgtcgtaaccccgatagggagctgcggccttggtgtttcaccaccgaccccaacaagcgctgggaactttgygacatcccccgctgcagtgagtatgatgcacacccagattccaggatttggacctgccctgttcttgaaatcaaaagaaaacatgtgtcagtgcctgagt

SEQ ID NO: 34529 - DNA, 201 bp, Homo sapiens
ctgaatctgatttgaataataaccagatcctcagctgatgtgcacacacattcaaacactaatgtcagtaatgaatacattaacatctgtcttcagaaatrcacacacacatgttgctggtgtattttccaaatattttccttttctctttactccttgtctttcttttccctttgtaccaatgagattcaagtctcctaa

SEQ ID NO: 34530 - DNA, 201 bp, Homo sapiens
gtgtatttcctgcataaactatgctccagtgcaacatctacaataattactttccttatttttgaagtggaccatatctcgacatttattaatcaatctgmatgtgtaaaacctttagatttttatgaattcctcctcaagctttatagtcaactatatgagtggattgccctctgtggatttgatagcaattttttaaat

SEQ ID NO: 34531 - DNA, 201 bp, Homo sapiens; identical to SEQ ID NO: 7527

SEQ ID NO: 34532 - DNA, 201 bp, Homo sapiens
tgggaaaaacattccatgtttaattaaggctctgcagctctatcagacatttgctgtcatttagatattttagcattcctcaagaagtgaacgcctgatgwttttaatttcaaagctaacctcctcccacaatattgcaagtgaaatacgcattcttgctgctcaaaatatggtccacgggtcagcagcagggatgttttc

SEQ ID NO: 34533 - DNA, 201 bp, Homo sapiens; identical to SEQ ID NO: 7482

SEQ ID NO: 34534 - DNA, 201 bp, Homo sapiens
ttaagctgaaataaaacaattccaggaaaatatataatattttcacaaacttgaggaaggcaaaatttttttcaggcaggacccagaaaacactagctttraaagaaaataaattataatttgggctttcataaaatgaaaattatgttcatcaaaagtcattgttaagaaatcagtaggtaagtaacagactggaataaa

SEQ ID NO: 34535 - DNA, 201 bp, Homo sapiens
tctgcagtgtgtcatctttcagaacctcccctgaccgcatgttccctggagggctcgctgtcttcagagccaggcttgtctcctgctgcagcctccactgytctcctagtcactctgtaacccaccccctctgcctgcggcccccaccacgcccctcaaagtggtcaaggttgtcctgttgtctaattccatggagcttgc

SEQ ID NO: 34536 - DNA, 201 bp, Homo sapiens; identical to SEQ ID NO: 7483

SEQ ID NO: 34537 - DNA, 201 bp, Homo sapiens
tttctttgtgatcttttgatatatctctcaagtgctttttagtggattagctttagaatgcatcagccaactcctgctcaataatccatttttccagcccrgaatgtcttaaattgaggaaggacaaagtcccagaggtggggagcagggggactttggccgaggactttgcatgaatcgatgagcatgcatccacctccc

SEQ ID NO: 34538 - DNA, 201 bp, Homo sapiens; identical to SEQ ID NO: 7485

SEQ ID NO: 34539 - DNA, 201 bp, Homo sapiens
agctccctgtgattgagaataaagtgtgcaatcgctatgagtttctgaatggaagagtccaatccaccgaactctgtgctgggcatttggccggaggcacygacagttgccaggtaagcaaagatcaagagaccaaagttagtcttgtgctctcttgtctcagtctcagtccctcagacttcattccccaggtggcaaatt

SEQ ID NO: 34540 - DNA, 201 bp, Homo sapiens
ctgtcttacaagaaatgctaaagggagtctgcaagatgaaaaaagatgctaattagtaacaaaaaagaaaacataaaactcactagttaaagtaagtacayagtcaaattcataatattcaaatacgttaatggtggccacatatatctgtaatatgaaagaatgaatctcttatatctttagcatgaaggttaaaagaca

SEQ ID NO: 34541 - DNA, 201 bp, Homo sapiens
ccagcctgaggagagacctcgctgaacatcttgggcattcagtagtcaccacataaagccaaactttgggagtaggattagtgtattcctataataaaggycactccagaaacagcatagtaaagctgaaaagcaagtctaaaaaaatcaacacgatctccaagtaaattaactgattgccagaagaaaattcaacccttt

SEQ ID NO: 34542 - DNA, 201 bp, Homo sapiens; identical to SEQ ID NO: 7486

SEQ ID NO: 34543 - DNA, 201 bp, Homo sapiens; identical to SEQ ID NO: 7559

SEQ ID NO: 34544 - DNA, 201 bp, Homo sapiens
ttcattaaccccagacctgtcttacaagaaatgctaaagggagtctgcaagatgaaaaaagatgctaattagtaacaaaaaagaaaacataaaactcactrgttaaagtaagtacatagtcaaattcataatattcaaatacgttaatggtggccacatatatctgtaatatgaaagaatgaatctcttatatctttagca

SEQ ID NO: 34545 - DNA, 201 bp, Homo sapiens
ttggattaagcaaaaaagagaaattattagtgaactgaaaattctgcaggctcacatcatggccccagaccctgtccattattcttgggcacaaatgtgayattctcgtggctgcagatgctgtggtggctctggctctgccaggaaaagaaataaggaaggccactctccccattacacaaacaatagtcttccagctct

SEQ ID NO: 34546 - DNA, 201 bp, Homo sapiens
tccatatcatcctgggtctctgtggctcttcataatcatccattttttccctgtacagactgtatgtttgggaatgggaaaggataccgaggcaagagggygaccactgttactgggacgccatgccaggactgggctgcccaggagccccatagacacagcattttcactccagagacaaatccacgggcgggtctggaa

SEQ ID NO: 34547 - DNA, 201 bp, Homo sapiens
ccaggctgctcccagtgttttgcatttttaaaaatttaaatgctgcaaacctctatgaattacatattattgttcctagtttacaaatgaggagcctgagkctcagagaatgtgtgggatggtacagactaacctgaattagaaccctggctcccatttactggctgtcaggacttagaaaagtcataaactctctggctg

SEQ ID NO: 34548 - DNA, 201 bp, Homo sapiens
aaatgtaaagttatttggaaaacccaggttccagattcactagagcatagaatctctggttggttgggaaggaatttcctcttacagttgttactaataaytgtatgaacaattatttaaaatattaacatttacatttgtgaagaccttgaagggctggagacaacagagaagcatttttgaataccctctgcagcccct

SEQ ID NO: 34549 - DNA, 201 bp, Homo sapiens
catacaaaccaatgcgctctgcagtgtgtcatctttcagaacctcccctgaccgcatgttccctggagggctcgctgtcttcagagccaggcttgtctccygctgcagcctccactgttctcctagtcactctgtaacccaccccctctgcctgcggcccccaccacgcccctcaaagtggtcaaggttgtcctgttgtct

SEQ ID NO: 34550 - DNA, 201 bp, Homo sapiens
aggactttgcatgaatcgatgagcatgcatccacctccctgtcctgccccttgtgctctgtgtaccctcaggaggtcaggacaggcctttctgagaatgaraatctgttcatttgctttcctactggatacttgtcatcagcatacaaaccaatgcgctctgcagtgtgtcatctttcagaacctcccctgaccgcatgtt

SEQ ID NO: 34551 - DNA, 201 bp, Homo sapiens
tgggcactgctggccagtcccaaaatggaacataaggaagtggttcttctacttcttttatttctgaaatcaggtaagacatagtttttttaaattataakaattattttttctcccacaatgtagtaaaaatacatatgccatggctttatgtgcaattcatttaatttttgattcatgaaacttccagttgaaaatctt

SEQ ID NO: 34552 - DNA, 201 bp, Homo sapiens
ttttgttttcttggtttaatcaaacatttaaaaacgaatggtctagatgatttcaaagtggctttccttttcctgtgcttttcctactatttaaaaacttyacctccttgatttcttgatctccctttctgcactgctgggtctgggagcattgaggccaagtaaaaggaaccttggcaaaggaggaacacctatgggtgt

SEQ ID NO: 34553 - DNA, 201 bp, Homo sapiens
gcctatgggtgtcattacatgtgagatgggtctcttgaaggtagcataccagtgggtcttgctttttatccagcttgccactctgtgcctcttaagttggrcatttagcccatttacattcaaggttagtattgctatgtgtgaatttgatgccctcattgtgttgttatgctggcttgtttgtgtgatggttttatagtg

SEQ ID NO: 34554 - DNA, 201 bp, Homo sapiens
taagtttaattagatcccatttgtcaatttttgcctttgttgagattgcttttggcatcttcatgaaatttttgcccgttcctatgtccaggatggtgttrcctaggttgtcttccaggatttttgtacttttggattttacatttaagtctttaatccatcttgagttgatttctgtatatggtgtaaggaaaggggtcc

SEQ ID NO: 34555 - DNA, 201 bp, Homo sapiens
taagaataacggcctccagctccattcatgttcctgtaaaagatattacctcattctttcttatggctaaacagtattccatggtgtatatgtaccacatwttcttcatccaatgtgtcattgatggtcatataggtgattccatgtctttgctactgtgaatagtgctgcaatgaacattcatgtgcatgtgtctttagg

SEQ ID NO: 34556 - DNA, 201 bp, Homo sapiens
cttattaataaacatttgttttctttaaataaagaaaaatacttattggatttcctgcttcgttctgcagggcattccaatatcacagtaaagagcaacartgtgtgataatggctgaaaacaggaagtcctccataatcattaggatgagagatgtagttttatttgaaaagaaaggtgagtacattttcttcctcctcc

SEQ ID NO: 34557 - DNA, 201 bp, Homo sapiens
tgttgggagtatgaggcttggatcaggggaaggggagttgacattagttcttaaagaattggaataacaaatccatgggtatttctgaaaaaaaaaaaaaraaaaagaaaggaagctacttggaattgtcccatatttaacattctgctgaccaatcaatttgtcctagttacagaaaaccaccctggacttctcctatgc

SEQ ID NO: 34558 - DNA, 201 bp, Homo sapiens
agaattggttctgtgttacagaaaatctgacctggactgctcttttttgtaatgggggagaggggacagaagaaaatattggaaaggcatcagggggctamgctagaatataattggccttagtatggaaagtacaagcagcacaggccaggaaacctccacacatgtgagggttctcaggcctcttccctttagtgacat

SEQ ID NO: 34559 - DNA, 201 bp, Homo sapiens
atccctacactttgggaggctgagacaagcagatcacctgaggtcaggagttcgagactagcctggccaaaatggtgaaacctcatctctactgaaaatasaaaaaaaaattagccaggtgtggtggcgtgcacctgcagttgcagctactcaggaggctgaagcaggagaatcgcttgaacccaggagatggaggttgca

SEQ ID NO: 34560 - DNA, 201 bp, Homo sapiens
aaagtcctcaagtctttggctaaatagaaagctgcatatgcacagggagaggttccagagagaaaataggataaagaacagctactggggaaagaaaaacygcaggggaacagtgagctcaatggagatgccagagctcacatagcactgggggatatttgagttctgaccagcctgaggagagacctcgctgaacatctt

SEQ ID NO: 34561 - DNA, 201 bp, Homo sapiens
ttaagagtcaatatcacttctcaccaaattgatctttggattcagcccatacccaattgttaaggaagaaattacaagatctaaataaagatatatcatgyttatatattaaaagagtcaatatcacttctcaccaaattgatctttggattcagcccatacccaaccagaatctcagcagtcgttttttttaaaaaatgt

SEQ ID NO: 34562 - DNA, 201 bp, Homo sapiens
gattagctttagaatgcatcagccaactcctgctcaataatccatttttccagcccggaatgtcttaaattgaggaaggacaaagtcccagaggtggggarcagggggactttggccgaggactttgcatgaatcgatgagcatgcatccacctccctgtcctgccccttgtgctctgtgtaccctcaggaggtcaggaca

SEQ ID NO: 34563 - DNA, 201 bp, Homo sapiens
tgctttttagtggattagctttagaatgcatcagccaactcctgctcaataatccatttttccagcccggaatgtcttaaattgaggaaggacaaagtccmagaggtggggagcagggggactttggccgaggactttgcatgaatcgatgagcatgcatccacctccctgtcctgccccttgtgctctgtgtaccctcag

SEQ ID NO: 34564 - DNA, 201 bp, Homo sapiens
tctcaagtgctttttagtggattagctttagaatgcatcagccaactcctgctcaataatccatttttccagcccggaatgtcttaaattgaggaaggacraagtcccagaggtggggagcagggggactttggccgaggactttgcatgaatcgatgagcatgcatccacctccctgtcctgccccttgtgctctgtgta

SEQ ID NO: 34565 - DNA, 201 bp, Homo sapiens
cagcagcgatgcgctatgaagcatagtaacataacacagagaacttaattgaagggggaaataaatggaagttttctttttttgaatatcagttgtagccygctctgctatacttcaaaaaaactcttcagaaagtttaactgaactcactgtaggacacactttgtggatttattgtgtgttttgaagtcacactgtgag

SEQ ID NO: 34566 - DNA, 201 bp, Homo sapiens
gaggggatctcagcagcgatgcgctatgaagcatagtaacataacacagagaacttaattgaagggggaaataaatggaagttttctttttttgaatatcwgttgtagcctgctctgctatacttcaaaaaaactcttcagaaagtttaactgaactcactgtaggacacactttgtggatttattgtgtgttttgaagtc

SEQ ID NO: 34567 - DNA, 201 bp, Homo sapiens
gtggagaaacatcttccatttcacaaattaagtcttttacacatgcaaatatgcatacacattcacacaccacagtgaggaagaaattctcacaccattartaaaatacatttgcatcagtagcaatatacatctgcattttgcctataatataaatgtatttttccactaaaagatttgtttgatgtttccttgccagca

SEQ ID NO: 34568 - DNA, 201 bp, Homo sapiens
tgtctttagttgccatctttatttatgtccaaatgcccgactgtgtgttcttaactaaacattttgattcatagctacccattctacttccagtaaacagmaagttttatttggttaatgctaaccaaatagattaaaaggaagtcatgacaattagacattgacattgatttactgaccatttattccacttggatctcc

SEQ ID NO: 34569 - DNA, 201 bp, Homo sapiens
taagtatgtcatgaatgcataaaatatatgtagatacctagtctattttattctttactaccataaaatataacaaaactattgcaaaagttaaaatttartaaaaattgtgtacacactcacagatcgtatatggtgctattctcagttgagagaagtgtatacaaacatcaagatgcagtattaaattgtaactgcata

SEQ ID NO: 34570 - DNA, 201 bp, Homo sapiens
aggcatgagccaccgcgcccagcctatttgaacgttcctatgcctgctacaagtgcagcagcagaatctccacacatcttgcgtgcgaaagtttcctgtarttcctttagcatagagaggctggggaaggttagagactgacttgtactctttagacatatagttgatcattgaacaacacacgtctgaactgttacacac

SEQ ID NO: 34571 - DNA, 201 bp, Homo sapiens
agcatcttggtggcacctctaactcaaagtccctcgatggagtcagttccagttctccacttctggccccatctggtacacaccactgcctctcactgccygggctctctatccttgacaggctgccttgaagttgagcccagactgattttcttgcctcagaccccactaccgtgcctgggactcatgcacctttgactc

SEQ ID NO: 34572 - DNA, 201 bp, Homo sapiens
tggtcagtgtgccaacccctgaaattgatcaagggtcaactgtaatcctaaaagaatctaatacaatattgtaaacagtaagtggtcaataaataaggaaytgaactaataagaatacataaatcccagaatatgtgcaacctgatcatagtacacagagatctctctatatatctcttttcttagttcatgctgttcttt

SEQ ID NO: 34573 - DNA, 201 bp, Homo sapiens
cacctcagcctccccagtatctgggacgacaggagcatgccaccatgccctgctaatttttggtatttttagtagagatggggtttcaccatgctggccargctggtctcaaactcctgacctcgtgatccacctgccttggcctcccaaagtactgggattacaggcatgagccaccgcgcccagcctatttgaacgttc

SEQ ID NO: 34574 - DNA, 201 bp, Homo sapiens
aattaacctgaattttttttttttctgagacagagttttgctctcgttgcccaggctagagtgcaaccgtgcaatctcggctcaccacaacctccgcctcygggttcaagagattctgctacctcagcctcccaagtagctgggattacaggcatgtgccaccatgcctggctaattttatatttttagtagagacagggt

SEQ ID NO: 34575 - DNA, 201 bp, Homo sapiens
tgatcaagaataaaactattttaaatattttctttatttatttattttaccatttctggtgcttctcatctactggggtagatctcaatttccatctggtrtcagtttctttctgtgaaaaacaacttttagcattttttgtagcacaggtctgctactgctgaagtctttcagattttgagtgtctgaaaaagtattttg

SEQ ID NO: 34576 - DNA, 201 bp, Homo sapiens
gcattttttgtagcacaggtctgctactgctgaagtctttcagattttgagtgtctgaaaaagtattttgccttcagtttttaaaagtaattttgctgaaygtagatactgggttgagagtttcatcacttgcaacactttaatgatgatgttccattatcttctgttttaaatagtttgactagtaatctgatctttgtt

SEQ ID NO: 34577 - DNA, 201 bp, Homo sapiens
ttttgattcatagctacccattctacttccagtaaacagaaagttttatttggttaatgctaaccaaatagattaaaaggaagtcatgacaattagacatygacattgatttactgaccatttattccacttggatctcccacctctaggtcaaggagagcctctggatgactatgtgaatacccagggggcttcactgtt

SEQ ID NO: 34578 - DNA, 201 bp, Homo sapiens
ctgctgaagtctttcagattttgagtgtctgaaaaagtattttgccttcagtttttaaaagtaattttgctgaatgtagatactgggttgagagtttcatyacttgcaacactttaatgatgatgttccattatcttctgttttaaatagtttgactagtaatctgatctttgttcctatgttttcaataggtcatttttc

SEQ ID NO: 34579 - DNA, 201 bp, Homo sapiens
aagatactttcacttatgtcgtaatttctatgtcatttggtgtaggatgtagagatattaacgtttacacctaacttaagtttgtcatctaagacctgaargggttttgtctatcagctgcacccctgggtagagacacaaccttggggaaggcctcagccccatccctcgtacagcaggaatgagaacagccctgcctgt

SEQ ID NO: 34580 - DNA, 201 bp, Homo sapiens
gcaagctgatttttagaatatagtctaagtgcttcttttccatcctccccagattctcacctgctacacacccctcagagggactggaggagaactactgmaggaatccagacaacgatccgcaggggccctggtgctatactactgatccagaaaagagatatgactactgcgacattcttgagtgtgaaggtcaggagt

SEQ ID NO: 34581 - DNA, 201 bp, Homo sapiens
acggaaaaagggccccatggtgccatacaaccaacagccaagtgcggtgggagtactgtaagataccgtcctgtgactcctccccagtatccacggaacarttggctcccacaggtaagcaagggtatgggagcttactgagggcccaagttttctccttatttttgtataccagtggcatcatcacaatatacagtagct

SEQ ID NO: 34582 - DNA, 201 bp, Homo sapiens
gggcagcagagcctgggctcaaggaaggttgaaagaaggggtggcgtggagctgccaggtgcaaatgtcaggccagcaatgcagtccagcttgcatggacrtgcttcgcctaggaagttgtgacttggctgcattttccacttcaggtgagatggaaggttgaactctacctcacctcctggtgaggttgatgtttcctgg

SEQ ID NO: 34583 - DNA, 201 bp, Homo sapiens
ccttaagcaccaccaatgcatcactgttatattaagtctgcccgttttccttagtactccataaaatttaagtcacatattactctgcctcaccatgttayttcaataattctgaatcaaagtttaagtttgtgaataattttgcaaaaaagagccaatcatgcttctcaacaacataaaaagagaagcgctgtcacttca

SEQ ID NO: 34584 - DNA, 201 bp, Homo sapiens
tgtttaaggatttatatccactaatatggtaacatagtagtggttccatagttctaacctgtttgtcaatccagttaatcttttactatcttgcaatctgytaatgaaactgtttttctttgttttataatttcaacttttagagtcaggggtacatgtgcaggtgtgttacataactaaattgcgtgacactgagctttg

SEQ ID NO: 34585 - DNA, 201 bp, Homo sapiens
ccctggtgctatactactgatccagaaaagagatatgactactgcgacattcttgagtgtgaaggtcaggagtggttctagaaaatgttttcatttctgcycttcacctgtaaaataatttgttgtaaagccccttcccacagggatgttattaataattgagtaacgtattcacctctcggaaagaagcaaaaccccaga

SEQ ID NO: 34586 - DNA, 201 bp, Homo sapiens
ctcacctgctacacacccctcagagggactggaggagaactactgcaggaatccagacaacgatccgcaggggccctggtgctatactactgatccagaasagagatatgactactgcgacattcttgagtgtgaaggtcaggagtggttctagaaaatgttttcatttctgcccttcacctgtaaaataatttgttgtaa

SEQ ID NO: 34587 - DNA, 201 bp, Homo sapiens; identical to SEQ ID NO: 7517

SEQ ID NO: 34588 - DNA, 201 bp, Homo sapiens; identical to SEQ ID NO: 7518

SEQ ID NO: 34589 - DNA, 201 bp, Homo sapiens
aaaagtgacctacaagtcctatgggatgttattggtctttattttattgctggtttaaaacagttatggttattggttactgtgggtgattgatcagagcrtccatttatcatgtttttctttctttgcaactgaaacttctgcctcaggagttcactgaaatgtaggctttaggtgttgttcatcctattctctctgtgc

SEQ ID NO: 34590 - DNA, 201 bp, Homo sapiens
ataatcacctcattgcatggtcctggggactgatgaacaaaggctaacatgtggaaaagggcaactaaagaaagaagagccacctccaggttaattagtasaagtctcctcgctggtatgccctaatacactaaaacagcagtaaaaacaatctgcacattggcatcgaaggcacagataaacttgccgaggacccttacc

SEQ ID NO: 34591 - DNA, 201 bp, Homo sapiens
gcttcgttctgcagggcattccaatatcacagtaaagagcaacaatgtgtgataatggctgaaaacaggaagtcctccataatcattaggatgagagatgyagttttatttgaaaagaaaggtgagtacattttcttcctcctcctcctactgtcctccccatcctcccactcttcctctttctctattctatctttaatt

SEQ ID NO: 34592 - DNA, 201 bp, Homo sapiens
aggagacagccaatgaaaattaattttttcaaagatgaatagatatctagattttttcaagcacaactcatttaagaaaatatcacctcactgagccccawatgagttaggtctcacttagaaagtgtcccctagtgccaggtaaagtgcctcatatttgcaatcccagcacttctggagacggagataggaggatctcat

SEQ ID NO: 34593 - DNA, 201 bp, Homo sapiens
tctaaggatagacatgaaatgcgtgagccttggaacaccttctccctctcctgccccacgtgagctggagcttacatgccttcttgttttcagtactgccrtaaccctgatggtgatgtaggtggtccctggtgctacacgacaaatccaagaaaactttacgactactgtgatgtccctcagtgtggtaggttgccttct

SEQ ID NO: 34594 - DNA, 201 bp, Homo sapiens
caaagtatcaatttaactaaaatttgaactaaatcctctttccaggtttggaatgcacttctgtggaggcaccttgatatccccagagtgggtgttgactrctgcccactgcttggagaagtatgtttaggggacaattgacatgaagtcttgtcttaaatactttttctgtccttcttttcctcctttcctcctttcctt

SEQ ID NO: 34595 - DNA, 201 bp, Homo sapiens
caattcttcacgatctgttacagaaaatagaggagaagggaaatatttcttgactcaatttgtgagaaaaaaaaaaaaccctagttgtaaaaaagtagacwaggatattgtgagaaactatagcacattatgtattgtgaacataaatataaaaagatgtaacaaaattttaatcattaacatgatgaatatcccaaacaa

SEQ ID NO: 34596 - DNA, 201 bp, Homo sapiens
caatgtggcttccaccataaagacgcagcagacacaatctcaggaacacaggtaatactgaagatgtagtagatgaactagaaactgatgaatgttgagastaaaatcagttcctactttaaatgcatagacattaatgtaacacaacaagaaacatgaaaaaacaaggaggtaaaataaaacaccatcaaaggacacaat

SEQ ID NO: 34597 - DNA, 201 bp, Homo sapiens
agtctcctaacctttgacctatgagcagacgtcatggatttttgaatccctgatgttttatgtatatttacatcaatgtgtttttctggaatgaggattcrtaacttccatcagattctctaaggggaccacgaatttaaaataagaataagcttcttgctctagaaagtcatgatggttcctagaataaggtttcgtgag

SEQ ID NO: 34598 - DNA, 201 bp, Homo sapiens
tttaaataaagaaaaatacttattggatttcctgcttcgttctgcagggcattccaatatcacagtaaagagcaacaatgtgtgataatggctgaaaacargaagtcctccataatcattaggatgagagatgtagttttatttgaaaagaaaggtgagtacattttcttcctcctcctcctactgtcctccccatcctcc

SEQ ID NO: 34599 - DNA, 201 bp, Homo sapiens; identical to SEQ ID NO: 7439

SEQ ID NO: 34600 - DNA, 201 bp, Homo sapiens
ggcttgggaaggtagctatggaatccagactgagcacccatagcaggaccacgggatggagatgggaggggtcaggggccagggtggggtggaatgtggarcagaggttcaggggaactgatcagagttgggaggtcatggagacggactatcttggcgaatgggttcaaagcaaccagagttgcttctttccaacccaaa

SEQ ID NO: 34601 - DNA, 201 bp, Homo sapiens
tttgtgtaggtgacgggcttgggaaggtagctatggaatccagactgagcacccatagcaggaccacgggatggagatgggaggggtcaggggccagggtrgggtggaatgtggagcagaggttcaggggaactgatcagagttgggaggtcatggagacggactatcttggcgaatgggttcaaagcaaccagagttgct

SEQ ID NO: 34602 - DNA, 201 bp, Homo sapiens
ctttgtgtaggtgacgggcttgggaaggtagctatggaatccagactgagcacccatagcaggaccacgggatggagatgggaggggtcaggggccagggyggggtggaatgtggagcagaggttcaggggaactgatcagagttgggaggtcatggagacggactatcttggcgaatgggttcaaagcaaccagagttgc

SEQ ID NO: 34603 - DNA, 201 bp, Homo sapiens
ctcccacctctaggtcaaggagagcctctggatgactatgtgaatacccagggggcttcactgttcagtgtcactaagaagcagctgggagcaggaagtakagaagaatgtgcagcaaaatgtgaggaggacgaagaattcacctgcaggtatttccattgtcgttgcacctacgcaggaatctgtaattcagatggcaag

SEQ ID NO: 34604 - DNA, 201 bp, Homo sapiens
atctcccacctctaggtcaaggagagcctctggatgactatgtgaatacccagggggcttcactgttcagtgtcactaagaagcagctgggagcaggaagyatagaagaatgtgcagcaaaatgtgaggaggacgaagaattcacctgcaggtatttccattgtcgttgcacctacgcaggaatctgtaattcagatggca

SEQ ID NO: 34605 - DNA, 201 bp, Homo sapiens
aattagacattgacattgatttactgaccatttattccacttggatctcccacctctaggtcaaggagagcctctggatgactatgtgaatacccaggggscttcactgttcagtgtcactaagaagcagctgggagcaggaagtatagaagaatgtgcagcaaaatgtgaggaggacgaagaattcacctgcaggtattt

SEQ ID NO: 34606 - DNA, 201 bp, Homo sapiens
agtcatgacaattagacattgacattgatttactgaccatttattccacttggatctcccacctctaggtcaaggagagcctctggatgactatgtgaatrcccagggggcttcactgttcagtgtcactaagaagcagctgggagcaggaagtatagaagaatgtgcagcaaaatgtgaggaggacgaagaattcacctg

SEQ ID NO: 34607 - DNA, 201 bp, Homo sapiens
tgcatggacgtgcttcgcctaggaagttgtgacttggctgcattttccacttcaggtgagatggaaggttgaactctacctcacctcctggtgaggttgaygtttcctggtgtttataactttctttgtaaatacttgaaaggaatttaccattttaatgctggaagagacgtctattccttcttaagaggacctgagtgg

SEQ ID NO: 34608 - DNA, 201 bp, Homo sapiens
aggaagtcatgacaattagacattgacattgatttactgaccatttattccacttggatctcccacctctaggtcaaggagagcctctggatgactatgtraatacccagggggcttcactgttcagtgtcactaagaagcagctgggagcaggaagtatagaagaatgtgcagcaaaatgtgaggaggacgaagaattca

SEQ ID NO: 34609 - DNA, 201 bp, Homo sapiens
ggcctccaagttccatttctacccagggatgaacaaatcaacatcaatcttggtaacacaactgccactgatggtgccttactcttctctcatgacatggmacaatcaatagcaaacataaaatttgttcttgtttaaggatttatatccactaatatggtaacatagtagtggttccatagttctaacctgtttgtcaat

SEQ ID NO: 34610 - DNA, 201 bp, Homo sapiens
ccggaaaaactaagtggtgtggtttcgctaaacagattttgctaagtacttaagcactgcagatgcttgagtaatatgctcataagttcctttctgatttsaattactgggaaaatgtatatatggatagtagaaggatggcatcccataataaaaggcaggcagcctaaccctcacatgcatttttctctccctctgtat

SEQ ID NO: 34611 - DNA, 201 bp, Homo sapiens
tggtactgtgtgacaactcagttctcccatcacttccacctgttcgaatcacggggatcctttatttgtacaccatgttataggtatttgcccttaagcaycaccaatgcatcactgttatattaagtctgcccgttttccttagtactccataaaatttaagtcacatattactctgcctcaccatgttacttcaataat

SEQ ID NO: 34612 - DNA, 201 bp, Homo sapiens
tgatcaagggtcaactgtaatcctaaaagaatctaatacaatattgtaaacagtaagtggtcaataaataaggaattgaactaataagaatacataaatcycagaatatgtgcaacctgatcatagtacacagagatctctctatatatctcttttcttagttcatgctgttctttcaggtagaaagcgccttattttgaa

SEQ ID NO: 34613 - DNA, 201 bp, Homo sapiens
ggaaagaaggaagaaaagaaagagaaagaaagaaagaaagaaagaaagagagagagagagagaaagaaagaaagaaagaaagaaagaaagaaagaaagaamgaaagaaagaaagaaagaagggaaagaaagaaagagaacgaaagaaagaagggagggagggagggagggagggaggaagggtgggtgggttgtgaactct

SEQ ID NO: 34614 - DNA, 201 bp, Homo sapiens
tgagaaagaaagaaagaaggaaagaaggaaagaaggaagaaaagaaagagaaagaaagaaagaaagaaagaaagagagagagagagagaaagaaagaaagraagaaagaaagaaagaaagaaagaaagaaagaaagaaagaaagaagggaaagaaagaaagagaacgaaagaaagaagggagggagggagggagggaggga

SEQ ID NO: 34615 - DNA, 201 bp, Homo sapiens
cagagcagtcaaacataactgctgatgcttttctttcagtcctgccgtcatcactgacaaagtaatcccagcttgtctgccatccccaaattatgtggtcrctgaccggaccgaatgtttcatcactggctggggagaaacccaaggtgagataaattccattgcccacataacgaattggttttgacctacagtccatgt

SEQ ID NO: 34616 - DNA, 201 bp, Homo sapiens
gagactctatgtgagaaagaaagaaagaaggaaagaaggaaagaaggaagaaaagaaagagaaagaaagaaagaaagaaagaaagagagagagagagagaragaaagaaagaaagaaagaaagaaagaaagaaagaaagaaagaaagaaagaaagaagggaaagaaagaaagagaacgaaagaaagaagggagggagggag

SEQ ID NO: 34617 - DNA, 201 bp, Homo sapiens
taccctccagtgttttgcccaatttttgtccaaggtggcaacataatttagttcagttcttgtttatttccaccatcatctatgcaccaaaatttatgttyctcaaggagggaccattcagaggatgcttcccaccggttcaagtgacagtgccagaaccaaagcgcatattgtaggaaatcaaacaatggcctccaagtt

SEQ ID NO: 34618 - DNA, 201 bp, Homo sapiens
agtgttgtgtgactgtcataagcccagtacaaaaatggccttctttgttggggagcttcttaccctccagtgttttgcccaatttttgtccaaggtggcarcataatttagttcagttcttgtttatttccaccatcatctatgcaccaaaatttatgtttctcaaggagggaccattcagaggatgcttcccaccggttc

SEQ ID NO: 34619 - DNA, 201 bp, Homo sapiens
attagtagtgttgtgtgactgtcataagcccagtacaaaaatggccttctttgttggggagcttcttaccctccagtgttttgcccaatttttgtccaagktggcaacataatttagttcagttcttgtttatttccaccatcatctatgcaccaaaatttatgtttctcaaggagggaccattcagaggatgcttcccac

SEQ ID NO: 34620 - DNA, 201 bp, Homo sapiens
aagaccagtatttgtcccaggtcctgcttttttacaatttcctccgaaatccagatacctgtcaacaccttggaaaaactgacttctccccaattagtagkgttgtgtgactgtcataagcccagtacaaaaatggccttctttgttggggagcttcttaccctccagtgttttgcccaatttttgtccaaggtggcaaca

SEQ ID NO: 34621 - DNA, 201 bp, Homo sapiens
gacagattcgttgtctcagatttgatctcaaagaaaaaccaagaccagtatttgtcccaggtcctgcttttttacaatttcctccgaaatccagatacctrtcaacaccttggaaaaactgacttctccccaattagtagtgttgtgtgactgtcataagcccagtacaaaaatggccttctttgttggggagcttcttac

SEQ ID NO: 34622 - DNA, 201 bp, Homo sapiens
agaaagcagctttcggacagattcgttgtctcagatttgatctcaaagaaaaaccaagaccagtatttgtcccaggtcctgcttttttacaatttcctccraaatccagatacctgtcaacaccttggaaaaactgacttctccccaattagtagtgttgtgtgactgtcataagcccagtacaaaaatggccttctttgt

SEQ ID NO: 34623 - DNA, 201 bp, Homo sapiens
ctcccctgaccgcatgttccctggagggctcgctgtcttcagagccaggcttgtctcctgctgcagcctccactgttctcctagtcactctgtaacccacyccctctgcctgcggcccccaccacgcccctcaaagtggtcaaggttgtcctgttgtctaattccatggagcttgcctgtcttcattttattagcctcttt

SEQ ID NO: 34624 - DNA, 201 bp, Homo sapiens
ccacctccctgtcctgccccttgtgctctgtgtaccctcaggaggtcaggacaggcctttctgagaatgaaaatctgttcatttgctttcctactggatayttgtcatcagcatacaaaccaatgcgctctgcagtgtgtcatctttcagaacctcccctgaccgcatgttccctggagggctcgctgtcttcagagccag

SEQ ID NO: 34625 - DNA, 201 bp, Homo sapiens
aatgggggaaaattatttcaaactgaaaagagaaaagtttgattctgttttgggatatttcctagggacatgagctggggaggggatctcagcagcgatgygctatgaagcatagtaacataacacagagaacttaattgaagggggaaataaatggaagttttctttttttgaatatcagttgtagcctgctctgctata

SEQ ID NO: 34626 - DNA, 201 bp, Homo sapiens
gccagcaaataagccctatcaaatcctattgccatatgagtcctagaggtgaataagagaagaaaaaatgggggaaaattatttcaaactgaaaagagaamagtttgattctgttttgggatatttcctagggacatgagctggggaggggatctcagcagcgatgcgctatgaagcatagtaacataacacagagaactt

SEQ ID NO: 34627 - DNA, 201 bp, Homo sapiens
cactgacaatagtatcaaaaccacaagatatttagtgatacatttaacacaatatgcacaagaattatgtactgcatactaaaaaacattgttaaggaagraatcaaaagatctaaataaagatatatcacgcttatatattaagagtcaatatcacttctcaccaaattgatctttggattcagcccatacccaattgtt

SEQ ID NO: 34628 - DNA, 201 bp, Homo sapiens
tgggtgacagagtgagactctatgtgagaaagaaagaaagaaggaaagaaggaaagaaggaagaaaagaaagagaaagaaagaaagaaagaaagaaagagrgagagagagagaaagaaagaaagaaagaaagaaagaaagaaagaaagaaagaaagaaagaaagaaagaagggaaagaaagaaagagaacgaaagaaagaa

SEQ ID NO: 34629 - DNA, 201 bp, Homo sapiens
tgagccaagattgtgccactgcactccagcctgggtgacagagtgagactctatgtgagaaagaaagaaagaaggaaagaaggaaagaaggaagaaaagaragagaaagaaagaaagaaagaaagaaagagagagagagagagaaagaaagaaagaaagaaagaaagaaagaaagaaagaaagaaagaaagaaagaaagaa

SEQ ID NO: 34630 - DNA, 201 bp, Homo sapiens
tgggaggtggaggttgcagtgagccaagattgtgccactgcactccagcctgggtgacagagtgagactctatgtgagaaagaaagaaagaaggaaagaargaaagaaggaagaaaagaaagagaaagaaagaaagaaagaaagaaagagagagagagagagaaagaaagaaagaaagaaagaaagaaagaaagaaagaaa

SEQ ID NO: 34631 - DNA, 201 bp, Homo sapiens
cttcaacctgggaggtggaggttgcagtgagccaagattgtgccactgcactccagcctgggtgacagagtgagactctatgtgagaaagaaagaaagaargaaagaaggaaagaaggaagaaaagaaagagaaagaaagaaagaaagaaagaaagagagagagagagagaaagaaagaaagaaagaaagaaagaaagaaa

SEQ ID NO: 34632 - DNA, 201 bp, Homo sapiens
gattctttcttctctttgcagtatgccctgacaataattatatccatcagcctagtccccttggccattgaaacactaagactgtcttaggatccctgctscagtttctcagaggtgctaggagggcattaggagtctgaagccctggaagtgtgttctgactttgccactagctagatagacctggactaggcacattac

SEQ ID NO: 34633 - DNA, 201 bp, Homo sapiens
ttccatcttctacatatggctagccagttaccccagcaccatttattgaatagggagttattttcccattgcttgtttttgtcagctttgttaaaaatcaratgtctgtaggtgtgtggccttatttctgggctctctattctgttccactggtctacgtgtcttttttttttttttttaccagtaccatgctgtttttgt

SEQ ID NO: 34634 - DNA, 201 bp, Homo sapiens
tcttaagtttaattagatcccatttgtcaatttttgcctttgttgagattgcttttggcatcttcatgaaatttttgcccgttcctatgtccaggatggtrttgcctaggttgtcttccaggatttttgtacttttggattttacatttaagtctttaatccatcttgagttgatttctgtatatggtgtaaggaaagggg

SEQ ID NO: 34635 - DNA, 201 bp, Homo sapiens
agaaaatgttttcatttctgcccttcacctgtaaaataatttgttgtaaagccccttcccacagggatgttattaataattgagtaacgtattcacctctsggaaagaagcaaaaccccagaattaacctgaattttttttttttctgagacagagttttgctctcgttgcccaggctagagtgcaaccgtgcaatctcgg

SEQ ID NO: 34636 - DNA, 201 bp, Homo sapiens; identical to SEQ ID NO: 7548

SEQ ID NO: 34637 - DNA, 201 bp, Homo sapiens
acagagtctgtttttgagcaaaacagaattaaatgagatataaataacaaaaaaattgggaaattatcaaatatctgaaaatgaaacaacacatttccaawtacttcataagtcaaagaaggaatttagaaaagttttgaactgaataatagtaaaaatacaacatatcaaagttcgtatgatgcagcgaatgtttttagg

SEQ ID NO: 34638 - DNA, 201 bp, Homo sapiens
ggttgaggcagctagagaaggctcagggaggaggtgggaactgagctgggtttggagttgagagagctcttgacaagcaccaggaaggcaggggaagatgyggccctgcaccttctgagggggaccattaagagatgaagttgactaaagcagagactttgtgtaggtgacgggcttgggaaggtagctatggaatccaga

SEQ ID NO: 34639 - DNA, 201 bp, Homo sapiens
agtggcatgggtctctgagagaatcattaacttaatttgactatctggtttgtggatgcgtttactctcatgtaagtcaacaacatcctgggattgggacmcactttctgggcactgctggccagtcccaaaatggaacataaggaagtggttcttctacttcttttatttctgaaatcaggtaagacatagtttttttaa

SEQ ID NO: 34640 - DNA, 201 bp, Homo sapiens
ttgaaccctgctgagccagtggcatgggtctctgagagaatcattaacttaatttgactatctggtttgtggatgcgtttactctcatgtaagtcaacaayatcctgggattgggacccactttctgggcactgctggccagtcccaaaatggaacataaggaagtggttcttctacttcttttatttctgaaatcaggta

SEQ ID NO: 34641 - DNA, 201 bp, Homo sapiens
acatgttgtaaggactctttattcaaggtaatgtttgaaccctgctgagccagtggcatgggtctctgagagaatcattaacttaatttgactatctggtytgtggatgcgtttactctcatgtaagtcaacaacatcctgggattgggacccactttctgggcactgctggccagtcccaaaatggaacataaggaagtg

SEQ ID NO: 34642 - DNA, 201 bp, Homo sapiens
gcgtggagcagccgaggggggagattgctttcaccacttcccagcatctattgcagattccaccctcaaacatgttgtaaggactctttattcaaggtaaygtttgaaccctgctgagccagtggcatgggtctctgagagaatcattaacttaatttgactatctggtttgtggatgcgtttactctcatgtaagtcaac

SEQ ID NO: 34643 - DNA, 201 bp, Homo sapiens
gcccagcctatttgaacgttcctatgcctgctacaagtgcagcagcagaatctccacacatcttgcgtgcgaaagtttcctgtagttcctttagcatagaraggctggggaaggttagagactgacttgtactctttagacatatagttgatcattgaacaacacacgtctgaactgttacacacagatttttttcaataa

SEQ ID NO: 34644 - DNA, 201 bp, Homo sapiens
gggaaggaataaggagacatgacggcagcgtggagcagccgaggggggagattgctttcaccacttcccagcatctattgcagattccaccctcaaacatkttgtaaggactctttattcaaggtaatgtttgaaccctgctgagccagtggcatgggtctctgagagaatcattaacttaatttgactatctggtttgtg

SEQ ID NO: 34645 - DNA, 201 bp, Homo sapiens
ctagtctattttattctttactaccataaaatataacaaaactattgcaaaagttaaaatttagtaaaaattgtgtacacactcacagatcgtatatggtrctattctcagttgagagaagtgtatacaaacatcaagatgcagtattaaattgtaactgcataaatttaaccgtagtgcataccacactatggtaataat

SEQ ID NO: 34646 - DNA, 201 bp, Homo sapiens
aaatttaaccgtagtgcataccacactatggtaataatttcatatcctcctcctgttgctgttgcaatgagcaaaggtgttgcgagtatccacttaaaacrttctgtgatactcaacattccatcatgagcagttcatccccagtgaattgcgcatcacagtaaaaagtgctctctccctgttcgcatgtatttttcgtcc

SEQ ID NO: 34647 - DNA, 201 bp, Homo sapiens
cctaagacccagaaatcataatccatgggatttgtttagtaaagaagaaaatctgtggctctaggtgtccactaaaggagagccaaaaatgtcccgaatartctcaggaccacagcatcattttatgaataacagaaccaagacctcagattgtacaacagattggttcttattgctggaatggggcataaaccatgcctg

SEQ ID NO: 34648 - DNA, 201 bp, Homo sapiens
acactcacagatcgtatatggtgctattctcagttgagagaagtgtatacaaacatcaagatgcagtattaaattgtaactgcataaatttaaccgtagtrcataccacactatggtaataatttcatatcctcctcctgttgctgttgcaatgagcaaaggtgttgcgagtatccacttaaaacgttctgtgatactcaa

SEQ ID NO: 34649 - DNA, 201 bp, Homo sapiens
gcctgcccggttttgaaacagtctgcagtacacacggtgacaggagaatgacctgtgggagagatacatgtttagaaggaagagaaaggacaaaggcacaygttttaccatttaaaatattgttaccaaacaaaaatatccattcaaaatacaatttaacaatgcaacagtcatcttacagcagagaaatgcagagaaaag

SEQ ID NO: 34650 - DNA, 201 bp, Homo sapiens
gtgcctgtaatcccagcaactcaggaggctgaggcaggagaatcacttgaacccaggaggtggaggttgcagtgagctgagatcgtgccattacggtccarcctgggtgacagagcgagactcaaaacaaacaaacaaacaaacaaacaaaaagataataatttactacttgaagcaaaatgatagcaatgtattgctact

SEQ ID NO: 34651 - DNA, 201 bp, Homo sapiens
catgtaaatgaacaacaagcaaatattgaaggtggaccacttatttcccattgctaattgcctgcccggttttgaaacagtctgcagtacacacggtgacrggagaatgacctgtgggagagatacatgtttagaaggaagagaaaggacaaaggcacacgttttaccatttaaaatattgttaccaaacaaaaatatcca

SEQ ID NO: 34652 - DNA, 201 bp, Homo sapiens
tagtgatacatttaacacaatatgcacaagaattatgtactgcatactaaaaaacattgttaaggaaggaatcaaaagatctaaataaagatatatcacgyttatatattaagagtcaatatcacttctcaccaaattgatctttggattcagcccatacccaattgttaaggaagaaattacaagatctaaataaagata

SEQ ID NO: 34653 - DNA, 201 bp, Homo sapiens
caagagcatgtaaatgaacaacaagcaaatattgaaggtggaccacttatttcccattgctaattgcctgcccggttttgaaacagtctgcagtacacacrgtgacaggagaatgacctgtgggagagatacatgtttagaaggaagagaaaggacaaaggcacacgttttaccatttaaaatattgttaccaaacaaaaa

SEQ ID NO: 34654 - DNA, 201 bp, Homo sapiens
ctgcacacactttacactgatgcccaggctagcccagtctaaaggaaacaccaacataggaagggatgtgtgcaggattcacaaaagatcttttctacccsccggaaaaactaagtggtgtggtttcgctaaacagattttgctaagtacttaagcactgcagatgcttgagtaatatgctcataagttcctttctgattt

SEQ ID NO: 34655 - DNA, 201 bp, Homo sapiens
gacaacatgtgtatataatctttaatatgttaatatatattaataaatcaataaacttcccacagagaacactctaagttcagatggcatcattagaaatkttattatttaaaaaaaatccaattcttcacgatctgttacagaaaatagaggagaagggaaatatttcttgactcaatttgtgagaaaaaaaaaaaaccc

SEQ ID NO: 34656 - DNA, 201 bp, Homo sapiens
ccaggtctaacaaggacagcttttcttccataaatgagtacacaatatatggaaaaaactatttttacatattggagaacagataaactgagataatttakaaagggaatcaaatgagatcaacccaataactaccttggctttgttcctggagacttcctgggctgaagaacaaggagatggagcccaagccgaccacag

SEQ ID NO: 34657 - DNA, 201 bp, Homo sapiens
atgaatcagagaccaggaagagccatgcacctgagaggctcttttttaagccagctacatattatgtgttcccagaaacttcaacagcactacaaataatmctaactcatccaacattatataaaaatactctggatagattgaggtctttatacagtattacaacagtgtggcataatgtagctgaaatgcacacgtgca

SEQ ID NO: 34658 - DNA, 201 bp, Homo sapiens
atgtcatgaatgcataaaatatatgtagatacctagtctattttattctttactaccataaaatataacaaaactattgcaaaagttaaaatttagtaaarattgtgtacacactcacagatcgtatatggtgctattctcagttgagagaagtgtatacaaacatcaagatgcagtattaaattgtaactgcataaattt

SEQ ID NO: 34659 - DNA, 201 bp, Homo sapiens
caaaccatccagctagaaatatcaacaaaaatagaaaaagttaagtatgtcatgaatgcataaaatatatgtagatacctagtctattttattctttactrccataaaatataacaaaactattgcaaaagttaaaatttagtaaaaattgtgtacacactcacagatcgtatatggtgctattctcagttgagagaagtg

SEQ ID NO: 34660 - DNA, 201 bp, Homo sapiens
tgttacacacagatttttttcaataaatgtgttagaaaatgttttggagttttgcaacaatttgaaaaaactcaaagacaaaccatccagctagaaatatyaacaaaaatagaaaaagttaagtatgtcatgaatgcataaaatatatgtagatacctagtctattttattctttactaccataaaatataacaaaactat

SEQ ID NO: 34661 - DNA, 201 bp, Homo sapiens
cccaaagtactgggattacaggcatgagccaccgcgcccagcctatttgaacgttcctatgcctgctacaagtgcagcagcagaatctccacacatcttgmgtgcgaaagtttcctgtagttcctttagcatagagaggctggggaaggttagagactgacttgtactctttagacatatagttgatcattgaacaacaca

SEQ ID NO: 34662 - DNA, 201 bp, Homo sapiens
cactctgcagggtcagagactccagcggcattgggagctgcctcgtgttctgcagcctcacagacaggaggtccagtgccgctgctctgttctggaatatsctcctgaatgtgttttgggtgcagttgccatttctttcatctttttaaacacaggtacttttggagctggccttctcaaggaagcccagctccctgtgat

SEQ ID NO: 34663 - DNA, 201 bp, Homo sapiens
ccagaacattttcctcattcccaaaggaaacctcatgttcattaagcagtagctccccttaacatattagttatgaagatcatagcattatacaaaactcmtgacacaatgatgagtgaaaaaatcaagatgtgaaattttgtgttatgatgtaattagtaaaagaagcatattaaaacatctgaaaaaagagtatataaa

SEQ ID NO: 34664 - DNA, 201 bp, Homo sapiens
ttcagaacatttttatttcaattaattaatttttaacttttattttaggttcaggggtacatgtgcaagtttcttgtatatgtaaacagtggtttgtcatrcagattattttgtcacctaggtactaaccctagtacccaattcttagtatttcctgctcctctccctcctcccactcttctccctcaagtaggccccagt

SEQ ID NO: 34665 - DNA, 201 bp, Homo sapiens
gcttatttccaatcctctttcatttggtatcaagtattttactggattcttacaactatggcgtagtaacattcactgaggaggaaatggaggatccaagsatggagcaagttgctctgggcacacaacacatttgcaattttacagcctcttggtggcatctcagtcagacattccatgcactgatcaatgccctattcg

SEQ ID NO: 34666 - DNA, 201 bp, Homo sapiens
gataggctgatacatttcgagtttagagttcccaccccacatccccacaccccgagtctagggcatttagtgctccaccagggaacctgtagagtgaggamgtctgcatgacaggctgggccttctgatgatgctcagaagcagaaagtgtgcctgcttcaaagttggtgacgatgatgtttcttgatcagaatagggcat

SEQ ID NO: 34667 - DNA, 201 bp, Homo sapiens
agctggggtgttctgatggcttgaacaagtaatttggaaattttgggttttggaggagttctctgataggctgatacatttcgagtttagagttcccaccycacatccccacaccccgagtctagggcatttagtgctccaccagggaacctgtagagtgaggacgtctgcatgacaggctgggccttctgatgatgctca

SEQ ID NO: 34668 - DNA, 201 bp, Homo sapiens
gacactctagaaggagagaagagcctttccagctcagcctttataaacagtagctgatctccctcctgctccccagtgtcctccccgccatcccagcaaaygtgcaaatagaaggtccccgttcctcatgatcctcagagagctggggtgttctgatggcttgaacaagtaatttggaaattttgggttttggaggagttc

SEQ ID NO: 34669 - DNA, 201 bp, Homo sapiens
tgaaattcaaatgttgcaacttgcctattatttattttagtgcatttttttgtacttttcccagtttggtgttaggtggcattaagttctcagtaatgacrcttatcaaataggaacttagtgcttgttactcacctttatccattcccccaacactcaacaaattgcctttgctatatccctatgagatgagcagatcaa

SEQ ID NO: 34670 - DNA, 201 bp, Homo sapiens
cagtgtggacagggatgagcatggcctggatgagaaggcacggggcaggagcctgagctgctctcctgggcctggccacaagcccagggcagcttctctgrgtctgtgaactgaggggtgatgtcctgggatgctctgacactctagaaggagagaagagcctttccagctcagcctttataaacagtagctgatctccct

SEQ ID NO: 34671 - DNA, 201 bp, Homo sapiens
tcatttagtgctgtttggagccagatactagttgagtcagctaagaaacagctatttgtaggagaagcaggtttgggacaggtgacaaggcacgcagggcrctcgctgtgctggtggttctggaagacagggtgtcagtgtggacagggatgagcatggcctggatgagaaggcacggggcaggagcctgagctgctctcc

SEQ ID NO: 34672 - DNA, 201 bp, Homo sapiens
tcagttattccaggctgacaattcccccttcatcataatatgtttaagagaatcatataagactatatttgtttcaaagcactttaaaaaccacaagatcragttgggtgtctggtgtgggtgcctgtaatcccagctacttgggaggctgaggcaggagggtcacttgagtcccggagtttgaggctgcagtgagttatg

SEQ ID NO: 34673 - DNA, 201 bp, Homo sapiens
caaggagttcaaggcaagcctgggcaataagtgggaccctgtctctaaaaacaaacaaaaaaaagaaagtccttggaatacagggccaaccttgtttcctwgttgccatctctgaacacagccttcatctgattacctcctccatgcccgactgtgcctagcacacagcaggtgctcaatgtttgctcttgaaaaagagtc

SEQ ID NO: 34674 - DNA, 201 bp, Homo sapiens
tctggaatgaggattcgtaacttccatcagattctctaaggggaccacgaatttaaaataagaataagcttcttgctctagaaagtcatgatggttcctaraataaggtttcgtgagtattctatttcacattaattgtgctggaaaacacctcccattccacagtcgcttctggtcttcctcttcattctatgatgacta

SEQ ID NO: 34675 - DNA, 201 bp, Homo sapiens
tctgtcttcagaaatgcacacacacatgttgctggtgtattttccaaatattttccttttctctttactccttgtctttcttttccctttgtaccaatgarattcaagtctcctaacctttgacctatgagcagacgtcatggatttttgaatccctgatgttttatgtatatttacatcaatgtgtttttctggaatgag

SEQ ID NO: 34676 - DNA, 201 bp, Homo sapiens
tgtcccaggtcctgcttttttacaatttcctccgaaatccagatacctgtcaacaccttggaaaaactgacttctccccaattagtagtgttgtgtgactktcataagcccagtacaaaaatggccttctttgttggggagcttcttaccctccagtgttttgcccaatttttgtccaaggtggcaacataatttagttca

SEQ ID NO: 34677 - DNA, 201 bp, Homo sapiens
gtgaatgttacggtttaaaaggaaaatgacatttggattatgctagaaaatcctgagtccttattgccaattttattgccaagtgcctgttgtgaattacrtcggaatgagaggcaagtcgcacttaagtgagtaggattctggtttttactctctattttgcttcatccatttcagttttcttcttcctctctgtccttc

SEQ ID NO: 34678 - DNA, 201 bp, Homo sapiens
ggtagtctaggctcatctttatgagggaactgaggtctcggggggtgggggttatcccaaataggttcacagaagaaccagaaataaaacctgcctttctmgactgtaagtcttgtgattttcatctaaatggttgtctctatacagcaactcatctctagaactgaaaataagcttaaatccctcctccatccccaataa

SEQ ID NO: 34679 - DNA, 201 bp, Homo sapiens
gacctccagataacatcaacttaatggtgaaagattaatgttttctctctaagattgggaataagaaaaatatgtttgctctcagtacttctaatcagcaktttactacattggtcacaaccattgccataagacctgaaaacaaaacaaaaagagaggaaaaaaaggaaggaaagaaagaaagggcctaaagtttggaga

SEQ ID NO: 34680 - DNA, 201 bp, Homo sapiens
aataattactttccttatttttgaagtggaccatatctcgacatttattaatcaatctgaatgtgtaaaacctttagatttttatgaattcctcctcaagytttatagtcaactatatgagtggattgccctctgtggatttgatagcaattttttaaatgattcatgtttcaacttgttaaaaacatttaatttagttaa

SEQ ID NO: 34681 - DNA, 201 bp, Homo sapiens
gtgggatattgacctgctactaacttacctgccagggttttgccaggaacagtcagtgttagatcacatttacttctgccacttgccaccagccacactgscttcaccaagtccaagaccctatcaccactggttggggctacttgtagctgtacacatgatctctaagaaatgtaacttccctgtttaaagcccttccta

SEQ ID NO: 34682 - DNA, 201 bp, Homo sapiens
catcaagtataaatatttgaagggatgcatgacactttaaaaactgtttcctctactgtgttggtagccaggtattaagactgttaatagtaacaatttasctctccaaacattctgcatcccaggtgttaaagaggactggaaacaccttagttcttgtattcttgaggatgatttgccatattgtgtctagtattacgg

SEQ ID NO: 34683 - DNA, 201 bp, Homo sapiens
ttagaaggaagagaaaggacaaaggcacacgttttaccatttaaaatattgttaccaaacaaaaatatccattcaaaatacaatttaacaatgcaacagtyatcttacagcagagaaatgcagagaaaagcaaaactgcaagtgactgtgaataaagggtgaatgtagtctcaaatcctcaaagagctgtgtttatttcat

SEQ ID NO: 34684 - DNA, 201 bp, Homo sapiens
cgtggggggaacagacatgggtgggcacactagcaaacacctgccagctgcatgtggacccaggtgggcaccggactgttttaaacacaggagagggcccrttgtctaactggtgagttggttgagtggaagctggttgagaacttttactgcaaaccatttacagtagaccacaattttatagccctgtttggcactttt

SEQ ID NO: 34685 - DNA, 201 bp, Homo sapiens
actccctgagggcaaagatggcctcttatttactcttgattccctagcacccagcacagcactaagcattgtacccactgaaagaacatctgaaggatgarcgtttatagcaaaagtggtttccactgacgttcccttctctcttccccaactttggattgaggagcccaggagctggtcaggtggcaagataagatgaga

SEQ ID NO: 34686 - DNA, 201 bp, Homo sapiens
cgattcagttattccaggctgacaattcccccttcatcataatatgtttaagagaatcatataagactatatttgtttcaaagcactttaaaaaccacaasatcgagttgggtgtctggtgtgggtgcctgtaatcccagctacttgggaggctgaggcaggagggtcacttgagtcccggagtttgaggctgcagtgagt

SEQ ID NO: 34687 - DNA, 201 bp, Homo sapiens
tccgttttctcatgtggaaaaagagttgaaatgaggtactctgttactcctagaactcacttaatgttcaccagttcatacacattcatgatcagagaacrattcagttattccaggctgacaattcccccttcatcataatatgtttaagagaatcatataagactatatttgtttcaaagcactttaaaaaccacaaga

SEQ ID NO: 34688 - DNA, 201 bp, Homo sapiens
cctctttccaggtttggaatgcacttctgtggaggcaccttgatatccccagagtgggtgttgactgctgcccactgcttggagaagtatgtttaggggamaattgacatgaagtcttgtcttaaatactttttctgtccttcttttcctcctttcctcctttcctttctcactcttcctcccttccttctctggctgtga

SEQ ID NO: 34689 - DNA, 201 bp, Homo sapiens
gcagaacaaagtatcaatttaactaaaatttgaactaaatcctctttccaggtttggaatgcacttctgtggaggcaccttgatatccccagagtgggtgytgactgctgcccactgcttggagaagtatgtttaggggacaattgacatgaagtcttgtcttaaatactttttctgtccttcttttcctcctttcctcct

SEQ ID NO: 34690 - DNA, 201 bp, Homo sapiens
tgtggacaggccatgcctgtgcctcccccaagcatcggaaaaattggcatagatgggcccttctcaaaaatcccactcctggagcactggccaaaattacyaccatcctgatgctgggcttgcagtcctttcctttgggaatatgaacatggtcaaaattaagtgaacgtgtctttctggctttctgtacaatggagcaga

SEQ ID NO: 34691 - DNA, 201 bp, Homo sapiens
atatttcagattcattctttcctaaactatgtggtggtctacgtcctcactgacttatcaacatgctaccatcatgcacttcctatctctattcctcttcwttaaatttggttccaaatggctcacaccattattctgagctattacctgcctacgcagtcctagaaagtaagtgattcaggaaacattccccaaaagtaa

SEQ ID NO: 34692 - DNA, 201 bp, Homo sapiens
cctttcataagttccattttcttgggtatctcttaggaagcaagcataggaaacaggcccatccgtctgcctgttttgcttcctcatctcacttctacacragggtgcctgtgctcaattgctgttttcccctaaagagactcttttccataagtttgtgaaatgccatcgacaaacctgatcgcattgcatttcactctg

SEQ ID NO: 34693 - DNA, 201 bp, Homo sapiens
ttagaaatgtgacactttctgggttgggagagcaaggacaaaattatctccagtctatcacaggcacagattctttttctttggacactttcgtgaatcaytgaattcaatgcagaggctactcatccattcgcaaacaaaaaaattctaggtcatgatccccataaatgaagagtgatcagtccaatcccagggaacctg

SEQ ID NO: 34694 - DNA, 201 bp, Homo sapiens
tacatttacataaaatccacacagctgaggcatcagcacctgcctctaagttttctgaaggaggaaaaaagctacaaaaattaatatatgtatatatacayatatatttttataggttctctactgtgaaaatgacaaaaattgctgtctttttcttgatctgggcagctccatcaaaatctgtaggcacagtgatttgca

SEQ ID NO: 34695 - DNA, 201 bp, Homo sapiens
taatcctcagaaacatttagattgggacacaaatcttatttttactcttaaatttttcacattttgggggacatggtctatatttttctcagatttctgawatgttgtcttttaaaaatgtgtaaaagttacagttccttttctatagtttattttaaaatgtgggtcaatagtcccactgcttagaataagaggcagaca

SEQ ID NO: 34696 - DNA, 201 bp, Homo sapiens
aaggtaagaacaggcccagaaacgatttatactgtccctccacgtaagccctgcaaaacccttctacatttacataaaatccacacagctgaggcatcagyacctgcctctaagttttctgaaggaggaaaaaagctacaaaaattaatatatgtatatatacatatatatttttataggttctctactgtgaaaatgaca

SEQ ID NO: 34697 - DNA, 201 bp, Homo sapiens
attttatatttaacaaggagatgggaagtctaagcattccttttggtcttggcttcttattctgcagggtgaccatggtccttgggccctaacatctggaygaagccttgtaaaacagaaatactgaggtgttttaatcctcagaaacatttagattgggacacaaatcttatttttactcttaaatttttcacattttgg

SEQ ID NO: 34698 - DNA, 201 bp, Homo sapiens
aaatattattttatatttaacaaggagatgggaagtctaagcattccttttggtcttggcttcttattctgcagggtgaccatggtccttgggccctaacrtctggatgaagccttgtaaaacagaaatactgaggtgttttaatcctcagaaacatttagattgggacacaaatcttatttttactcttaaatttttcac

SEQ ID NO: 34699 - DNA, 201 bp, Homo sapiens
gaggtgggcggatcacgaggtcaggagttcaagaccaacctggccaatatgatgaaaccccacctctactaaaaatacaaaaaaattagccagttgtggtracacgcacctgtagtctgagctactcgggaggctgaggcaggagaatgacttgaacccaggaggcagaggttgcagtgagctgagatcgtgccactgact

SEQ ID NO: 34700 - DNA, 201 bp, Homo sapiens
gtattacttcacctcttagatttaattttttttgttcaaaagatgaaaggattagatttacaaaatcacttctacctctatgaccctgaaaataagatttwtaaaatattattttatatttaacaaggagatgggaagtctaagcattccttttggtcttggcttcttattctgcagggtgaccatggtccttgggcccta

SEQ ID NO: 34701 - DNA, 201 bp, Homo sapiens
gttcagtgtcactaagaagcagctgggagcaggaagtatagaagaatgtgcagcaaaatgtgaggaggacgaagaattcacctgcaggtatttccattgtygttgcacctacgcaggaatctgtaattcagatggcaagtaatttactcacaaatttattaatgatttaagaggaaagagaaatttatggagccagagttt

SEQ ID NO: 34702 - DNA, 201 bp, Homo sapiens
atttatgtccaaatgcccgactgtgtgttcttaactaaacattttgattcatagctacccattctacttccagtaaacagaaagttttatttggttaatgstaaccaaatagattaaaaggaagtcatgacaattagacattgacattgatttactgaccatttattccacttggatctcccacctctaggtcaaggagag

SEQ ID NO: 34703 - DNA, 201 bp, Homo sapiens
gcacagctgaggcccccttggccaccctctgccacgaccaggcagaaagcagctttcggacagattcgttgtctcagatttgatctcaaagaaaaaccaaraccagtatttgtcccaggtcctgcttttttacaatttcctccgaaatccagatacctgtcaacaccttggaaaaactgacttctccccaattagtagtgt

SEQ ID NO: 34704 - DNA, 201 bp, Homo sapiens
cctgttgtctaattccatggagcttgcctgtcttcattttattagcctcttttggcctctcacccttgtgcaaatcactagcattctgtgccaaggacggmgctggcatctccaggcttggaatagagctaccaaagctcagccagatgtctggaagagcctcaggacaaggggacaccctgtagccttgtggtgggagca

SEQ ID NO: 34705 - DNA, 201 bp, Homo sapiens
caaggttgtcctgttgtctaattccatggagcttgcctgtcttcattttattagcctcttttggcctctcacccttgtgcaaatcactagcattctgtgcraaggacggagctggcatctccaggcttggaatagagctaccaaagctcagccagatgtctggaagagcctcaggacaaggggacaccctgtagccttgtg

SEQ ID NO: 34706 - DNA, 201 bp, Homo sapiens
gaatgaaaatctgttcatttgctttcctactggatacttgtcatcagcatacaaaccaatgcgctctgcagtgtgtcatctttcagaacctcccctgacckcatgttccctggagggctcgctgtcttcagagccaggcttgtctcctgctgcagcctccactgttctcctagtcactctgtaacccaccccctctgcctg

SEQ ID NO: 34707 - DNA, 201 bp, Homo sapiens
gaggtcaggacaggcctttctgagaatgaaaatctgttcatttgctttcctactggatacttgtcatcagcatacaaaccaatgcgctctgcagtgtgtcrtctttcagaacctcccctgaccgcatgttccctggagggctcgctgtcttcagagccaggcttgtctcctgctgcagcctccactgttctcctagtcact

SEQ ID NO: 34708 - DNA, 201 bp, Homo sapiens
atgtggggggatttctcctcacaccccaagcgagtctccagcagataccagctgggtgtcctacaatgtaactcagtgctgacactctatctggagacagygtcagatcccataagttaaggctcagtcccacaagaccgccccactgcagatgccaatcccaagttccaggcggtgacctgtacttctgcccaactggac

SEQ ID NO: 34709 - DNA, 201 bp, Homo sapiens
catggcacaatcaatagcaaacataaaatttgttcttgtttaaggatttatatccactaatatggtaacatagtagtggttccatagttctaacctgtttrtcaatccagttaatcttttactatcttgcaatctgctaatgaaactgtttttctttgttttataatttcaacttttagagtcaggggtacatgtgcaggt

SEQ ID NO: 34710 - DNA, 201 bp, Homo sapiens
tcagctgcacccctgggtagagacacaaccttggggaaggcctcagccccatccctcgtacagcaggaatgagaacagccctgcctgttgggaagcttgasggaggctatggacgtgcagcgcttggcagagggtctcgtcatggaaggttccagcaaatgtgagatacttttatgatttcattttctccaaaagaaaggg

SEQ ID NO: 34711 - DNA, 201 bp, Homo sapiens
ctaacttaagtttgtcatctaagacctgaaggggttttgtctatcagctgcacccctgggtagagacacaaccttggggaaggcctcagccccatccctcrtacagcaggaatgagaacagccctgcctgttgggaagcttgagggaggctatggacgtgcagcgcttggcagagggtctcgtcatggaaggttccagcaa

SEQ ID NO: 34712 - DNA, 201 bp, Homo sapiens
tgtagagatattaacgtttacacctaacttaagtttgtcatctaagacctgaaggggttttgtctatcagctgcacccctgggtagagacacaaccttggrgaaggcctcagccccatccctcgtacagcaggaatgagaacagccctgcctgttgggaagcttgagggaggctatggacgtgcagcgcttggcagagggt

SEQ ID NO: 34713 - DNA, 201 bp, Homo sapiens
ctctgtgtaccctcaggaggtcaggacaggcctttctgagaatgaaaatctgttcatttgctttcctactggatacttgtcatcagcatacaaaccaatgygctctgcagtgtgtcatctttcagaacctcccctgaccgcatgttccctggagggctcgctgtcttcagagccaggcttgtctcctgctgcagcctccac

SEQ ID NO: 34714 - DNA, 201 bp, Homo sapiens
ttgaacactaaaatagaagttttacagcatatatactacctggttgctctagacttaagccagggaaaagtacagattcaacatttaaaattgagatagaygctttccacttaatgctaccagtcttgctttatttcatgagaatgagaatataataatatggcatacgttcatttgggggaaagattgatgtcttataac

SEQ ID NO: 34715 - DNA, 201 bp, Homo sapiens
gggacactgtccctacctccagagaccctgtgggctggctacagagagaaggcagggaggaggaaaagaagaataaagtcatatgtttaagtcacccccayggccgttggttagtcatgggaggctccccagaggagctgtcctgaagctggctgacagaaggcaacatttcaacttaggacagtaatccttgctacatac

SEQ ID NO: 34716 - DNA, 201 bp, Homo sapiens
ggaggctgaggcaggagaatgacttgaacccaggaggcagaggttgcagtgagctgagatcgtgccactgactccagcctgggcgacagagcgagactccrtctcaaaaaatatatatattcattgtaacttattttgcccattcaagcaacacctccaccatcttctggtcccacctaccagtgtctgaagggaacaggt

SEQ ID NO: 34717 - DNA, 201 bp, Homo sapiens
tttgaggagagaagagagtgaggctaaaataggaaatcaggaaaagcgattcggtccccctgtccctcacatggggccaccctcttgttgcccagtgtggyttcttcttgagggttctgcatggttcctcaatcccagggaattccgcaggacattccacccaagaccattgggctcccacctctactcttttgccagtta

SEQ ID NO: 34718 - DNA, 201 bp, Homo sapiens
taattgtatgaacaattatttaaaatattaacatttacatttgtgaagaccttgaagggctggagacaacagagaagcatttttgaataccctctgcagcycctgcactgttgtaggcattggtggatggtaccaaagatgggacactgtccctacctccagagaccctgtgggctggctacagagagaaggcagggagga

SEQ ID NO: 34719 - DNA, 201 bp, Homo sapiens
tccatgcccgactgtgcctagcacacagcaggtgctcaatgtttgctcttgaaaaagagtcttatccatgaatgtaaatgttcagtgctactaaaatcttkcttgtccattcagatttccaaacaagaacctgaagaagaattactgtcgtaaccccgatagggagctgcggccttggtgtttcaccaccgaccccaacaa

SEQ ID NO: 34720 - DNA, 201 bp, Homo sapiens
aagaatttgaggagagaagagagtgaggctaaaataggaaatcaggaaaagcgattcggtccccctgtccctcacatggggccaccctcttgttgcccagygtggcttcttcttgagggttctgcatggttcctcaatcccagggaattccgcaggacattccacccaagaccattgggctcccacctctactcttttgcc

SEQ ID NO: 34721 - DNA, 201 bp, Homo sapiens
gcagatcacctgaggtcaggagttcgagactagcctggccaaaatggtgaaacctcatctctactgaaaatagaaaaaaaaattagccaggtgtggtggcrtgcacctgcagttgcagctactcaggaggctgaagcaggagaatcgcttgaacccaggagatggaggttgcagtgagctgagatcatgccactgcactcc

SEQ ID NO: 34722 - DNA, 201 bp, Homo sapiens
agtcagagaggataaagggagtggtaagaatttgaggagagaagagagtgaggctaaaataggaaatcaggaaaagcgattcggtccccctgtccctcacrtggggccaccctcttgttgcccagtgtggcttcttcttgagggttctgcatggttcctcaatcccagggaattccgcaggacattccacccaagaccatt

SEQ ID NO: 34723 - DNA, 201 bp, Homo sapiens
tcctgaagggagacccattctccaaagacccccgagggtcaccactccctgtccaggggtgtggcctcatagctccttttgaacaggggcacaggaaggayggctttagagcattcaaaaaataactttgccaaaataataataataataatagaaaggaagaagaggctgagcatggtggctcacacctgtaatccctac

SEQ ID NO: 34724 - DNA, 201 bp, Homo sapiens
cctttaatgaactgggccatgaggtgagtcagagaggataaagggagtggtaagaatttgaggagagaagagagtgaggctaaaataggaaatcaggaaawgcgattcggtccccctgtccctcacatggggccaccctcttgttgcccagtgtggcttcttcttgagggttctgcatggttcctcaatcccagggaattc

SEQ ID NO: 34725 - DNA, 201 bp, Homo sapiens
ccagggacaatgcacatcaatgatgtcccactgtcctttggtgctggggctctaaggcctccactgggtcaggctcctgaagggagacccattctccaaaracccccgagggtcaccactccctgtccaggggtgtggcctcatagctccttttgaacaggggcacaggaaggacggctttagagcattcaaaaaataact

SEQ ID NO: 34726 - DNA, 201 bp, Homo sapiens
aagaaaattatgtggatgtagaatttctgataacatcattcccaaggtgccttatccaagaggaactgctacaataatattttaagtggaaataaatacakgctggaagcattatatattagtagagtatttttttttcccagagtactttctcaagcacatcaacatgagccccctaagagacatttcacattaaaaata

SEQ ID NO: 34727 - DNA, 201 bp, Homo sapiens
ctcaggaacccccaagggatttaggagctccgtgtcaggaactggggggcagagaccaaatatacgtttcttattctaccacagtgtcatatgaaggggargacaacactgcctttctgtgtcttgccccatagagggcgcacaatgcatggaaataaatgtttctgaatcaacagcaaacaggcttcatcgggtaggaga

SEQ ID NO: 34728 - DNA, 201 bp, Homo sapiens
acagagtgcggtggcgccagcacagagctctgctcaacgtccctctgtgctttcacgatgctgatggattatgaaggtagggaagaatgtacagccaggargccattaggagggcaactaatttataaaatcacatttgtagaatttaatgcatccaacaactaccaggggaaaggtgggcaaaagctataccaacaccac

SEQ ID NO: 34729 - DNA, 201 bp, Homo sapiens
tagaatataattggccttagtatggaaagtacaagcagcacaggccaggaaacctccacacatgtgagggttctcaggcctcttccctttagtgacatttmtttaaagtttccattattggggactgtctctagtttctagtgtttgtatgctaggttccagtaatcaaagatgccctttatgaaatttaagtcagatttt

SEQ ID NO: 34730 - DNA, 201 bp, Homo sapiens
ccgaggcaagagggcgaccactgttactgggacgccatgccaggactgggctgcccaggagccccatagacacagcattttcactccagagacaaatccaygggcgggtctggaaaaaaatgtaagccactttgatttggactctttggccttttgctcaccaatctttgcaaacagaattggttctgtgttacagaaaat

SEQ ID NO: 34731 - DNA, 201 bp, Homo sapiens
tgcctttaggacaggtgcaaaccctccaaggtgctcaacttaaccactcaccttgttctaaaatgggttatctcagtatcccagtccaaattcgtattctrtcatgctgccatatgtgtgattctttccaagccagtaagcatctccagtaatttcttaaggtaggcagcgttcattgcagtcttcagcattgcagtttct

SEQ ID NO: 34732 - DNA, 201 bp, Homo sapiens
acacttggacgctgggatgaaaagccatggaaaatctcactgatgcagaaaccttccatgctacacgagaaatcaagtgtttttagagggtctgccatgtrgaaggaagcctcagtgcactctctcaaggaggcagaggtgtgacttttggcacaacatgagtgggctgtgcctttaggacaggtgcaaaccctccaaggt

SEQ ID NO: 34733 - DNA, 201 bp, Homo sapiens; identical to SEQ ID NO: 7452

SEQ ID NO: 34734 - DNA, 201 bp, Homo sapiens
tatccacttaaaacgttctgtgatactcaacattccatcatgagcagttcatccccagtgaattgcgcatcacagtaaaaagtgctctctccctgttcgcrtgtatttttcgtcctgtttcgtgctgtactgtaaaccttgaataacaccatgggatccaatatgaagtggcactagtgatgctggaagtgctcccaagaa

SEQ ID NO: 34735 - DNA, 201 bp, Homo sapiens
gaatgcctagtttaaaaaaaatcaatgaaactatgagttttaggccaaatctgagaaaagatcaaagatgactatgtttgggactgaagtaagcatatcargttagaactctcatcacatgttcgactcaaattgtggagcaaaagagtaaataagatataaaaatgaaaatgaagatacgtgaaattcaaatgttgcaac

SEQ ID NO: 34736 - DNA, 201 bp, Homo sapiens
aacgttctgtgatactcaacattccatcatgagcagttcatccccagtgaattgcgcatcacagtaaaaagtgctctctccctgttcgcatgtatttttcrtcctgtttcgtgctgtactgtaaaccttgaataacaccatgggatccaatatgaagtggcactagtgatgctggaagtgctcccaagaagcagagaaaag

SEQ ID NO: 34737 - DNA, 201 bp, Homo sapiens; identical to SEQ ID NO: 7437

SEQ ID NO: 34738 - DNA, 201 bp, Homo sapiens
agcaccaggaaggcaggggaagatgcggccctgcaccttctgagggggaccattaagagatgaagttgactaaagcagagactttgtgtaggtgacgggcytgggaaggtagctatggaatccagactgagcacccatagcaggaccacgggatggagatgggaggggtcaggggccagggtggggtggaatgtggagcag

SEQ ID NO: 34739 - DNA, 201 bp, Homo sapiens
ctgtgcagaccttcatgtggtgtcttgtgaaagactttgaccactgtgtggacttcccttcagtgtatctctcagagtgcaagactgggaatggaaagaaytacagagggacgatgtccaaaacaaaaaatggcatcacctgtcaaaaatggagttccacttctccccacagacctaggtaagacattccctttcatcttt

SEQ ID NO: 34740 - DNA, 201 bp, Homo sapiens
acccactgcccaatgcttggtagtcaagaggagcttcctccctgcagctctgcccagatagggctgagctgggctctggagcgaggcgctgggatgagccwcttccatgctgctcatgtaaactccagattcagtgtcggttttctgaacccgagacaatgatctaaatgcagtcgaaggctttggggaaagagagagtgc

SEQ ID NO: 34741 - DNA, 201 bp, Homo sapiens
aagcctgccattcccccatctaaaaagccctttccccattctctcactctgtctcatcatgtatgtaatatgtatcatcattaagtgatctcattttataytgtttccttgaatatttcctgtaacccccctgcctgattccactagaatgtaagctccatgacggccaagcctctggctgcactgtgccccgtgtgtccc

SEQ ID NO: 34742 - DNA, 201 bp, Homo sapiens
tcacacccatgcagcataacacttctcacaccagatgtggggggatttctcctcacaccccaagcgagtctccagcagataccagctgggtgtcctacaaygtaactcagtgctgacactctatctggagacagtgtcagatcccataagttaaggctcagtcccacaagaccgccccactgcagatgccaatcccaagtt

SEQ ID NO: 34743 - DNA, 201 bp, Homo sapiens
caatagtatcaaaaccacaagatatttagtgatacatttaacacaatatgcacaagaattatgtactgcatactaaaaaacattgttaaggaaggaatcamaagatctaaataaagatatatcacgcttatatattaagagtcaatatcacttctcaccaaattgatctttggattcagcccatacccaattgttaaggaa

SEQ ID NO: 34744 - DNA, 201 bp, Homo sapiens
gaaatgactcgttgtaagcacataactcacgtggggggaacagacatgggtgggcacactagcaaacacctgccagctgcatgtggacccaggtgggcacsggactgttttaaacacaggagagggcccgttgtctaactggtgagttggttgagtggaagctggttgagaacttttactgcaaaccatttacagtagacc

SEQ ID NO: 34745 - DNA, 201 bp, Homo sapiens
acctccctttcacaaagtaccttgagtttacacttttgatgagtgtcttatgtctactgtaatactatgtcccaatgaagatgtacttgcaatcataatasgcagtattgggttaaaagcattagtttgctgtaggtatgttaggagcactttccccatgtgattgatcaattaattaaaaaatggctaaagtgggtaacc

SEQ ID NO: 34746 - DNA, 201 bp, Homo sapiens
gagcatgtaaatgaacaacaagcaaatattgaaggtggaccacttatttcccattgctaattgcctgcccggttttgaaacagtctgcagtacacacggtsacaggagaatgacctgtgggagagatacatgtttagaaggaagagaaaggacaaaggcacacgttttaccatttaaaatattgttaccaaacaaaaatat

SEQ ID NO: 34747 - DNA, 201 bp, Homo sapiens
tgatccataaccaggagaaaaagcactcaaaacaaataaaccccaaaatgaagaaattggcaagaagatttgaaatatatatatatcataattgtgttcamggatttaaataaaacatgaacatggaagaaacaaatggataatatcaaaaaagaaaaattataaaataaccaaatagaaattaaataactaaaaaagtgc

SEQ ID NO: 34748 - DNA, 201 bp, Homo sapiens; identical to SEQ ID NO: 7468

SEQ ID NO: 34749 - DNA, 201 bp, Homo sapiens
ttagagcaaaaatccctccaagagtgctgtgtggtttcctatgcacaacctggaatagtccattgcttcatgcctaccctggacatgaagggccatgccgyagcggaagtctctatgcacccacccccgtctatacctgagcaacacattcctctttgctgctctcttacaggctacagagtgcggtggcgccagcacaga

SEQ ID NO: 34750 - DNA, 201 bp, Homo sapiens
ttgcatttttcagactctacattttaaacattattctttatagttttaaaagcaaaaagtaaagaaacaacaaccaaccccaaaccaacacgacaaagccsagattgttaattccagggctcaggaacacagaatcatatatgatgtttacactctgcagggtcagagactccagcggcattgggagctgcctcgtgttct

SEQ ID NO: 34751 - DNA, 201 bp, Homo sapiens
tatatatggatagtagaaggatggcatcccataataaaaggcaggcagcctaaccctcacatgcatttttctctccctctgtatagggtgacagtggaggkcctctggtttgcttcgagaaggacaaatacattttacaaggagtcacttcttggggtcttggctgtgcacgccccaataagcctggtgtctatgttcgtg

SEQ ID NO: 34752 - DNA, 201 bp, Homo sapiens
tttagagcaaaaatccctccaagagtgctgtgtggtttcctatgcacaacctggaatagtccattgcttcatgcctaccctggacatgaagggccatgccrcagcggaagtctctatgcacccacccccgtctatacctgagcaacacattcctctttgctgctctcttacaggctacagagtgcggtggcgccagcacag

SEQ ID NO: 34753 - DNA, 201 bp, Homo sapiens
acaaacaatagtcttccagctctgagaggtcgaacttgtgtcaccagcctgcccctaaacccgtcactgattaactccaacctgcatcagctgttccatgmtggaggtggacgcaggaccacactcataccaagatgggggcaaagtgtagttccctcaacaggattataggatatagtgtgataggctgctgggcagcca

SEQ ID NO: 34754 - DNA, 201 bp, Homo sapiens
ttttaagtgccataactacctcaggccactcaccctcctggggtgtgctggtggccagggactaaagtggtgacttttccggtagggaaggaggtagaggrtacaggacagagaccaactgcacacactttacactgatgcccaggctagcccagtctaaaggaaacaccaacataggaagggatgtgtgcaggattcaca

SEQ ID NO: 34755 - DNA, 201 bp, Homo sapiens
gttgtctttagagcaaaaatccctccaagagtgctgtgtggtttcctatgcacaacctggaatagtccattgcttcatgcctaccctggacatgaagggcyatgccgcagcggaagtctctatgcacccacccccgtctatacctgagcaacacattcctctttgctgctctcttacaggctacagagtgcggtggcgcca

SEQ ID NO: 34756 - DNA, 201 bp, Homo sapiens
aactctgtgctgggcatttggccggaggcactgacagttgccaggtaagcaaagatcaagagaccaaagttagtcttgtgctctcttgtctcagtctcagyccctcagacttcattccccaggtggcaaattcaaggattttcaaccgaagaccccagtctaagtgttgtttagaaacttcctagatctgtccctgaatgc

SEQ ID NO: 34757 - DNA, 201 bp, Homo sapiens
atggtaataatttcatatcctcctcctgttgctgttgcaatgagcaaaggtgttgcgagtatccacttaaaacgttctgtgatactcaacattccatcatragcagttcatccccagtgaattgcgcatcacagtaaaaagtgctctctccctgttcgcatgtatttttcgtcctgtttcgtgctgtactgtaaaccttga

SEQ ID NO: 34758 - DNA, 201 bp, Homo sapiens
tcaggtgggagtactgcaacctgaaaaaatgctcaggaacagaagcgagtgttgtagcacctccgcctgttgtcctgcttccagatgtagagactccttcygaagaaggtaagaaatctgtggctggacatctacacacttggacgctgggatgaaaagccatggaaaatctcactgatgcagaaaccttccatgctacac

SEQ ID NO: 34759 - DNA, 201 bp, Homo sapiens
tactcttgattccctagcacccagcacagcactaagcattgtacccactgaaagaacatctgaaggatgagcgtttatagcaaaagtggtttccactgacrttcccttctctcttccccaactttggattgaggagcccaggagctggtcaggtggcaagataagatgagaacggagaagtcattacttggggcctctgtt

SEQ ID NO: 34760 - DNA, 201 bp, Homo sapiens
tggttgtttttcatagtaaaagtagatccctttagttacactgtgagtacttagagtaaggtgactggcctgggaatgataccatcttggatgtcattttmtccttggagaaatgtattttagttccaatgcacatttcacaatacagtcctatagagagaaatacagagagctagacagttagagatatacttttatgtg

SEQ ID NO: 34761 - DNA, 201 bp, Homo sapiens
aaaatcctgagtccttattgccaattttattgccaagtgcctgttgtgaattacatcggaatgagaggcaagtcgcacttaagtgagtaggattctggttyttactctctattttgcttcatccatttcagttttcttcttcctctctgtccttccttcccactctgtccagaggaatgtatgcattgcagtggagaaaac

SEQ ID NO: 34762 - DNA, 201 bp, Homo sapiens
aaaaagagaaattattagtgaactgaaaattctgcaggctcacatcatggccccagaccctgtccattattcttgggcacaaatgtgatattctcgtggcygcagatgctgtggtggctctggctctgccaggaaaagaaataaggaaggccactctccccattacacaaacaatagtcttccagctctgagaggtcgaac

SEQ ID NO: 34763 - DNA, 201 bp, Homo sapiens
ctccctgagggcaaagatggcctcttatttactcttgattccctagcacccagcacagcactaagcattgtacccactgaaagaacatctgaaggatgagmgtttatagcaaaagtggtttccactgacgttcccttctctcttccccaactttggattgaggagcccaggagctggtcaggtggcaagataagatgagaa

SEQ ID NO: 34764 - DNA, 201 bp, Homo sapiens
agaggatggattgagagcaggagaggatgtcctgcccaggaacccatcctagagaaatggcatcctgcctgggagctagtttcccagggtggctttgataygtcttgcagaaacaaacccacttgacacacctgatacggtattgacagtaacactatttttcgtggttgtttttcatagtaaaagtagatccctttagtt

SEQ ID NO: 34765 - DNA, 201 bp, Homo sapiens
gcatgagatctttttctcaacgtgactatgctgtgcagaccttcatgtggtgtcttgtgaaagactttgaccactgtgtggacttcccttcagtgtatctytcagagtgcaagactgggaatggaaagaactacagagggacgatgtccaaaacaaaaaatggcatcacctgtcaaaaatggagttccacttctccccaca

SEQ ID NO: 34766 - DNA, 201 bp, Homo sapiens
agacagccacaggtcatgaatgtgaggattctgagaggttggagcaacattcttgggaggcatgagggggagcacattctccaagatcccccccagcccgrggtcctcgcctgctttgactattactccgttgttttcggactcctccgtagctgcccgacctcttcagatcccatagtctccctttatatcttgagtccc

SEQ ID NO: 34767 - DNA, 201 bp, Homo sapiens; identical to SEQ ID NO: 7429

SEQ ID NO: 34768 - DNA, 201 bp, Homo sapiens
gtgtcagtcttggtcatctatgacaccacaccggcaccagaagaccccagaaaactacccaaatgcgtatgtctttgatttttactgtaagaggggcatcrgccaactgaaatttctgttaaaagagccatgcttcatgcttcaagccaacttcctaggaccaaatttctcttagacccagaatgtgtagaaaaatgtctc

SEQ ID NO: 34769 - DNA, 201 bp, Homo sapiens
cccacagcctgcactgccgaatgcatcctcctctcatctgccctcgtgttctcatgaacactcagtagggacccataaaaaagagcttgcatgtaagtgcratttccaattataagtactctatctgttctttcacacccaggttttaaatgaaatattactaggaacttattaatgttctaaaatgctataaatctattt

SEQ ID NO: 34770 - DNA, 201 bp, Homo sapiens
cttcactcaggaacccccaagggatttaggagctccgtgtcaggaactggggggcagagaccaaatatacgtttcttattctaccacagtgtcatatgaakgggaggacaacactgcctttctgtgtcttgccccatagagggcgcacaatgcatggaaataaatgtttctgaatcaacagcaaacaggcttcatcgggta

SEQ ID NO: 34771 - DNA, 201 bp, Homo sapiens
actcagtgaataatttattcttcaggaaagagagtggacctttggtgtatgtgagaattcggggtgtgaggtgacacgtgttgatacttaccaggtaggargaactgagcaaagagaacatagaaagaagcacctacccaagggtctttctctgaaggagttccttgtgaaagggtctcacaggcatagatgctactaaat

SEQ ID NO: 34772 - DNA, 201 bp, Homo sapiens
atactcaacattccatcatgagcagttcatccccagtgaattgcgcatcacagtaaaaagtgctctctccctgttcgcatgtatttttcgtcctgtttcgygctgtactgtaaaccttgaataacaccatgggatccaatatgaagtggcactagtgatgctggaagtgctcccaagaagcagagaaaagtcatgacattt

SEQ ID NO: 34773 - DNA, 201 bp, Homo sapiens
aacctgaagaagaattactgtcgtaaccccgatagggagctgcggccttggtgtttcaccaccgaccccaacaagcgctgggaactttgtgacatcccccrctgcagtgagtatgatgcacacccagattccaggatttggacctgccctgttcttgaaatcaaaagaaaacatgtgtcagtgcctgagtgcagcctctga

SEQ ID NO: 34774 - DNA, 201 bp, Homo sapiens
gagttcaaggagttcaaggcaagcctgggcaataagtgggaccctgtctctaaaaacaaacaaaaaaaagaaagtccttggaatacagggccaaccttgtytccttgttgccatctctgaacacagccttcatctgattacctcctccatgcccgactgtgcctagcacacagcaggtgctcaatgtttgctcttgaaaaa

SEQ ID NO: 34775 - DNA, 201 bp, Homo sapiens
ctgagcatggtggctcacacctgtaatccctacactttgggaggctgagacaagcagatcacctgaggtcaggagttcgagactagcctggccaaaatggygaaacctcatctctactgaaaatagaaaaaaaaattagccaggtgtggtggcgtgcacctgcagttgcagctactcaggaggctgaagcaggagaatcgc

SEQ ID NO: 34776 - DNA, 201 bp, Homo sapiens
gctgttgcaatgagcaaaggtgttgcgagtatccacttaaaacgttctgtgatactcaacattccatcatgagcagttcatccccagtgaattgcgcatcmcagtaaaaagtgctctctccctgttcgcatgtatttttcgtcctgtttcgtgctgtactgtaaaccttgaataacaccatgggatccaatatgaagtggc

SEQ ID NO: 34777 - DNA, 201 bp, Homo sapiens
gaaaaaccaagaccagtatttgtcccaggtcctgcttttttacaatttcctccgaaatccagatacctgtcaacaccttggaaaaactgacttctccccarttagtagtgttgtgtgactgtcataagcccagtacaaaaatggccttctttgttggggagcttcttaccctccagtgttttgcccaatttttgtccaagg

SEQ ID NO: 34778 - DNA, 201 bp, Homo sapiens
acctacaactgggggagaggcggacaggtcccatggccccaggtctaggatggcatttggtattggttgatgggtgtggatgagaacaagagagggaacayttgtgcaggatatggtatcagcacctgtaatacattttagggattctttcttctctttgcagtatgccctgacaataattatatccatcagcctagtccc

SEQ ID NO: 34779 - DNA, 201 bp, Homo sapiens
ggtgtgatccattttttatttgtatatttccctacacctaaaacaagcaaaaaaacagtaaaggtctttgagtctcttaatccataatttcagcattcctragtatgcttccctgggtaagtggggttttcacccagccctcaagttaagagtgttagattatttttcatgtgaaattagccagactggctttcttaacac

SEQ ID NO: 34780 - DNA, 201 bp, Homo sapiens
tttttgaattgaaccctttaccattatgtaatgcccttctttgtcttttttggtctttgttggtttaaagtctgttttgtctgaaattaggatggcaaccyttgcttttttgtctgatttccatttgcttggtaggttctcctccatccctttattctgagcctatgggtgtcattacatgtgagatgggtctcttgaagg

SEQ ID NO: 34781 - DNA, 201 bp, Homo sapiens
agttttgcaaaattttaatgaaacctgggcttgcaaaattggaaaactagattatttgtgacgacactgagacatccctgggcatgtctatctggaaaaayggcattttctctggcaattttgcagacattctatttcaatttggcaaagaaaataaagcagtttttcacaaaggcagaaatacaactagaatgttcactc

SEQ ID NO: 34782 - DNA, 201 bp, Homo sapiens
ttgtcagctttgttaaaaatcagatgtctgtaggtgtgtggccttatttctgggctctctattctgttccactggtctacgtgtcttttttttttttttttaccagtaccatgctgtttttgttactgtagccctgaagtatagtttgaagccaggtaatgtgatgtctccagctttgttctttttgtttaggattgcctt

SEQ ID NO: 34783 - DNA, 201 bp, Homo sapiens
acacagtccaggtgatgcacccactgcccaatgcttggtagtcaagaggagcttcctccctgcagctctgcccagatagggctgagctgggctctggagcsaggcgctgggatgagcctcttccatgctgctcatgtaaactccagattcagtgtcggttttctgaacccgagacaatgatctaaatgcagtcgaaggctt

SEQ ID NO: 34784 - DNA, 201 bp, Homo sapiens
gtaattatgattaccaccaccattagcattatcattaccaccaccagtaccatcaccatcaccaccgccaccacctccatgatcattactacccaccaccrtcaccgtcaccatcatttcactaccagcacaattatcattaccaccaccatcactaccacccttatcacaaccctcatcatcaccaccattccaccactg

SEQ ID NO: 34785 - DNA, 201 bp, Homo sapiens
cttggctctgttaggtactagatgagtatctttaggcagggagcactttacattttaaagactgctatcatttgtggttgaataactggaatttgcttacrtcaattttccagatggccaaaatgataaggtcactgattctgttgagtgatttttacacatgtaaactgttagaaaaacagtgcttggcagccgggcatg

SEQ ID NO: 34786 - DNA, 201 bp, Homo sapiens
gtattgactaaaatatgtgaatgttacggtttaaaaggaaaatgacatttggattatgctagaaaatcctgagtccttattgccaattttattgccaagtrcctgttgtgaattacatcggaatgagaggcaagtcgcacttaagtgagtaggattctggtttttactctctattttgcttcatccatttcagttttcttc

SEQ ID NO: 34787 - DNA, 201 bp, Homo sapiens
gaagtcactaattctgagtggccaagggtgtcagggagacagcaccaatttcatggcacagaggttacctgaaggggctggaccatattttcctcttgacrtcctcatcttttctaggtccccaaggccttcatcctacaaggtcatcctgggtgcacaccaagaagtgaatctcgaaccgcatgttcaggaaatagaagt

SEQ ID NO: 34788 - DNA, 201 bp, Homo sapiens
agtattgactaaaatatgtgaatgttacggtttaaaaggaaaatgacatttggattatgctagaaaatcctgagtccttattgccaattttattgccaagwgcctgttgtgaattacatcggaatgagaggcaagtcgcacttaagtgagtaggattctggtttttactctctattttgcttcatccatttcagttttctt

SEQ ID NO: 34789 - DNA, 201 bp, Homo sapiens
cattcagcagtcagcggaatgatcagaataatttcatacaaagttttaaagatcattattgaaatgaagatgccaaatattgaaaactcctaatggagaaygtagactcctgggaatatatgcacccttggctccccactggcctgtgcatcccggtctaaggacatggcatcatggaaattctgaacttggtcatgacta

SEQ ID NO: 34790 - DNA, 201 bp, Homo sapiens
ctgaatcaaagtttaagtttgtgaataattttgcaaaaaagagccaatcatgcttctcaacaacataaaaagagaagcgctgtcacttcaggtgaatattrttctccctgaggccatgagcataaacaaaaactccagactaaaaccctgagacggtgccaggtcattcagcagtcagcggaatgatcagaataatttcat

SEQ ID NO: 34791 - DNA, 201 bp, Homo sapiens
ccatgttacttcaataattctgaatcaaagtttaagtttgtgaataattttgcaaaaaagagccaatcatgcttctcaacaacataaaaagagaagcgctrtcacttcaggtgaatattgttctccctgaggccatgagcataaacaaaaactccagactaaaaccctgagacggtgccaggtcattcagcagtcagcgga

SEQ ID NO: 34792 - DNA, 201 bp, Homo sapiens
tcaccatgttacttcaataattctgaatcaaagtttaagtttgtgaataattttgcaaaaaagagccaatcatgcttctcaacaacataaaaagagaagcrctgtcacttcaggtgaatattgttctccctgaggccatgagcataaacaaaaactccagactaaaaccctgagacggtgccaggtcattcagcagtcagc

SEQ ID NO: 34793 - DNA, 201 bp, Homo sapiens
tggatgacaatctcagatgggaatcgagagcatctccttctgccttgctaatagcaagctgatttttagaatatagtctaagtgcttcttttccatcctcyccagattctcacctgctacacacccctcagagggactggaggagaactactgcaggaatccagacaacgatccgcaggggccctggtgctatactactga

SEQ ID NO: 34794 - DNA, 201 bp, Homo sapiens
atctattatctatttatccattcatcaatccttctacccattatctatcctctgtgtctatctatctatctatctatctatctatctatctatctatcatctatcatccatctacctattatctgcctatctaccatttgtgtgtcatctgtcttcctatccagctacagagagggactgcctttggttttagttttttat

SEQ ID NO: 34795 - DNA, 201 bp, Homo sapiens
tattaggactaaaagagagaatgtgtggaaagatgttagtggaattcctggcagatagttcacatggacaaaatggtattaactacaaaaatttttacagrgaaaacggtaactgacaaaagcaggtgtttggaatgaattaagaccatggcagccttttgaggcctttatatttctcctgactgtgcaataaaaatattt

SEQ ID NO: 34796 - DNA, 201 bp, Homo sapiens
catctattatctatttatccattcatcaatccttctacccattatctatcctctgtgtctatctatctatctatctatctatctatctatctatctatcatctatcatccatctacctattatctgcctatctaccatttgtgtgtcatctgtcttcctatccagctacagagagggactgcctttggttttagtttttta

SEQ ID NO: 34797 - DNA, 201 bp, Homo sapiens
cagacagatcaactttgaattcttgatctgcttcttcatagctatttacacttaggcaagttttgttttgttttgttttacgttgccactcagttttctcwtctgtaaaatagggataataacaccttcctcaaatggttttattaggactaaaagagagaatgtgtggaaagatgttagtggaattcctggcagatagtt

SEQ ID NO: 34798 - DNA, 201 bp, Homo sapiens
tcatctattatctatttatccattcatcaatccttctacccattatctatcctctgtgtctatctatctatctatctatctatctatctatctatctatcatctatcatccatctacctattatctgcctatctaccatttgtgtgtcatctgtcttcctatccagctacagagagggactgcctttggttttagtttttt

SEQ ID NO: 34799 - DNA, 201 bp, Homo sapiens; identical to SEQ ID NO: 7528

SEQ ID NO: 34800 - DNA, 201 bp, Homo sapiens
tctatcatctattatctatttatccattcatcaatccttctacccattatctatcctctgtgtctatctatctatctatctatctatctatctatctatctatcatctatcatccatctacctattatctgcctatctaccatttgtgtgtcatctgtcttcctatccagctacagagagggactgcctttggttttagtt

SEQ ID NO: 34801 - DNA, 201 bp, Homo sapiens
ttccttttcattcttttttcttaatttttgtcaactgtcttatttcagaaagccagtcttccatttctgagattctttcctcagcttggtttattttgctrttaatacttggattgctttgtgaaattcttacagtttgtttctcagctctcagctctgtcagatccattaggttcttttttaaaccagtgattttgtctt

SEQ ID NO: 34802 - DNA, 201 bp, Homo sapiens
agtattacggcaaaactctaagtagcattttaaatagtatttatttgggttggaattatttctatgcattgactcatcttcctgggtttcattagctgtaygcattgtacttccttccttaccactatttatctcgaattcttgagattaaagtgcagattaaatctaaactttatctggtgaagttattagttcttacaa

SEQ ID NO: 34803 - DNA, 201 bp, Homo sapiens
ctgtagccctgaagtatagtttgaagccaggtaatgtgatgtctccagctttgttctttttgtttaggattgccttggctattctggctcctttttggttmtatataaatttttgaagtagttttttaatagtgctgtgaagaatatcattggcagtttgataggaatagcaatgaatctgtaaattactttgggcagtat

SEQ ID NO: 34804 - DNA, 201 bp, Homo sapiens
ctgcatgacaggctgggccttctgatgatgctcagaagcagaaagtgtgcctgcttcaaagttggtgacgatgatgtttcttgatcagaatagggcatttyttatttccaatcctttatcctcttgaacttactaaagtagaatcaggtctaaaaaccggagttctaatgtttgagagtccctgggactctaaagtatatg

SEQ ID NO: 34805 - DNA, 201 bp, Homo sapiens
tgatctcaaagaaaaaccaagaccagtatttgtcccaggtcctgcttttttacaatttcctccgaaatccagatacctgtcaacaccttggaaaaactgayttctccccaattagtagtgttgtgtgactgtcataagcccagtacaaaaatggccttctttgttggggagcttcttaccctccagtgttttgcccaattt

SEQ ID NO: 34806 - DNA, 201 bp, Homo sapiens
gtggggtgaaagccgtggctgtagagcttcatgcggagttacttagctttgctctcctgtggacaggccatgcctgtgcctcccccaagcatcggaaaaaktggcatagatgggcccttctcaaaaatcccactcctggagcactggccaaaattactaccatcctgatgctgggcttgcagtcctttcctttgggaatat

SEQ ID NO: 34807 - DNA, 201 bp, Homo sapiens
gccaccctctgccacgaccaggcagaaagcagctttcggacagattcgttgtctcagatttgatctcaaagaaaaaccaagaccagtatttgtcccaggtyctgcttttttacaatttcctccgaaatccagatacctgtcaacaccttggaaaaactgacttctccccaattagtagtgttgtgtgactgtcataagccc

SEQ ID NO: 34808 - DNA, 201 bp, Homo sapiens
tttcctaaactatgtggtggtctacgtcctcactgacttatcaacatgctaccatcatgcacttcctatctctattcctcttctttaaatttggttccaartggctcacaccattattctgagctattacctgcctacgcagtcctagaaagtaagtgattcaggaaacattccccaaaagtaaagtttctcaggtaagat

SEQ ID NO: 34809 - DNA, 201 bp, Homo sapiens
atcactagcattctgtgccaaggacggagctggcatctccaggcttggaatagagctaccaaagctcagccagatgtctggaagagcctcaggacaagggracaccctgtagccttgtggtgggagcacagctgaggcccccttggccaccctctgccacgaccaggcagaaagcagctttcggacagattcgttgtctca

SEQ ID NO: 34810 - DNA, 201 bp, Homo sapiens
ccgtgcctgggactcatgcacctttgactcccatggaagggaagtgcagtagtttcccaggtgcaattctggtgtcctcacccacattgaggatgtacaasaatcaggttcttagagattggagaaagaaggaagaatgggaacaagatttttcccaaaggactgtgaggtcccccacctaaccttgatgtgagacaagtg

SEQ ID NO: 34811 - DNA, 201 bp, Homo sapiens
caccacgcccctcaaagtggtcaaggttgtcctgttgtctaattccatggagcttgcctgtcttcattttattagcctcttttggcctctcacccttgtgmaaatcactagcattctgtgccaaggacggagctggcatctccaggcttggaatagagctaccaaagctcagccagatgtctggaagagcctcaggacaag

SEQ ID NO: 34812 - DNA, 201 bp, Homo sapiens
ctgcggcccccaccacgcccctcaaagtggtcaaggttgtcctgttgtctaattccatggagcttgcctgtcttcattttattagcctcttttggcctctyacccttgtgcaaatcactagcattctgtgccaaggacggagctggcatctccaggcttggaatagagctaccaaagctcagccagatgtctggaagagcc

SEQ ID NO: 34813 - DNA, 201 bp, Homo sapiens
cataagttccattttcttgggtatctcttaggaagcaagcataggaaacaggcccatccgtctgcctgttttgcttcctcatctcacttctacacgagggygcctgtgctcaattgctgttttcccctaaagagactcttttccataagtttgtgaaatgccatcgacaaacctgatcgcattgcatttcactctgctgtt

SEQ ID NO: 34814 - DNA, 201 bp, Homo sapiens
ttagtacaacgatgcatgtctactgtatgtaaggcatactagcagaaattgagctcagcactagagaagatgattgcattctatgccttgcttcttttttwaaaaaaaggcttccatagatagattctcagaacagcccatggcaaatgtaaagttatttggaaaacccaggttccagattcactagagcatagaatctct

SEQ ID NO: 34815 - DNA, 201 bp, Homo sapiens
cacctctaactcaaagtccctcgatggagtcagttccagttctccacttctggccccatctggtacacaccactgcctctcactgcccgggctctctatccttgacaggctgccttgaagttgagcccagactgattttcttgcctcagaccccactaccgtgcctgggactcatgcacctttgactcccatggaagggaa

SEQ ID NO: 34816 - DNA, 201 bp, Homo sapiens
ggcgacaagagcaaaactccacctcagaaaaaaaaaaaaaaaaaaagaaggaaggaaaaagaaacactcctttatgtcttctaaggatagacatgaaatgygtgagccttggaacaccttctccctctcctgccccacgtgagctggagcttacatgccttcttgttttcagtactgccgtaaccctgatggtgatgtagg

SEQ ID NO: 34817 - DNA, 201 bp, Homo sapiens
tgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagctggagcttacatgccttcttgttttcagtactgccgt

SEQ ID NO: 34818 - DNA, 201 bp, Homo sapiens
gctcctgataataatatggaatagagttgtatctaacatgactctttcttgcaagtgacagaaaatgcaacttaagttggattaagcaaaaaagagaaatyattagtgaactgaaaattctgcaggctcacatcatggccccagaccctgtccattattcttgggcacaaatgtgatattctcgtggctgcagatgctgtg

SEQ ID NO: 34819 - DNA, 201 bp, Homo sapiens
cccaggagatggaggttgcagtgagctgagatcatgccactgcactccagcctgggcgacaagagcaaaactccacctcagaaaaaaaaaaaaaaaaaaaraaggaaggaaaaagaaacactcctttatgtcttctaaggatagacatgaaatgcgtgagccttggaacaccttctccctctcctgccccacgtgagctgg

SEQ ID NO: 34820 - DNA, 201 bp, Homo sapiens
aaatggtgaaacctcatctctactgaaaatagaaaaaaaaattagccaggtgtggtggcgtgcacctgcagttgcagctactcaggaggctgaagcaggakaatcgcttgaacccaggagatggaggttgcagtgagctgagatcatgccactgcactccagcctgggcgacaagagcaaaactccacctcagaaaaaaaa

SEQ ID NO: 34821 - DNA, 201 bp, Homo sapiens
gaaccagaaataaaacctgcctttctagactgtaagtcttgtgattttcatctaaatggttgtctctatacagcaactcatctctagaactgaaaataagyttaaatccctcctccatccccaataattcaagctgcatttcagagaaaaccaggactttggaatcagacagatcaactttgaattcttgatctgcttctt

SEQ ID NO: 34822 - DNA, 201 bp, Homo sapiens
cggggggtgggggttatcccaaataggttcacagaagaaccagaaataaaacctgcctttctagactgtaagtcttgtgattttcatctaaatggttgtcwctatacagcaactcatctctagaactgaaaataagcttaaatccctcctccatccccaataattcaagctgcatttcagagaaaaccaggactttggaat

SEQ ID NO: 34823 - DNA, 201 bp, Homo sapiens
aaaatgaaaatgaagatacgtgaaattcaaatgttgcaacttgcctattatttattttagtgcatttttttgtacttttcccagtttggtgttaggtggcmttaagttctcagtaatgacgcttatcaaataggaacttagtgcttgttactcacctttatccattcccccaacactcaacaaattgcctttgctatatcc

SEQ ID NO: 34824 - DNA, 201 bp, Homo sapiens; identical to SEQ ID NO: 7431

SEQ ID NO: 34825 - DNA, 201 bp, Homo sapiens; identical to SEQ ID NO: 7432

SEQ ID NO: 34826 - DNA, 201 bp, Homo sapiens
gaacctgtagagtgaggacgtctgcatgacaggctgggccttctgatgatgctcagaagcagaaagtgtgcctgcttcaaagttggtgacgatgatgtttyttgatcagaatagggcatttcttatttccaatcctttatcctcttgaacttactaaagtagaatcaggtctaaaaaccggagttctaatgtttgagagtc

SEQ ID NO: 34827 - DNA, 201 bp, Homo sapiens; identical to SEQ ID NO: 7433

SEQ ID NO: 34828 - DNA, 201 bp, Homo sapiens
agagttcccaccccacatccccacaccccgagtctagggcatttagtgctccaccagggaacctgtagagtgaggacgtctgcatgacaggctgggccttytgatgatgctcagaagcagaaagtgtgcctgcttcaaagttggtgacgatgatgtttcttgatcagaatagggcatttcttatttccaatcctttatcct

SEQ ID NO: 34829 - DNA, 201 bp, Homo sapiens
aaagaatggctcagtttactgcagcctttttgcagatgcaaaagatgatcttttagaaagcagaaacagggggtctggtgcatgagatctttttctcaacrtgactatgctgtgcagaccttcatgtggtgtcttgtgaaagactttgaccactgtgtggacttcccttcagtgtatctctcagagtgcaagactgggaat

SEQ ID NO: 34830 - DNA, 201 bp, Homo sapiens
tgtgggtgcctgtaatcccagctacttgggaggctgaggcaggagggtcacttgagtcccggagtttgaggctgcagtgagttatgatcgtgtcactgcaycagcctgggcgacagagtaagacactgtaccaaaaaaaaaaacaccaaaaaaacaaaaaacaaacaaaaaaaaaacaacttcacaatgtcaaaaaaatca

SEQ ID NO: 34831 - DNA, 201 bp, Homo sapiens
cctctggctgcactgtgccccgtgtgtccccagcatcctggtggggctcgatacacagagagctcataagtagcatttgaatacatgaatcaaagaatggytcagtttactgcagcctttttgcagatgcaaaagatgatcttttagaaagcagaaacagggggtctggtgcatgagatctttttctcaacgtgactatgc

SEQ ID NO: 34832 - DNA, 201 bp, Homo sapiens
gtatcttgcatgcaactgatgcctttcaaatgaaaccttacatctgcatagtccatagacaaccacaggcaaatgtgagggtgaaactctgtgttctacgytgctctgtgtcagtgaagcaaggcagtgccagttcagagggctctggggcctcaagacagggatgactggttgtgggtactgcagctgcgagcagagcag

SEQ ID NO: 34833 - DNA, 201 bp, Homo sapiens
acccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagctg

SEQ ID NO: 34834 - DNA, 201 bp, Homo sapiens
aagccctttccccattctctcactctgtctcatcatgtatgtaatatgtatcatcattaagtgatctcattttatattgtttccttgaatatttcctgtamcccccctgcctgattccactagaatgtaagctccatgacggccaagcctctggctgcactgtgccccgtgtgtccccagcatcctggtggggctcgatac

SEQ ID NO: 34835 - DNA, 201 bp, Homo sapiens
gagcagtcaaacataactgctgatgcttttctttcagtcctgccgtcatcactgacaaagtaatcccagcttgtctgccatccccaaattatgtggtcgcygaccggaccgaatgtttcatcactggctggggagaaacccaaggtgagataaattccattgcccacataacgaattggttttgacctacagtccatgtga

SEQ ID NO: 34836 - DNA, 201 bp, Homo sapiens
aacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagct

SEQ ID NO: 34837 - DNA, 201 bp, Homo sapiens
ttattgtaatgcggcattgtgatctctggatttagcatgagttgatagctgactttttctgcagaagcatcttggtggcacctctaactcaaagtccctcratggagtcagttccagttctccacttctggccccatctggtacacaccactgcctctcactgcccgggctctctatccttgacaggctgccttgaagttg

SEQ ID NO: 34838 - DNA, 201 bp, Homo sapiens
gtctgccatccccaaattatgtggtcgctgaccggaccgaatgtttcatcactggctggggagaaacccaaggtgagataaattccattgcccacataacraattggttttgacctacagtccatgtgacaaaatgatcattttggagaaagctgtgcaaattcctatccatgaatgtggtccaccccactcctgattttg

SEQ ID NO: 34839 - DNA, 201 bp, Homo sapiens
gaacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagc

SEQ ID NO: 34840 - DNA, 201 bp, Homo sapiens
ggggaaggagcttggcctccaagtccactgaagaccagcatcctgagattgcctgggaaggtggtacagggcagtgatgaagatcatgggagccacactgsccagcttcgcatttgggcttctcctagggacaccaagagggaggaaggaggggttaggatggtatgaaagattctacttggccaatattattgtaatgcg

SEQ ID NO: 34841 - DNA, 201 bp, Homo sapiens
tgaacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgag

SEQ ID NO: 34842 - DNA, 201 bp, Homo sapiens
ttcatgtgctcttgaaaagaatgtgtcttctgcggttgttgggtggggtgttccctcaaggtcatttaggtgaagttggttgctggtgttcttctgtatcsttactgattgtctgtctcctccttcattgactactgtggatgaatggtgatgtgtccaactttaactgtaaattagtctatttctcttttagatcgtaac

SEQ ID NO: 34843 - DNA, 201 bp, Homo sapiens
tgtaaagccccttcccacagggatgttattaataattgagtaacgtattcacctctcggaaagaagcaaaaccccagaattaacctgaattttttttttttctgagacagagttttgctctcgttgcccaggctagagtgcaaccgtgcaatctcggctcaccacaacctccgcctccgggttcaagagattctgctacct

SEQ ID NO: 34844 - DNA, 201 bp, Homo sapiens
tggtttcgctaaacagattttgctaagtacttaagcactgcagatgcttgagtaatatgctcataagttcctttctgatttcaattactgggaaaatgtayatatggatagtagaaggatggcatcccataataaaaggcaggcagcctaaccctcacatgcatttttctctccctctgtatagggtgacagtggagggcc

SEQ ID NO: 34845 - DNA, 201 bp, Homo sapiens
accatttacagtagaccacaattttatagccctgtttggcactttttcatatcactgggagcctgaagaaatagaagtgggttggatctctttcagcctcdgaaaagcctgccattcccccatctaaaaagccctttccccattctctcactctgtctcatcatgtatgtaatatgtatcatcattaagtgatctcatttt

SEQ ID NO: 34846 - DNA, 201 bp, Homo sapiens
aaaataatttgttgtaaagccccttcccacagggatgttattaataattgagtaacgtattcacctctcggaaagaagcaaaaccccagaattaacctgawttttttttttttctgagacagagttttgctctcgttgcccaggctagagtgcaaccgtgcaatctcggctcaccacaacctccgcctccgggttcaagag

SEQ ID NO: 34847 - DNA, 201 bp, Homo sapiens; identical to SEQ ID NO: 7443

SEQ ID NO: 34848 - DNA, 201 bp, Homo sapiens
aagatgcggccctgcaccttctgagggggaccattaagagatgaagttgactaaagcagagactttgtgtaggtgacgggcttgggaaggtagctatggawtccagactgagcacccatagcaggaccacgggatggagatgggaggggtcaggggccagggtggggtggaatgtggagcagaggttcaggggaactgatc

SEQ ID NO: 34849 - DNA, 201 bp, Homo sapiens
gccagaagcagcctatcaatagagaaattgaaaatctgaccacacaaatgctgcagcacccagctgaaatgcatttggatgacaatctcagatgggaatcragagcatctccttctgccttgctaatagcaagctgatttttagaatatagtctaagtgcttcttttccatcctccccagattctcacctgctacacaccc

SEQ ID NO: 34850 - DNA, 201 bp, Homo sapiens
cagaaagcagctttcggacagattcgttgtctcagatttgatctcaaagaaaaaccaagaccagtatttgtcccaggtcctgcttttttacaatttcctcygaaatccagatacctgtcaacaccttggaaaaactgacttctccccaattagtagtgttgtgtgactgtcataagcccagtacaaaaatggccttctttg

SEQ ID NO: 34851 - DNA, 201 bp, Homo sapiens
attcagtgggctacacccaaaggctagatcaaacttctctgccacaggattaacatatgttttaacccacctggtgggcacattctctcataagctctttyggaaagccaggttttctgtggatgtatcatctttccagtgtgctgcaatgcccggggagagggaaaagtttcttttacagccatgcttagtgggaagtgg

SEQ ID NO: 34852 - DNA, 201 bp, Homo sapiens
cggctaattttttgtatttttagtagaaacggggtttcaccgtgtcagccaggatggtcttgatctcctgacctcatgatccgcccacctcggcctcccaragtgctgggattacaggcgtgagccaccgggcccggccggccctgcttcgtaagaatgaaaaggcagtgggccgcctgtagtcccagctactcgggaggc

SEQ ID NO: 34853 - DNA, 201 bp, Homo sapiens
ctaccgatttctctcctcacagataaagagagttttaatgagcaaaaaacttgcagaatctgaaggaaaaggctggtatagctgtacgaagtggcagagcrtgaaattggtggttattactttttttttttttccccgccatcagattccaccccgcatcaaagctgtgccaaataggctcgctttgtttagggacagggt

SEQ ID NO: 34854 - DNA, 201 bp, Homo sapiens
cactcgagtgcattgaccccaggagacggcagcgctaacttagcagagcgtttgctgtcaggcctttggatacctacagagcttactgtttcttgatagaytcctaatttttttcgtaaacaaatctgaaagtcaccaccttccccgttgactaccgatttctctcctcacagataaagagagttttaatgagcaaaaaac

SEQ ID NO: 34855 - DNA, 201 bp, Homo sapiens
cacacaccccacaaaaccatgtttgggttttctactcggagagcttgggcggtcattgactggtccacacacaccccacctgggcaccgcgtaggaataasgcagggcaagatgcagttttctccttaaaaagggtggttgtcttcctcgaaccaaaaattttcccgtatggcccgctggaaaaactgccccgtcccaccc

SEQ ID NO: 34856 - DNA, 201 bp, Homo sapiens
ctggaaaaactgccccgtcccacccaggttcgcgcccttaaacttacactcctgaggcctggagcaaagccggccgatctgcctcacgctccccgagcagrgacaaggaaaagacactaaacctaaaacgcacgactcgctcagaaccccaactctaacttggagaagggcccgcccctccagttacaccccagctccaag

SEQ ID NO: 34857 - DNA, 201 bp, Homo sapiens
aggttcatctttcccatgtgagtaatctgttattccagcaccatttgttgaaaagactttaatttctccatttcattccattgatgcctttgttgaaaacragcataagtctgggtctatttctgaactctgttctctttctctgtccttatgccaaaaccacattgtcttgtttacaacagctttataggtaatgttaaa

SEQ ID NO: 34858 - DNA, 201 bp, Homo sapiens
attctctgataatcaagagttcacaaagaagagaatacttacttcacttcagttaatcaaagaagagatataaaaatccttaagacagtctctggccatamggacgaaagcacctaagaagcagattagtatatggtctttttaacctttttaaagctaatacagtttcagccatgtctgccttacctgtaatacccatat

SEQ ID NO: 34859 - DNA, 201 bp, Homo sapiens
cactgcgacctccgccttccgggtttaagtgatactcctgcctcagtctcctgagtatctgggattacaggcgcccaccaccaggcccaactaattttttstatttttagtagaggcggtttcaccgtgttggccaggttggtctcgaactcctgacctcaggtgatctgcccgcctcagcctcccaaagtgctgggatta

SEQ ID NO: 34860 - DNA, 201 bp, Homo sapiens
ggcgtgagccactgcacttggcctggactcatcttcattgtccacctcctaggctaaatttatgtcttttatgtgcttgtaatctctgcataccactttartgacacttgccctggagtgtgattggtaatccctctccccactagatccttgaaggcaggacctgtgttccctgtttaaccatagttctcaattagtaat

SEQ ID NO: 34861 - DNA, 201 bp, Homo sapiens
ctgtgttccctgtttaaccatagttctcaattagtaattcaaatttgggttggggagagctaagtggtaatttttaattccttcaaattttccatgaattsgactaatttaaattctggtcagagataacaaaggataatacaatttgatctatgattatcttgtgataaatacttaatggaagttaaattatttttaaaa

SEQ ID NO: 34862 - DNA, 201 bp, Homo sapiens; identical to SEQ ID NO: 7577

SEQ ID NO: 34863 - DNA, 201 bp, Homo sapiens
ttagtgacatccattccatccaaaaggttaagggtgtgatctaaaagatcccttagaaattctaaattgtcttaaaattttgaaccagtagcatctgttaygtgtacctaaggctaatgtaacagaatcagttcccctagaaagcatgtgatccaaatgctctcagtggctgggggtagtggctcacacctgaaatctcaa

SEQ ID NO: 34864 - DNA, 201 bp, Homo sapiens
tactcacagcttgctttatggctggaattggtcctattcccataatggaaggctccacacccacttgggaccaggaaactatccgtgctaaaggtgtaagyccacgtttatcagcttctgacttcttcataagaacgacagctgcagcaccatcatttattcctgtaaaatatgagtgacttaatttctaccatgcttatt

SEQ ID NO: 34865 - DNA, 201 bp, Homo sapiens
ctgctgtagatccccaaactctccacgccagacgccgccgacccggaagtagcaagtcccctgccactgagtggccaagaaggcgatctgttatcctgcaycgccaatcatcgctcacgtcgaggggcacgcaggccctggagcccaccaaccacctcgtagctacgcccaagaccacgcttgttgcttaagtccggggtc

SEQ ID NO: 34866 - DNA, 201 bp, Homo sapiens
agccggtgtggtggtgtgcgcctgtagtcccagccactcaggaggctgagacaggagaattgcttgaacctgggaggcggagattgcagtgagccaagatygcaccactgcactccagcctgggcgacagagtgaggctccgtctcaaaaagaaaaaaaaaggattacagcagttggggaggggagatctctgacaggaaa

SEQ ID NO: 34867 - DNA, 201 bp, Homo sapiens
gcgatctgttatcctgcaccgccaatcatcgctcacgtcgaggggcacgcaggccctggagcccaccaaccacctcgtagctacgcccaagaccacgcttkttgcttaagtccggggtcaaaggcacacaccccacaaaaccatgtttgggttttctactcggagagcttgggcggtcattgactggtccacacacacccc

SEQ ID NO: 34868 - DNA, 201 bp, Homo sapiens
gtctagttgggatgtcaagaaaccaaattaattctttcagtataggttaagtcaatgatcaaatacagagaaatgacatgtttccttaaactgttttaagrataattttgtacataaatattgagttgggtgtggtggctcatgcctgtagtcccccagctacttgggaggttaaggcagggggctcacttgagcccagga

SEQ ID NO: 34869 - DNA, 201 bp, Homo sapiens
gggtgccagagtgagacccgtctccacacacacacacaaaaaagttattgctttgctttctatgtcttgtctttacttatcaagctgtttttctttctttytttttttttttgttggatgatgtctcactatgttgaccaggctggagtgcagcagctactaacaggcaaaatcaaccatagtatactatacaacctcaaa

SEQ ID NO: 34870 - DNA, 201 bp, Homo sapiens
ttaattcatttcatcactaccattttggttaataatatatggccattttagtgtcattccatatgtattgcacatgttgaatatccggcacactcagaccrgtgaatgttttctcaacaggttattattgcagcagaactcctaaaaaatgcagatgaattagtcaaacagaaaattcatcccacatcagttattagtggc

SEQ ID NO: 34871 - DNA, 201 bp, Homo sapiens
actaagatataatttctaaagattcctatgtattactcttttagatgttactcttacctataaataggttgatgtttaaaccactatgatatactcacctyttctagttgacaccaaaactggtacaatctctttgtcaaaatggccagctttctgtgcattctctgtcctgttctgggacagaactgcaaccttgtcctg

SEQ ID NO: 34872 - DNA, 201 bp, Homo sapiens
tcacctcagacaggcaggtatcctgtccgctactgtaacatcctctttaaatagcccccatcacacctatttgttgtttgttccagcccctccgcgaaccytgcctctacccgccgcatggcagctacctgggagagtgcctggagttgaatgaatgaaaatagtctgtagggtgcactgcccttgtcaatcacaagcaga

SEQ ID NO: 34873 - DNA, 201 bp, Homo sapiens
tgtggtcttcgcagtgccgcgagctctatttcgatccggcacgtcgaatacaaaatagaacccgcacgttccaatgtactgtgcaagcccaggcgagtgasctgggagaaggggggcaagactaattaccagggttcctgcaaaccgagaacccccaaaactgcgaccgaagcgccatcgctgagacgatctcggaaaagc

SEQ ID NO: 34874 - DNA, 201 bp, Homo sapiens
aggaggaactgaatacatttttgttgaatgagtgacactttgaggtagtaaggaggagcaggcatactttcctatgcgtcaggctggccctgctgctgctkcttcttcttctttttaaaaggagtctcactctgttgcccaggctgaatggagtgcagtggcacaatctcagctcactgcaagctccgcctcccgggttca

SEQ ID NO: 34875 - DNA, 201 bp, Homo sapiens
tggagtgcaatggtgcaatatctcagcttactgcaacctccgcctcttaggttcaagcaagtctcctcccttggcctccagagtagctgggactacaggcrcctgctgcaacacctggctaattttttgtagttttagtagagatggggtttcaccgtgttagccaggatggtctcaatctcctgacctcatgatccgccc

SEQ ID NO: 34876 - DNA, 201 bp, Homo sapiens
tctccattaaaaataaatttagccgggcatggtgtgtgtgccatgtagctagtagtcctagctgcttgggaggctgaggcagaaggatcacttgagcctargagttcaaggctgcagtgagccatgattgtgcctctgcactccagcctgggtgaccctgtctcacaaaacaaaacaaaaatcaggaaatttaacatgaat

SEQ ID NO: 34877 - DNA, 201 bp, Homo sapiens
cttccccatcatattttcacccactagttttagcattcattcatgactttctaactccaacattccttctattggtaagatattaattggcattttaccayaaagaaaaccttttccttttctcccatttattcagttatttatatcaggatggactcatacattttcattttattgaataagttataactcattactttc

SEQ ID NO: 34878 - DNA, 201 bp, Homo sapiens
cataaagaaaaccttttccttttctcccatttattcagttatttatatcaggatggactcatacattttcattttattgaataagttataactcattactytcattacttactttgatgctgaaatttttcaatacttgggcagttataacccattactatcattacttatttgcacgctgaaattgttcaaaatttaggc

SEQ ID NO: 34879 - DNA, 201 bp, Homo sapiens
agataaagagagttttaatgagcaaaaaacttgcagaatctgaaggaaaaggctggtatagctgtacgaagtggcagagcatgaaattggtggttattactttttttttttttccccgccatcagattccaccccgcatcaaagctgtgccaaataggctcgctttgtttagggacagggtcccacctgtcgcccagacga

SEQ ID NO: 34880 - DNA, 201 bp, Homo sapiens
ccgcacgttccaatgtactgtgcaagcccaggcgagtgagctgggagaaggggggcaagactaattaccagggttcctgcaaaccgagaacccccaaaacygcgaccgaagcgccatcgctgagacgatctcggaaaagcctcgcctctttttcctcacggacgactcagtcgctcgccaggcgcagccatataaagtcag

SEQ ID NO: 34881 - DNA, 201 bp, Homo sapiens
taataataattaattaattaattacgagtgttcaaacccaaagaatcagaagatgggggcactctcaggactcagctatattcctctggggagtgatatgycccatttgcaaggggcatgatgtggcacctattttccaagctcagaactgagccctaagagggcagggaacttacctgtattgttggaaccatactccca

SEQ ID NO: 34882 - DNA, 201 bp, Homo sapiens
tagagccttttctttgattcttgtttcatacttgcatcttcaactaattatgctctttcctggattcttcctgtggctcttttgtccttcaagcttcttcrtacatccttgtgctataggtactccctatcgtacatctttacaggcagatgtcatgagtggtttactacacaaaacttctctggtgcttttcttctcatc

SEQ ID NO: 34883 - DNA, 201 bp, Homo sapiens
caatggtaaatgtttataaagtggttactctattcccagtttcagatatactcaaacctaccacccttccttggagagtttgtggggaagaactagcaaakaagtcgctgataaaaacttagagattatattcatcacaatgttatcaatctgggattaggctggaaactaaaaacgggtaaggttacttgagactgaaaa

SEQ ID NO: 34884 - DNA, 201 bp, Homo sapiens
aggctggagtgcagcagctactaacaggcaaaatcaaccatagtatactatacaacctcaaactgctggcctcaagtgatcctcccaccacagcctccctrgtagctgggactataggcacctgccactgcaccctgtaaaagctattctcttatatatacttctagaagctttacattttttgcttttatttttaaatcc

SEQ ID NO: 34885 - DNA, 201 bp, Homo sapiens
tactcaaacctaccacccttccttggagagtttgtggggaagaactagcaaataagtcgctgataaaaacttagagattatattcatcacaatgttatcartctgggattaggctggaaactaaaaacgggtaaggttacttgagactgaaaacatatgcaggatcatatacatattaaaaagacaggcccagtgcggtgc

SEQ ID NO: 34886 - DNA, 201 bp, Homo sapiens
tccctgcctatcttacctcgttccttttatgccaagtaagccaatgtctttttttttttttttttttttttaccttgggaagtaatgaactcagtcctagtaactagtatttctttaactattacccacatggccaacacctagaagatactatcttaaaattggattgtgaaattcactggtaagctctcagggttactt

SEQ ID NO: 34887 - DNA, 201 bp, Homo sapiens
tggcccactgcgtctgcgcaacatcgtttgaggcgaaggttcaacctcttcccagcggtccaacatccgacttccgttctccgctttcgcgcccttcccaycggctatctaattggacaaaaatgccgaccccgccccttccccggagcctcacttccgtcacagtcctgtttctctccctgttgtccctgcctctttttc

SEQ ID NO: 34888 - DNA, 201 bp, Homo sapiens
tggggcagggcgctgtggccccacttttcccacagcgaggaggagccccgccgcgcgcggcagggttttgagaccggcaacgcgtggatgtggtgtccggkgcggcgttggaaacgcgccctccgcgggaaagcgggcctcccgggctcgcacgtgcgggccacgcctcgcacccccttttgtttcagggcgaccccctga

SEQ ID NO: 34889 - DNA, 201 bp, Homo sapiens
ctggtcagagataacaaaggataatacaatttgatctatgattatcttgtgataaatacttaatggaagttaaattatttttaaaaatcacagaaggtaaytcaggttacaaaaatactttgcagagaatcagatatcaccaaggagagaattcagaagatcctggcaactggtgccaatgttattctaaccactggtgga

SEQ ID NO: 34890 - DNA, 201 bp, Homo sapiens
ggtcttcgcagtgccgcgagctctatttcgatccggcacgtcgaatacaaaatagaacccgcacgttccaatgtactgtgcaagcccaggcgagtgagctrggagaaggggggcaagactaattaccagggttcctgcaaaccgagaacccccaaaactgcgaccgaagcgccatcgctgagacgatctcggaaaagcctc

SEQ ID NO: 34891 - DNA, 201 bp, Homo sapiens
ttcccataatggaaggctccacacccacttgggaccaggaaactatccgtgctaaaggtgtaagcccacgtttatcagcttctgacttcttcataagaacracagctgcagcaccatcatttattcctgtaaaatatgagtgacttaatttctaccatgcttattaacctcagttacatatctgtggcttctttaccacct

SEQ ID NO: 34892 - DNA, 201 bp, Homo sapiens
ttttaaagcataagactttgagatgggcatggtggtatgtgcctgtagtcccagctactaaggaggctgaggtaggagtattaattgaacccaggagtgcyagtccaatgtgggcaacatagcaagaccctgtctcgggagtgggtgcgtgtgtgcgcatgtgttgcgcgcacgcgtgcgtagtagcagcagtatcaattt

SEQ ID NO: 34893 - DNA, 201 bp, Homo sapiens
aaaataaaaaatgtttttttgtggattatgtgcagtacatctttttgtaatttaaagcacatacaacatggtagaaggaatgtgaattaaaagaaattacrtgcatttaatgccataaaatttttctaagataaaatgcaatgaattagtctaaatttgtgtgtttacatacaatcgattataggtactctttattatgct

SEQ ID NO: 34894 - DNA, 201 bp, Homo sapiens
cgggatcctccatatgctgaacgctggttccctgggtccccttatttctttctctatactttgtgtctttttcttttccaagtctctcgttccacctaacragaaacacccacaggtgaggaggggcaacccaccccttcataacttaataggcaaagcattatccaaacagactgttcacagaaaagaaaaatattaatg

SEQ ID NO: 34895 - DNA, 201 bp, Homo sapiens
gagtagctgggactacaggcacctgctgcaacacctggctaattttttgtagttttagtagagatggggtttcaccgtgttagccaggatggtctcaatckcctgacctcatgatccgcccgcctcggcctcccaaagtgctaggattacaggcgtgagccaccgcgcccggctggaagctattcttttgttgttgttgtt

SEQ ID NO: 34896 - DNA, 201 bp, Homo sapiens
gcactccagcctgggtgaccctgtctcacaaaacaaaacaaaaatcaggaaatttaacatgaatcaaacactattatctaatccttggtccacattcaaayttcacctatatttcagtaatgtccttctagctcctttatttgagccaataaagaagcatgcattgtacaactatcaatctctctagtttgcttttgtctg

SEQ ID NO: 34897 - DNA, 201 bp, Homo sapiens
ctttttcttttccaagtctctcgttccacctaacaagaaacacccacaggtgaggaggggcaacccaccccttcataacttaataggcaaagcattatccraacagactgttcacagaaaagaaaaatattaatgactcaaattcacaaaaatatgctcaatctcactaacaaaatgcatggacaagacaattcgatgcaa

SEQ ID NO: 34898 - DNA, 201 bp, Homo sapiens
ctgaatttgttcatttctaaaatgacagttccatcttaggataaaaggagttaccgtgtgctgcctaactaaattctaaacttgtaatatagcacttttaycacaaatgctactgagtccaaggatattaaaatcatgaaagagcaatattcacagatcctttgtaactctcttattagcaactattctgtcaaccctggc

SEQ ID NO: 34899 - DNA, 201 bp, Homo sapiens
tatatgccaggcctgtcttaacggtttatagataaagcttatgtctcaattctattattttttctatatttttttttagctgcagaaactaacacagaaasgttaagtaacttgaaaaagattaaaactagtaagtaatggagccatggtttaagtcccagtgtctggctccagagtcaatgctcttaactaccatgaaga

SEQ ID NO: 34900 - DNA, 201 bp, Homo sapiens
agaagtccttaagaaattctaaaaaatcctcaccaagcagataagcagcagataaacctgataaacacttacatgctgtagtatagtggtaataacctagygtcctggctctgaggtcagttaaaacatatgtaaatcttagctctggcacttactaatcatgtctccctaaacctcaatttctttgatcctgtaaaatgg

SEQ ID NO: 34901 - DNA, 201 bp, Homo sapiens
tgtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcaga

SEQ ID NO: 34902 - DNA, 201 bp, Homo sapiens
gcgccaccagcctggctaattttgtatttttagtagagatggagtttctccatgttggtcatgtgggtctcaaactcccgacctcaggtgatctgcctgcrttgacctcccaaagtgctgggattacaggcatgagccaccacacctggcctattttttaatttaatttaatttaatttaattttttgagacagagttttg

SEQ ID NO: 34903 - DNA, 201 bp, Homo sapiens
gtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagat

SEQ ID NO: 34904 - DNA, 201 bp, Homo sapiens
gtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagatag

SEQ ID NO: 34905 - DNA, 201 bp, Homo sapiens
ctcacacctgtaatcccagcactttgggaggccgggggggggggcgcattacttgaggtcaggagtttgagaccagcctggacaatatggtgaaacccccyctctctactaaaaatacaaaaattagctgggcatggtggtgcacgcctgtaatcccagctactcaggaggttgaggcaggagaattgcttgaacctgaga

SEQ ID NO: 34906 - DNA, 201 bp, Homo sapiens
tgaggaaggagaatcactggaacctgggaggcggagattgcagtgagccaagatcacaccactgcactccagcctgggctacagagtgagactccgtctcaaaaaaaaaaaaaaataaaaaatgtttttttgtggattatgtgcagtacatctttttgtaatttaaagcacatacaacatggtagaaggaatgtgaattaa

SEQ ID NO: 34907 - DNA, 201 bp, Homo sapiens
ggctgaggtggcaagaatctgaagcccaggaggttgaggctgcagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcag

SEQ ID NO: 34908 - DNA, 201 bp, Homo sapiens
agttctttgtgagctggctgatctgcaagacaaagaagttggagatggaactacttcagtggtaggtagactggctaaagaatgatcatttttctaaaaaygaccgactttcagaaagttgaagccataagtgggtcatttgtgctgtgtcagaaataagttacatattctgaatgcccagaagattgagcaagaagaaaa

SEQ ID NO: 34909 - DNA, 201 bp, Homo sapiens
gctgaggtggcaagaatctgaagcccaggaggttgaggctgcagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcagt

SEQ ID NO: 34910 - DNA, 201 bp, Homo sapiens
ctgcagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcagtctgcacgggtattcttttttccttccttcctcatacaa

SEQ ID NO: 34911 - DNA, 201 bp, Homo sapiens; identical to SEQ ID NO: 7567

SEQ ID NO: 34912 - DNA, 201 bp, Homo sapiens
gcctcggcctcccaaagtgctaggattacaggcgtgagccaccgcgcccggctggaagctattcttttgttgttgttgttgttgttgtgtcactatgttamccagactggaatgcagtagatactcacaggtgcaatcatagtagactatgatagcattgcccaggctagactcaaactcttggactcaagcaatctcttg

SEQ ID NO: 34913 - DNA, 201 bp, Homo sapiens
cttcttaagcttgatatttttgaagaacatgggcgagttcttttgttaagggtcatcaattttgatttgtctgatgtttcctcagaattagattaagattstgccaaaaggcaggtataccactgaatgatagtatgatttttctcagtgagtcttattaggacacaaatgacaatcagtttatcccaggtgatgttatct

SEQ ID NO: 34914 - DNA, 201 bp, Homo sapiens
agctactcaggaggctgaggtgggggttgcagtgagccaagattgagccactgcactccaatctgggtgccagagtgagacccgtctccacacacacacamaaaaaagttattgctttgctttctatgtcttgtctttacttatcaagctgtttttctttctttttttttttttttgttggatgatgtctcactatgttga

SEQ ID NO: 34915 - DNA, 201 bp, Homo sapiens; identical to SEQ ID NO: 7569

SEQ ID NO: 34916 - DNA, 201 bp, Homo sapiens; identical to SEQ ID NO: 7572

SEQ ID NO: 34917 - DNA, 201 bp, Homo sapiens; identical to SEQ ID NO: 7573

SEQ ID NO: 34918 - DNA, 201 bp, Homo sapiens
tgcagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcagtctgcacgggtattcttttttccttccttcctcatacaac

SEQ ID NO: 34919 - DNA, 201 bp, Homo sapiens
gcagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcagtctgcacgggtattcttttttccttccttcctcatacaaca

SEQ ID NO: 34920 - DNA, 201 bp, Homo sapiens
cagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcagtctgcacgggtattcttttttccttccttcctcatacaacaa

SEQ ID NO: 34921 - DNA, 201 bp, Homo sapiens
agtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgctgtcatcttttaaatcagtctgcacgggtattcttttttccttccttcctcatacaacaaa

SEQ ID NO: 34922 - DNA, 201 bp, Homo sapiens
ttgaacctgggaagcggaggttgcggtgagctgagatcacaccattacactccagcctgggcaacaagggcgaaactccgtctcaaaaaaaaaaaagtgcgggggggtgcttaaataagcattatcaaacctatgtctaataaacacaggatataacctaggcattatcagtgtttctaactagggccatttgctcccaag

SEQ ID NO: 34923 - DNA, 201 bp, Homo sapiens
ctacgcccaagaccacgcttgttgcttaagtccggggtcaaaggcacacaccccacaaaaccatgtttgggttttctactcggagagcttgggcggtcatygactggtccacacacaccccacctgggcaccgcgtaggaataaggcagggcaagatgcagttttctccttaaaaagggtggttgtcttcctcgaaccaaa

SEQ ID NO: 34924 - DNA, 201 bp, Homo sapiens
acctgtaatcccagcactttgggaggccgggggggggggcgcattacttgaggtcaggagtttgagaccagcctggacaatatggtgaaaccccccctctstactaaaaatacaaaaattagctgggcatggtggtgcacgcctgtaatcccagctactcaggaggttgaggcaggagaattgcttgaacctgagacagag

SEQ ID NO: 34925 - DNA, 201 bp, Homo sapiens
tttctaaaattgtaaagttataccgattttgttaagtaaaagtaggttttcttcccatttatttgctgcttgtagtctcacagtgatacgagcagttatasgcatgggataaaataacattgggccactgtaaattgagatgaagtaaccattttcatctcttctgcagggactagacattgtttctgtatagtatatcta

SEQ ID NO: 34926 - DNA, 201 bp, Homo sapiens
ctttgttgaaaacgagcataagtctgggtctatttctgaactctgttctctttctctgtccttatgccaaaaccacattgtcttgtttacaacagctttawaggtaatgttaaaatcagagcatgtaagtgctattttctgacttcaaaattgttttggctattctgagtgctttgcattttatacagtatttatttacac

SEQ ID NO: 34927 - DNA, 201 bp, Homo sapiens
aagaggaaggcatgcctcttgcacttgagacaagaggaaagcatctgtctcctgcctgtccctgggcaatgcactgtctcggtataaaacccgattgtacrttccatctactgagttagggaaaaaccgccttagggctggaggtgggacatgcgggcagcaatactgctttgtaaagcattgagatgtttatgtgtatgc

SEQ ID NO: 34928 - DNA, 201 bp, Homo sapiens
cgtagtagcagcagtatcaattttgtgcaataaaattttgaataaccaattttatgcaaattgatatcaatagagaggagtaatgctgtattgaaattacytgttgccttccctgcttttttagggtgaaaaggtaataaaaagcatgtctaaaagtgatatgaattgcagatagtgataatgttgtaacattttggtgac

SEQ ID NO: 34929 - DNA, 201 bp, Homo sapiens
ccttaaacgcattgccaaagcttctggaggtatgtcttgtgctggctgtcacataaaatacttttattatccctgatcctatcaaaggtctttttacattrgaatattgacagaaaacagctcaaaaacatttatattctcttaatgctttgtgctaccaacacatttatagagccatttttcatgtaactggagaaattt

SEQ ID NO: 34930 - DNA, 201 bp, Homo sapiens; identical to SEQ ID NO: 7584

SEQ ID NO: 34931 - DNA, 201 bp, Homo sapiens
ccaagccacaaaatattcttttgattttttttttaacttaaaaaaagtaaaaacaagtttttagctcacaatctacctttggcccacgggccgtagtttgstgacacttgaaccatttgttcaatgaagggcccgattcattatgtcaaaggtcatttcctactataatattctgaaattctctacttttaatattgcgag

SEQ ID NO: 34932 - DNA, 201 bp, Homo sapiens
accccaactctaacttggagaagggcccgcccctccagttacaccccagctccaagctccacccttcttacaaccttttctagaaggcactagaatggccsactgcgtctgcgcaacatcgtttgaggcgaaggttcaacctcttcccagcggtccaacatccgacttccgttctccgctttcgcgcccttcccatcggct

SEQ ID NO: 34933 - DNA, 201 bp, Homo sapiens
ctcgagaccagcctgggcagcagcaaaaccccatctctacaaaaaataccagaaaaaaaaaaaaagaaaaagaaaaaaattagccggccatggtagtgtgwgcctgcagtcccagatgctcaggaagctgagatgggagaatcgtttgagcctgggaggcagaggttgcagccagctgatactgtaccactgcactccagc

SEQ ID NO: 34934 - DNA, 201 bp, Homo sapiens
tcccagatgctcaggaagctgagatgggagaatcgtttgagcctgggaggcagaggttgcagccagctgatactgtaccactgcactccagcctgggtgayagagccagagcttgtctcaaacaaaacaaaacaaattagctgggagtaatggcatgcgcctctagtcccagccactcaggaggctgaggtgggaagattg

SEQ ID NO: 34935 - DNA, 201 bp, Homo sapiens
agcactgaccccgtccttaacttcctactgtggtcttcgcagtgccgcgagctctatttcgatccggcacgtcgaatacaaaatagaacccgcacgttccmatgtactgtgcaagcccaggcgagtgagctgggagaaggggggcaagactaattaccagggttcctgcaaaccgagaacccccaaaactgcgaccgaagc

SEQ ID NO: 34936 - DNA, 201 bp, Homo sapiens; identical to SEQ ID NO: 7574

SEQ ID NO: 34937 - DNA, 201 bp, Homo sapiens
tcctgggttcaagcaatcctcctgccttagcctcccagagtgcttgggattgcaggcatgtgccaccacaagcaactaattaaaaacctcttttttttttytttaagagacagggtctcgctatgttgcccaggctggtcttgaactcctggcctcaagtgatcctcccttctcggcctctgtagtgctgggattacacgc

SEQ ID NO: 34938 - DNA, 201 bp, Homo sapiens
tcttaaaattggattgtgaaattcactggtaagctctcagggttacttgtgcatctttaccttctctgggtttaatccaagttctttaactattgcagcaragacagctgcaaaggcttcattgatttcaaatatgtcaacatcttccagtgaccaacctgcttttgtaacctagaggaaagattcatagaaaagaggtct

SEQ ID NO: 34939 - DNA, 201 bp, Homo sapiens
ttaaaattggattgtgaaattcactggtaagctctcagggttacttgtgcatctttaccttctctgggtttaatccaagttctttaactattgcagcagaracagctgcaaaggcttcattgatttcaaatatgtcaacatcttccagtgaccaacctgcttttgtaacctagaggaaagattcatagaaaagaggtctaa

SEQ ID NO: 34940 - DNA, 201 bp, Homo sapiens
aggagaattgcttgaacctgggaggcggagattgcagtgagccaagattgcaccactgcactccagcctgggcgacagagtgaggctccgtctcaaaaagraaaaaaaaggattacagcagttggggaggggagatctctgacaggaaatggaagaataagcctgggcttcacaaggaggtattgggagtttctggtactg

SEQ ID NO: 34941 - DNA, 201 bp, Homo sapiens
attgcagtgagccaagattgcaccactgcactccagcctgggcgacagagtgaggctccgtctcaaaaagaaaaaaaaaggattacagcagttggggaggrgagatctctgacaggaaatggaagaataagcctgggcttcacaaggaggtattgggagtttctggtactggaaaaatacaaaggtagataaactgaagtt

SEQ ID NO: 34942 - DNA, 201 bp, Homo sapiens
gtttttatattattatttttaagagaccatctgtagcacagtctgaagtgctgcagtgctgtcatatctcactgcagcctggaactcctgggttcaagcartcctcctgccttagcctcccagagtgcttgggattgcaggcatgtgccaccacaagcaactaattaaaaacctcttttttttttttttaagagacagggt

SEQ ID NO: 34943 - DNA, 201 bp, Homo sapiens
tttctatgtcttgtctttacttatcaagctgtttttctttctttttttttttttttgttggatgatgtctcactatgttgaccaggctggagtgcagcagmtactaacaggcaaaatcaaccatagtatactatacaacctcaaactgctggcctcaagtgatcctcccaccacagcctccctagtagctgggactatagg

SEQ ID NO: 34944 - DNA, 201 bp, Homo sapiens
agaagggggccaacaggaggaatcataacagagggaactctgagcaaaagcaaggaggcaagaacttgagtgagtgagagagtgtgtgagtgtgtgagagwgtgtgtgtgtgtgtgtgtttatgggctgtttctaataagcctgacttctcctggaatcactgagacttacctgctgccaagacatgtccaaagatgacct

SEQ ID NO: 34945 - DNA, 201 bp, Homo sapiens; identical to SEQ ID NO: 7575

SEQ ID NO: 34946 - DNA, 201 bp, Homo sapiens
cttgtagtctcacagtgatacgagcagttatacgcatgggataaaataacattgggccactgtaaattgagatgaagtaaccattttcatctcttctgcakggactagacattgtttctgtatagtatatctaaatatcctgtgtaggcaggacttaagggaactttatgtagacttattttattaaaatgccattttttt

SEQ ID NO: 34947 - DNA, 201 bp, Homo sapiens
atgaatgaaataatgctttataatgatgaagataatagttaacatttactgagcacttagtatatgccaggcctgtcttaacggtttatagataaagcttrtgtctcaattctattattttttctatatttttttttagctgcagaaactaacacagaaaggttaagtaacttgaaaaagattaaaactagtaagtaatgg

SEQ ID NO: 34948 - DNA, 201 bp, Homo sapiens
ttccttacctgtaaactgggaatggtatcatctaccctatatggggctgttgtgaacacatgtacaaaagcacctggtaaagtactacacagatgtcagtrtcatcccatcaaaatcactccgattatttttgttacctttagcctgcctcctcctgaacctcagcaatggctgggctgaatcagcttctatctagggaat

SEQ ID NO: 34949 - DNA, 201 bp, Homo sapiens
acagtggggttttcccttctctcaaggatctcagtcttacatgagtattagtcaaaacctgacatacataaaacagtggctttatatattttcacaagttwtatgcttgtttatagtaggaaatctaatctttgtcaattactccatcatgacctgagccttttttcttttctttttttctaaagaagagcaatttatttt

SEQ ID NO: 34950 - DNA, 201 bp, Homo sapiens
agaggcattagatttggaaatatggagtctactcctggttttcctggtggctctagtaaaaaatcacaatctctttttttttttttgagacggagtctcastctgttgcccaggctggagtgcagtggcgcgatctcggctcactgcaagctccgcctcccaggttcacgccactctcctgtctcagcctccctagtagct

SEQ ID NO: 34951 - DNA, 201 bp, Homo sapiens
agacataggagactccattttgttctgtactaagaaaaattcttctgccttgagattctgttaatctatgaccttacccccaaccccctgctctctgaaayacgtgctgtgtcaaactcagggttaaatggattaagggttgtgcaagatgtgctttgttaaacagatgcttgaaggcagcatgctcgttaagagtcatca

SEQ ID NO: 34952 - DNA, 201 bp, Homo sapiens
ctgacttcaaaattgttttggctattctgagtgctttgcattttatacagtatttatttacactatttatttatttatttagagatggagtttcattcttkttgcccaggctggagtgcaatggtgcaatatctcagcttactgcaacctccgcctcttaggttcaagcaagtctcctcccttggcctccagagtagctgg

SEQ ID NO: 34953 - DNA, 201 bp, Homo sapiens
ggctggagtgcagtggcgcgatctcggctcactgcaagctccgcctcccaggttcacgccactctcctgtctcagcctccctagtagctgggactacaggygcctgccaccacgcctggctaatttttttgtgtatttttagtagagacggggtttcaccgtgttagccaggatggtcttgatctcctgacctcgtgatcc

SEQ ID NO: 34954 - DNA, 201 bp, Homo sapiens
ggagtgcaatggcgtgatctcagctcaacgcaacctccgcctcccaggttcaagcgattctcctgcctcagcctcccgagtagctgggattacaggcatgygccaccagcctggctaattttgtatttttagtagagatggagtttctccatgttggtcatgtgggtctcaaactcccgacctcaggtgatctgcctgcgt

SEQ ID NO: 34955 - DNA, 201 bp, Homo sapiens
ctttctaggtccaatagcttctgttgaaactgttcgactcagccattgtagtgctagaacagccaggtgatgcgtaaacaaatgagagtaggtacagctakgttctaagaacctgggcaacgaaatttgattttcatttaattttcccaagccacaaaatattcttttgattttttttttaacttaaaaaaagtaaaaaca

SEQ ID NO: 34956 - DNA, 201 bp, Homo sapiens
aagtcgctgataaaaacttagagattatattcatcacaatgttatcaatctgggattaggctggaaactaaaaacgggtaaggttacttgagactgaaaasatatgcaggatcatatacatattaaaaagacaggcccagtgcggtgcctcaggctgtgagcagtggctcacacctgtaatcccagcactttgggaggccg

SEQ ID NO: 34957 - DNA, 201 bp, Homo sapiens
agtaaggcagacagagaaaaaatgaggaaatacatctttagttatttttaatgatccaaatattaaatcaaagtaatgcgttggggccgagtgcagtggcycacgtctgtaatcccagcaccttgggaggctgaatcaggcagatctctcgagctcaagagctcgagaccagcctgggcagcagcaaaaccccatctctac

SEQ ID NO: 34958 - DNA, 201 bp, Homo sapiens
ggcagacagagaaaaaatgaggaaatacatctttagttatttttaatgatccaaatattaaatcaaagtaatgcgttggggccgagtgcagtggctcacgyctgtaatcccagcaccttgggaggctgaatcaggcagatctctcgagctcaagagctcgagaccagcctgggcagcagcaaaaccccatctctacaaaaa

SEQ ID NO: 34959 - DNA, 201 bp, Homo sapiens; identical to SEQ ID NO: 7571

SEQ ID NO: 34960 - DNA, 201 bp, Homo sapiens
gggagagctaagtggtaatttttaattccttcaaattttccatgaattggactaatttaaattctggtcagagataacaaaggataatacaatttgatctrtgattatcttgtgataaatacttaatggaagttaaattatttttaaaaatcacagaaggtaactcaggttacaaaaatactttgcagagaatcagatatc

SEQ ID NO: 34961 - DNA, 201 bp, Homo sapiens
aaagattcatagaaaagaggtctaaacttgggtggaaaggctaaagttaaaccattctttgtcaacataaatatatgctgcatgatactggtaactgctastttggtttgttcttaggttaatacagtgacattctcacacatttttgccttagtgacatccattccatccaaaaggttaagggtgtgatctaaaagatcc

SEQ ID NO: 34962 - DNA, 201 bp, Homo sapiens
aatgctcttggttactcttctggtagggaaagactagagctaactacatgaataagctcacttaaggctaacaggaagacaaatttcataaaagggaatarggttatactcacagcttgctttatggctggaattggtcctattcccataatggaaggctccacacccacttgggaccaggaaactatccgtgctaaaggt

SEQ ID NO: 34963 - DNA, 201 bp, Homo sapiens
tcttcatttgtatgtctagttgggatgtcaagaaaccaaattaattctttcagtataggttaagtcaatgatcaaatacagagaaatgacatgtttccttmaactgttttaagaataattttgtacataaatattgagttgggtgtggtggctcatgcctgtagtcccccagctacttgggaggttaaggcagggggctca

SEQ ID NO: 34964 - DNA, 201 bp, Homo sapiens
cttttttagggtgaaaaggtaataaaaagcatgtctaaaagtgatatgaattgcagatagtgataatgttgtaacattttggtgacaagtaatgcttgctkctttaatagattagattactaaaaggaagtcccttgaaattacccttgatttttcacgtgtgtaccctttgtccattccaaacctgttactgtccttaac

SEQ ID NO: 34965 - DNA, 201 bp, Homo sapiens
ctgaggaaagtagctaccagggacctgtttgtgccaaattctgctatagtttgggtcatagtacttggctggttacgagtgagtggatcaggcagtctcaragccaatcgtgcactgctggcaggacataagagatatcagttatcaataagggagcttgacgggagcattctgtattagaaaatagcgagtgaccccaaa

SEQ ID NO: 34966 - DNA, 201 bp, Homo sapiens
tagctgggactataggcacctgccactgcaccctgtaaaagctattctcttatatatacttctagaagctttacattttttgcttttatttttaaatccaygatttatctcaaattagcttttatatagggtgtgaggtagggatctaggttcatctttcccatgtgagtaatctgttattccagcaccatttgttgaaaa

SEQ ID NO: 34967 - DNA, 201 bp, Homo sapiens
aatgatccaaatattaaatcaaagtaatgcgttggggccgagtgcagtggctcacgtctgtaatcccagcaccttgggaggctgaatcaggcagatctctygagctcaagagctcgagaccagcctgggcagcagcaaaaccccatctctacaaaaaataccagaaaaaaaaaaaaagaaaaagaaaaaaattagccggcc

SEQ ID NO: 34968 - DNA, 201 bp, Homo sapiens
attatccccattccactttccactatgaaacttaagacttttgatgacagggataacatctactttatctttgtaactcctgcctctaacgcaatgcctakcaagtgatacaggtatgatgcttgttcaataaataaataatacatcacacagtaatgatttccaatttactcttacaactttacatagtacttaagaagt

SEQ ID NO: 34969 - DNA, 201 bp, Homo sapiens
gatcctgtaaaatgggggaaattataactgcttcatgatgtaattttaaggattaaatgagaaaaaacatataaagcaagtagcataattcctggcaaatrtaagtgttcattaaacaaccacctttataacaaagtatctcaagtcatactagactcctaactggtctttcttcaagtcctgctccctcaaaaatttaat

SEQ ID NO: 34970 - DNA, 201 bp, Homo sapiens
gcagctaaaatgatttttttttttttgagacagaattttgctctgtcgcccaggcgctcagctcactgcaacctccgcctcctgggttcaagtgattctcrtgcctcagccactggagtagctgggattacaggcgtgcaccaccacgcccctctaatttttatatttttagtagagacggggtttcaccatgttggccag

SEQ ID NO: 34971 - DNA, 201 bp, Homo sapiens
cgtgcaccaccacgcccctctaatttttatatttttagtagagacggggtttcaccatgttggccaggttggtctcaaactcctgacctcagatgatccgscttcttcggctggctccctaaagtgctgggattacaggcatgagacaatgcgcccagccagaatgatcttgaaaaaccaattcgggctcaagctttaaat

SEQ ID NO: 34972 - DNA, 201 bp, Homo sapiens
ctcaacacttggggagcctaaggcaagaggatcaattgaactcaggagttcaaaaccagcctgggcgacatagaccttgtctctacgaaatgaagaaggcktggtgcacctgtagttcgaggtaatgggaggctaaggcaggaggaatatttgagcctaggagttttgaggctgcagtgagctatgatggtgccactgcac

SEQ ID NO: 34973 - DNA, 201 bp, Homo sapiens
cgggaaagcgggcctcccgggctcgcacgtgcgggccacgcctcgcacccccttttgtttcagggcgaccccctgagtgtccatgttaaacgccaggtttyattttaggaccatttaccagaaaaagagtaggtccatccgcgcgccctcggatgagcccggtgccctgtccgcccgcagctgcagtcgaggtcgggcgtc

SEQ ID NO: 34974 - DNA, 201 bp, Homo sapiens; identical to SEQ ID NO: 7565

SEQ ID NO: 34975 - DNA, 201 bp, Homo sapiens
tgtgagaaattaataaatacatcatgatatgacagtgtgatcttaccgagtcagtaaatgtgatacacagtataaactcttcatagatcatccagcatgcyggtatagtagaaacactattgtttggtgagaaagatgttaattctggagaaactagatagtttgtggggaaaatgtatttctagattaaactttagccat

SEQ ID NO: 34976 - DNA, 201 bp, Homo sapiens
gtttctctccctgttgtccctgcctctttttccttcccgccgtgccccgcggccgggccggggcagccgggaagcgggtggggtggtgtgttacccagtakctcctgggacatcgctcgggtacgctccacgccgtcgcagccactgctgtggtcgccggtcggccgaggggccgcgatactggttgcccgcggtgtaagc

SEQ ID NO: 34977 - DNA, 201 bp, Homo sapiens
agttttccttccataagaagctgacagtctttttgctttaaaaatatttcttagtgttttatcaacttgaagaactatcttttttaaataaaataatagcytaatataggtcatatgaatagtcacactcggtttagcttctgttgagcattttttctaaaggtaatagatgtgttgtcttttacggttgtattgatgaac

SEQ ID NO: 34978 - DNA, 201 bp, Homo sapiens
gcctgcagtcccagatgctcaggaagctgagatgggagaatcgtttgagcctgggaggcagaggttgcagccagctgatactgtaccactgcactccagcytgggtgatagagccagagcttgtctcaaacaaaacaaaacaaattagctgggagtaatggcatgcgcctctagtcccagccactcaggaggctgaggtgg

SEQ ID NO: 34979 - DNA, 201 bp, Homo sapiens
gcacgcgtgcgtagtagcagcagtatcaattttgtgcaataaaattttgaataaccaattttatgcaaattgatatcaatagagaggagtaatgctgtatkgaaattacctgttgccttccctgcttttttagggtgaaaaggtaataaaaagcatgtctaaaagtgatatgaattgcagatagtgataatgttgtaacat

SEQ ID NO: 34980 - DNA, 201 bp, Homo sapiens
tgtgcgcatgtgttgcgcgcacgcgtgcgtagtagcagcagtatcaattttgtgcaataaaattttgaataaccaattttatgcaaattgatatcaatagrgaggagtaatgctgtattgaaattacctgttgccttccctgcttttttagggtgaaaaggtaataaaaagcatgtctaaaagtgatatgaattgcagata

SEQ ID NO: 34981 - DNA, 201 bp, Homo sapiens
accgagaacccccaaaactgcgaccgaagcgccatcgctgagacgatctcggaaaagcctcgcctctttttcctcacggacgactcagtcgctcgccaggmgcagccatataaagtcagggacaagcctttggctgctgtagatccccaaactctccacgccagacgccgccgacccggaagtagcaagtcccctgccact

SEQ ID NO: 34982 - DNA, 201 bp, Homo sapiens
ggcaagactaattaccagggttcctgcaaaccgagaacccccaaaactgcgaccgaagcgccatcgctgagacgatctcggaaaagcctcgcctctttttyctcacggacgactcagtcgctcgccaggcgcagccatataaagtcagggacaagcctttggctgctgtagatccccaaactctccacgccagacgccgcc

SEQ ID NO: 34983 - DNA, 201 bp, Homo sapiens
cctgtttgtgccaaattctgctatagtttgggtcatagtacttggctggttacgagtgagtggatcaggcagtctcaaagccaatcgtgcactgctggcakgacataagagatatcagttatcaataagggagcttgacgggagcattctgtattagaaaatagcgagtgaccccaaaagatccaccctttagaaatgtga

SEQ ID NO: 34984 - DNA, 201 bp, Homo sapiens
ctggaaccaagagtgcttgagtgctgacataggtcccatgttaccgtgtcctgtaaacccagcataccccctccccacattcatgtatccaggacatatayttgcaacctgaaaaacataactaagatataatttctaaagattcctatgtattactcttttagatgttactcttacctataaataggttgatgtttaaac

SEQ ID NO: 34985 - DNA, 201 bp, Homo sapiens
tccagcttctcatgaaacctgctgtgtgtgcacagtggtcatggacgctctggaaccaagagtgcttgagtgctgacataggtcccatgttaccgtgtccygtaaacccagcataccccctccccacattcatgtatccaggacatatatttgcaacctgaaaaacataactaagatataatttctaaagattcctatgta

SEQ ID NO: 34986 - DNA, 201 bp, Homo sapiens
atacttacttcacttcagttaatcaaagaagagatataaaaatccttaagacagtctctggccataaggacgaaagcacctaagaagcagattagtatatkgtctttttaacctttttaaagctaatacagtttcagccatgtctgccttacctgtaatacccatatgacagttgtgaaatgcatctgtaagaccatcaca

SEQ ID NO: 34987 - DNA, 201 bp, Homo sapiens
ttagcatttaagtagtaatatttgaagttaaaaacttggaccagtatcttttttctcatttgactaccacattttctcctaataatagattttagtggctrtgcttatgggatagattaaacttgccatgatctgaagagggagggttttttcatgtcctcctcctatatgaaatggctgaacgggtattattacttacga

SEQ ID NO: 34988 - DNA, 201 bp, Homo sapiens
tagattttagtggctatgcttatgggatagattaaacttgccatgatctgaagagggagggttttttcatgtcctcctcctatatgaaatggctgaacggrtattattacttacgacattttggctctgtgttaagcatgatgaatgcaaagagtttgagtagtgactttataagcgtttttctcccccacacttttaaac

SEQ ID NO: 34989 - DNA, 201 bp, Homo sapiens
acagcgagaccctgtctcaaaaaaaaaaaaaaaaaaaaaatagtttaaacagtagttaaaccagacctacaagaaagctttgccaagagtaagaaatgtgytgtcatcttttaaatcagtctgcacgggtattcttttttccttccttcctcatacaacaaagtgtcctttcttccatcaaagccagtccctctacagtaa

SEQ ID NO: 34990 - DNA, 201 bp, Homo sapiens
aaaaaaaaaatagtttaaacagtagttaaaccagacctacaagaaagctttgccaagagtaagaaatgtgctgtcatcttttaaatcagtctgcacgggtrttcttttttccttccttcctcatacaacaaagtgtcctttcttccatcaaagccagtccctctacagtaagtgttctagagtctgtttccttctgctcta

SEQ ID NO: 34991 - DNA, 201 bp, Homo sapiens
ttcctcacggacgactcagtcgctcgccaggcgcagccatataaagtcagggacaagcctttggctgctgtagatccccaaactctccacgccagacgccrccgacccggaagtagcaagtcccctgccactgagtggccaagaaggcgatctgttatcctgcaccgccaatcatcgctcacgtcgaggggcacgcaggcc

SEQ ID NO: 34992 - DNA, 201 bp, Homo sapiens
ataaagtcagggacaagcctttggctgctgtagatccccaaactctccacgccagacgccgccgacccggaagtagcaagtcccctgccactgagtggccragaaggcgatctgttatcctgcaccgccaatcatcgctcacgtcgaggggcacgcaggccctggagcccaccaaccacctcgtagctacgcccaagacca

SEQ ID NO: 34993 - DNA, 201 bp, Homo sapiens
gcaaccctttgattatgtccttcttgaaatgctttcggggatggaaggctttgtgatgctgctttgtctggaccatgtcataatactctccaggatagccyctttgttcccatgacttcatgtattatctctctatgccagagactctttcagctgtttctctaagctccaaacacacatacctctatctagtagaatgct

SEQ ID NO: 34994 - DNA, 201 bp, Homo sapiens
tggctgctgtagatccccaaactctccacgccagacgccgccgacccggaagtagcaagtcccctgccactgagtggccaagaaggcgatctgttatcctkcaccgccaatcatcgctcacgtcgaggggcacgcaggccctggagcccaccaaccacctcgtagctacgcccaagaccacgcttgttgcttaagtccggg

SEQ ID NO: 34995 - DNA, 201 bp, Homo sapiens
tttgaaaacacagatgatatactagtcttgcttagagatattaagcttagtatctagattgtttggtgtaacctgcaaggtttttcacttttctggttctrccttcttttgtgctttcaactctggactcctgtttttgtttgtttgtttgtttttgagacggagttttgctcttgttgcccaggctggagtgcagtggca

SEQ ID NO: 34996 - DNA, 201 bp, Homo sapiens
cggtctcggctcactgcgacctccgccttccgggtttaagtgatactcctgcctcagtctcctgagtatctgggattacaggcgcccaccaccaggcccarctaattttttgtatttttagtagaggcggtttcaccgtgttggccaggttggtctcgaactcctgacctcaggtgatctgcccgcctcagcctcccaaag

SEQ ID NO: 34997 - DNA, 201 bp, Homo sapiens
tgccttagtgacatccattccatccaaaaggttaagggtgtgatctaaaagatcccttagaaattctaaattgtcttaaaattttgaaccagtagcatctsttatgtgtacctaaggctaatgtaacagaatcagttcccctagaaagcatgtgatccaaatgctctcagtggctgggggtagtggctcacacctgaaatc

SEQ ID NO: 34998 - DNA, 201 bp, Homo sapiens
tgggccgcctgtagtcccagctactcgggaggctgaggcaggagaatggcgtgaaaccgggagacggagcttgcagtgagccgagatcacgccactgcacyccagcctgggccacagagagagactccgtctcaaaaaaaaaaaaaaaaaaaaaaaaaaaaggaaaagaaaaggcagtgtaggtggtgtaggtcagtggtc

SEQ ID NO: 34999 - DNA, 201 bp, Homo sapiens
gaaccaaactggggcaccaatcagggggcactgtgatctttagacttcccagcctccaaaaacagtgaggaatgcgcgtgtaaagccacccagtctgtggttttttttttttttcacagcagcccaagctaagacagcagtgagtgctcttacaggggagaaaaacaaaacaaaatatcgagcctcgaggatacatttgcc

SEQ ID NO: 35000 - DNA, 201 bp, Homo sapiens; identical to SEQ ID NO: 34922

SEQ ID NO: 35001 - DNA, 201 bp, Homo sapiens; identical to SEQ ID NO: 34924

SEQ ID NO: 35002 - DNA, 201 bp, Homo sapiens
ctcttacaggggagaaaaacaaaacaaaatatcgagcctcgaggatacatttgcccaaatcagttaagtgtaataccaggattcaaaccaattagatgcaraagccactctatcacctctcttatcacaggcataccagaaaataaagcatccaattccagaaatgagaaatactgactctgtgtaccacagaataagtgc

SEQ ID NO: 35003 - DNA, 201 bp, Homo sapiens; identical to SEQ ID NO: 34852

SEQ ID NO: 35004 - DNA, 201 bp, Homo sapiens
gcctgaagtgggaggatcacttgagtcgaggactttgaggctgcagtgagccatgactgcaccactgcacttgagcctaagtgacaaagcaagaccctgtytcaattaaaaaaaaaaaaaaaaaaaaaaagcctaagaaatagatgactattttctttatacttttctgtattttaaaatattttgtaacaattataagtc

SEQ ID NO: 35005 - DNA, 201 bp, Homo sapiens
gtgggaggatcacttgagtcgaggactttgaggctgcagtgagccatgactgcaccactgcacttgagcctaagtgacaaagcaagaccctgtctcaattaaaaaaaaaaaaaaaaaaaaaaagcctaagaaatagatgactattttctttatacttttctgtattttaaaatattttgtaacaattataagtcaagaaaa

SEQ ID NO: 35006 - DNA, 201 bp, Homo sapiens
cgaccccagcccaaagccgggctcagaccacctagcagttccgcccctgccgcaggcattaccgatggcgcctcccggagccggccaatcaggggccccgsaggagaacacctccctacgccaaccaatgggagaggcaggccacgcgatggctctaccccgggagccaatccaagcacgagggacggagtacgcacatcg

SEQ ID NO: 35007 - DNA, 201 bp, Homo sapiens
cacctagcagttccgcccctgccgcaggcattaccgatggcgcctcccggagccggccaatcaggggccccggaggagaacacctccctacgccaaccaaygggagaggcaggccacgcgatggctctaccccgggagccaatccaagcacgagggacggagtacgcacatcgggagaggagagggtggggctgtagcacc

SEQ ID NO: 35008 - DNA, 201 bp, Homo sapiens
aaccggcgggtcaagggcgttgaaaaccatgcggcacgaaggagacgaagtcacgacttctagccattgtgtgacagcccgaccccagcccaaagccgggctcagaccacctagcagttccgcccctgccgcaggcattaccgatggcgcctcccggagccggccaatcaggggccccggaggagaacacctccctacgcc

SEQ ID NO: 35009 - DNA, 201 bp, Homo sapiens
aggggcgggcggaggcgcgcggggcgcggggcgcggggcgcggggcggaagtgaggccggggcgcggggcgcggggcggaagtgaggccggggtctgggcytgcgggcagaaccgcggacctcggacgcatttacagagcgcctgaaaccccagtgtttctggacaccccaatgttggagttccccgacttgacgtcttgg

SEQ ID NO: 35010 - DNA, 201 bp, Homo sapiens
gggcttgcgggcagaaccgcggacctcggacgcatttacagagcgcctgaaaccccagtgtttctggacaccccaatgttggagttccccgacttgacgtyttgggcttttttttaaaaaatcttagggtttctcgaaacagtaaagactggggggtgacaaagacttatctctcgttcagctcaggactggaatcccacg

SEQ ID NO: 35011 - DNA, 201 bp, Homo sapiens
atagtggtgaaatcagctgtctactctgctaagaactcagcagcacactgaagtctcttcagttgtcttcaatgtgtttcctgtcccctaacatatctgartccaaggaattcaaggaatgcctcccgtggcttttgctctattctatcccattttccccttactccctggccacttctgagtctttgtgggcttactctc

SEQ ID NO: 35012 - DNA, 201 bp, Homo sapiens; identical to SEQ ID NO: 34944

SEQ ID NO: 35013 - DNA, 201 bp, Homo sapiens
ggggccccggaggagaacacctccctacgccaaccaatgggagaggcaggccacgcgatggctctaccccgggagccaatccaagcacgagggacggagtrcgcacatcgggagaggagagggtggggctgtagcaccaggtcagggaacgcgggagccgcagggttccagggatcccgcggctcctcgcggcttggcctg

SEQ ID NO: 35014 - DNA, 201 bp, Homo sapiens
aggtcagcagtttgacaccagcctggccaacatggtgatatcccgtttctaccataaaatagaaaaattagccgggcgtggtgccgtgcgcctgtaatccyagctactggggaggctgacatgggaaaatcgcttgaacctaggaggcagaggtttcagtgagccgagatcacaccactgcactccagcctgagcgacaga

SEQ ID NO: 35015 - DNA, 201 bp, Homo sapiens
tgcggcacgaaggagacgaagtcacgacttctagccattgtgtgacagcccgaccccagcccaaagccgggctcagaccacctagcagttccgcccctgcygcaggcattaccgatggcgcctcccggagccggccaatcaggggccccggaggagaacacctccctacgccaaccaatgggagaggcaggccacgcgatg

SEQ ID NO: 35016 - DNA, 201 bp, Homo sapiens
agactgtagaaaaggttaatcaaggttgggcgcggtggctcacacctgtaatcccagcactttgggaggccgaggtgggtggatcacaaggtcaggagttygagaccagcctggccaacacagtgaaacctcatctcttctaaaaatacaaaaataagccgggcatggtggcgcacgcctgtaatcccagctactcaggag

SEQ ID NO: 35017 - DNA, 201 bp, Homo sapiens
gggtggatcacaaggtcaggagttcgagaccagcctggccaacacagtgaaacctcatctcttctaaaaatacaaaaataagccgggcatggtggcgcacrcctgtaatcccagctactcaggagtctgaggcaggagaattacttgaatccgggaggtggaggttgcagtgagccacgatggtgccactgcactccagcc

SEQ ID NO: 35018 - DNA, 201 bp, Homo sapiens
ctgaggcaggagaattacttgaatccgggaggtggaggttgcagtgagccacgatggtgccactgcactccagcctgggtggcagagcgagactctcggcaaaaaaaaaaaagagaaaaagaaaaaaaagaaaaggttaatcaagagacagtgcagtatttaacatactgctgaagaccggatatacctgtatcagctaaa

SEQ ID NO: 35019 - DNA, 201 bp, Homo sapiens
tcctacctacattctaacaccccttactcatataatattaccagatatgttgttagtaaaaatcagtagtgctggccagcgttttaaaacaaacatcactractacaaagatactctacttgaaatcaggtcacaaaaaaccaacgctgcttttcaattaaaactcaaaaagggccaggagctgtagctcactcctgcaat

SEQ ID NO: 35020 - DNA, 201 bp, Homo sapiens; identical to SEQ ID NO: 34905

SEQ ID NO: 35021 - DNA, 201 bp, Homo sapiens
aactcatataaaaataacttgaccctacacaaaatgtccttttagcaacattcaaagtaattaactgttacaatttccaaagcggcagaagtattgaagcaaaaaaaaaaaaaaaaaaaaaaaaagaaaagaaaaaaaaaacaaagaaaaaaaacaacaaaaaaaaaccaaaacgtacacccacaaaaaggcaaattgtga

SEQ ID NO: 35022 - DNA, 201 bp, Homo sapiens
aaaactgttgacggacctggagaatcttcctgaagaactttaaagttgattgaaagaatcattaaatcctggaaacctacattaagactttgcagagataygcggatgggtcagataaatcagagaaggtaaagagtgtaggccccagaggtggggcaatagagaaggaaaaaaattgcataacagtgcaatttcaggaga

SEQ ID NO: 35023 - DNA, 201 bp, Homo sapiens
tccaaggaattcaaggaatgcctcccgtggcttttgctctattctatcccattttccccttactccctggccacttctgagtctttgtgggcttactctcwcatccccttaacatgttccccaaggctcctactttgcaccagctccctgggtaataccagtcattcctacggcatcaatcaccacctgtatactgacaag

SEQ ID NO: 35024 - DNA, 201 bp, Homo sapiens; identical to SEQ ID NO: 34874

SEQ ID NO: 35025 - DNA, 201 bp, Homo sapiens
tatgttgttagtaaaaatcagtagtgctggccagcgttttaaaacaaacatcactgactacaaagatactctacttgaaatcaggtcacaaaaaaccaacsctgcttttcaattaaaactcaaaaagggccaggagctgtagctcactcctgcaatcccaacacgttgggaagccaaggcagaaggatcccttggggccag

SEQ ID NO: 35026 - DNA, 201 bp, Homo sapiens
aatttacctctgaaactccccctaaacatcacttcttccagaaaaaccttccaatctcctgcatttggtgcagcatcttacccctaacttcctctttcaayttaccatgtaattcctagtttatctgtctcctctactgactacataagctttccaagatgatcctgttacactgctttatgcacagctcctagcacatta

SEQ ID NO: 35027 - DNA, 201 bp, Homo sapiens
caaacttggcagtcataaacccacatctactctaacaagtctgaatggtgcataagtacagtaacagcatgagtacgaatgcccttacacagcacagattytaaacagacagatttatacagacatcattgtgttgtattttaaggaaaaatttccatttacaatttcacattaactcatataaaaataacttgaccctac

SEQ ID NO: 35028 - DNA, 201 bp, Homo sapiens
tgggaggatcacttgagtcgaggactttgaggctgcagtgagccatgactgcaccactgcacttgagcctaagtgacaaagcaagaccctgtctcaattaaaaaaaaaaaaaaaaaaaaaaagcctaagaaatagatgactattttctttatacttttctgtattttaaaatattttgtaacaattataagtcaagaaaaa

SEQ ID NO: 35029 - DNA, 201 bp, Homo sapiens; identical to SEQ ID NO: 34948

SEQ ID NO: 35030 - DNA, 201 bp, Homo sapiens
aagccaggtctttgctacaggctggattcaccaacctaccatgcagcaaattcctccttggtctccatgaggggaacagtgaatcaccaaagtggaattgycataggatgaaggtcagcagtgtactccttaccactaggggctagctcaacactccctcagcacagccaccccatgatgggtccagatcagttaatgaca

SEQ ID NO: 35031 - DNA, 201 bp, Homo sapiens; identical to SEQ ID NO: 34956

SEQ ID NO: 35032 - DNA, 201 bp, Homo sapiens
aatcaggggccccggaggagaacacctccctacgccaaccaatgggagaggcaggccacgcgatggctctaccccgggagccaatccaagcacgagggacsgagtacgcacatcgggagaggagagggtggggctgtagcaccaggtcagggaacgcgggagccgcagggttccagggatcccgcggctcctcgcggcttg

SEQ ID NO: 35033 - DNA, 201 bp, Homo sapiens
attctatcccattttccccttactccctggccacttctgagtctttgtgggcttactctcacatccccttaacatgttccccaaggctcctactttgcacsagctccctgggtaataccagtcattcctacggcatcaatcaccacctgtatactgacaagtctgaaatccttacatctaacctcgtctcctaagctgact

SEQ ID NO: 35034 - DNA, 201 bp, Homo sapiens
ggattttttactcacttgagcagactgtagaaaaggttaatcaaggttgggcgcggtggctcacacctgtaatcccagcactttgggaggccgaggtgggyggatcacaaggtcaggagttcgagaccagcctggccaacacagtgaaacctcatctcttctaaaaatacaaaaataagccgggcatggtggcgcacgcct

SEQ ID NO: 35035 - DNA, 201 bp, Homo sapiens
cacagggataggtgaactcccaagacagtgacgtagagcagcaggcaatgatttgagtacagggcataactactcatgaaagagggaacatctgagaaagwaagttgtcagaaggaatggctttacattgttttgcaaaagtgtctcaaaaactggagtagtcagttgtatccaatacacctgaggagccaaggaaactga

SEQ ID NO: 35036 - DNA, 201 bp, Homo sapiens
actactacaggactccatcaatgagtccaacttttagtgataaaaaactactgtactgggcaaacttggcagtcataaacccacatctactctaacaagtytgaatggtgcataagtacagtaacagcatgagtacgaatgcccttacacagcacagattctaaacagacagatttatacagacatcattgtgttgtattt

SEQ ID NO: 35037 - DNA, 201 bp, Homo sapiens; identical to SEQ ID NO: 34881

SEQ ID NO: 35038 - DNA, 201 bp, Homo sapiens; identical to SEQ ID NO: 34883

SEQ ID NO: 35039 - DNA, 201 bp, Homo sapiens; identical to SEQ ID NO: 34885

SEQ ID NO: 35040 - DNA, 201 bp, Homo sapiens
cagaccacctagcagttccgcccctgccgcaggcattaccgatggcgcctcccggagccggccaatcaggggccccggaggagaacacctccctacgccamccaatgggagaggcaggccacgcgatggctctaccccgggagccaatccaagcacgagggacggagtacgcacatcgggagaggagagggtggggctgta

SEQ ID NO: 35041 - DNA, 201 bp, Homo sapiens
atggctctaccccgggagccaatccaagcacgagggacggagtacgcacatcgggagaggagagggtggggctgtagcaccaggtcagggaacgcgggagscgcagggttccagggatcccgcggctcctcgcggcttggcctgaccggcttcctccacatacgcccctctcctacacaagtccggccctcggcgctcctg

SEQ ID NO: 35042 - DNA, 201 bp, Homo sapiens
ctcgaaacagtaaagactggggggtgacaaagacttatctctcgttcagctcaggactggaatcccacgggcgagaatctcgagtgcgagcccggcccgcrgcgggtctcagcacagctctgatgggtccttttgctctcggcggcttcgggaggtcctatgcgtttctcctggcgccagtcattcgctcgcgtgaggggc

SEQ ID NO: 35043 - DNA, 201 bp, Homo sapiens; identical to SEQ ID NO: 34998

SEQ ID NO: 35044 - DNA, 201 bp, Homo sapiens
tttccatcttaaattactcagcagtgactgagagctacctgcatggaagcaggaagttactccagtgttataaacaaacttcttagactcaacatcctatyctccatccctttttttttcctgtagagtccaaaaacctcaaccgtctcatttttaaattatccaattggagttacctttttaaaaaagttattcttaagg

SEQ ID NO: 35045 - DNA, 201 bp, Homo sapiens
ccacctcccacctcaccatccagcagccctcagtacctcagcctgtgtcctgtggaaaacactcgggaagtgagcactgtgcccatgttgcctccaccgcrtgcccctgcctggaaggatctgtgtgtgtgtggtcagggtggaaggcacctgcttcccctggacaccctgcgccatgccctggagacatcatctgtccat

SEQ ID NO: 35046 - DNA, 201 bp, Homo sapiens
accgtgaacatctctctttctccaaatctctcaatgaggaggcagttgatgagttaactgcatgggctttggtcccagatcatacagctcacatccaagcrctgtcacttaccaactgcatgaccttgggcaaggtatataatttctttatgactgaattgctcatcttttcaaggagggtaataaaattacctatttggt

SEQ ID NO: 35047 - DNA, 201 bp, Homo sapiens
gctggatttgtgctgccttccttgctgtaggaagcccacgcttgggaaataacattcccacagaaggtctgagaggctctgacgggccaaggttgtaaacscccatgatttgactccacgggcagttaaagtgtgttcccaccccccacggatccgctgccactaggctgtgcgaaggcatttacctccctggcactttga

SEQ ID NO: 35048 - DNA, 201 bp, Homo sapiens
cccgcagttaacagcatatagaaacttgctgtaatttaaaaacatagaacacaagtatagaaatgacattcagctttgactgctgatgcataaaagtgtcwtaacttttgtttttactttaacaattactgattttattctaactgggaagtcagaaagacatttgggcagctatagtcactcaggacatagcccagaagt

SEQ ID NO: 35049 - DNA, 201 bp, Homo sapiens
gtattgctatgtcacccagccaggctggcctcaggctcctggccttaagtgatcctcctgaagttctgggattacaggcatgagccacagtgcctggcttrctagcatgttttaatagaaatttggatctttaaaaattgtctccatgagttatattcatattttgtcaaatccttggtatgttttaatatttgaatgtat

SEQ ID NO: 35050 - DNA, 201 bp, Homo sapiens
cccacatgcacacacacgtgcatgcacacacacattcatcacatacacagttcctggccattcacctttatttactttttaaaaataaaaaaagagttttktgttttttttctcataatactcagactggtcttttatttatttgtttattcactcaaaaatatctcttgggcagccgctgtgtgccaggtgctgtgctaa

SEQ ID NO: 35051 - DNA, 201 bp, Homo sapiens
aggtgatggattaggatctgttgggtgtcttgtaattctgataaagacatccttctgatgtttgggcctggagcaggtttgtaaagggactgttagacatrggtgtgctgacagtgacagaaagtgacctggcagccgcctgaccagtgagagagacagtatttgagaaggaggaggaaacagtcctgctgtttggggcta

SEQ ID NO: 35052 - DNA, 201 bp, Homo sapiens
tgatgataagtaacctcatgaggcgggtagtgggaccctttgtatcagacagagggcaggtggggcagcccggagacatgaatgtaaggtatccatggggrcagggccagctcctgggtggctgaaatctacagggatttaattcctccaacctggttgaagatgatcaaggcagttgtttgctgattgtggcagctttgg

SEQ ID NO: 35053 - DNA, 201 bp, Homo sapiens
gggaggctgaggcaggaggatggtgtgtacccgggaggcggagcttgcagtgagccgagatcatgccacttcactccagcctgggtgacagagtgagactyggtctcaaaaaaaaaaaaaagaaaaattactaattttcataaatgtccagtatcgggggaaccagcccccgatttttcaacgtaggttcttttctatttc

SEQ ID NO: 35054 - DNA, 201 bp, Homo sapiens
gtgctgtgctaagcaatgaaaatgaacagtgaacacctcctgtcccctctcccaaggacatagccagtggttactgctgggccacgtcagtgggcagtccyggggcagcactgggcagtgagggtggcaggtcagcatggaggttccggccttcccctgtcaggtggtgggaggaccgtgtagcatccttagaggtttttc

SEQ ID NO: 35055 - DNA, 201 bp, Homo sapiens; identical to SEQ ID NO: 7619

SEQ ID NO: 35056 - DNA, 201 bp, Homo sapiens
gggggcgctgcaggaggccagggcgtgtttcatcccttatctgcaactgcataaggcagacacccctagagtggccatttaagaggcgcccctgccttccycccgggaatgcattcttttcccagggctgttaattattaaaattccttactggggaaagaattcagcgatatttctcttacccgttttcggtaataagag

SEQ ID NO: 35057 - DNA, 201 bp, Homo sapiens
aagttgtctgccctccaaagaagttggagtgcaaattcgtccagaaacacaaaacctacgacctgcggctgctctcctctctcaccgggtcctggtccctsgtccacaacggagtctcgtgagtgccttcccagtccacccgcggcgccacaccctcagcatgtgaacttcagactgcttgacgatggttggctcttttgg

SEQ ID NO: 35058 - DNA, 201 bp, Homo sapiens
cccacaaagttccacatttaacttcctccaaggaaggggattaaaattttcaactaactcccttcagttgaaatctcggaccacttttaaaacaaaaaccwtggtctaattctttactttgttatgaatttcttgacagtggattgagcgatacgtgtcagaactaagcatttcactgtaggcaaattgtgtcttagttat

SEQ ID NO: 35059 - DNA, 201 bp, Homo sapiens; identical to SEQ ID NO: 7624

SEQ ID NO: 35060 - DNA, 201 bp, Homo sapiens; identical to SEQ ID NO: 7625

SEQ ID NO: 35061 - DNA, 201 bp, Homo sapiens; identical to SEQ ID NO: 7626

SEQ ID NO: 35062 - DNA, 201 bp, Homo sapiens
tttttttccctcaagtttctctcgtggttacaactgatttccttgaagtatttaataattaggttgtttccactgtttttggctgttctttaaaaaaaaaacaaaacacacacacacacagtagtgaagatagttgtgcatgtagcatttggatgatttctttcaggtaaatttgcagaaaagaggcattatctggatcaa

SEQ ID NO: 35063 - DNA, 201 bp, Homo sapiens
gaataaaattttgattttctttgcacataaagcatttttcctagagatatgtgtatgtgtgtgtgtgtgtgtgtgtgtgtgtgtgtgtatatatatatatrtatatatatatatatatgtattttttttgagatggaatctcgctctgtcacccaggctgaagtgcagtggcgtgatcttgtctcactgcaacctcctcct

SEQ ID NO: 35064 - DNA, 201 bp, Homo sapiens
ctgacttcttagcggtgacctgcaggccacctccatttggagagcaccattttgcaagtccagcctcgcctggcgggaagagctcatgctttctcctgggrctggcatttggcatcctgagcacctgctgaccggaacgagaaataatctggtgtctgacaccaaatgagctcttaatctttggcgccaacaagacagcat

SEQ ID NO: 35065 - DNA, 201 bp, Homo sapiens
gagaggctcccatgtaccagggtagccttgcaagctgctgctcctacacatgcctcagccatcaggttattcactagttcccaaagtcaccctgtaacctrgtgggtttacatatgctgctcttggtgctggaatgccttggcccaccttcctcatccttccaaacctacttctagtgcccctcctgggaaggcccacctt

SEQ ID NO: 35066 - DNA, 201 bp, Homo sapiens
ctggcacagtgatggggtctcaggcctccaccttactgcacgatgaagagtttgaggagatcaagaaggagactggcttttcccacagtcaaatcacacgyctgtacagccggttcagcaacctggacaaaggagagaacaggacgatttccaggggattccagaacttgccatcaacccagtgggggactggatcatcaa

SEQ ID NO: 35067 - DNA, 201 bp, Homo sapiens
tagaagcggaccccacatagtcagtgccccgctccgttgcttgtcagcatcctgccactgatttttggtccatggctgcgtcacctcccaccacccccagyagcagtgccattgtttcctttgtgtgtaccatgccccgaatagggtccagtcagggcaccccagctctgtccctctaccctgttcccattgctgcctccc

SEQ ID NO: 35068 - DNA, 201 bp, Homo sapiens
ttccaaaaaaaaaaaatctgtgtgtttgcaactaagttatcttcctatgtgtaactttttgggacttaagtgataacagtaatattactaaaaatcaaccrtattgttgtttttcactgtggtttattccttctgactgctgtgatattttgtgtggatctgctgaagttaatttatccactcttctgttgatgggccttt

SEQ ID NO: 35069 - DNA, 201 bp, Homo sapiens; identical to SEQ ID NO: 7658

SEQ ID NO: 35070 - DNA, 201 bp, Homo sapiens
tgcaactttatgtgaaatgatgtataatgaaaccagttttttttcctcagctttatgttatgttatgttatgttatgttatgttatgttatgttatgttadttttttgagacagagtctcgctctcgcccaggctggagtgcagtggcgcgatctcggctcactgcaagctctgcctcccaggttcacgccattctcctgc

SEQ ID NO: 35071 - DNA, 201 bp, Homo sapiens
aggaataaaattttgattttctttgcacataaagcatttttcctagagatatgtgtatgtgtgtgtgtgtgtgtgtgtgtgtgtgtgtgtatatatatatrtatatatatatatatatatgtattttttttgagatggaatctcgctctgtcacccaggctgaagtgcagtggcgtgatcttgtctcactgcaacctcctc

SEQ ID NO: 35072 - DNA, 201 bp, Homo sapiens
tatactttgccacgaataacatgttgtcagttgctttcctcttggatttattttcttcttatgttacccccacccatcattgtatttatatttatttttaytttttatttttttgggatggactcttgctctgtcactcaggctggagtgcagtggtgcggtcttggctcgttgcaacctctgcctcctggttcagacgat

SEQ ID NO: 35073 - DNA, 201 bp, Homo sapiens
tatacaaggaataaaattttgattttctttgcacataaagcatttttcctagagatatgtgtatgtgtgtgtgtgtgtgtgtgtgtgtgtgtgtgtatatrtatatatatatatatatatatatatgtattttttttgagatggaatctcgctctgtcacccaggctgaagtgcagtggcgtgatcttgtctcactgcaac

SEQ ID NO: 35074 - DNA, 201 bp, Homo sapiens
tgtgtcccacagccgttttatactttgccacgaataacatgttgtcagttgctttcctcttggatttattttcttcttatgttacccccacccatcattgkatttatatttatttttattttttatttttttgggatggactcttgctctgtcactcaggctggagtgcagtggtgcggtcttggctcgttgcaacctctg

SEQ ID NO: 35075 - DNA, 201 bp, Homo sapiens
tatatacaaggaataaaattttgattttctttgcacataaagcatttttcctagagatatgtgtatgtgtgtgtgtgtgtgtgtgtgtgtgtgtgtgtatrtatatatatatatatatatatatatatgtattttttttgagatggaatctcgctctgtcacccaggctgaagtgcagtggcgtgatcttgtctcactgca

SEQ ID NO: 35076 - DNA, 201 bp, Homo sapiens
agaccctttacgggtgtcaggctgggggacagtcaggtctttctcatcccacgaggccatatttcagactatcacatggggagaaaccttggacaataccsagctttccagggcagaggtccctgcggccttccgcagtgcattgtgcccctggtttattgagactagagaatggcaatgacttttaccgagtatactgct

SEQ ID NO: 35077 - DNA, 201 bp, Homo sapiens
tggtgtgtacccgggaggcggagcttgcagtgagccgagatcatgccacttcactccagcctgggtgacagagtgagactcggtctcaaaaaaaaaaaaaagaaaaattactaattttcataaatgtccagtatcgggggaaccagcccccgatttttcaacgtaggttcttttctatttccctaagtgttggccggtctg

SEQ ID NO: 35078 - DNA, 201 bp, Homo sapiens
gttttgtaggcaaagcctctcagcctcccgtggatttccttatcctcacagttaggaatgccaggttcacgcctcctcagggcttatttagggtgaaaggcagttcttgagtgctcacaaggaggcagagttctccagcgtggttttttgttgtgtttcagacctggctggaaatgagtacgacctgactggcctaagcac

SEQ ID NO: 35079 - DNA, 201 bp, Homo sapiens
gggaggctgaggcgggtggatcacgaggtcaggagattgagaccatcctggctagcatggtgaaaccccgtctctactaaaaatacaaaaaaaaaaaaaaattagctgggcgtggtggcgggcgcctgtagtcccagctactggggaggctgaggcaggaggatggtgtgtacccgggaggcggagcttgcagtgagccga

SEQ ID NO: 35080 - DNA, 201 bp, Homo sapiens
tggtgggttcagggggctggagaagggctgcacttgctgggtttgggctgatttctttctttctttctctttctttcttttttttttaagtcacttctttbcgtgatgatcatttttaaccacatcttctgttttctccccctttctcttccagataaaaatggaagtaaaaatctgggaaaatttatttcctctcccatg

SEQ ID NO: 35081 - DNA, 201 bp, Homo sapiens
ccatagctccatttttccttttcattataaaaattttcaaacatggaacattaaaacagaaatttacatgcctgccactctgacagccattgatgttttgscagatttttcatgtaagccatgcgtcattgatggctcatatcaccccaccctgatgccaagaacgaacattcctttatgtaaattcagtaccatcgttgt

SEQ ID NO: 35082 - DNA, 201 bp, Homo sapiens
tgtggcacacctctggattgagagtcagttagagggaaggtgagaagtgtttccaggaggctgaaaaagagctggaagtggggcagaagaaaaccaggagmctgtggatgcaagccacaggagaaggggtttcatgaggtggagaatgatcagtagcatccagtgccacaagagaccatgtaacgggaaggctaggacacg

SEQ ID NO: 35083 - DNA, 201 bp, Homo sapiens
cctcctatcaccagacatttctacaaatgaggaccttcacaggactaaggtgccaccatcagaaccacaatatgtggggacggtactgccagctaagcctyagtgctgtttcggtgttgacagctgtcacaatgatgcccttttcagtagaggagcctgtgatggtcacgtgttgcaggtgatcattgtgccatttggttt

SEQ ID NO: 35084 - DNA, 201 bp, Homo sapiens
gcactcgtctgtttattgtggcactattcacagtagcaaagatacggaataaacgttaagtgcccaccaacggatgactaggtaaagaacacacacacacmcacacacacacacacgtctatcatggaataccactcagccgtaaggcagaatgaaatcctatgttttggagtaatattggtggaacttgaggccattatc

SEQ ID NO: 35085 - DNA, 201 bp, Homo sapiens
aattcaacatcccttaatgaaaagacaacactcaaaaaatattagaagggacatacctcagaataataaaaggcatatacgacagaaccacagccagcatygtactgaacagggaaaagttgaaagcatttcccctaagaagtggaacaagacaatgatgcccactttttcatctctcctattcaacatagtactggaagt

SEQ ID NO: 35086 - DNA, 201 bp, Homo sapiens
ttgggtgtgtgagcaggatcctcaccgtctcccgcggggcctggaaggcagagttctcaggaagttattttgttctcccttgctttgcactttggcagcaraatttatattgggttgtgcaggccagcaggtggtatttatgggtaaaaaccagctgcagtggaatccgatgggtgggtctatgagtctctgtgcttgacc

SEQ ID NO: 35087 - DNA, 201 bp, Homo sapiens
cagaaaatgtattcaacacattcttttgtgtgtgtttgagtgaagacggtgtttccacacagcttgcagatactttcttccagaagcttgtttgttgctawcatttaacatcttactgttacagcttagttttctctttgattgaatatattgatctcttttttttttttctgttggcttttttcttaagtctttacttgt

SEQ ID NO: 35088 - DNA, 201 bp, Homo sapiens
ttaagaagtgagcaaaggacgtgaacaaacatttctctaaagaagacatacaaatggccaagaatctcctaaacatactccacatcactaatcatcagagraatatacaaattattataaaaccacatggaatactatgcagccataaaaatgatgagttcatgtcctttgtagggacatgaatgaaactggaaaccatca

SEQ ID NO: 35089 - DNA, 201 bp, Homo sapiens
tggtgccctggtgtcattgctcccacgaacggctgtgaagcttgttgccagtggcagccttgtcctgttgctgcactgtgcttgtgggctgcgccatgaayactgttctgtctcttaaaatctgggccttcttgctttacaggtaccgctgatgcttttatcgtccgctttgtttgcaatgatgatgtttactcagggccc

SEQ ID NO: 35090 - DNA, 201 bp, Homo sapiens
agaggagctggattatatctggaaatctgtgaagtcccaaggattttcagcaggggtatgacatacatctgactcgtgaatgagaaaatcagtgtggcctstggatggacctcgcatctggtctgagcactccctgcacccctcagcttctccatcattctctcatcgccctcacctcctagcctacctacgctactagcc

SEQ ID NO: 35091 - DNA, 201 bp, Homo sapiens
ttagggcctgggcctccagacattcaaaggcatggaccaggggaactgcgagcaggttagaggcgtgtatggggaatgtggctgaagatgaccctggaacrgtgagtgtgcagtattgtaagaaacttgtatgtcctgcagaggagctggattatatctggaaatctgtgaagtcccaaggattttcagcaggggtatgac

SEQ ID NO: 35092 - DNA, 201 bp, Homo sapiens
tccagttctgtggagtgctgtgtgaggcatgtcttctcttccctcctggagtagggagacagccagtagttgctacctgccccgagcagggtgcttgcagrtcttgcctatgtggaatcctctaagtgtcttggtgaaatgcagctgttttcagaatgaagagttctttcattttcccttcttgccatatgccatcttgct

SEQ ID NO: 35093 - DNA, 201 bp, Homo sapiens
gaatagctacaacaaagtggcaccttttacttataatgaggtattgacttccattttatgtgcattaaaaaaagaataccagcttccattataatgagttyggtattggttatagtctttgaggacgttttcttttgatccctgctctgtgagataaattggtagattatggcccctattccacagggactcagagtagct

SEQ ID NO: 35094 - DNA, 201 bp, Homo sapiens
ccttccttaaggaatcctggaagccatacaggagaagaggaacatttcttattacataccttttaatgactaaaaggtgttctaaagacaaaagacatacrctagactgggaaaaacatttccagcatgtttgccaatgtactattaggatgagagcttttcttaaaaattggtaagaaagacagacacccaggagaaaaa

SEQ ID NO: 35095 - DNA, 201 bp, Homo sapiens
ttgagtttttctgttaaaatttaaatttttttttaagtgagcctaatagtttcctgaactattatgttcagggaagttatgttgttgctgattctgatggkgtgtgtgtgtgtgtgtgtgtgtgtgtgtgtgtgtgtgtgacagagacagagagaagtcgagtctaaagttctgtcaggcttagactatgcctgaatactt

SEQ ID NO: 35096 - DNA, 201 bp, Homo sapiens
tagggaaacccatccgctgccttggtgggttcagggggctggagaagggctgcacttgctgggtttgggctgatttctttctttctttctctttctttctkttttttttaagtcacttctttgcgtgatgatcatttttaaccacatcttctgttttctccccctttctcttccagataaaaatggaagtaaaaatctggg

SEQ ID NO: 35097 - DNA, 201 bp, Homo sapiens
ttctcgtgcctcagcctcccgagtagttgggactataagcgtgcgcgaccatgcctggctaatttttgtgtgtgtgtgtgtgtgtgtgtgtgtgtgttttkttttttttttaagtagattcagggtttcaccatgttggccaggctggtctcgaactcctgacctcaagtgatcctcccaccttggcctcccaaagtgctg

SEQ ID NO: 35098 - DNA, 201 bp, Homo sapiens
gcgtggactgactgcagttctccaggatagtttcagcagaagcagtgagattacagtcaggagcaaaacagtatctgagctttctttatgggaaagattcygactgtgtgcttggtttatatggttaaattaattgcccttgttaaattaaaaaaatagggtatgtttctgccacagactttgctttaaaagcagagatct

SEQ ID NO: 35099 - DNA, 201 bp, Homo sapiens
tgagacagaaaacagaacatgagatttcttaagatgtttattttctttaagaaactaatttatgagtcttatatttcctctccaactttagggagtagcartagtcttcttagggaaatgcagtagccttaacagcttccaggtgagtgtaatttctgagtctgggctcacacttggtatacttcagggtggtgtatttga

SEQ ID NO: 35100 - DNA, 201 bp, Homo sapiens
gagcgagtgaaccaggcaccctggtggggggcctgcatgtcagacccagcgggaagcatgtctgacttggttgagaggcagctaagggcccagtgtgtctrggtgggctgagccattgggagaatggagggaggggccagagagcacggaggattagctgtggccagatcacagaggctgtgggactttgggctccctctg

SEQ ID NO: 35101 - DNA, 201 bp, Homo sapiens
gtcagttttgggtacaaaacatacaaaagcataaaaaaaaatcctgaattaacccccacttagcagaggctaaattttcatcctgatttgttactggacartcttctttttaataaaatgaagggagatgggcagactaagcttttcttcacagtttctcattgggaacattgctctcgtccttttttgaatcctggtttt

SEQ ID NO: 35102 - DNA, 201 bp, Homo sapiens
agtgatccccatctcttttccccattgacaggtgatctggaaagtgcaccagtgttgagaacttctggggaaggcggttgcttttatgagtttgagtggcrcacagctgcggcctgtgtgctgtctaagacagaaggggagaactgcacggtctttgactcccaggcaggtctgtgtccaagcaggacctctgctttaatg

SEQ ID NO: 35103 - DNA, 201 bp, Homo sapiens
ttgcaaactttttagaccgtaaggagctaagctcagtctgctcgtgaaaaatgatggtgacatgccatgtgtgcccttcccgtttgacagacggcgatctygatgtcgtgtttgcctcttcctctaagtgcggaaaggataagaccaagtctgtttcttccaccatcttcttccactgtgaccctctggtggaggacggga

SEQ ID NO: 35104 - DNA, 201 bp, Homo sapiens
ttttgattttctttgcacataaagcatttttcctagagatatgtgtatgtgtgtgtgtgtgtgtgtgtgtgtgtgtgtgtatatatatatatatatatatrtatatatatgtattttttttgagatggaatctcgctctgtcacccaggctgaagtgcagtggcgtgatcttgtctcactgcaacctcctcctccctggtt

SEQ ID NO: 35105 - DNA, 201 bp, Homo sapiens
tcatgttgcactgctacttgattctccctggtcctggggaagagcagactgtgttccttctgccgcttctccatgcccaccaccccagatcctaaagggartttcctgttctcaccttgataacaatcttaattaattgattatctcacttttctctcctactttctgtttttaagaactttcaaaggttgtaaggattca

SEQ ID NO: 35106 - DNA, 201 bp, Homo sapiens
atttatggtgtggatttgtcccacctaatgtggatattgatacatctagctgcagaaatattaatatgtttgatcacaggatctgggggtgtgagaattgyctcttaaaatcctaataaagatgttggattccaaggctcatctgacccctaggagttcaggtgatggattaggatctgttgggtgtcttgtaattctgat

SEQ ID NO: 35107 - DNA, 201 bp, Homo sapiens
gttccctgcgttgggagaacactgtttgcccaagcttacatcaaacacttagaaaactttagcaaaaattaaccacaaagcaggcaagtcagcaatttccyttttttttttttttttttttttttttttggagacagagacttgctcttttgcccaggctggagtgcagtggtgcgatcttggctcactgcaacctctgct

SEQ ID NO: 35108 - DNA, 201 bp, Homo sapiens
ggtcttggctcgttgcaacctctgcctcctggttcagacgattctcctgcctcagcctcccaagtagctgggattgcaggcatgtgtcattatgccctgcyaatttttgtatttttggtagagatggggtttcaccatgttgaccaggctggtcttgaactcctcacctcagataatctgcctgccttggcctcccaaagt

SEQ ID NO: 35109 - DNA, 201 bp, Homo sapiens
gatggaggttcgctgtgttggccagggtagtctggaactcctgacctcaggtgatccaccaccttggtctcccagaatgctgggattacaggcgtgagccwtcgcacccagccaggttttcttaatatatcaaatttatgtgctggtcactttagatatttgattttttaacaaaataacactcactggagtttacttaaa

SEQ ID NO: 35110 - DNA, 201 bp, Homo sapiens
tcctcaagtgtccagttggccggatctgagttgcttcctgtgggaggtggaggctgcggtgacagtggtgccctctgctctcctgttagaccccagacctytcagtcccacagatactctcctgggctctgattttccaacctgatcatgataccctttttgttttgttttgtttttgttttatctgagtgtacctcttat

SEQ ID NO: 35111 - DNA, 201 bp, Homo sapiens
ataaagagagtagaatctgtcagcatgagttgtcttgggatttcagatttataatctgtgtgtaataggtttgtttgcctgatgtgcggccagtcagtacrctgagacattggggattacagccgagaaagagtttaattgtagggcaggcgaatgaggagatgagaagaaacctcaaattcacctccctaaggaatttgg

SEQ ID NO: 35112 - DNA, 201 bp, Homo sapiens
tctgttattggtaaggcttctggtcaacagtaggcaatactagttgttaagttttaggggagttaaagttctatgtgggttttcgattgtgtgtggggtcygtgctcctaatccctgggttattcaaggttattctacataatttttctgtccgttacacctcagtaaagctggataaaagcgaaaaccaaaagactacga

SEQ ID NO: 35113 - DNA, 201 bp, Homo sapiens
  misc_feature (1)...(201): n = A,T,C or G, or insertion/deletion polymorphism (see Tables 1-2)
ccaagggcacctccagggatcttggtaccactcatggcccctcggaaccctgaagatgaaactcatcccatgttcgtggagtttcatacagccccacctgnatcttgggtggctcacctcaaaggcggtgtggttatttttagctgcagaaggtggttccatcctctgtgtggtttgaggctgtggttccacttccccttg

SEQ ID NO: 35114 - DNA, 201 bp, Homo sapiens
atcccttaacacactgacaaggtaataaggactttaaaaaaaagaaacagaagttgaaaccaagagcaaaaactcagatggtggattttgagggatgcagktaccacccgggggtgacgtggaatagtgcctgagatttttttttccccaaatgttatcagtgttgtacattgtagaatcatgtaaatatggccagacgcg

SEQ ID NO: 35115 - DNA, 201 bp, Homo sapiens
gtgcccctcctgggaaggcccaccttctcatagcaggtgatactgctggtgtgtctgcaggagtcttcacgctccatcgcgcagcactggccacttgtctsgttacacataagacctccacgttcacaagtggtatgtctagcagacctttgaggatccccagctttcagagtgcttgtgcatgcgcatttagtcattctt

SEQ ID NO: 35116 - DNA, 201 bp, Homo sapiens
agtgagaatctgttaaaagcattcaataaggaattgtgagcctcgttggattttaggaattatctcggtattcagaattgctggtgtgtctttaaaagcargttcaggcatgtccatgtctttactaagaaggactttggaacagagttttaatcctttataacaaaaagcaagtgaaccaagaagtaagcggcctcctgc

SEQ ID NO: 35117 - DNA, 201 bp, Homo sapiens
ttccattgtgaagaggtattttgtgttttttaaggaagtatactttgaaggtgatactttgagacaaagagaatattccgcttcacaataatttttcaccrgatggttttagtatttactgatggtctttgcctgtatccattataacactggagttgcaaaacacaaaccctttttctttttttttttttttgagatgga

SEQ ID NO: 35118 - DNA, 201 bp, Homo sapiens
actggtggttatgaggcttatgatgagagtgaggatgatgcctccgataccaaccctgatttctacatcaatatttgtcagccactaaatcccatgcacgsagtgccctgtcctgccggagccgctgtgtgcaaagttcctattgatggtccccccatagtaagtatgacaaatccaagggtggagataatttttgcaaga

SEQ ID NO: 35119 - DNA, 201 bp, Homo sapiens
gtctcaaaaaagaaagaaagaaagaaagaaagaaagaaagaaagaaagaaagaaaggtacatggaagattcgattgcttggattgccttagggaactatgrgatccctaggtgagggttgcagttgagcatggtagctgcttttcctcttcaggttgcctttaggctgcgatggagatagcatgagctctggagcaggaca

SEQ ID NO: 35120 - DNA, 201 bp, Homo sapiens
aggtattttgtgagaaagaatgagagaaaccacattcacgtaactgtcattacagatattgttacagttgttctgttttattgttgatctcttgctgtgcstagcttacaaattgagcttcatcctctgtatgtgtgtataggaaacagcatagtatatatagggttctcaatttcaggcattcactgtgggtctcggaac

SEQ ID NO: 35121 - DNA, 201 bp, Homo sapiens
atttgggtaagcacatctcaggtagagaggacttttgagtttcaggagggtagaattgcatcaagaggtgagtgtggctgcgttgagtgaggagagtggtrggttagggcggtgtcatgaaggagttggaatttccttctcagtgtaatgggaagctgctttgaacagggagaggtgtggcctgatttaattctgaagtgc

SEQ ID NO: 35122 - DNA, 201 bp, Homo sapiens
attgaaaggcacatgggccggtgctgtggctcatgcctgtaatcccagcactttgggaggccgaggcgggtggatcacgaggtcaggagatcgagaccacrgtgaaaccctgtctctactaaaaatacaaaaaatcttagatgggcgcggtggcgggcgcctgtagtcccagctactcgggaggctgtggcaggagaatgg

SEQ ID NO: 35123 - DNA, 201 bp, Homo sapiens
tcaaggatgacaagaggtcacaaggcagaaggtcagggcaggatcacaaggtcagcgcgaaactagaatcactaaataacttccatgtcccactgtgcacrcattgtgagggttcaagagcagagaaccggtttaactagaattcgccaggctggaatttccaaatcctagcaagcctgggggcgctgcaggaggccaggg

SEQ ID NO: 35124 - DNA, 201 bp, Homo sapiens
ggaaaaaacaaatgataaggaagagaaaattatgtttattattcattgagcggcagtggatcatcatataaagatcttcgtccttattgtcttcatgttgygtaggctgagtaggaggaggaagaggagggactggtcttgttgttctggggttaccgaggtgaaagaaaatctgtgtataagtggacctgggaagttcag

SEQ ID NO: 35125 - DNA, 201 bp, Homo sapiens
tatttatacgattttcaagtttattatgaaatagtctttaaaaaatatttactttagtggaaacatatctagtgatagtttaaccagggtgcataccagaktacataatagtttttggaatattcttcataaattttcagagagattatttaaaccacatgactgtttctgagctcctgttgatactaggggctaggcata

SEQ ID NO: 35126 - DNA, 201 bp, Homo sapiens
tgcaaggcggcaagatagccacattgagttggggacagtatggcctgggggtgttggataggtaaggcagaagcaagcccagaacttggagcctgttgtgmctgtcacagtaaggagtttgaagtcctgaaagcagttgagagctgtaggagggccagattgggcttttgagcaagatagtctagatgaaagtaaagagat

SEQ ID NO: 35127 - DNA, 201 bp, Homo sapiens
gagcagaattgggaagctgtggatggcagtcagacggaaacagagaagaagcattttttcattaatatttgtcacagagtgctgcaggaaggcaaggcacragggtgtcccgaggacgcggcagtgtgtgcagtgggtgagttgtgcctggatggaagatctaggtgatgcttttctagggcatccagtttggaatgagtt

SEQ ID NO: 35128 - DNA, 201 bp, Homo sapiens
cgtggcactctagggaaacccatccgctgccttggtgggttcagggggctggagaagggctgcacttgctgggtttgggctgatttctttctttctttctytttctttcttttttttttaagtcacttctttgcgtgatgatcatttttaaccacatcttctgttttctccccctttctcttccagataaaaatggaagta

SEQ ID NO: 35129 - DNA, 201 bp, Homo sapiens
ttgagcccaggaggtggaggcctcaatgagctgtaatcaggccactgtactcctgcctaggtaagagagtagtgagagcttgtctcaggaaaaaacaaatsataaggaagagaaaattatgtttattattcattgagcggcagtggatcatcatataaagatcttcgtccttattgtcttcatgttgcgtaggctgagtag

SEQ ID NO: 35130 - DNA, 201 bp, Homo sapiens
acaggcattttagggactgggaaacaggcagaattcttggtagcttcttgaataaagaaggtgcatggacgtaggccatttaaaatgttcctctgtcttamtttgggaatataaccttcatcctatatggggttcagaaagaatttcgactgctacagcctagctattcctctacactcacgcccgcctgccccagtccat

SEQ ID NO: 35131 - DNA, 201 bp, Homo sapiens
taactgtactaacatgccagaaagtggaaagttggcaagttaactaacaaataagaaatgtttaacctagtgggatttggagttgctagggttcttgtctrtggtgagatacgaggcataaatttgtttgtatggctcttaccgtctgacctgcagtttaatgtctgcggcacaatgcctgtctgtgggaccatcctggga

SEQ ID NO: 35132 - DNA, 201 bp, Homo sapiens
tattgctgagaagcaaaccgccctgcagcatccctcagcctgtaccggtttggctggcttgtttgatttcaacatgagtgtattttttaaaattgattttkctcttcatttttttttcaatcaactttactgtaatataaagtattcaacaatttcaataaaagataaattattaattgggtgttaccattttttccttga

SEQ ID NO: 35133 - DNA, 201 bp, Homo sapiens
gctggtatttcaaggatttcattttctttagggtccactgctggagagttagtgtgagtctttggggatgttgcagcgctcttttttttttttttttttttaatacttctagagttgttactctgtttcattctcatctggataaactatctcttctttatttttgaatttactttggcaggatttttttttttcccttga

SEQ ID NO: 35134 - DNA, 201 bp, Homo sapiens
tttttttcagggagtagtctcagtgggattggtaccagttctttgtacctttggtagaatttggctctcaatctgtctggtcctgtgctttttcttgggaratttttaaagtactgattcaatctcactcctttttactggtcttttcaggatttctgtttcttccgattcaatcttgggaggttgtatgtttccaggaat

SEQ ID NO: 35135 - DNA, 201 bp, Homo sapiens
ggcatgagccaccatgcccggctaatttatatatatatatatatatattttttttgtttgtttgtttgtttgtttgtttatttgtttgttttgtagagacrgggtttctctatgttggccaggctggccttgaactcctgacctcaggtgatccgcctgcctcggcctcccaaagtgctgggattacaggagtgagcccct

SEQ ID NO: 35136 - DNA, 201 bp, Homo sapiens
atggcagctgaaaaacaacgaacagctttgtacataaaagatgatacagcttggtctaatgtggttctaaggaggctctgccggcgagtcttaggggttcyggcgggcagccgcgtgaacctggagcttggggtctgcagtgctgggaggccgaggcctggcatgttggggacaggtcttgggagctgactgggggcctgg

SEQ ID NO: 35137 - DNA, 201 bp, Homo sapiens
aatggtaagatatttcttttttttttttctttggagacagagtctcgcactgttgaccgagctggagtgcagtggcacgatctcggctcactgcaacctcygtctcccaggttgaagcagttctcctgcctcaccctcctaggtagctgtaattataggcgtgtgccaccacgcccagctaatttttgtatttttagtaga

SEQ ID NO: 35138 - DNA, 201 bp, Homo sapiens
tcttagaatatcttaaaagttgtgtttaatttttctgccagattttcttaggatgacaaatctgccaatcatttcagagacggattttcacccacctcttyccctgttacttccctgtagttgcacatgcagacttctccagaaccacttgcaatctctactttaaacccaacatgtgccaagtgaacttcctgtctgttc

SEQ ID NO: 35139 - DNA, 201 bp, Homo sapiens
agcagggtgacaccgctggtgtgtctgcaggattccaaacctacctccagtgcccctcctgggaaggcccaccttctcatagcagggtgacaccgctggtstgtctgcaggattccaaacctacctccagtgcccctcctgggaaggcccaccttctcatagcaggtgatactgctggtgtgtctgcaggagtcttcacgc

SEQ ID NO: 35140 - DNA, 201 bp, Homo sapiens
tcgtggagtttcagccattgctagggtttgacgagaatgcactcatttcttcaggtcttaaatgtttaataaatgttacgtagtttgcacatggaggtcaragattgggtactaactgtggctatcatttatttaatttttttttttttttttttttttgagatggagtcttactctgtcacccaggctggagtgcagtgg

SEQ ID NO: 35141 - DNA, 201 bp, Homo sapiens
gtgtgaaatgccttgtcttctgtagttaaaacgcttgcgaaatgcaaacagtttctttggcaaggagttataattaagggcaagagtacgtttgctaatasctaaatattttgccttaaaagctttggttttatgcattaaaaaattattttgtagagatgggagtattgctatgtcacccagccaggctggcctcaggct

SEQ ID NO: 35142 - DNA, 201 bp, Homo sapiens
gaggaccccaatgtggctgttaatgtctagccaaacgtggcactctagggaaacccatccgctgccttggtgggttcagggggctggagaagggctgcacktgctgggtttgggctgatttctttctttctttctctttctttcttttttttttaagtcacttctttgcgtgatgatcatttttaaccacatcttctgttt

SEQ ID NO: 35143 - DNA, 201 bp, Homo sapiens
tctttttctttctctctttctttcgagatggagtctcgctctgttgccaggctggagtgcagtggcatgatctcggctcactgcaatctctgcctcccggrttcaagggattctcctgcctcagcctccctagtagctgggattaaaggcacgcactgccacgcccggctaatttttgtatttttaatagcgacagggttt

SEQ ID NO: 35144 - DNA, 201 bp, Homo sapiens
tatttacctttttaaagtctttccaaaagaactagtgttttgttttttcatcttttcaccttttatttgcaattttattaatttatccactcagtaacttstacatcatttttctgtttctcgtttgacttgaatgcttagctcttttattttaaatcattttgcataattaagaaatatatttaaagcttcatgtttctt

SEQ ID NO: 35145 - DNA, 201 bp, Homo sapiens
ccttgagtcaccaaggcactggcatatcaaaaagcggtgccgctgtccatatcttgacgattgtagacacagttgtagctgtagagagatgatgggattcygtcatcatcagagacctgccccatctgttgacccccaggctgtgactccaggcaccctgcagggcatcccaccactgctcagagcaattctagggcccat

SEQ ID NO: 35146 - DNA, 201 bp, Homo sapiens
ggtttaggtactggaattgaatcagtcactacaacaggcaagaatctctttttttcatggagcttacattttagtagggtgggagacagatgaaaaaagcwatggctaagtagtatgttaaactgtgatgactgctacagaaaaggaaaggaagggtaatcaggagtactgggggctcgggtgtgtgtgtgaggatattaa

SEQ ID NO: 35147 - DNA, 201 bp, Homo sapiens
agagttcccaccagctctcccgtggaatcagatgtgttgtgttcccagcacccacgtgtggcagtgcacatggagtatcatcagccggaggtgcttccccragccttggtgtccagagtttttcccggggctctgacatgggcaggattggtccattgatcactcaggtactgcatggccagcccctgctccgtatcctgt

SEQ ID NO: 35148 - DNA, 201 bp, Homo sapiens
catgtcacaggttgtgccttctcttgctgtcctctttcccagtgctcggtaaatcttgattaaaggaaggaaggaaggattgtttcagaagccttcagggrccctatcatgcagagaaggaaagtctaggctctctctgacacagcttgaagatgtctgagaggctcccatgtaccagggtagccttgcaagctgctgctc

SEQ ID NO: 35149 - DNA, 201 bp, Homo sapiens
tccacagcacggagctagcactctgtgtttctctgttctctgccttcctcacacttcggtgaatccttcagtcattcagaatcagatgttgcatgtcacargttgtgccttctcttgctgtcctctttcccagtgctcggtaaatcttgattaaaggaaggaaggaaggattgtttcagaagccttcaggggccctatcat

SEQ ID NO: 35150 - DNA, 201 bp, Homo sapiens
gcagaccggggatcctcgatcgggaatcattgcctggccacccattgtcaaatgttaaaagatgtagaaagttatttaactggagaaggtgtggtgccacrtggtctgaacgtgccccacagtggtgaatgaagagcactgtagctgagaacaaaatcatggggaagctgcttatacacacactcacacccacatgcacac

SEQ ID NO: 35151 - DNA, 201 bp, Homo sapiens
gcagggagtgctggcagtgctgttgtggttaaacaccctgtgtgctgctgggaacggtgccatagttaattctggcacatgtgtgctagtgaagacattgrttttctgtgaagtggaaagagttctagctgcagagttggagacctggctgaggactggtgttgccgcatccaaccacatttgcttgagcgagctgctctc

SEQ ID NO: 35152 - DNA, 201 bp, Homo sapiens
gctctgagcactcctgggatggggtgcggttcctggtgcagttagttattgggaggaacgaaggagacagcaccatttcagcagcagctttaactgtgtcygtgcacgtggaggggcctgccctctgagttgtgcattgaacagcaggcacgacaaaggctcatttcccaaagtgtatctggcttgaagcagcgctttaaa

SEQ ID NO: 35153 - DNA, 201 bp, Homo sapiens
gcttgcagtgagctgagatcgcaccgctgcactccagcctgggcaacacagtgagactccgtctcaaaaaagaaagaaagaaagaaagaaagaaagaaagraagaaagaaagaaaggtacatggaagattcgattgcttggattgccttagggaactatgggatccctaggtgagggttgcagttgagcatggtagctgct

SEQ ID NO: 35154 - DNA, 201 bp, Homo sapiens
ttcgtacataattacttgctcaagaaatgttagctattattgggtcatgattatttatatgtgtttgaattccagctttgccacatcccagagtgtctttragtaagtcactgagtatccttgtgcctcaattcctcatctataagtaggttcccatctcataggtttttaaagattcatgcttacatgcttagcagtgtc

SEQ ID NO: 35155 - DNA, 201 bp, Homo sapiens
ttaagtatgtggccctgactctgggttctctattctgttccattgatctgtgtgcctatttttatatcagtaccatgctgtttgattactatagccttcargtataatttgaagtcaggtaacatgatgcctccagctttgttctttttgtttaggattgcttttgctattcaggctttggctactcatatggttccatat

SEQ ID NO: 35156 - DNA, 201 bp, Homo sapiens
taattctgtgaaaaatgacattggtactttgataagaattgcactgaatctgcagattgctttgggcattatggtcatgttaacaatactaattcttctargccatgatttttgcatctgtgttcattagggatattggcctatagttttccttttttgttgtgtccttgccttgctttggtgttagggtgttactggctt

SEQ ID NO: 35157 - DNA, 201 bp, Homo sapiens
aatacaacttcactaataagccaggtggattagtcctttctcacattgctgtaaagaactacctgatacttggtaatttatgaaggagagaggttggattmacagttctgaaggctgtgtaggaagcatggctggggaggcctcaggaaacttaaaatcatggcagcaggtgaaggggaagcaggcagcttcttcacatgg

SEQ ID NO: 35158 - DNA, 201 bp, Homo sapiens
tgctaaccatgtttgtaggctaggcgtgggatgctaaccgtgttgtaggctaggcgtgggatgctaaccgtgttgtaggctaggcgtgggatgctaaccgygttgtaggctaggcgtgggatgctaaccgtgttgtaggctaggtgtgggaattggaagacatttgaatgcctggcacgtcctcggtgttcattggtgctg

SEQ ID NO: 35159 - DNA, 201 bp, Homo sapiens
gtttgcagccttgaggagtccttcctcactcagattcccccaaacaatgaggagcttgataattcgaggtgtggagtttggatgggggccgggggtcaccstcctgcatgtggtggcttggtcccaggctaggctgggagaaagggggctgtcgtggttccagggcaagaagagccgtcctccctgtttccctgtggtagg

SEQ ID NO: 35160 - DNA, 201 bp, Homo sapiens
aaagcgatgctttattattggtgatttttttaaataaagatgttagataattttttggaagagcagaattcattaggataggctaataaactactcacaayttaagtggctcagcccattaaaggtttattttcttagttcagtgctagtctttggggatggggctggggtcgggggtgcgggctctgctccatgtggtca

SEQ ID NO: 35161 - DNA, 201 bp, Homo sapiens
ttggtagagatgggatttcaccatgttggtcaggctggtctccaactgctgacctcatgatccgcccacctcggcctcccagagtgctgggattacaggcrtgagccaccgcgcccagctatcttattttttttcgtgatcattagtagattggtcaaatattgaatacccgtgtgaggaatcacctagggctgtggggtt

SEQ ID NO: 35162 - DNA, 201 bp, Homo sapiens
ctgttagattccttaagttaacttttttttttttaaacattactgtgtataagagacaacctaggatctatgagataaggagagatacatttttcaatctrcagacttcctgacatagctctggtttcttggaatctgcagtatttcgtggtatttgtgcgtagatagccctaagtaaattatgaagggagagctaaaacc

SEQ ID NO: 35163 - DNA, 201 bp, Homo sapiens
cgaggtgcagcctggccagtgtggtctggaggggtctggcaagcgctatctggagcactcagaggtgtggcctgtttttccgggtgggtctagtgagtgtrgcttggagtgctgggtggtgtggcctggctggcaccgaggtccctgcggattctggagaacctcaaggtgcggccccgggggtgtggccaagtgtggtgt

SEQ ID NO: 35164 - DNA, 201 bp, Homo sapiens
ttggcgccaacaagacagcatctaaggacaaccacggtgcccccattgtccgcttagggaatggacccctgttggggtgggaggtagactttttgttttcrgaaccaacatgtctcaagcagctgtgcttaatatatgtttaatccccatccactccatggggcagcgttgtcatccgtttcacaggctgggcccctgagc

SEQ ID NO: 35165 - DNA, 201 bp, Homo sapiens
cttgggtctgagtaatgcgaagctttcatattatgatgggatgatccaactgaactacagaggcggcacaccctataacaatgaaagacacacaccgagarctacgctcatcacctttctctgtgatcgagacgcgggagtgggcttccctgaatatcaggtaggaatgtttgttcctcatcgcgctccctgaggatactc

SEQ ID NO: 35166 - DNA, 201 bp, Homo sapiens
aagttactcatggtgctgttcagcttttctttgccctaactcttcttcggtttgtctgttgcttttattatttgtatctggctgccgctgtggacaggcaygtagctggatgtcgtttgctgctgtcgcccagcttaccagttctcccatggttcagatgttcttctgcttccctgttgtcttttgttgcagaatctcagc

SEQ ID NO: 35167 - DNA, 201 bp, Homo sapiens
gttgcagagacatgagatgatagctaggggaatgtagggaccaggaaggacgtttgtgaggtggtagatctcatggcatgctgacggaaacgatccagtgsagagggaaaacctggtgatgtaaagtgagaggagatgattgcacaacagtcctcatgtaagagagaagagataccgaaaagaacgcagaggagccaagac

SEQ ID NO: 35168 - DNA, 201 bp, Homo sapiens
gtggagggcgggaatagtagagcaagaagagagggcattcaggaggagaggagcagaggccaggccatgcaaaaccaacaacagtgtctaaagtgatctcrgcttgtcagtggctttacttattaccatatgctttaaactttgtaaaatgtcatattatatatgtaatatgcaagtttccaccctttagttaggtgttaa

SEQ ID NO: 35169 - DNA, 201 bp, Homo sapiens
ggccacagactggtagcggtttgtagcctgttaggagctgggctgcacagcaggaggtgagtggtgggtgacagagtgaagcttcgtctgtatttacagcygctccccattgcttgcactactgcctgagctctgcatcctgttagataagtggcagcagtagatgcttataggagcgcgaaccctattgtgaactgcaca

SEQ ID NO: 35170 - DNA, 201 bp, Homo sapiens
ccttcctttcattcctttcctttccttcctttttcctctttctttctttcttttctctctctctctttttctttctctctttctttcgagatggagtctcrctctgttgccaggctggagtgcagtggcatgatctcggctcactgcaatctctgcctcccgggttcaagggattctcctgcctcagcctccctagtagct

SEQ ID NO: 35171 - DNA, 201 bp, Homo sapiens
gagtttttctgttaaaatttaaatttttttttaagtgagcctaatagtttcctgaactattatgttcagggaagttatgttgttgctgattctgatggggkgtgtgtgtgtgtgtgtgtgtgtgtgtgtgtgtgtgtgacagagacagagagaagtcgagtctaaagttctgtcaggcttagactatgcctgaatacttga

SEQ ID NO: 35172 - DNA, 201 bp, Homo sapiens
cattcctatacaccattaacagacaaagagagccaaatcatgagtgaactcccattcacaattgctacagagagaataaaatacctaggaatccaacttayaagggatgtgaagaacctcttcaaggagaactacaaaccactgctcaaggaaataaaagaggacacaaacaaatggaagaatattccatgctcatggata

SEQ ID NO: 35173 - DNA, 201 bp, Homo sapiens
gcacccagccaggttttcttaatatatcaaatttatgtgctggtcactttagatatttgattttttaacaaaataacactcactggagtttacttaaaacytttttttttttcaaatggaaataaagtcattttataccatatctacttttatattttaatatttcttctgttaccctctcctcccccccaagtgaatgtg

SEQ ID NO: 35174 - DNA, 201 bp, Homo sapiens
atgggttcagcacaccaacatggcacatgtatacatatgtaacaaacctgcacgttgtgcacatgtaccctaaaacttaaagtgtaataataataaaattwaaaaaaaaagtttaggaaaaaaaaaataaactgcatatatggaacgtaataaaaaaaaaccccacaatgagataccatcttataccagtcaaaaatggca

SEQ ID NO: 35175 - DNA, 201 bp, Homo sapiens
gaagttggcagaaatttaaatggttgaatcatagagtgctggcaaggagcctggaaatgggcacatttatttatacgttgctgtaggaagacggttgtctytaaatccttttgggaagataatagttggtgtgaggttgtttttttttttttttttttttttttgagacagaatcttgctctgttgcccaggccggagtgc

SEQ ID NO: 35176 - DNA, 201 bp, Homo sapiens
ggtaatgtactcactaaggaacagtgttaattgaggttacctctggagcctggaattctgtttggcttcttgttggtgacctggtaggacacagtgagtcygactgtagttgccgtcccaggtgattcatttactttaaagagcctggcccctgacttccagtgatttgatagtgtctgattcttgtatgcactcacagaa

SEQ ID NO: 35177 - DNA, 201 bp, Homo sapiens
attatgagatctcatttttctttgagaagttggcagaaatttaaatggttgaatcatagagtgctggcaaggagcctggaaatgggcacatttatttataygttgctgtaggaagacggttgtctctaaatccttttgggaagataatagttggtgtgaggttgtttttttttttttttttttttttttgagacagaatct

SEQ ID NO: 35178 - DNA, 201 bp, Homo sapiens
cgaacttcttttgatcttgttagaaaggaaaaaatgtgaaccttcaaaacaaccacaagaactggagctccccgcagatcagaggaacagaagagctagcrtagaaatagatccaaatatgtatgggaacttaagataacttacaaccaaaaaattgggtgtaagtagctattgtctcttacgaaacaaagttcaatccct

SEQ ID NO: 35179 - DNA, 201 bp, Homo sapiens
atttggaagctcccccaacccagtttttatggaagcttcaggaggtcagcatttcttctcccgggtatagggtgggaccctcactggggaggatcttaagrcccacagtccaaaagcagggaagatgagagtcctaccttggggcaggtggaaggaggggcaggtggagagattgtttcctgaggcctgacacacccaaca

SEQ ID NO: 35180 - DNA, 201 bp, Homo sapiens
atgaagccgtttacctaattggttaaggactcacccgtgggcctcacaccgcctaggttaattcttcactttataattccgtgatgttgggcaagttcctyattctgagccttgggatatttggcttcaaagctgaggaacttgggagggttggataatggcatcacgttctgtggggagatttggctcacatgttagctg

SEQ ID NO: 35181 - DNA, 201 bp, Homo sapiens
gtagtaaaatgtttaatagttacatgaccattagcataaccccaagattcacagggactgaggaaactaagatatattttaaaagagtttggatatatggyaataaatgaggaagggacagagtgatacttcatggagatgttttgtgttgaagggaaggaacccagttttctaagatttattttctttaagagattgagc

SEQ ID NO: 35182 - DNA, 201 bp, Homo sapiens
ggattacaggcgtgagccaccgtgcccggcctcatcaactttataatgagacagttttgaaggaaatgatgtcattcgaggacctcccatagtcgcttcayggaaggttgcagtttgaaggaaactgtcagcgaccctatgaggacacactgtactggacaacagtggtgtctaagctgagaggggtggcagagttcccag

SEQ ID NO: 35183 - DNA, 201 bp, Homo sapiens
tgttttttccctttctccttagttaaggagactggtctggatttctgaaggtgactgtgctggatatgtatgagctgaaacactgtctgatactgttgagrgacagtagtgagccaggtgatttcttgaatactctgttagaggacttgcgtgcatgtcgaaagtaggagaatcttttttggatgttcaggttggaaacac

SEQ ID NO: 35184 - DNA, 201 bp, Homo sapiens
tggtagagatgggatttcaccatgttggtcaggctggtctccaactgctgacctcatgatccgcccacctcggcctcccagagtgctgggattacaggcgwgagccaccgcgcccagctatcttattttttttcgtgatcattagtagattggtcaaatattgaatacccgtgtgaggaatcacctagggctgtggggtta

SEQ ID NO: 35185 - DNA, 201 bp, Homo sapiens
tgaatagtatatgttgaaggaaacgctaagtgggtggtgcaggggagagaggaagacttgcttgagcacatcgggaagtaggacaggaagggttctctgtytgccttgtaggttctaattgccatggcaataatataattgctgtggccgctgcggtaggcaggagggctgcctgtgaagtcaggatcaccaggctttgtg

SEQ ID NO: 35186 - DNA, 201 bp, Homo sapiens
gccagtttccttctcaagccatcagtagagatgctgatcctgcatctgccagtcattgctccaggagggaagacattactgtcccagagtgacggtgtcaytggggataacagacacttcagaaaatgccaccactgagctgtatgaagtgccatggcagctagtgctggagctgtggattcagccggggagcactgtctg

SEQ ID NO: 35187 - DNA, 201 bp, Homo sapiens
cttcctgcctggttgctcacatgatgtcattgtctccggggcggattattctagtggatcttgctctgggaaccatgattgtataacccatcagtcccatygagggctgttcacctcgcgcaactgctagcagtccagggcctggggaacttcgaatttcaggaattttctgaccatccttttctggactgtttaggatga

SEQ ID NO: 35188 - DNA, 201 bp, Homo sapiens
aattagagatacccacatctatttaggagaagccttggcccgtgggtatggggttctcaagttttttggatattacctggtgtttaaaggggacataattrtgtaaattattatgattgttcttattatgggcatattgtatgtaatttgttgattttaatctttagtttttggaaaggaacttgcagtaaataattgttt

SEQ ID NO: 35189 - DNA, 201 bp, Homo sapiens
atgaaaaaagcaatggctaagtagtatgttaaactgtgatgactgctacagaaaaggaaaggaagggtaatcaggagtactgggggctcgggtgtgtgtgygaggatattaaatagggtaagtgtcactgagaatgtgacacgtaagtaaagaccttgagttgagggagtgagctgtgtgtctctctgggggaacagccag

SEQ ID NO: 35190 - DNA, 201 bp, Homo sapiens
aatgtggacagatttgagatgggcgtatagctgtggacctttctgatgtatagaatgcagcagacaaggtaaagatggcacttaatgtaatgtaatggggrtgccactctgagatggaaaattctgggaaaggacagttttataaatttataagctatcagatacattataatgctacttttaatttgcttttccttggaa

SEQ ID NO: 35191 - DNA, 201 bp, Homo sapiens
ctgtccgtgtccatgtgtacctattatttagtttctacttataagtgagaacatgtggtatttggtgttctctttctgagttattttacttaggataatgkgctattgttcaattcatgttgctgcaaaacatgtgatttcattcttttttatggccaacatgtggaatttgtccatagaaaagaatgaaatcacacacac

SEQ ID NO: 35192 - DNA, 201 bp, Homo sapiens
ttctgtttctcgtttgacttgaatgcttagctcttttattttaaatcattttgcataattaagaaatatatttaaagcttcatgtttctttcttcggagtrccataccactcatagattctgatacttttttttttctccatatttcaattttgtgtatttcctttttggattcaaaagttctatctgtttcaacttcctg

SEQ ID NO: 35193 - DNA, 201 bp, Homo sapiens
gaaagggtgcagaggttcagctatgcaacatgaatgaattctggagatccactgtgcagcatggtgactatgatactgctttgtgtatttaaaattttcaragagtagatcttgtgttctttcccctctccaaataaaaggaaattatttgaggtgatggatatgtttaactagcttgactggggcaatgattttgtaatg

SEQ ID NO: 35194 - DNA, 201 bp, Homo sapiens
cccaaacaggtatatcaaaaaatgctcagcatcgctgatcatcagggaaatgcacatcataaacacagtgagacgttgcctcacacctgccagaatggctrctgtcagacgaaagacaacaagtgtgggtgaggatgtggagaaaagcgaacacttgtccacctttggtgagaatgtaaattggtatagccattatggaaa

SEQ ID NO: 35195 - DNA, 201 bp, Homo sapiens
cccatctctgcaaaaaataaaaaaattagccaggcatggtggtgcatgcctgtagtcccaactacttgggaggctgaggcaggaggattgcttgagcccargaggtggaggcctcaatgagctgtaatcaggccactgtactcctgcctaggtaagagagtagtgagagcttgtctcaggaaaaaacaaatgataaggaag

SEQ ID NO: 35196 - DNA, 201 bp, Homo sapiens
gctccagctctgtgtgagatggaggcctggacaagctgagtctccccaggaagctctttggtagcgtcctttctgacagcgcagaccggggatcctcgatygggaatcattgcctggccacccattgtcaaatgttaaaagatgtagaaagttatttaactggagaaggtgtggtgccacgtggtctgaacgtgccccaca

SEQ ID NO: 35197 - DNA, 201 bp, Homo sapiens
acctctcgtccctgtcaaggtacagtgacaactgggaagccatcactgggacgggggacccggagcactacctcatcaatgtctgcaagtctctggccccrcaggctggcactggtgagagagggcctcctcgtggggtggtgtttgcagtgagtgtatcacaggccagcactggtgagagggggcctcctcgtggggtgg

SEQ ID NO: 35198 - DNA, 201 bp, Homo sapiens
gtgtgtgtgtgtgtgacagagacagagagaagtcgagtctaaagttctgtcaggcttagactatgcctgaatacttgaacgtttctagacagagtgcccartgtttaaagagaatacgaccaagcctaactaactgcgggttttcttcttttcagagatggggctggcaactccttcgacctctcgtccctgtcaaggtac

SEQ ID NO: 35199 - DNA, 201 bp, Homo sapiens
tatttatatacaaggaataaaattttgattttctttgcacataaagcatttttcctagagatatgtgtatgtgtgtgtgtgtgtgtgtgtgtgtgtgtgtrtatatatatatatatatatatatatatatatgtattttttttgagatggaatctcgctctgtcacccaggctgaagtgcagtggcgtgatcttgtctcac

SEQ ID NO: 35200 - DNA, 201 bp, Homo sapiens
tgcatgtgatcgtccacagagctgctctcaacagctttgccagatcgccctctggacacctggggtcccatccttagagattttggttttgtgggtctgcrgttctgttttttggagggatgccctgtgttctgccgtgtgaaacacccagtatgagccacttgatcactgttgactttcctgggggaaagtgcaggtgat

SEQ ID NO: 35201 - DNA, 201 bp, Homo sapiens
taaaatgaggagtcgggctaggttaactctcagctccgtcaccacctggagctgctgtggtgactgcatggggaagggattggagctgaagcagagagtgracccctggcactcttgcgtgatccacatgtcagtgagcagagtgggccaggagcggtgtggtgacccctgcgatgaagggaggtcttcgttgcatgtgat

SEQ ID NO: 35202 - DNA, 201 bp, Homo sapiens
ttgctttaataattagtggtcttgggtgcaggggattagattagtcagttaatttacctaggactcggtttgctcatattaaaatgaggagtcgggctagrttaactctcagctccgtcaccacctggagctgctgtggtgactgcatggggaagggattggagctgaagcagagagtggacccctggcactcttgcgtga

SEQ ID NO: 35203 - DNA, 201 bp, Homo sapiens
ttttgctttaataattagtggtcttgggtgcaggggattagattagtcagttaatttacctaggactcggtttgctcatattaaaatgaggagtcgggctrggttaactctcagctccgtcaccacctggagctgctgtggtgactgcatggggaagggattggagctgaagcagagagtggacccctggcactcttgcgt

SEQ ID NO: 35204 - DNA, 201 bp, Homo sapiens
agtaagtccatggatgtgttgtctcttttggacagactaacttggtatgattttgctttaataattagtggtcttgggtgcaggggattagattagtcagktaatttacctaggactcggtttgctcatattaaaatgaggagtcgggctaggttaactctcagctccgtcaccacctggagctgctgtggtgactgcatg

SEQ ID NO: 35205 - DNA, 201 bp, Homo sapiens
tgtgaccgcggcacccagcgggtgagcatgtaccgacggccctcagcggggtcttctccccaccctcaggctgctgggatcatattagaaagaatctgtcytcagatctcatcaaatctcctggttaactgagtttaaaataaccatttacagaaaatatgttgaaactttcatcagttagtattgattttcatgaacgta

SEQ ID NO: 35206 - DNA, 201 bp, Homo sapiens
cccttagaaaagtttggagaaaattttaaaaaataaactcaatacatggaagtattgctggatagtagatgagtattaatttatgattattctttaaattrtatatatacattatgtactatcttgtttatgtattatttctaaacagttaaaaacagtaaatataccccattcagggctcaccaaaagtaaccaatgata

SEQ ID NO: 35207 - DNA, 201 bp, Homo sapiens
gtaggaagtgagggggatggtggaagtactggcccgagctctgttttcaggagtgtgtgacagcaaaaactggcctttgcagttgagttgcctgtgggctrtggcctagagggaaggccaggagggtcttgctgttagggctgccaccttcttcatgcctgctgtgtgctgggaggagagagctccttcagagcggaccca

SEQ ID NO: 35208 - DNA, 201 bp, Homo sapiens; identical to SEQ ID NO: 7640

SEQ ID NO: 35209 - DNA, 201 bp, Homo sapiens
tcacaggctgactggaatccagaaaggaaagcaacacccgttgcctcagccacttacgccagcacatttttttgttatttttttccctcaagtttctctcrtggttacaactgatttccttgaagtatttaataattaggttgtttccactgtttttggctgttctttaaaaaaaaaacaaaacacacacacacacagtag

SEQ ID NO: 35210 - DNA, 201 bp, Homo sapiens
agcccatcttctttccactcaatcacaacaaatacattagggtatatataacctgtcacggctactcatttgtcattcagaatgtgggagaaatgcagccrccaccagccccctggtggtgcagatgggggtggggctggcgggggtggggctcctgcccatgccctctctacactggagtaattattgtctccttttttt

SEQ ID NO: 35211 - DNA, 201 bp, Homo sapiens
tggcagctggtcttctgtgtgggtttgagggaccaggccaggctaggatcccgtccatgttgaatgtttagagttcgacttctgtgagtaggaaaagcacygtttatagggctttggtgtttgactctaaaaccagagaggaagattctccaggaaacctcggtttcatgatgttcagaacatcaggattgggagctgttt

SEQ ID NO: 35212 - DNA, 201 bp, Homo sapiens
ctgcttgggttgctaaacaggtttcgttaatttctgctttggatatgagacacattctcaccctttggctgtgtggctgtgctttcaaaagactttgtgtyttggggtagctgaagccctgacagtaggggacaatgtcagtttacagttggtgctgatgcatgttgcaagccatttggtctttcttgccctggaagggca

SEQ ID NO: 35213 - DNA, 201 bp, Homo sapiens
ttactaagaaggactttggaacagagttttaatcctttataacaaaaagcaagtgaaccaagaagtaagcggcctcctgcttgggttgctaaacaggtttygttaatttctgctttggatatgagacacattctcaccctttggctgtgtggctgtgctttcaaaagactttgtgtcttggggtagctgaagccctgacag

SEQ ID NO: 35214 - DNA, 201 bp, Homo sapiens
tttaaaagcaggttcaggcatgtccatgtctttactaagaaggactttggaacagagttttaatcctttataacaaaaagcaagtgaaccaagaagtaagyggcctcctgcttgggttgctaaacaggtttcgttaatttctgctttggatatgagacacattctcaccctttggctgtgtggctgtgctttcaaaagact

SEQ ID NO: 35215 - DNA, 201 bp, Homo sapiens
ctaacttatgaaaatggcttgttaaaaatgaacttcacggggggggacacttgccataaggtttatcagcgctccacagccatcttcttctactgtgaccrcggcacccagcgggtgagcatgtaccgacggccctcagcggggtcttctccccaccctcaggctgctgggatcatattagaaagaatctgtcctcagatc

SEQ ID NO: 35216 - DNA, 201 bp, Homo sapiens
actcactttgaaaatgccaggctatgagaatagtgagaatctgttaaaagcattcaataaggaattgtgagcctcgttggattttaggaattatctcggtrttcagaattgctggtgtgtctttaaaagcaggttcaggcatgtccatgtctttactaagaaggactttggaacagagttttaatcctttataacaaaaag

SEQ ID NO: 35217 - DNA, 201 bp, Homo sapiens
gggacccgaaccaaaccttgtttaatgttctccttctttacaggtctcctgactcagaagctaacttatgaaaatggcttgttaaaaatgaacttcacggrgggggacacttgccataaggtttatcagcgctccacagccatcttcttctactgtgaccgcggcacccagcgggtgagcatgtaccgacggccctcagcg

SEQ ID NO: 35218 - DNA, 201 bp, Homo sapiens
cagtaattgcttgatgcactctggaatcctgaagttggctagagctccctgacatgggctaaagccataactgggaacagaaggaaccacgtggaaaatamtacatcatctttttagtttgtaacctgaagaataacattgccagtgtttgtgtacaagtgattttattttattttttaacaactttattgcctagaatcg

SEQ ID NO: 35219 - DNA, 201 bp, Homo sapiens
tattcccaaagtgtaatgtgacaggagtgcatggtatggtgctgggaggccagggatactttgtctcacactcttcagggtgtgtggtgtcacatgtcttrggctaagtttgacagcctagggacccgaaccaaaccttgtttaatgttctccttctttacaggtctcctgactcagaagctaacttatgaaaatggcttg

SEQ ID NO: 35220 - DNA, 201 bp, Homo sapiens
atcacatgaaggatggtaaaaatttttcattcataactcaaatgtcagtaattgcttgatgcactctggaatcctgaagttggctagagctccctgacatkggctaaagccataactgggaacagaaggaaccacgtggaaaatactacatcatctttttagtttgtaacctgaagaataacattgccagtgtttgtgtac

SEQ ID NO: 35221 - DNA, 201 bp, Homo sapiens
agtacgtggacagccctcaggcacagtggagaaagtgacattcccttaggtgatgaggctaaggaatgcctcatgtcatcatacacgggtcagtctgtgaygttgcagcagccttggacaaggggaagcctgattttattcccaaagtgtaatgtgacaggagtgcatggtatggtgctgggaggccagggatactttgtc

SEQ ID NO: 35222 - DNA, 201 bp, Homo sapiens
gttgtgcctggatggaagatctaggtgatgcttttctagggcatccagtttggaatgagttagaagatctttctgtggttcatctaagcctcctctttctrtaatcacatgaaggatggtaaaaatttttcattcataactcaaatgtcagtaattgcttgatgcactctggaatcctgaagttggctagagctccctgac

SEQ ID NO: 35223 - DNA, 201 bp, Homo sapiens
ttaggaacttgtaaaaatgaagtcaaagtagctggtggtgagtacgtggacagccctcaggcacagtggagaaagtgacattcccttaggtgatgaggctraggaatgcctcatgtcatcatacacgggtcagtctgtgacgttgcagcagccttggacaaggggaagcctgattttattcccaaagtgtaatgtgacagg

SEQ ID NO: 35224 - DNA, 201 bp, Homo sapiens
gaaatcagcattgcttttggctaaaatacacttttgttttgttacagaaccagagcagaattgggaagctgtggatggcagtcagacggaaacagagaagmagcattttttcattaatatttgtcacagagtgctgcaggaaggcaaggcacgagggtgtcccgaggacgcggcagtgtgtgcagtgggtgagttgtgcct

SEQ ID NO: 35225 - DNA, 201 bp, Homo sapiens
tttcacaaagtggcaggtaccattgtttgtcgttttccttttgttgcaaaggaatggaattaaaatattaaaatattttgctgaagatgaattttcccttragtcagaaacatgagtgttctactgtaaaaaaaaaaaaaagcatattaatgatatttcggattttgcttgattttcttaaacagagtacatactgaagga

SEQ ID NO: 35226 - DNA, 201 bp, Homo sapiens
aagcgctatgacctgtccgcgctggtccgccatgcaggtactgccctccttgccatgcgggtcttagtccacatgctcatggaacattttcccatgagtayttttggaaatgcggttactattttctttgtcagtgggttgcgtcacagccctcccccagttttttcatgtggctgtgtgaattattagaaggagcattgg

SEQ ID NO: 35227 - DNA, 201 bp, Homo sapiens
gcttttttttttactgaagcatattgctaatttcacgagtgacattttccttgtgtgcctggattgatgggattttggcgtctgatgcttgaagacactawtgtggggtttggttttgtgttgtttgatgaagcaagtctttattcggggacctagactttcctagaaagctgtttgccaggcgatttgtattatatataa

SEQ ID NO: 35228 - DNA, 201 bp, Homo sapiens
ctcctctgcggtgccaccgacgggaagaagcgctatgacctgtccgcgctggtccgccatgcaggtactgccctccttgccatgcgggtcttagtccacaygctcatggaacattttcccatgagtacttttggaaatgcggttactattttctttgtcagtgggttgcgtcacagccctcccccagttttttcatgtggc

SEQ ID NO: 35229 - DNA, 201 bp, Homo sapiens
cccgttgtcagagtggaaggtaggactgggcctgtccctacaagtcattttaaatgtatagagtagcagacgttctgaacgatgccttagatatgagaccrtgtgataacagccatagctggggtcatgagacacacgctagggggaggataatttcttttccttgagcttttttttttactgaagcatattgctaatttc

SEQ ID NO: 35230 - DNA, 201 bp, Homo sapiens
gatcttgaactcctgaacttgtgatccacccgtctcggcctcccaaagtgctgagattacaggtgtgagccaccgtgcccggccccatttgattaattttyaaaataaacaggaaacaaatcaggctgctgatttatattacagggctcaccagcatttcagcttcaggatggttgtgagtacgtgtttatctggagaact

SEQ ID NO: 35231 - DNA, 201 bp, Homo sapiens
cacctgccaccacgcccagctaacttttgtatttttagtagagacggggtttcaccatcttggccaggctgatcttgaactcctgaacttgtgatccaccygtctcggcctcccaaagtgctgagattacaggtgtgagccaccgtgcccggccccatttgattaatttttaaaataaacaggaaacaaatcaggctgctg

SEQ ID NO: 35232 - DNA, 201 bp, Homo sapiens
cggtttgcttccccacatcagccctgtggaacagtccattcagcagcccctgcttcagctactcccaagcgagaatgtggggccctcccggagcggagccrcaccgcctgtctctgggccccatctgtgtgtggacatgtccgtctcctaccctgcactctcgcctctgcattcctggcacccagcagcaccagccacaaa

SEQ ID NO: 35233 - DNA, 201 bp, Homo sapiens
gtctcgtgagtgccttcccagtccacccgcggcgccacaccctcagcatgtgaacttcagactgcttgacgatggttggctcttttgggttctcaagatgsgaatactatgcccatgtgaggctgatggtggttgagttgtgactgttcctggaagcagcccgcagtgtcaatcctggcacagagggtggttctgaggtca

SEQ ID NO: 35234 - DNA, 201 bp, Homo sapiens
aggggcccagagcacctcaaagcccttggatgtgttcatgaatcttagagtgtagtgacagtcctagttagtaaggaaaggcagagctgtattcagtccayccattgcatctgtttataagcgtattggcatatttttataggggtgtctgggtgtgcctctgtagatgcacacagcatggggcaacgtggattttgcctt

SEQ ID NO: 35235 - DNA, 201 bp, Homo sapiens
cctttctgaacatgaggagatgaagatataatagatagaaataatagccatggtgaggaatccttcttagcaggtagaagatggggggtgtgacgtggagrtcttggtgtgtgcctgcgtatgttgagagttgtatggtcggtccttttgtgatgcagggacagctcactcaaacctgcagtggttggctgagactggatg

SEQ ID NO: 35236 - DNA, 201 bp, Homo sapiens
aaattacattgttattaactgtggttgtggtggtgtttaatggatctcttgggcaggtcattcttgttgactaatggaatgtccccttccccagcctggawtccctcatgttgcactgctacttgattctccctggtcctggggaagagcagactgtgttccttctgccgcttctccatgcccaccaccccagatcctaaa

SEQ ID NO: 35237 - DNA, 201 bp, Homo sapiens
ctcaattttggtcacgtatggagtttaaatttctcctcttgaattgtgcaggtaacgatgggaaaggaactcctgtattcacaggggaggttgactgcacytacttcttcacatgggacacggaatacgcctgtgttaaggagaaggaagacctcctctgcggtgccaccgacgggaagaagcgctatgacctgtccgcgc

SEQ ID NO: 35238 - DNA, 201 bp, Homo sapiens
caggtcttgggagctgactgggggcctggcgtggtggcggcagcccgcagtccctgcctggcccttgtctgggaggccgcggttctctgcggcctctcgcyggtgtcgcccttggccactgggctgcgaggaagccggcgaggagtgggtgtgcgccccgcccggctctaccggcgagggatgcagtggccgccagcgtgg

SEQ ID NO: 35239 - DNA, 201 bp, Homo sapiens
ctctgggagctgaccacagcccgggagcagaggatcccactcactgctcttgcgttcctcctgcctgcccttttaatcttatctttggagatgctgtacayagccttctgtcaatgtctcccaaggtgaaaggcatgctggcctgccatcgaggacttagggttaagcatctgaagcttaatagaagcctgtgtcaactca

SEQ ID NO: 35240 - DNA, 201 bp, Homo sapiens
cttccggtggtacaccagctatgcctgcccggaggagcccctggaatgcgtagtgaccgacccctccacgctggagcagtacgacctctccaggtgaggcrgagtcagctgctctgtttttggcctggtacagatgctgaggttgcaagtgttgctggtgagcgtgtgactgagctgatgatggggagtgatgctggctgt

SEQ ID NO: 35241 - DNA, 201 bp, Homo sapiens
agaaaaataatacatcacgatcaagtgggttttattccagggttgcaaggatggttcagtgtatgcaaatcaataaatgtgattcaccatttaaacaattwaaaaaaaagtctgaccatctcaggagatacagaaaaagcatttgatgaaattcaacatcccttaatgaaaagacaacactcaaaaaatattagaagggac

SEQ ID NO: 35242 - DNA, 201 bp, Homo sapiens
tgagtcccagagaacttgtcttgttcacagtcgcatcactaagtcagcagtgcacagggaactagagctccatttctgtcctcctttctgtgagtccccaktgtcacccagagatgttcaggagcctctgggagctgaccacagcccgggagcagaggatcccactcactgctcttgcgttcctcctgcctgcccttttaa

SEQ ID NO: 35243 - DNA, 201 bp, Homo sapiens
tgagttgtgtcactgttggactctgctgagctgagtagtctcattaaaggagagtgtgcatctgagttgaggaagacaatatagatgtggaccttgtttgyagagttcacaagctgcttacatagaaatagcaaggacagtgcagccagtgggaaggagccggctgagggacttgatattatttccatggaaaccagttgg

SEQ ID NO: 35244 - DNA, 201 bp, Homo sapiens
gtttaaaacttgcctgtgttttcgtggagtttcagccattgctagggtttgacgagaatgcactcatttcttcaggtcttaaatgtttaataaatgttacrtagtttgcacatggaggtcaaagattgggtactaactgtggctatcatttatttaatttttttttttttttttttttttgagatggagtcttactctgtc

SEQ ID NO: 35245 - DNA, 201 bp, Homo sapiens
tgcctcctccttaggcagagagctccttggttccatttgaaaaccttccttccccttttgctggaattgagagactgaggacacaaagtggtgtgctggakaataaactagagcctgtggtgccagactggcaacttggggattgtgtgagtgagggagagattgtgcagagctaatcctaacattgctgatgagtggaca

SEQ ID NO: 35246 - DNA, 201 bp, Homo sapiens
ttgtcctgagaggtcccaggaggcagttgagtgtgtatgtgtgcgtgagtgcgtgtgtgagtgcacgagtgtgtgagtgcaagtgtgtgtgtctgagtgtstgtgagtgcaagtgtgtgtgtctgagtgtgtgtgtgtgagtgtgtttgtctgagtgcgtgtgtctctgtcttcatcagctcctaggagatgcctccggac

SEQ ID NO: 35247 - DNA, 201 bp, Homo sapiens
tgcctgcgaggctctctctgggaggaagtcaggtctttctttccttcgtttccttcctttcattcctttcctttccttcctttttcctctttctttctttyttttctctctctctctttttctttctctctttctttcgagatggagtctcgctctgttgccaggctggagtgcagtggcatgatctcggctcactgcaat

SEQ ID NO: 35248 - DNA, 201 bp, Homo sapiens
tgtttaaaacttgcctgtgttttcgtggagtttcagccattgctagggtttgacgagaatgcactcatttcttcaggtcttaaatgtttaataaatgttaygtagtttgcacatggaggtcaaagattgggtactaactgtggctatcatttatttaatttttttttttttttttttttttgagatggagtcttactctgt

SEQ ID NO: 35249 - DNA, 201 bp, Homo sapiens
cagcctgtatcttccccatgtgcccagcccctctgatgcctgaccttggttctggctcccaggtcaccccaactggctctcctggactccggctggctcargctgctctgctgtggtctgaatctccctgcaactttgtgatgacctcctttggcctgttctgttcagggctttttattaatgacttggccgagatctttg

SEQ ID NO: 35250 - DNA, 201 bp, Homo sapiens
aagaaatatatttaaagcttcatgtttctttcttcggagtaccataccactcatagattctgatacttttttttttctccatatttcaattttgtgtattycctttttggattcaaaagttctatctgtttcaacttcctggacccactaaatttttagatttttatttttttcaggtccatggactttgggggttttaaa

SEQ ID NO: 35251 - DNA, 201 bp, Homo sapiens
tttcccatttcccttgaacctctgaatcttctatcttgtttaaaacttgcctgtgttttcgtggagtttcagccattgctagggtttgacgagaatgcackcatttcttcaggtcttaaatgtttaataaatgttacgtagtttgcacatggaggtcaaagattgggtactaactgtggctatcatttatttaattttttt

SEQ ID NO: 35252 - DNA, 201 bp, Homo sapiens
gggaaagttttcatcttgaattttggtgcacactaaactacagcaaggacagattcggcaggggcgggatggcttgtcaattttgattgagtgacctcttyttttatgtaatgagtatcaagataatcctttttgcaaagtggtgaccctatggtagagtttggatctggggattgcagaatgtcactgggtgcgttgaag

SEQ ID NO: 35253 - DNA, 201 bp, Homo sapiens
aatctgggtgtggtgcagatgagtccccaagccgcggcgaatggatctttgagcatcatgtatgtcaacggtgacaagtgtgggaaccagcgcttctccascaggatcacgtttgagtgtgctcagatatcggtgtgtgttcagaccagcaatgagatgttgtccccgggtgactccatttcccatttcccttgaacctct

SEQ ID NO: 35254 - DNA, 201 bp, Homo sapiens
tactttgaagcgagaggatgtcaagtccatacatttggaactcatttcctgtagatatttttccctagctggctagagagcttgctgttttagatccgtartgatttgttgatgctacgcaaaaggcttaatgtagacatttaaaaagattcaagtttttttcttggttctcccaaacacatttgtctgtgtattcacaaa

SEQ ID NO: 35255 - DNA, 201 bp, Homo sapiens
tggaaatgagtacgacctgactggcctaagcacagtcaggaaaccttggacggctgttgacacctctgtcgatgggagaaagaggactttctatttgagcrtttgcaatcctctcccttacattcctggatgccagggtgagttctccttggtctcttgattggcgtctgttcattttattagagcatttgactcaaggtc

SEQ ID NO: 35256 - DNA, 201 bp, Homo sapiens
agtatagtccaaggcccctcaggcacggctgtgttcatggcggctgttaagaaggctgtctaattcttgggcgttatttattttgtacgaaatctaaaagygagaacaagagaagtcttcatgctcacagcaaaaccttcggcactttcttccagccagttactactttgaagcgagaggatgtcaagtccatacatttgg

SEQ ID NO: 35257 - DNA, 201 bp, Homo sapiens
aaggaggcagagttctccagcgtggttttttgttgtgtttcagacctggctggaaatgagtacgacctgactggcctaagcacagtcaggaaaccttggayggctgttgacacctctgtcgatgggagaaagaggactttctatttgagcgtttgcaatcctctcccttacattcctggatgccagggtgagttctccttg

SEQ ID NO: 35258 - DNA, 201 bp, Homo sapiens
ccttaacttggtagttgaccttcataaaagcaggatgaaaatgcagttttctgaaaatgtgttaggggcagttacgattcaaaaattaggaacagaaaacygcaaaaaccccagaactggtctttgagctttttaaaagcatggaatatctgccgagaagctgcattttaaacattttatttttgcttctttcaaattgtt

SEQ ID NO: 35259 - DNA, 201 bp, Homo sapiens
ctaagtgatcctcctgcctcagcctccaaagtagctgactacaggcgcatgccaccaggcccggctgtgaagggcagttttgagggacagagtgggtgtgktttgtaggcaaagcctctcagcctcccgtggatttccttatcctcacagttaggaatgccaggttcacgcctcctcagggcttatttagggtgaaaggca

SEQ ID NO: 35260 - DNA, 201 bp, Homo sapiens
ggagaatcagttactccagcattccttcctagtagacttcggcaagttgccgtttgtcactaaacaatcaaatgtttttcctggctttagagtaagaatgyttctgttagaactgttcactttataaacttgctgtttgtacggaacctactgtaggaaaagtatttaatgagtttacagttgatagggttttttatttta

SEQ ID NO: 35261 - DNA, 201 bp, Homo sapiens
actcagggcccctcaaattcctgcatcaagatatcgactctgggcaagggatccgaaacacttactttgagtttgaaaccgcgttggcctgtgttccttcyccagtggactgccaagtcaccggtaaggccgtgcggcctaagaactgagaggccggtcaagagtcagtgtgtgtgtgagtggatatgaaggtgtgtttct

SEQ ID NO: 35262 - DNA, 201 bp, Homo sapiens
tgtgtaaacctgtcataggccactgttgtagcgagtgtgaccactttgttcatgtcgagtccctcgatacacacttggtgccctggtgtcattgctcccaygaacggctgtgaagcttgttgccagtggcagccttgtcctgttgctgcactgtgcttgtgggctgcgccatgaatactgttctgtctcttaaaatctggg

SEQ ID NO: 35263 - DNA, 201 bp, Homo sapiens
gtgtgtaaacctgtcatcacataggccaccattggagcgagtgtgtaaacctgtcataacacaggccaccgttgcagtgtgtaaacctgttgtaacacagrccactgttgcagtgagtgtgtaaacctgtcataggccactgttgtagcgagtgtgaccactttgttcatgtcgagtccctcgatacacacttggtgccct

SEQ ID NO: 35264 - DNA, 201 bp, Homo sapiens
cggagcctctgctgtctgatgtttggctccagcatcttcaaagcaggggcttttctcctctgtccacctgattggcctttgtgaggaaccaccacctggcrgtggcctcattagcatcatgggccagccagctgagctgacagcccgcaggttttctagaaaggcccaccttcccttgtagtttgcacactccaggaaggg

SEQ ID NO: 35265 - DNA, 201 bp, Homo sapiens
ctctattaattatttttccttgggcccagtttctttggtttgagtttgtcaccatgattgcatggtgctggtgcccttgcagtgacaggtgactcctgacygtgcactctgcagtgggtctccacccgaccttggctgcctccttgtgcagctgcgtggggtagggctgggagcagttgttggaatttggctgtaaattgt

SEQ ID NO: 35266 - DNA, 201 bp, Homo sapiens
gtcgctgagtcgggggtggctttgtgcggagcggtcgccccggcccttggggtcggcgcctgccctcgcgcggccgggcgtccgggaaagttggaggcagraactccagtttgctttgttcccgctgcgcgtttgcatcagagtttcgccagcggggcaccggtgaggcccctcggtgtggagaggctcaccggggcgttg

SEQ ID NO: 35267 - DNA, 201 bp, Homo sapiens
aagactttgaaatggaccaaaaatattagtggtcaactgtaatggaatgctagctgtttagtacagtcttttgggttatctgattctatggggtcttgtgyctgccactgtctttgaggtattttacaactctgtaaattgtagactactgatggtaatatacacgatttttgtctttagaaatgcaaattgtgtctattg

SEQ ID NO: 35268 - DNA, 201 bp, Homo sapiens
gttttgccatgttgcccacgctgatcttgaagtccttgcctcggtgatcctcccacattggcctcccaaagtgcgtggattagaggcgtgtgccttgggaytggcctgcataattttcaagtgcgttgtgtgtattcttgtgaaacataactccctctccttttcttcctctttccattttccgtaaggtacgggagaatc

SEQ ID NO: 35269 - DNA, 201 bp, Homo sapiens
gtgcattgcagccttgacttccctgcctcaagtaattctcccacctcagcctcccgagtagctgggactacaggcaggcaccaccatgcctagctggtttytgtagtttttgtagacatggagttttgccatgttgcccacgctgatcttgaagtccttgcctcggtgatcctcccacattggcctcccaaagtgcgtgga

SEQ ID NO: 35270 - DNA, 201 bp, Homo sapiens
aggaagaaggggatcgagagagggaacgggacagtaggggccaagtcagtccatgcatgcttctgggttggagagagctgtagtttgggctggtgtttcaraaataggattcaggtttgactaagtaagactgtaatcttctaatacctattcatataaaacaagcctcttcttgttaatttccctgtttttaggttcatc

SEQ ID NO: 35271 - DNA, 201 bp, Homo sapiens
gatacatggtaggaacttagtatttgttcaataagccaacgaattagagttacattgtcttctaatgcttggattggtaaactcgtgggatttaaatattytctggaagagtaggaatgccaggatgttaggcttatggtagaaacctgtcataacataggccgctgttgcagtgtgtaaagctgtcatcacataggccac

SEQ ID NO: 35272 - DNA, 201 bp, Homo sapiens
tgcctcctggcgctgcttaggaagaaggggatcgagagagggaacgggacagtaggggccaagtcagtccatgcatgcttctgggttggagagagctgtartttgggctggtgtttcagaaataggattcaggtttgactaagtaagactgtaatcttctaatacctattcatataaaacaagcctcttcttgttaatttc

SEQ ID NO: 35273 - DNA, 201 bp, Homo sapiens
tttgtacttgctcctcgctctgcaaccagcacagctgcaggcaggggttttcgtctgcttcattcattccgatacatggtaggaacttagtatttgttcartaagccaacgaattagagttacattgtcttctaatgcttggattggtaaactcgtgggatttaaatattttctggaagagtaggaatgccaggatgttag

SEQ ID NO: 35274 - DNA, 201 bp, Homo sapiens
ctgagtatgcctgccacagagattacctggaaagtaaaacttgttctctgagcggcgagcagcaggatgtctccatagacctcacaccacttgcccagagyggaggtaagcaggtgctttctgcctcctggcgctgcttaggaagaaggggatcgagagagggaacgggacagtaggggccaagtcagtccatgcatgctt

SEQ ID NO: 35275 - DNA, 201 bp, Homo sapiens
cagtcagagtgatgtttctgaaacatcacatcatatcacttcccagctcagagccctcggaggctctgcactgtacctagagtagaagccagtgtccacartacggccatgggacgcccgtgggggctctctgagatgatcaccccctgctgctcttcccgcttggcccgctggcctccctgtttctgatataaacaaagt

SEQ ID NO: 35276 - DNA, 201 bp, Homo sapiens
agcaaaatgtagaaacctaacaacctgtctttgagcttttcataagtgtggaaaatctgcattaagctgcatgaaacattttttattttgcttctttcacrttgttcctgatagggcaccattcccaaactcacagctaaatccaactgccgctatgaaattgagtggattactgagtatgcctgccacagagattacctg

SEQ ID NO: 35277 - DNA, 201 bp, Homo sapiens
ttggcaagttaactaacaaataagaaatgtttaacctagtgggatttggagttgctagggttcttgtctgtggtgagatacgaggcataaatttgtttgtrtggctcttaccgtctgacctgcagtttaatgtctgcggcacaatgcctgtctgtgggaccatcctgggaaaacctgcttctggctgtgaggcagaaaccc

SEQ ID NO: 35278 - DNA, 201 bp, Homo sapiens
acagaaacagcaaaatgtagaaacctaacaacctgtctttgagcttttcataagtgtggaaaatctgcattaagctgcatgaaacattttttattttgctkctttcacattgttcctgatagggcaccattcccaaactcacagctaaatccaactgccgctatgaaattgagtggattactgagtatgcctgccacagag

SEQ ID NO: 35279 - DNA, 201 bp, Homo sapiens
catttatagatacggggatgtatgaatttaaatgatgtatagatactaaaccttaaaggcagtttatagatactgccctttggacttatgtactaactgtrctaacatgccagaaagtggaaagttggcaagttaactaacaaataagaaatgtttaacctagtgggatttggagttgctagggttcttgtctgtggtgag

SEQ ID NO: 35280 - DNA, 201 bp, Homo sapiens
aagggaatagagtgtaaagaggaaatggaggtgttacgagtcaaatggaaaaaaaataacagtttagaaaaaaattaaaagtaactttactgagttgttayaagtcaaataatcttaatgtgttagaggcaattatgattcaaaaaacagaaacagcaaaatgtagaaacctaacaacctgtctttgagcttttcataagt

SEQ ID NO: 35281 - DNA, 201 bp, Homo sapiens
taacattatgacttctgtgtcttccctctcttatatatggtacattattacatgcagtagatcttacacatttatagatacggggatgtatgaatttaaakgatgtatagatactaaaccttaaaggcagtttatagatactgccctttggacttatgtactaactgtactaacatgccagaaagtggaaagttggcaagt

SEQ ID NO: 35282 - DNA, 201 bp, Homo sapiens
agcttctgtcacatgcagctcactcagggagagctgtttgcattttgccttttgcttttttacagcaatccggaggggcctccacatataatgggatggtrttttgttctagtctctgtgagattattttaagtagttcacggacagatttttttttggtagttgggttgttttagtgaatagtggaaaaacgaagtagaa

SEQ ID NO: 35283 - DNA, 201 bp, Homo sapiens
accagagagcataattgacttcatttttacaactataatataataatttttaatggaataacaaatttaagaaatgtagggtaccactttatatttacttrtaattaacatgatttcaatgatacatactttctcataattgaaaatattataacattatgacttctgtgtcttccctctcttatatatggtacattatta

SEQ ID NO: 35284 - DNA, 201 bp, Homo sapiens
gtgactattacatttgtttgcccgtcggagcggagagaggtaagtgactcgtctcctgatcactaatgtggcgcacagtagcctgggttgcccatgcgaaygcgtttctgggcttggggcagggtgggcctggatgcaggaagctgggagccatgacagaggcactggtgggttctcaggagaagacaagcttcctgggat

SEQ ID NO: 35285 - DNA, 201 bp, Homo sapiens
taataagttgttctctttaaggaaacactttctaaaggtagtgctgaagcctgtactcattgtccattggtctctccttactgtatcttcacaccagagarcataattgacttcatttttacaactataatataataatttttaatggaataacaaatttaagaaatgtagggtaccactttatatttacttgtaattaac

SEQ ID NO: 35286 - DNA, 201 bp, Homo sapiens
ctctataagggatcccaacagtggatttgtgtttaatcttaatccgctaaacagttcgcaaggatataacgtctctggcattgggaagatttttatggtargagcgatatgatgcatttccagtttgctttgaaacagggggagagtgcattattgaagtcacctgcacgtggtgatatgagagaattgcccaggccactg

SEQ ID NO: 35287 - DNA, 201 bp, Homo sapiens
cccatgattaccttaagggaataattgagacagaaaacagaacatgagatttcttaagatgtttattttctttaagaaactaatttatgagtcttatattycctctccaactttagggagtagcaatagtcttcttagggaaatgcagtagccttaacagcttccaggtgagtgtaatttctgagtctgggctcacacttg

SEQ ID NO: 35288 - DNA, 201 bp, Homo sapiens
ggcgacggactggtgtggtcctgttagtcatgtgaaaaagtccttgccctaatgttaagttgctctagagggccctctgctgttggattccaaagcccatsttctttccactcaatcacaacaaatacattagggtatatataacctgtcacggctactcatttgtcattcagaatgtgggagaaatgcagccaccaccag

SEQ ID NO: 35289 - DNA, 201 bp, Homo sapiens
ctacctgacttcaaactatgctacaaggctacaataaccaaaacagcatggtactggtgcaaaacagatatatagaccaatggaaccgaacagagtcctcrgaaataacaccacacatctacaaccatctgatctttgacaaacctgacaaaaacaagaaatggggaaaggattccctatttaataaatggtgctgggaaa

SEQ ID NO: 35290 - DNA, 201 bp, Homo sapiens
agattgggcacctgagtaccccagcctgctcttcaggtctgtagctgcttagtggctatcagaccttccaagtctccatgcttttgaaggcctatgtgtgyggtttggtttcttggcaggggggtttgatgggttcccagacctaggagttcttggcgcctcgtcttccagtgaccccaccagggctgctctttctcctcc

SEQ ID NO: 35291 - DNA, 201 bp, Homo sapiens
ctttcttcattcaccagccccaggaagtagctttagttttaagacatcttttcatctttcatgaagaaatgaagtttctatctcttcctgaggcttgccawtccttcgggagggcagagctgtctctcatcaggacgtggagctgctgggcggtttgcttccccacatcagccctgtggaacagtccattcagcagcccct

SEQ ID NO: 35292 - DNA, 201 bp, Homo sapiens
cccagaacagccccctgcgcagccacaagcagcctcttggtggtggcttgagagttggaacctggcggccatgctgccccagtgatacctgcagcttaaarcatgtactcacttttctctcagaccctgcgggttcgagggctcaggtttttcttttaatgggtcacttttaaaagcagacagtgctcgactgaaagctag

SEQ ID NO: 35293 - DNA, 201 bp, Homo sapiens
cttgataattcgaggtgtggagtttggatgggggccgggggtcaccctcctgcatgtggtggcttggtcccaggctaggctgggagaaagggggctgtcgyggttccagggcaagaagagccgtcctccctgtttccctgtggtaggatcaggaagtctcagctaacttctgcacatggtcaagggggtcctgtcctcact

SEQ ID NO: 35294 - DNA, 201 bp, Homo sapiens
caaattctgcagttctgaggtttgcagccttgaggagtccttcctcactcagattcccccaaacaatgaggagcttgataattcgaggtgtggagtttggrtgggggccgggggtcaccctcctgcatgtggtggcttggtcccaggctaggctgggagaaagggggctgtcgtggttccagggcaagaagagccgtcctc

SEQ ID NO: 35295 - DNA, 201 bp, Homo sapiens
cgggtccattttgcatcccaaattctgcagttctgaggtttgcagccttgaggagtccttcctcactcagattcccccaaacaatgaggagcttgataatwcgaggtgtggagtttggatgggggccgggggtcaccctcctgcatgtggtggcttggtcccaggctaggctgggagaaagggggctgtcgtggttccagg

SEQ ID NO: 35296 - DNA, 201 bp, Homo sapiens
ccgggtccattttgcatcccaaattctgcagttctgaggtttgcagccttgaggagtccttcctcactcagattcccccaaacaatgaggagcttgataaytcgaggtgtggagtttggatgggggccgggggtcaccctcctgcatgtggtggcttggtcccaggctaggctgggagaaagggggctgtcgtggttccag

SEQ ID NO: 35297 - DNA, 201 bp, Homo sapiens
gaggcggagcttgcagtgagctgagatcgcaccgctgcactccagcctgggcaacacagtgagactccgtctcaaaaaagaaagaaagaaagaaagaaagraagaaagaaagaaagaaagaaaggtacatggaagattcgattgcttggattgccttagggaactatgggatccctaggtgagggttgcagttgagcatgg

SEQ ID NO: 35298 - DNA, 201 bp, Homo sapiens
atgaatttggatgtactttatacttttgtaatactcttttctcaatgtggctctcccaggcttgtcctgagttacgtgagggaagaggcaggaaagctagrcttttgtgatggtcacagccctgcggtgactattacatttgtttgcccgtcggagcggagagaggtaagtgactcgtctcctgatcactaatgtggcgca

SEQ ID NO: 35299 - DNA, 201 bp, Homo sapiens
ctctagtctgggcgacagagcaaggccctgtctcaaaaataaataaataaatacaataagaaattaacccagctggcctagtgtggttgaagtcttggtcktgttaacaaattgaagtttgttttcttcacagttaagattaaggtggcttcaagggcagactgatactttggctgattgatgggacccttacttttgcat

SEQ ID NO: 35300 - DNA, 201 bp, Homo sapiens
gaacccgggaggcggagcttgcagtgagctgagatcgcaccgctgcactccagcctgggcaacacagtgagactccgtctcaaaaaagaaagaaagaaagraagaaagaaagaaagaaagaaagaaagaaaggtacatggaagattcgattgcttggattgccttagggaactatgggatccctaggtgagggttgcagtt

SEQ ID NO: 35301 - DNA, 201 bp, Homo sapiens
taggccttcaacatacaaattttgaggggaaacagttcagtccataacagagtctttaagtgacacattggtaattcttaatatgaatgagtttgtgtgamgatttagtaacatgtgggacactgagcaagtgtgagcttctcttgtgggaaaaggcaggtcatctgtgatcagctattctctagcaggcagccaggggca

SEQ ID NO: 35302 - DNA, 201 bp, Homo sapiens
agagtgaaacaaagttgagcctactttgggctgaacttggagtttgtggtagggtttatggggggggttcttatttttcccatgcatcagagatagttttrttagcacccctgtgttcagaacatgcagaaattagtctaaggagggtgaggctgatctcacgatagaaactctttggaaaggcccatattttttatgctc

SEQ ID NO: 35303 - DNA, 201 bp, Homo sapiens
catatcctgaacttcgatcaaggattcacattttctccccattcagaggcctttggtagacaccttgttgtgcttgctctagtctggagctcgtggcatgkctgggtggttgtagggagcatgtgcaattataatggcactctgtccaaagaaaaaacttgagcgtaacctgaggggaaaagtgtttggaattttctatgt

SEQ ID NO: 35304 - DNA, 201 bp, Homo sapiens
tcgaggagctcctggggtctccaagtcgcctccgttccgcgccggggtccgccccgttcccgagggaaagttgcctgcgtggtgtccgcgagtcccgccgsgtcccgtgcgcaggcggggggcgcgggggcacacgcggtcgtggcggtcctggagccccgcgtccggccacttgtggctgtcgctgagtcgggggtggct

SEQ ID NO: 35305 - DNA, 201 bp, Homo sapiens
tgtgatcgagacgcgggagtgggcttccctgaatatcaggtaggaatgtttgttcctcatcgcgctccctgaggatactcatgcctgtggtgggcctttcrtttaagcagagcttgtatcagtctgggtttccagccaaatcatcaccgtcattagatttgccagggtgcctgggcagtattagtattttaagctgtttat

SEQ ID NO: 35306 - DNA, 201 bp, Homo sapiens
gtgtatatttctttatggtgggacctgtttgccttcccacttcctgttctaagctacactgcagactctggcagcagagaccaaggcttttccaaaccaayggccccagcacagggtcctggctttgtaactgctcagtgagggcaggatgccaggcaccctgttcatggacaatgtttctggggctgtggccaccgtctc

SEQ ID NO: 35307 - DNA, 201 bp, Homo sapiens
ggcaagagacaggagggacagtttgctggtgaccttcactgggatgtgacagggaccttggttcccagtggggaatggtgttccttataatgtgttgtgcygtgtacatatgctcttgtactgcctttgtatcttgccttggcagacatacgcatttctctagtgtgttgcacatgaccatatcctgaacttcgatcaagg

SEQ ID NO: 35308 - DNA, 201 bp, Homo sapiens; identical to SEQ ID NO: 7637

SEQ ID NO: 35309 - DNA, 201 bp, Homo sapiens
tgagctgagatcgcaccgctgcactccagcctgggcaacacagtgagactccgtctcaaaaaagaaagaaagaaagaaagaaagaaagaaagaaagaaagraagaaaggtacatggaagattcgattgcttggattgccttagggaactatgggatccctaggtgagggttgcagttgagcatggtagctgcttttcctct

SEQ ID NO: 35310 - DNA, 201 bp, Homo sapiens
tgagttgttttcacagcaccgtgtatatttctttatggtgggacctgtttgccttcccacttcctgttctaagctacactgcagactctggcagcagagascaaggcttttccaaaccaacggccccagcacagggtcctggctttgtaactgctcagtgagggcaggatgccaggcaccctgttcatggacaatgtttct

SEQ ID NO: 35311 - DNA, 201 bp, Homo sapiens
gtgtgattatcactcctaacacctaatctgatttaatgtaatacatgattttcagacacactacgagacccaggttcacagctgcgggcctgtccccccgrcactgccgcctgcctggtaagaggacaccaggcgtttgatgttggccagccccgggacggactgaagctggtgcgcaaggacaggtcagtcaaggcctcc

SEQ ID NO: 35312 - DNA, 201 bp, Homo sapiens
gggaaactgaggcccggctaggcacccccgccgcgcccagcccgccgagaggctcaggccccgggaggcacctggagcctgcgccccgcccgcgccgcttmctgtcccgcgcgctgcgctcacgtgacccgggcctgggaggagccggggcgggcgggggtcacctgaacaagggagtcacgtgagcggggggcgggggtg

SEQ ID NO: 35313 - DNA, 201 bp, Homo sapiens
tttccttccttttgtttccattcctttgtgccttccatgtggcagtggtatcctggtgggctctggggcttctgcaccaccggcagatgtctgactagtcratacgtcactccacacctaaaccatctcagtgcctgtcccctagagggtagagcccgtatgttttaatgtgaccctatccatagagcacagcctgcaggt

SEQ ID NO: 35314 - DNA, 201 bp, Homo sapiens
agaggatgggtacatttcttgattacaaataacatcataacctgtttcctgtgcacctcttatataccagtgcagagccagtactttacagtccttcatcmtgagctttgtttgcagagggttaatggcttgcccaaggtttcagaatagttacttagggagacttttaggaattcaataatgtatttaaagggaccctgg

SEQ ID NO: 35315 - DNA, 201 bp, Homo sapiens
actaaaaaagatgagcttttatgatgatgatgattactattttcagtcatgattattttgtatatttactctaaaagaaagtgaatttttttagttcaagwcttttagattcatcgttctactttcattgtggctagctcatggccatccacgtagtgaattaataaagctttgttgagtggcacttgcttgacagcgaca

SEQ ID NO: 35316 - DNA, 201 bp, Homo sapiens
cccagagttcctctccactccgcagctcccagctcctgggataagaaccaggtccctcagtcttactctctgctcactgtagtttccttccttttgtttcyattcctttgtgccttccatgtggcagtggtatcctggtgggctctggggcttctgcaccaccggcagatgtctgactagtcgatacgtcactccacacct

SEQ ID NO: 35317 - DNA, 201 bp, Homo sapiens
tagcttgaaaggggatagtgctaatgttgttgtacctcaagcagaggatgggtacatttcttgattacaaataacatcataacctgtttcctgtgcacctsttatataccagtgcagagccagtactttacagtccttcatcctgagctttgtttgcagagggttaatggcttgcccaaggtttcagaatagttacttagg

SEQ ID NO: 35318 - DNA, 201 bp, Homo sapiens
tgaaactggatcccttccttacacctgagacaaaattaattcaagatggattaaagacttaaatgttagacctaaaaccataaaaaccctagaagaaaacytaagcaataccattcaggacataagcatgggcaaggacttcatgactaaaacaccaaaagcaatggcaacaaaagccagaatagacaaatgggatctaat

SEQ ID NO: 35319 - DNA, 201 bp, Homo sapiens
cttttgttctccaaggataacctttattgattttttggaaaaagactaatacagtctttgtcttaaatgggtctgtaactcaagtttggttatagagttgrtgagttgtagattattgaattctggaataatacgctattttgatttggaaaacatttaggtttctggtctcttaacattttacagatcatctgaatttgc

SEQ ID NO: 35320 - DNA, 201 bp, Homo sapiens
agccttccaactggagttggtataaacccagtttctttagatgctgctcattctcagaacctatgaggtctggtttttgcaattctgtatcaattcttaaytccactaaccttgggaatggttaatttcctgaaatactgtttgccctcgctctttgtttaggatatcggccgggtagcaggaccaccaatactcaatcca

SEQ ID NO: 35321 - DNA, 201 bp, Homo sapiens
aaaaacaagaaatggggaaaggattccctatttaataaatggtgctgggaaaactggctagccatatgtagaaagctgaaactggatcccttccttacacytgagacaaaattaattcaagatggattaaagacttaaatgttagacctaaaaccataaaaaccctagaagaaaacctaagcaataccattcaggacataa

SEQ ID NO: 35322 - DNA, 201 bp, Homo sapiens
ccttggctctgagttacgggctgggtgaaaaagaaaaagggatgatcaaggacttgggtacttggtcgggatgcatatttggcccaagctgacttgttcckttctctgtacttgccaaaactggtgtgagaagctttagcttaagctttagaatctttgataaattaactaaagaccgtaaataaatggtctttatctaaa

SEQ ID NO: 35323 - DNA, 201 bp, Homo sapiens
caggaggattccttgagcccaggaggttgaggattcagtgagccatgattgcactgcagcctgggagacaaagcgagcccctgtctcaaaaaaaaaaaatygggaggcagaggtaggaggattgtttgagcccaggagtctcagactagcctgggcaacttagtgagaccccatctctacaaaaaattagccaagtgtggt

SEQ ID NO: 35324 - DNA, 201 bp, Homo sapiens
ctctcggccagacaccttgggtttcgggattctacagaagtgagggtcggtcttgttctctgtgtgtgcctgaatcccttggctctgagttacgggctggstgaaaaagaaaaagggatgatcaaggacttgggtacttggtcgggatgcatatttggcccaagctgacttgttcctttctctgtacttgccaaaactggt

SEQ ID NO: 35325 - DNA, 201 bp, Homo sapiens
ctttcgtgtgaattctaggcaagaaacctctctgagggagaccttacaagaaggccataatatcatgctcgtcctactttgaacatgctgttgtttattakcccagcagttatgggctttgaatagcgctttaggctaacccagtagaagggaatggtggagttggatccatctccaaggaaaatgttagtaatcgcggtt

SEQ ID NO: 35326 - DNA, 201 bp, Homo sapiens
cccagcactgtggaaggccaacatgggaagatcactcacttgaggacaggaattggtgaccagcctaggcaacatagtgagaccccatctacaaaaaattwaaaaaaaaatttagccaagtgtggtggctcatgcctgtagtcccagttactctggaggctgaggcaggaggattccttgagcccaggaggttgaggattc

SEQ ID NO: 35327 - DNA, 201 bp, Homo sapiens
gtggaaggaagctctgggaggtggacggctccttctgtgagggagtgcttctgtcgtcaagggagtactgcatagggtgaataacacagttatgtagatawatatggtggtcttacccccagggcctccacaactcctggatgggcctagcctaagcaattctgatttaacttattgcccctccttttagcaatactgttg

SEQ ID NO: 35328 - DNA, 201 bp, Homo sapiens; identical to SEQ ID NO: 7650

SEQ ID NO: 35329 - DNA, 201 bp, Homo sapiens
tggtaaggcactgctgctggctggtgaccttcactgctgcattttttgactgagcgttgccttatgtgtctcttaacagcagcagtcttggggtgggtggyggagctaggccagtcttagttctgcttaaggtcagtgtgcggtatatatgttcacaggcagggagtgatttgtggtaccttcatggctgcgatttctgaa

SEQ ID NO: 35330 - DNA, 201 bp, Homo sapiens
cacccccagcagcagtgccattgtttcctttgtgtgtaccatgccccgaatagggtccagtcagggcaccccagctctgtccctctaccctgttcccattkctgcctccctctccttagctcctgggaggcaagtactggtggtgcctcctctgtgtaatcctggaacatcttttgtgtcgtaatacaaatgattgtttgg

SEQ ID NO: 35331 - DNA, 201 bp, Homo sapiens
aggatccatctcgtctgctccaggggcaggctggtaaggcactgctgctggctggtgaccttcactgctgcattttttgactgagcgttgccttatgtgtytcttaacagcagcagtcttggggtgggtggcggagctaggccagtcttagttctgcttaaggtcagtgtgcggtatatatgttcacaggcagggagtgat

SEQ ID NO: 35332 - DNA, 201 bp, Homo sapiens
cacttatcattcagtgggtaagtagaactacctgaaattactggattggcaatatgattccccaattttgcaaaaatgactgtgtatagctatacgtatayagcgatacaaaaattttgaatgtttagaaatcataagtgtttataatacataatacacatttgttagtagttaaaaatgctaacggtttgaatgtctagt

SEQ ID NO: 35333 - DNA, 201 bp, Homo sapiens
actcagagtagctctgcaggggcagagccaggtcccagctactgcacaggggaacagctctttgctccagggacacagcaccacagcctgtcgtctgtgcytctgaaatctctgaagctctgaaaacttggggctcctttgacatgaatggactgaggctatttatggtgtggatttgtcccacctaatgtggatattgat

SEQ ID NO: 35334 - DNA, 201 bp, Homo sapiens
taagtcactgagtatccttgtgcctcaattcctcatctataagtaggttcccatctcataggtttttaaagattcatgcttacatgcttagcagtgtctgstatggaataagcactaaaaaagatgagcttttatgatgatgatgattactattttcagtcatgattattttgtatatttactctaaaagaaagtgaattt

SEQ ID NO: 35335 - DNA, 201 bp, Homo sapiens
gggtcatgattatttatatgtgtttgaattccagctttgccacatcccagagtgtctttgagtaagtcactgagtatccttgtgcctcaattcctcatctrtaagtaggttcccatctcataggtttttaaagattcatgcttacatgcttagcagtgtctggtatggaataagcactaaaaaagatgagcttttatgatg

SEQ ID NO: 35336 - DNA, 201 bp, Homo sapiens
ttgctcaagaaatgttagctattattgggtcatgattatttatatgtgtttgaattccagctttgccacatcccagagtgtctttgagtaagtcactgagwatccttgtgcctcaattcctcatctataagtaggttcccatctcataggtttttaaagattcatgcttacatgcttagcagtgtctggtatggaataagc

SEQ ID NO: 35337 - DNA, 201 bp, Homo sapiens
atgcaataaaggcaccccctcttacaggactgttaggattaaatgagctaaatcacagtgtccgaacacttcagtacttcgtacataattacttgctcaakaaatgttagctattattgggtcatgattatttatatgtgtttgaattccagctttgccacatcccagagtgtctttgagtaagtcactgagtatccttgt

SEQ ID NO: 35338 - DNA, 201 bp, Homo sapiens
ttccaggtgccatgctatgtgtttgatgaagagttgaggaagcatgatctcaatcctctgatcaagcttagtggtgcctacttggtggatgactccgatcyggacacttctctattcatcaatgtttgtagagacataggtatgaatctttgtggggctgagggggtggtggtgagggatttcttctatggcttcaatatc

SEQ ID NO: 35339 - DNA, 201 bp, Homo sapiens
ggcgtgtgccaccacgcccggttaattttttgtatttttagtagagatgggatttcactgtgttagccaggatggtctcgatctcctgaccttgtgatcckcccgccttggcctcccaaagtgctgggtttacagtcgcgagccaccgcgcccggtcaccacaaaccctttttcgacgtccacagtttacacctgagctct

SEQ ID NO: 35340 - DNA, 201 bp, Homo sapiens
catgaaacatccaaacctataaagcatagatattactaagggagaagaacaaacaaaatctggaaaatgtatttgaggacataattgatgtaaacttcttyagtttagcaggagatctagacctccaaatataggaagctcaaaaaattctaaggaaatatgttgcaaggaggacttcaccacaacatatagccatgagac

SEQ ID NO: 35341 - DNA, 201 bp, Homo sapiens
gttttagtatttactgatggtctttgcctgtatccattataacactggagttgcaaaacacaaaccctttttctttttttttttttttgagatggaatctsgctctgtttcccaggctggagtgcagtggcacgatctctgctcactgcaacctctgcctcctgggttcaagcgattctcctgcctcagcctcccgagtag

SEQ ID NO: 35342 - DNA, 201 bp, Homo sapiens
tttgataagtctcctttacctgtttgcattgttaaatctctctgtccctctcctcagccttgggatgacttctggctgcaatgtgagtccaggtcaggtawcccttaaattcttttccagctcacctcagagactagattactaggttactgttactattacgtccaccccttattatttgaacccagcattccttggtca

SEQ ID NO: 35343 - DNA, 201 bp, Homo sapiens
gaaggctggcactggtgagagaggacctcctcatggggtggtggttgcaatgaatgtattgaaagctggcactggtgagagagggcctcctcgtgggatgstgtttgcagtgagtgtattgaaggctggcactggtgagagagggcctcttcatggggtggtggcttgtcatgagtttatcagggaagatcaagtaggatg

SEQ ID NO: 35344 - DNA, 201 bp, Homo sapiens
aaagcctaacaagactggttttcttgcagggctccttcactgaagtggtttccatcagtaacttgggaatggcaaagaccggcccggtggttgaggacagyggcagcctccttctggaatacgtgaatgggtcggcctgcaccaccagcgatggcagacagaccacatataccacgaggatccatctcgtctgctccaggg

SEQ ID NO: 35345 - DNA, 201 bp, Homo sapiens
aagcaaataaggaggtaacatgggaacttcaaattacatgcttatgaagtatactctggggaactttatctttcaaatactgattctaacctttccgggtraaaatcttttttagcttccaaattgcatttgagcagagataccatgtgatttaatttttaaaacttttctgagtggttcttatttttaggacagggcatt

SEQ ID NO: 35346 - DNA, 201 bp, Homo sapiens
tgtgtgtgtgtgtgtgtatatatatatatatatatatatatatatatgtattttttttgagatggaatctcgctctgtcacccaggctgaagtgcagtggygtgatcttgtctcactgcaacctcctcctccctggttcaagcaattctcctgtctcagcatccctagtagctgggattacagacaccaccatgcctggct

SEQ ID NO: 35347 - DNA, 201 bp, Homo sapiens
cgactgtatcttcagggggaaaagcctaacaagactggttttcttgcagggctccttcactgaagtggtttccatcagtaacttgggaatggcaaagaccrgcccggtggttgaggacagcggcagcctccttctggaatacgtgaatgggtcggcctgcaccaccagcgatggcagacagaccacatataccacgaggat

SEQ ID NO: 35348 - DNA, 201 bp, Homo sapiens
taaagcaaataaggaggtaacatgggaacttcaaattacatgcttatgaagtatactctggggaactttatctttcaaatactgattctaacctttccggrtgaaaatcttttttagcttccaaattgcatttgagcagagataccatgtgatttaatttttaaaacttttctgagtggttcttatttttaggacagggca

SEQ ID NO: 35349 - DNA, 201 bp, Homo sapiens
ccctgtagggaggtcttcatagtggttagtgtcagccgttccaccggaattcaggatctgaagaacatcttacacgattattgaacgaaagccttatgatkccaatgccagtgattctttctgtagcaataatggggatgtgactagtatctagtgctatgtgactttcagttacaggccagcatgcagcctgattggtgc

SEQ ID NO: 35350 - DNA, 201 bp, Homo sapiens
ggagccttttcacgggaagcatgaggtcacgttttctggctttcgtttgctggcatttgcttaagagaacatttggagtttgagaggagaatgactgaggwtttcttcccatgaactcactcaatgtacttgcacagctggggcggtagaattcctttggattagttacacaaaatcccaacatgattttatgaagctttg

SEQ ID NO: 35351 - DNA, 201 bp, Homo sapiens
gaattggaagccagcaaggccagtcggaattgagaaaagcctccagctgtccacagagggcttcatcactctgacctacaaagggcctctctctgccaaasgtgagctcagagccatgttgttttgtagctaaaaagggccctggtggctctgtggctggccatgcaccttcctgagtgtaggatgtgcacatcccccgcc

SEQ ID NO: 35352 - DNA, 201 bp, Homo sapiens
aagaaacctcaaattcacctccctaaggaatttgggttgagggacttaagggatttggagcgggccaaggtgtggggattgtttattggtagaagagtgcrgggtgaagtcatcggatggggagatgaagaaactgcatttggttccctgtagggaggtcttcatagtggttagtgtcagccgttccaccggaattcagga

SEQ ID NO: 35353 - DNA, 201 bp, Homo sapiens
tgcagatgggctcctcatgggagccttttcacgggaagcatgaggtcacgttttctggctttcgtttgctggcatttgcttaagagaacatttggagtttragaggagaatgactgaggatttcttcccatgaactcactcaatgtacttgcacagctggggcggtagaattcctttggattagttacacaaaatcccaac

SEQ ID NO: 35354 - DNA, 201 bp, Homo sapiens
ctgggtttccagccaaatcatcaccgtcattagatttgccagggtgcctgggcagtattagtattttaagctgtttatttagtgggttgtgcaccttaatracagcccacaagcctgtcagttttgggtacaaaacatacaaaagcataaaaaaaaatcctgaattaacccccacttagcagaggctaaattttcatcctg

SEQ ID NO: 35355 - DNA, 201 bp, Homo sapiens
gaaagagtttaattgtagggcaggcgaatgaggagatgagaagaaacctcaaattcacctccctaaggaatttgggttgagggacttaagggatttggagsgggccaaggtgtggggattgtttattggtagaagagtgcagggtgaagtcatcggatggggagatgaagaaactgcatttggttccctgtagggaggtct

SEQ ID NO: 35356 - DNA, 201 bp, Homo sapiens
agggttggcgtctggtgggtgtactaacttggtcagatgcagatgggctcctcatgggagccttttcacgggaagcatgaggtcacgttttctggctttcrtttgctggcatttgcttaagagaacatttggagtttgagaggagaatgactgaggatttcttcccatgaactcactcaatgtacttgcacagctggggcg

SEQ ID NO: 35357 - DNA, 201 bp, Homo sapiens
cctggttctggtgactcctcacgtcgctcacgggccctcccttcagtgtggcagccttggagtgcttctgcccctcaggtctttgctgagagaaacgtgtrtttatttcagtgatgagaagacttggaacttgggtctgagtaatgcgaagctttcatattatgatgggatgatccaactgaactacagaggcggcacacc

SEQ ID NO: 35358 - DNA, 201 bp, Homo sapiens
ctctttattcacagattctgcatctgtgaacttgcctacttgagaacacgtgtaactccaaaatcaccacgcggaacactttctcagtcattgttggaacragtgtagtggcccaatgtgcatagtacccgacaagcctgttcctggttgaagttgaacagggggacactctggcctcttgtttctgcctcaccctgagat

SEQ ID NO: 35359 - DNA, 201 bp, Homo sapiens
tgccttggagggttggcgtctggtgggtgtactaacttggtcagatgcagatgggctcctcatgggagccttttcacgggaagcatgaggtcacgttttcyggctttcgtttgctggcatttgcttaagagaacatttggagtttgagaggagaatgactgaggatttcttcccatgaactcactcaatgtacttgcacag

SEQ ID NO: 35360 - DNA, 201 bp, Homo sapiens
taggttcaagcagtcctcctgcctcagcttcctaaagtgctgggattataggtatgagccaccatacacagcctagaagttttttgatggtctcaaatctratttggaaaggagagctttatttctcataaagatttgcagcctgcagggtggccatttctgacaggctgggaagtgtagcctcaggccagaagccagaaa

SEQ ID NO: 35361 - DNA, 201 bp, Homo sapiens
cctctttattcacagattctgcatctgtgaacttgcctacttgagaacacgtgtaactccaaaatcaccacgcggaacactttctcagtcattgttggaaygagtgtagtggcccaatgtgcatagtacccgacaagcctgttcctggttgaagttgaacagggggacactctggcctcttgtttctgcctcaccctgaga

SEQ ID NO: 35362 - DNA, 201 bp, Homo sapiens
ctggttgcggttaacaggaggggctgccttggagggttggcgtctggtgggtgtactaacttggtcagatgcagatgggctcctcatgggagccttttcaygggaagcatgaggtcacgttttctggctttcgtttgctggcatttgcttaagagaacatttggagtttgagaggagaatgactgaggatttcttcccatg

SEQ ID NO: 35363 - DNA, 201 bp, Homo sapiens
atgtgtgttctttactggagcaatgagttcagtgtatagtcagtcctctttattcacagattctgcatctgtgaacttgcctacttgagaacacgtgtaaytccaaaatcaccacgcggaacactttctcagtcattgttggaacgagtgtagtggcccaatgtgcatagtacccgacaagcctgttcctggttgaagttg

SEQ ID NO: 35364 - DNA, 201 bp, Homo sapiens
tgagggtgggagcacagtgtgttcattctcgcagtgctataaagaaacacctgagactgggtaatttataaagaaaagaggtataattagctcacagttcygcaggttgtaaaggaagaatggcagcatctgcatctggagaagcctcaggaaacttacagtcatggcagaaggcaacagagtatcgagcacctcacgtgg

SEQ ID NO: 35365 - DNA, 201 bp, Homo sapiens
aaaagctcttgtttctggattgattagggggaaaaaccgatttgggagagttgctgtggatgaaccagattcaagcacacgctctcattcgctgcagttcrtccctgggttgaatgcagtcaccgccagaacatttacccgtctcctgtggtcgttgtacgtggtgaatcttaaaagagatgtctctggacatctgtattg

SEQ ID NO: 35366 - DNA, 201 bp, Homo sapiens
tgtgaacctggccgttcagccagctgcagacctttggtaggagttttctttttccttttgtgtgcttttcgatcccctgggggcaaccattattcagtacwtctggagggcaagttgtccaggaagaggaagcagatcctaggagtgtcgtccttcactgggagaggtgtaggaagtgagggggatggtggaagtactggc

SEQ ID NO: 35367 - DNA, 201 bp, Homo sapiens
tgaattcaaaagtgtctttaggtgctttcagcagacacctgtgaaaaagagagttttgcttccaaaagctcttgtttctggattgattagggggaaaaacsgatttgggagagttgctgtggatgaaccagattcaagcacacgctctcattcgctgcagttcgtccctgggttgaatgcagtcaccgccagaacatttac

SEQ ID NO: 35368 - DNA, 201 bp, Homo sapiens
atatattatataagcatatttattatatatatattatagtgtatattatatatgtattatatataatatataatatatagttatatataatatatacacaygcacatatataaataacaccacaaaaagggtaaaagtttatttatttccatgaatatatctagttctgtttactaatactttatgaaatatgcttacagc

SEQ ID NO: 35369 - DNA, 201 bp, Homo sapiens
cgctggtccgccatgcaggtactgccctccttgccatgcgggtcttagtccacatgctcatggaacattttcccatgagtacttttggaaatgcggttacyattttctttgtcagtgggttgcgtcacagccctcccccagttttttcatgtggctgtgtgaattattagaaggagcattggactgggaggtgaaataact

SEQ ID NO: 35370 - DNA, 201 bp, Homo sapiens
tatttattttgtacgaaatctaaaagtgagaacaagagaagtcttcatgctcacagcaaaaccttcggcactttcttccagccagttactactttgaagcragaggatgtcaagtccatacatttggaactcatttcctgtagatatttttccctagctggctagagagcttgctgttttagatccgtagtgatttgttga

SEQ ID NO: 35371 - DNA, 201 bp, Homo sapiens
ttcaggtccacagtgtcttatctgaagaactttgaaaataaaactaatattgttaattttggatccgcatataaattgcatcgttgtgcatattgagaccyaaaaaagaatctgttcgcagcagcattaaatgagatttatattacagaataaaatatatagctcctgttttaacttcagctaatttcctttatgaattct

SEQ ID NO: 35372 - DNA, 201 bp, Homo sapiens
atatctatgataaacagattcaaaaatctcaacaaaatactagcaaactgaatgtaacagcacttcagaaaaataatacatcacgatcaagtgggttttaytccagggttgcaaggatggttcagtgtatgcaaatcaataaatgtgattcaccatttaaacaatttaaaaaaaagtctgaccatctcaggagatacagaa

SEQ ID NO: 35373 - DNA, 201 bp, Homo sapiens
gactgtgactattgcatcttcaggtccacagtgtcttatctgaagaactttgaaaataaaactaatattgttaattttggatccgcatataaattgcatcrttgtgcatattgagacccaaaaaagaatctgttcgcagcagcattaaatgagatttatattacagaataaaatatatagctcctgttttaacttcagcta

SEQ ID NO: 35374 - DNA, 201 bp, Homo sapiens
gtgtgtatgtgtgcgtgagtgcgtgtgtgagtgcacgagtgtgtgagtgcaagtgtgtgtgtctgagtgtctgtgagtgcaagtgtgtgtgtctgagtgtstgtgtgtgagtgtgtttgtctgagtgcgtgtgtctctgtcttcatcagctcctaggagatgcctccggacaggggcctgcccgtctctccctccagttcc

SEQ ID NO: 35375 - DNA, 201 bp, Homo sapiens
aaaatatttttctttcctcatttatattaaattagagatacccacatctatttaggagaagccttggcccgtgggtatggggttctcaagttttttggatrttacctggtgtttaaaggggacataattgtgtaaattattatgattgttcttattatgggcatattgtatgtaatttgttgattttaatctttagttttt

SEQ ID NO: 35376 - DNA, 201 bp, Homo sapiens
tccaggtggaacacggcctcttggtctagtaggaatggcctttgtatctttacgtttttctggccactgtcacacgtgggcatacttagcaaatgctgaaraggtttctgaggttgatatgcattgtgaatataataagatctgccctttgtagtcttagaatatcttaaaagttgtgtttaatttttctgccagattttc

SEQ ID NO: 35377 - DNA, 201 bp, Homo sapiens
tttttatgctcccttttttggaaggggaagggtggatggagggagagtttgtgacactagtttaaagaccagttagctaccctaagatacatagttactcyagtaactagtatgatacagagaaatggtggcagcttaaacgaggtcaggctgagaacaacatttagaggaaggcattttggaataatggcttctgtgacc

SEQ ID NO: 35378 - DNA, 201 bp, Homo sapiens
atgccatggacaactcaggggaacatgtcacgtggaggaaatactacattaacgtgtgtcggcctctgaatccagtgccgggctgcaaccgatatgcatcrgcttgccagatgaagtatgaaaaagatcaggtgaatctgttttcactgcttgtctcctttgccctcctaattccatgacttagtgggaggaggtggttat

SEQ ID NO: 35379 - DNA, 201 bp, Homo sapiens
ggttttagggcagcatatttagttttttaaaaaatatttttctttcctcatttatattaaattagagatacccacatctatttaggagaagccttggcccrtgggtatggggttctcaagttttttggatattacctggtgtttaaaggggacataattgtgtaaattattatgattgttcttattatgggcatattgtat

SEQ ID NO: 35380 - DNA, 201 bp, Homo sapiens; identical to SEQ ID NO: 7642

SEQ ID NO: 35381 - DNA, 201 bp, Homo sapiens
ggtatgccatggacaactcaggggaacatgtcacgtggaggaaatactacattaacgtgtgtcggcctctgaatccagtgccgggctgcaaccgatatgcrtcggcttgccagatgaagtatgaaaaagatcaggtgaatctgttttcactgcttgtctcctttgccctcctaattccatgacttagtgggaggaggtggt

SEQ ID NO: 35382 - DNA, 201 bp, Homo sapiens
aggttttagggcagcatatttagttttttaaaaaatatttttctttcctcatttatattaaattagagatacccacatctatttaggagaagccttggccygtgggtatggggttctcaagttttttggatattacctggtgtttaaaggggacataattgtgtaaattattatgattgttcttattatgggcatattgta

SEQ ID NO: 35383 - DNA, 201 bp, Homo sapiens; identical to SEQ ID NO: 7645

SEQ ID NO: 35384 - DNA, 201 bp, Homo sapiens
ggcaaaatctgaaggtggccttggaggaaactggtatgccatggacaactcaggggaacatgtcacgtggaggaaatactacattaacgtgtgtcggcctstgaatccagtgccgggctgcaaccgatatgcatcggcttgccagatgaagtatgaaaaagatcaggtgaatctgttttcactgcttgtctcctttgccct

SEQ ID NO: 35385 - DNA, 201 bp, Homo sapiens
actgtttaatgtttaagttataggcatactttttttttctctaaaacctcttcttctagcatttcattttgataggttttagggcagcatatttagttttytaaaaaatatttttctttcctcatttatattaaattagagatacccacatctatttaggagaagccttggcccgtgggtatggggttctcaagttttttg

SEQ ID NO: 35386 - DNA, 201 bp, Homo sapiens
tcacctgaacaagggagtcacgtgagcggggggcgggggtgggggggcggtgccgggcggctgtcacgtgacgcggttccggggccgccgtgccgtgtccstgtcgccgagcccagtcgagccgcgctcacctcgggctcccgctccgtctccacctccgcctttgccctggcggcgcgaccccgtcccgggcgcggcccc

SEQ ID NO: 35387 - DNA, 201 bp, Homo sapiens
agcatgttttatttggtagctttacttccccaactacatagaaataaatgagactgaaatgtgtaagctctttaaaagcatatacattttgctttgaaatyttagtctggcaaaatctgaaggtggccttggaggaaactggtatgccatggacaactcaggggaacatgtcacgtggaggaaatactacattaacgtgtg

SEQ ID NO: 35388 - DNA, 201 bp, Homo sapiens
tgatgggaagtattgaaacatttcagtggctgagttatatatcctgatttgtatttttgaagatcacactggtgcaagatggatgaggaagtggggctggygagggatgagactagtgtggaggcagggggagcagttaggtggccattgctggagcgcaggtagtggttttagcgggagtagaggtggagaaatgtggac

SEQ ID NO: 35389 - DNA, 201 bp, Homo sapiens
gctttgttgagtggcacttgcttgacagcgacacttttgtccactctttcaccttgctggatttgtgctgccttccttgctgtaggaagcccacgcttggsaaataacattcccacagaaggtctgagaggctctgacgggccaaggttgtaaacccccatgatttgactccacgggcagttaaagtgtgttcccaccccc

SEQ ID NO: 35390 - DNA, 201 bp, Homo sapiens
agcgaaggtggagtgtaatcctggtgcgtcatgcgcccagacaagccaactcctggtagtgtgattggtggagcatgttttatttggtagctttacttccmcaactacatagaaataaatgagactgaaatgtgtaagctctttaaaagcatatacattttgctttgaaattttagtctggcaaaatctgaaggtggcctt

SEQ ID NO: 35391 - DNA, 201 bp, Homo sapiens
gtcataatcaaagtttaattcacatttgtgtctctgtgctctctcttctagtcgattggtctctattctagtcttttgatcagtttattcctatgccaacycccatcatgttgatttttacatagactttttattctggactgttacagtaatgtcctggacaagcagagatgtggtcattctacttgtgggcctttctag

SEQ ID NO: 35392 - DNA, 201 bp, Homo sapiens
ttgtatatttactctaaaagaaagtgaatttttttagttcaagacttttagattcatcgttctactttcattgtggctagctcatggccatccacgtagtkaattaataaagctttgttgagtggcacttgcttgacagcgacacttttgtccactctttcaccttgctggatttgtgctgccttccttgctgtaggaagc

SEQ ID NO: 35393 - DNA, 201 bp, Homo sapiens
gccttgggactggcctgcataattttcaagtgcgttgtgtgtattcttgtgaaacataactccctctccttttcttcctctttccattttccgtaaggtahgggagaatcagttactccagcattccttcctagtagacttcggcaagttgccgtttgtcactaaacaatcaaatgtttttcctggctttagagtaagaat

SEQ ID NO: 35394 - DNA, 201 bp, Homo sapiens
tttcatcctgatttgttactggacagtcttctttttaataaaatgaagggagatgggcagactaagcttttcttcacagtttctcattgggaacattgctstcgtccttttttgaatcctggttttatgtcacgtgtctttctctttttgccatccctccgcgcatctgccgtggattaggaagaggataactccacctac

SEQ ID NO: 35395 - DNA, 201 bp, Homo sapiens
atccaattttgtctttttccatatggaaaactattttgtttccagttccgtttttatttccagttctgtttattgaacagcctcctcttttccctgacctrttacttctgtcataatcaaagtttaattcacatttgtgtctctgtgctctctcttctagtcgattggtctctattctagtcttttgatcagtttattcct

SEQ ID NO: 35396 - DNA, 201 bp, Homo sapiens
agattcggcaggggcgggatggcttgtcaattttgattgagtgacctcttcttttatgtaatgagtatcaagataatcctttttgcaaagtggtgaccctrtggtagagtttggatctggggattgcagaatgtcactgggtgcgttgaagctgaaggcgtgcatttctctgagtaatgagaagcacccttgagtcaccaa

SEQ ID NO: 35397 - DNA, 201 bp, Homo sapiens
agttttgggtacaaaacatacaaaagcataaaaaaaaatcctgaattaacccccacttagcagaggctaaattttcatcctgatttgttactggacagtcytctttttaataaaatgaagggagatgggcagactaagcttttcttcacagtttctcattgggaacattgctctcgtccttttttgaatcctggttttatg

SEQ ID NO: 35398 - DNA, 201 bp, Homo sapiens
cacgggttggacaagcttgtgtttagagttgatttttgtacccagtactgggtagggatccaattttgtctttttccatatggaaaactattttgtttccrgttccgtttttatttccagttctgtttattgaacagcctcctcttttccctgacctattacttctgtcataatcaaagtttaattcacatttgtgtctct

SEQ ID NO: 35399 - DNA, 201 bp, Homo sapiens
tcctttggcctgttctgttcagggctttttattaatgacttggccgagatctttgagagtgtgctgatctcatttggggatgctgggaagacagaatcatyatccaaaaagatcgaaatggacgagcaggatatgagaagggcattatatcgtttcagacttacagggaagaggtgtggacatcgatgagctgccaaccaa

SEQ ID NO: 35400 - DNA, 201 bp, Homo sapiens
tcagtgcctagatatctctgtgcgtatttctgcattctgcgtaactgcagttcaaatgaagtgagttgtctaaaccagcggtgccaagaggagatttgggkcccagtgttcctgctgccgttggagaccttgtgtgggttcctgtggtctgcagcccgggcctggttctggtgactcctcacgtcgctcacgggccctccc

SEQ ID NO: 35401 - DNA, 201 bp, Homo sapiens
caagacacaggctggcttcttgatttgggttttcagtttctaatttcatactgtggggcttgggagaattttgccgttcagttctctgtcccccagttggrcctactcttctgaagaagtattgggatgtagtttgtttctgtcacattaaatgagaaacctgagaatctcggtgaatttttgtgctttcagtctgcccgg

SEQ ID NO: 35402 - DNA, 201 bp, Homo sapiens
agagaaaggagcaggcccatccttgggaaagaagggtggattgaggttatgcctcactattgcgcattttgtgcttctcagtgcctagatatctctgtgcrtatttctgcattctgcgtaactgcagttcaaatgaagtgagttgtctaaaccagcggtgccaagaggagatttgggtcccagtgttcctgctgccgttgg

SEQ ID NO: 35403 - DNA, 201 bp, Homo sapiens
gctggtgtgtctttaaaagcaggttcaggcatgtccatgtctttactaagaaggactttggaacagagttttaatcctttataacaaaaagcaagtgaacyaagaagtaagcggcctcctgcttgggttgctaaacaggtttcgttaatttctgctttggatatgagacacattctcaccctttggctgtgtggctgtgct

SEQ ID NO: 35404 - DNA, 201 bp, Homo sapiens
ttctaggcaagaaacctctctgagggagaccttacaagaaggccataatatcatgctcgtcctactttgaacatgctgttgtttattagcccagcagttaygggctttgaatagcgctttaggctaacccagtagaagggaatggtggagttggatccatctccaaggaaaatgttagtaatcgcggttctggtggcctca

SEQ ID NO: 35405 - DNA, 201 bp, Homo sapiens
atactgatgagacctggtctgaaaactgaaggatgttaggagtttaatttcccagagaaaggagcaggcccatccttgggaaagaagggtggattgaggtyatgcctcactattgcgcattttgtgcttctcagtgcctagatatctctgtgcgtatttctgcattctgcgtaactgcagttcaaatgaagtgagttgtct

SEQ ID NO: 35406 - DNA, 201 bp, Homo sapiens
ctgggagggaagggtgaaggggtgtgtggggttccccatgtccagagcccaggaggctgggagggaaggatgagggtggtgtgtgggggcctctgtgcccmagacccaggaggctgggagggaaaggtgaagggtgtgtggaggccctgtgccccagacccaggaggctgggagggaagggtgggggtgtgtcgaggcccc

SEQ ID NO: 35407 - DNA, 201 bp, Homo sapiens
tgggagggaagggtgaaggggtgtgtggggttccccatgtccagagcccaggaggctgggagggaaggatgagggtggtgtgtgggggcctctgtgccccrgacccaggaggctgggagggaaaggtgaagggtgtgtggaggccctgtgccccagacccaggaggctgggagggaagggtgggggtgtgtcgaggcccct

SEQ ID NO: 35408 - DNA, 201 bp, Homo sapiens
gcaccaagggggcatcctttggacggctgcaatcaatgaaactggattacaggcaccaggatgaagcggtcgttttaagttacgtgaatggtgatcgttgycctccaggtaaatatttgcaatgaggtaaataaacttcaagctcatagtaaactagaaattagacatagcagcagaaagaagctgcggagtggagctcca

SEQ ID NO: 35409 - DNA, 201 bp, Homo sapiens
gaaaaaaaaaagaagacccgcagtagagtggggagatcttgccttgtagttatgagcatagatgaggccacaccctctgggtttggttcccagctgccctrgtttttagttatgaaatcatgggcccagagggagctaaagcccagatgagctgaggcttgacaaaacgggtgaaggcctcccatagctccatttttcctt

SEQ ID NO: 35410 - DNA, 201 bp, Homo sapiens; identical to SEQ ID NO: 7603

SEQ ID NO: 35411 - DNA, 201 bp, Homo sapiens
catcagctgcaatagtggttctctcttcactttgagacctgggtgctgccactctgctgacggccacgcatggtttttgtccaggtgactcgcgactcgcrcacctacagcgttggggtgtgcacctttgcagtcgggccagaacaaggaggctgtaaggacggaggagtctgtctgctctcaggcaccaagggggcatcc

SEQ ID NO: 35412 - DNA, 201 bp, Homo sapiens
ccccccagggaaagcctagggccaaggcgattgcgtggctctgatgcacacagaggagtctttgctcttcctcatgaacctgcctccagcatcagctgcartagtggttctctcttcactttgagacctgggtgctgccactctgctgacggccacgcatggtttttgtccaggtgactcgcgactcgcgcacctacagcg

SEQ ID NO: 35413 - DNA, 201 bp, Homo sapiens
aggtggggtgaccccactgctgggtcccttctcactgggctctgactggagacgacagccagagcagtggctggctggcaggggtggccgaggcccccagsagggagcaggaggagcaagcaagctgggcctaggggttgggggaggccccccagggaaagcctagggccaaggcgattgcgtggctctgatgcacacaga

SEQ ID NO: 35414 - DNA, 201 bp, Homo sapiens
gcctgggtacaggtcctcccgacaggtgtgcagtaggtgtgagccttctgggcgctgggtgggccaggagagtcaggtccatgcttcagcgtgcagcgtcrgctctgctcattcactcacttggcccgcacaatgtcttattacacaggtgagggaggtggggtgaccccactgctgggtcccttctcactgggctctgac

SEQ ID NO: 35415 - DNA, 201 bp, Homo sapiens
agcaatctcctggtgccaaacttccacgtgtatgagaatctcctggagagcttgctagagcaatctcccggtgccaaacttccatgtgtatgagaatctcytggagagcttgctagagcaatctcctggtgcccatctccagagattttcattcaataggttgaggcaggacccatgaaatggcatttctaacaagctggt

SEQ ID NO: 35416 - DNA, 201 bp, Homo sapiens
attcctccaacctggttgaagatgatcaaggcagttgtttgctgattgtggcagctttgggaagagggaggtaggaggtgccctggaattgagaggcactygggcatgtgcctccatgccatgccagagccctggcgtgtgctgattctttgggctgctggtcttactgatgtggtgtcgtggtcactggtgcctgggggc

SEQ ID NO: 35417 - DNA, 201 bp, Homo sapiens
attttggtcttgatttgaaattccttgatcaccagtaacattgaacatgtcttaacatatttattgatgtacatttttctttgatttgcttgatcatgtcwtgttcattttatattgggttattgtgtgtgacctagattagaattttttcttttcattggatattaagatccaccattgtgtggctaggagtgggttttt

SEQ ID NO: 35418 - DNA, 201 bp, Homo sapiens
agacatgaatgtaaggtatccatggggacagggccagctcctgggtggctgaaatctacagggatttaattcctccaacctggttgaagatgatcaaggcmgttgtttgctgattgtggcagctttgggaagagggaggtaggaggtgccctggaattgagaggcacttgggcatgtgcctccatgccatgccagagccct

SEQ ID NO: 35419 - DNA, 201 bp, Homo sapiens
tccatagactaacctttttccttttaaaaaattagttgttttgtataatgtagcgagcactgtttccaacaaaaatctaggatcttggcagtaaccactayctgttttactctttcctctttcacttttcgctaggagtaatcattagctcccatcttgtattaatttttttttttttttactgtatctaatttccaaaaa

SEQ ID NO: 35420 - DNA, 201 bp, Homo sapiens
gtgtctagagacagtagattggagcacttgtgaggcagggtctcagtttcacagacctctctcatgacatataagccctccccctttcttcctttgaaccygtagcacagaacattgaggctttctctctaagtagaagacaagacctggattcagccagggagctcacaggatgtgtagggggcaagggcagggtgatgt

SEQ ID NO: 35421 - DNA, 201 bp, Homo sapiens
gtcttgggagctgactgggggcctggcgtggtggcggcagcccgcagtccctgcctggcccttgtctgggaggccgcggttctctgcggcctctcgccggkgtcgcccttggccactgggctgcgaggaagccggcgaggagtgggtgtgcgccccgcccggctctaccggcgagggatgcagtggccgccagcgtggccg

SEQ ID NO: 35422 - DNA, 201 bp, Homo sapiens
tcttccccagcagttttcattttcaatggaagtacttttaccactgaatcatagggaaaaagatgcttaacattaattacaaatggaattcctgagagctrcctcatctttttttgttgctgttgaatgagggagggaataaataaagtgattctacaatacttggcctatggaatatctggccatgtggcatcttgcccc

SEQ ID NO: 35423 - DNA, 201 bp, Homo sapiens
ccagtggagagggaaaacctggtgatgtaaagtgagaggagatgattgcacaacagtcctcatgtaagagagaagagataccgaaaagaacgcagaggagscaagacgtttattgacctttgcctgagttcgttattaggggacaccatagcatgatagtccctaaggaatggagagcagtgttgtgtgacattggtcata

SEQ ID NO: 35424 - DNA, 201 bp, Homo sapiens
atctcttttccccattgacaggtgatctggaaagtgcaccagtgttgagaacttctggggaaggcggttgcttttatgagtttgagtggcacacagctgcrgcctgtgtgctgtctaagacagaaggggagaactgcacggtctttgactcccaggcaggtctgtgtccaagcaggacctctgctttaatgtgacttggaa

SEQ ID NO: 35425 - DNA, 201 bp, Homo sapiens
gaggcctggcatgttggggacaggtcttgggagctgactgggggcctggcgtggtggcggcagcccgcagtccctgcctggcccttgtctgggaggccgcrgttctctgcggcctctcgccggtgtcgcccttggccactgggctgcgaggaagccggcgaggagtgggtgtgcgccccgcccggctctaccggcgaggga

SEQ ID NO: 35426 - DNA, 201 bp, Homo sapiens
ttaaaaaagttattcttaaggactttccaatacctctcctgaggaagacatgtcaggtcttctaaaagtttacattatgaccaaagaaagatgctggtccycaggcattctacccagggggctgttctccaggccattcccacctcctgctaagaccatggggagccctctctgtaaggaggggcatatgcagggacctgc

SEQ ID NO: 35427 - DNA, 201 bp, Homo sapiens
atttgtatttttgaagatcacactggtgcaagatggatgaggaagtggggctggcgagggatgagactagtgtggaggcagggggagcagttaggtggccrttgctggagcgcaggtagtggttttagcgggagtagaggtggagaaatgtggacagatttgagatgggcgtatagctgtggacctttctgatgtatagaa

SEQ ID NO: 35428 - DNA, 201 bp, Homo sapiens
aagatattttaggaatgaacggattagtgatccccatctcttttccccattgacaggtgatctggaaagtgcaccagtgttgagaacttctggggaaggcrgttgcttttatgagtttgagtggcacacagctgcggcctgtgtgctgtctaagacagaaggggagaactgcacggtctttgactcccaggcaggtctgtg

SEQ ID NO: 35429 - DNA, 201 bp, Homo sapiens
gccgaggcctggcatgttggggacaggtcttgggagctgactgggggcctggcgtggtggcggcagcccgcagtccctgcctggcccttgtctgggaggcygcggttctctgcggcctctcgccggtgtcgcccttggccactgggctgcgaggaagccggcgaggagtgggtgtgcgccccgcccggctctaccggcgag

SEQ ID NO: 35430 - DNA, 201 bp, Homo sapiens
ctttttaaaaaagttattcttaaggactttccaatacctctcctgaggaagacatgtcaggtcttctaaaagtttacattatgaccaaagaaagatgctgstcctcaggcattctacccagggggctgttctccaggccattcccacctcctgctaagaccatggggagccctctctgtaaggaggggcatatgcagggac

SEQ ID NO: 35431 - DNA, 201 bp, Homo sapiens
caacagtcctcatgtaagagagaagagataccgaaaagaacgcagaggagccaagacgtttattgacctttgcctgagttcgttattaggggacaccatarcatgatagtccctaaggaatggagagcagtgttgtgtgacattggtcataagcttttctgattgaccaagatgtatactgaagactcacttttttcttcc

SEQ ID NO: 35432 - DNA, 201 bp, Homo sapiens
catccatctccagaactttttgatcctcccagactgaaactcagttcccattaaacacgagctctccattccctctcttctactttttgtctctacggatytgactgttctagatacctcatataggtggaatgctacagtatttgtagggctgttttttgacccttctatgcattatacctcatttcccactgtcccttc

SEQ ID NO: 35433 - DNA, 201 bp, Homo sapiens
gcgcttaggttcctcccgtgttgcaagcttggttcatctgtgcaggctccggtgacatgatgtcgaactgggagccatggcagctgaaaaacaacgaacarctttgtacataaaagatgatacagcttggtctaatgtggttctaaggaggctctgccggcgagtcttaggggttccggcgggcagccgcgtgaacctgga

SEQ ID NO: 35434 - DNA, 201 bp, Homo sapiens
tggaagcaggaagttactccagtgttataaacaaacttcttagactcaacatcctattctccatccctttttttttcctgtagagtccaaaaacctcaacsgtctcatttttaaattatccaattggagttacctttttaaaaaagttattcttaaggactttccaatacctctcctgaggaagacatgtcaggtcttcta

SEQ ID NO: 35435 - DNA, 201 bp, Homo sapiens
ccaggtcctgcagctggtgtacaaggatgggtccccttgtccctccaaatccggcctgagctataagagtgtgatcagtttcgtgtgcaggcctgaggccrggccaaccaataggcccatgctcatctccctggacaagcagacatgcactctcttcttctcctggcacacgccgctggcctgcgagcaagcggtgagttt

SEQ ID NO: 35436 - DNA, 201 bp, Homo sapiens
gttgacatggtgtggttttactatttttgaacattttccttattgttggattaatagcgcgtttccagtgttgctaattgtgctattatgtatcctctctytacctcccattgaaatatttcctttggataagttcccagctgtgggataaagtcagaagctagggtcattttgtttgtttgttttatatggtaaaatata

SEQ ID NO: 35437 - DNA, 201 bp, Homo sapiens
gtccagcgcttaggttcctcccgtgttgcaagcttggttcatctgtgcaggctccggtgacatgatgtcgaactgggagccatggcagctgaaaaacaacsaacagctttgtacataaaagatgatacagcttggtctaatgtggttctaaggaggctctgccggcgagtcttaggggttccggcgggcagccgcgtgaac

SEQ ID NO: 35438 - DNA, 201 bp, Homo sapiens
aaaaaaatcataaatggtttaaaacattgcccgtgatctcaccacttaaacacaatgttaattttcattacctttatttatagatgtatgttgtttttacmaagtcaaaatttttatggtaacaaatcttaatgtttctcaaagtgtagtattttgtaaatacttttctatgtttcacagttccattaataatttttagga

SEQ ID NO: 35439 - DNA, 201 bp, Homo sapiens
agtcccgctcctcagtccagcgcttaggttcctcccgtgttgcaagcttggttcatctgtgcaggctccggtgacatgatgtcgaactgggagccatggcrgctgaaaaacaacgaacagctttgtacataaaagatgatacagcttggtctaatgtggttctaaggaggctctgccggcgagtcttaggggttccggcgg

SEQ ID NO: 35440 - DNA, 201 bp, Homo sapiens
gaatttttccctcatcccctcctcaaaaccaaatcagaaatggagaaaccagatggtgtcagaagggagttgtgggtctcagcgctgtatcctcttcctcrggactgatactcggccagtcatgtggttacttaacttccttcaaaggggaaaaaaatcataaatggtttaaaacattgcccgtgatctcaccacttaaac

SEQ ID NO: 35441 - DNA, 201 bp, Homo sapiens
cgagacaggaggaaaggtcaaacctgtctccccaagctggcggctgggtcgggttttataagcataagcttattaccataaggtaatgaggtgtgttctgwttggatcttgcaattagatgacaccagggctctatctgattggatcctggatcttgccatgtggtgtgcgcttcttatttcagtcccgctcctcagtcca

SEQ ID NO: 35442 - DNA, 201 bp, Homo sapiens
gggagataggtcatttggaatttttccctcatcccctcctcaaaaccaaatcagaaatggagaaaccagatggtgtcagaagggagttgtgggtctcagcrctgtatcctcttcctcgggactgatactcggccagtcatgtggttacttaacttccttcaaaggggaaaaaaatcataaatggtttaaaacattgcccgt

SEQ ID NO: 35443 - DNA, 201 bp, Homo sapiens
cgcagggtttttgctggagagagtggactgcactgcgacgagacaggaggaaaggtcaaacctgtctccccaagctggcggctgggtcgggttttataagyataagcttattaccataaggtaatgaggtgtgttctgattggatcttgcaattagatgacaccagggctctatctgattggatcctggatcttgccatgt

SEQ ID NO: 35444 - DNA, 201 bp, Homo sapiens
tggaggaccccaatgtggctgttaatgtctagccaaacgtggcactctagggaaacccatccgctgccttggtgggttcagggggctggagaagggctgcrcttgctgggtttgggctgatttctttctttctttctctttctttcttttttttttaagtcacttctttgcgtgatgatcatttttaaccacatcttctgt

SEQ ID NO: 35445 - DNA, 201 bp, Homo sapiens
tccttcatggcgctttctggctgaacctatggatgaccctggaggaccccaatgtggctgttaatgtctagccaaacgtggcactctagggaaacccatcygctgccttggtgggttcagggggctggagaagggctgcacttgctgggtttgggctgatttctttctttctttctctttctttcttttttttttaagtca

SEQ ID NO: 35446 - DNA, 201 bp, Homo sapiens
gcatccttcatggcgctttctggctgaacctatggatgaccctggaggaccccaatgtggctgttaatgtctagccaaacgtggcactctagggaaacccwtccgctgccttggtgggttcagggggctggagaagggctgcacttgctgggtttgggctgatttctttctttctttctctttctttcttttttttttaag

SEQ ID NO: 35447 - DNA, 201 bp, Homo sapiens
gtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttg

SEQ ID NO: 35448 - DNA, 201 bp, Homo sapiens
actctcataactatacaaataattggaaattaaatagcctgcttctgaatgaattttgagtcaacaatgtagttaagatggaaattaaaaaaaaattgaaacaaatgaaagtggatacacagcataaaacctgcgggatacagcaaaagcagggctaagtgggaagtttatagtgttaaatgcctacatcaaaaatagaga

SEQ ID NO: 35449 - DNA, 201 bp, Homo sapiens
tctttaaaggacagtcttcacttctaagacccacctcatcatgagtgatgctttgttatctacaccaccagctaaagagtgtggaactatgccttgctttkactctgctgccaacgtgacaaatcgaattagctaatgtgattttagttaattctcagcagctgcacattgagggtgattagtgtttacttgattttagaa

SEQ ID NO: 35450 - DNA, 201 bp, Homo sapiens
acaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcaga

SEQ ID NO: 35451 - DNA, 201 bp, Homo sapiens
tcacaggatctgggggtgtgagaattgcctcttaaaatcctaataaagatgttggattccaaggctcatctgacccctaggagttcaggtgatggattagratctgttgggtgtcttgtaattctgataaagacatccttctgatgtttgggcctggagcaggtttgtaaagggactgttagacatgggtgtgctgacagt

SEQ ID NO: 35452 - DNA, 201 bp, Homo sapiens
taagagaggtgtgagcatggtaagtgtgggcctgtgacgatctagatgctcaactgcgggttagtgagccaaggctagacaaccagaaagtgcgtgtcagrtccaaggatactcttattcaaaatgtctgccttgggtaagatggtacgctagtagtgtgtctgaataatttaaaccactgattgagggctgagtgagctc

SEQ ID NO: 35453 - DNA, 201 bp, Homo sapiens
gtgcaacatgatattttgaaatatgtatacattgaggaatggctacattgagctaattacatatgtgttacctcacatatttcgtttttttttttttttttgtgaggactcttaaaatctactctcttagtgatacgcaagaataaattacattgttattaactgtggttgtggtggtgtttaatggatctcttgggcagg

SEQ ID NO: 35454 - DNA, 201 bp, Homo sapiens
tagatgctgctcattctcagaacctatgaggtctggtttttgcaattctgtatcaattcttaattccactaaccttgggaatggttaatttcctgaaatastgtttgccctcgctctttgtttaggatatcggccgggtagcaggaccaccaatactcaatccaatagcaaatgagatttacttgaattttgaaagcagta

SEQ ID NO: 35455 - DNA, 201 bp, Homo sapiens
tttgggttttaactctggtgttctcgttgaccctttatgaggcagcactttcatttttctccagagtctcctggtcgtaggtgttaactttgggtccaatytgccttcccttggctctttctagatccgatttctttaccttctccaggccaacctcggggtgtggtcctgttcatcaaaacaatgaacatggagtttaga

SEQ ID NO: 35456 - DNA, 201 bp, Homo sapiens
cctgtcctgccggagccgctgtgtgcaaagttcctattgatggtccccccatagtaagtatgacaaatccaagggtggagataatttttgcaagacttttmgtgataacctttgcgttgtttcttgccttcagtggggagttgctcaagcataaaaaaaatggagaaagtaagtgggactgtgtatgttctgggtccgcta

SEQ ID NO: 35457 - DNA, 201 bp, Homo sapiens
tgaatttgggttttaactctggtgttctcgttgaccctttatgaggcagcactttcatttttctccagagtctcctggtcgtaggtgttaactttgggtcsaatctgccttcccttggctctttctagatccgatttctttaccttctccaggccaacctcggggtgtggtcctgttcatcaaaacaatgaacatggagtt

SEQ ID NO: 35458 - DNA, 201 bp, Homo sapiens
catgtgatggaatgaacattcaatgtaaaacaatggttaaagccggattggacacttgaagttataagtgttggctatgaaattgatggtcctgacttgcraaagttctcatcagaaaattggccatcgagtctgtgattgtgttttctccgcctttcccttgtggtgcaggggcctgctttggacagaccaggattagcg

SEQ ID NO: 35459 - DNA, 201 bp, Homo sapiens
ttttctttctgttaagtgactgaatttgggttttaactctggtgttctcgttgaccctttatgaggcagcactttcatttttctccagagtctcctggtcrtaggtgttaactttgggtccaatctgccttcccttggctctttctagatccgatttctttaccttctccaggccaacctcggggtgtggtcctgttcatc

SEQ ID NO: 35460 - DNA, 201 bp, Homo sapiens
tgtcctcagtctctttgcatgctaatggcaaaaaggatgagcagagccaggaagctgagacgcttttgtctcctgcagcagtcaccccatgtgggggacayatggtcatgtgatggaatgaacattcaatgtaaaacaatggttaaagccggattggacacttgaagttataagtgttggctatgaaattgatggtcctga

SEQ ID NO: 35461 - DNA, 201 bp, Homo sapiens; identical to SEQ ID NO: 7643

SEQ ID NO: 35462 - DNA, 201 bp, Homo sapiens
gttcctgtgagcatggtttggagggcctggtgaatgtgtcctggtaggcctggtgagtgtgtgagcatggcctagagtgtcaccaaaccaaagtggacccrcctgcctgtgcaccagggaaagccaaacaccaaagcgcagggtttttgctggagagagtggactgcactgcgacgagacaggaggaaaggtcaaacctgt

SEQ ID NO: 35463 - DNA, 201 bp, Homo sapiens
gtttacatgagcatctgtggggagaatgaaaactgccctcctggcgtgggtgagtgctgtggtctctcgtgtgttgtctgactctcccgtcctctggggtygtcctcagtctctttgcatgctaatggcaaaaaggatgagcagagccaggaagctgagacgcttttgtctcctgcagcagtcaccccatgtgggggacac

SEQ ID NO: 35464 - DNA, 201 bp, Homo sapiens; identical to SEQ ID NO: 7646

SEQ ID NO: 35465 - DNA, 201 bp, Homo sapiens
gagtgtagcttggagtgctgggtggtgtggcctggctggcaccgaggtccctgcggattctggagaacctcaaggtgcggccccgggggtgtggccaagtrtggtgtgtggagggcccttgtgtgcagcctggtggttcctgtgagcatggtttggagggcctggtgaatgtgtcctggtaggcctggtgagtgtgtgagc

SEQ ID NO: 35466 - DNA, 201 bp, Homo sapiens
gatgagcctcccaagtctcagctccctggagtcactgtgtccccatcttcttccaccctacaggacacctgtttgatctgagctccttaagtggcagggcrggattcacagctgcttacagcgagaaggggttggtttacatgagcatctgtggggagaatgaaaactgccctcctggcgtgggtgagtgctgtggtctct

SEQ ID NO: 35467 - DNA, 201 bp, Homo sapiens; identical to SEQ ID NO: 7649

SEQ ID NO: 35468 - DNA, 201 bp, Homo sapiens
tctctaaatccttttgggaagataatagttggtgtgaggttgtttttttttttttttttttttttttgagacagaatcttgctctgttgcccaggccggartgcagtggcgccatcttggctcactgcatcctccgccccctgggtttaagcgattctcctgcttcagcctcctgagtagcttggattacgggcaccacca

SEQ ID NO: 35469 - DNA, 201 bp, Homo sapiens
catgatacagcctggctgttggtggaggatttaggacaggggtcgtggtgagaagtcagaagtcccgatgctgacataatctgtgtgtgagctcgccgatratgagcctcccaagtctcagctccctggagtcactgtgtccccatcttcttccaccctacaggacacctgtttgatctgagctccttaagtggcagggcg

SEQ ID NO: 35470 - DNA, 201 bp, Homo sapiens; identical to SEQ ID NO: 7651

SEQ ID NO: 35471 - DNA, 201 bp, Homo sapiens
ttatctaaatgttgcttctcccgctcacttttggtttctatttgcatggaatatcttttcctacctatttaccttgagtctttgtttttaccagttaggtkgttttctgtaagcaacatatggttggatcatttttttttttaaatctagttcaccaatctatatcttttatgtaaaggatttaattcatttatgttcaga

SEQ ID NO: 35472 - DNA, 201 bp, Homo sapiens; identical to SEQ ID NO: 7653

SEQ ID NO: 35473 - DNA, 201 bp, Homo sapiens
attttttggggggggtctcaatttcgtttagttctgctctgatttttgttatttcttctgttaggtttcaatttggtttgttcttttttttttctagtgcyatgagggttacattaggtcattaatttgtgatctttatttttgatgtaggcatttagtgctataaacttccctcttaccgctgctttgctgtatcccaga

SEQ ID NO: 35474 - DNA, 201 bp, Homo sapiens; identical to SEQ ID NO: 7654

SEQ ID NO: 35475 - DNA, 201 bp, Homo sapiens
ttgtgtctcttctttttttggttaatttgagtagtagtccattgattatgttcatcttttcaaagaaccaactttgttttgttgatcctttgcattttttkgggggggtctcaatttcgtttagttctgctctgatttttgttatttcttctgttaggtttcaatttggtttgttcttttttttttctagtgccatgaggg

SEQ ID NO: 35476 - DNA, 201 bp, Homo sapiens
ctggtctgcttttcggtccaggccatcccgaacgccttctgcttggtcccacccttggctgtgagactcctgccaaatgaccccactgccaccctcccaamccctcctgccttggtgcagtctcattaggaacaggaaggtgttgccagccctcgtcttcctttccctgggaactggagatgcagtgactgtgaggacagt

SEQ ID NO: 35477 - DNA, 201 bp, Homo sapiens
ccatttcctctaggttttctagtttttgagtgtagagatgtttatagtagcctctgatgatcttttgtctttccatagtatcaatgtctactttttcattyctgattgtgcttatttgaattgtgtctcttctttttttggttaatttgagtagtagtccattgattatgttcatcttttcaaagaaccaactttgttttg

SEQ ID NO: 35478 - DNA, 201 bp, Homo sapiens
tgaagtcaggtaacatgatgcctccagctttgttctttttgtttaggattgcttttgctattcaggctttggctactcatatggttccatatgaattttargattgtttttctaattctgtgaaaaatgacattggtactttgataagaattgcactgaatctgcagattgctttgggcattatggtcatgttaacaatac

SEQ ID NO: 35479 - DNA, 201 bp, Homo sapiens
catgctgtttgattactatagccttcaggtataatttgaagtcaggtaacatgatgcctccagctttgttctttttgtttaggattgcttttgctattcargctttggctactcatatggttccatatgaattttaggattgtttttctaattctgtgaaaaatgacattggtactttgataagaattgcactgaatctgc

SEQ ID NO: 35480 - DNA, 201 bp, Homo sapiens
cctatttttatatcagtaccatgctgtttgattactatagccttcaggtataatttgaagtcaggtaacatgatgcctccagctttgttctttttgtttargattgcttttgctattcaggctttggctactcatatggttccatatgaattttaggattgtttttctaattctgtgaaaaatgacattggtactttgata

SEQ ID NO: 35481 - DNA, 201 bp, Homo sapiens
tgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggc

SEQ ID NO: 35482 - DNA, 201 bp, Homo sapiens
tactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccgtattgttgtttttca

SEQ ID NO: 35483 - DNA, 201 bp, Homo sapiens
tgacagtgtcagtccagcagctctaggctctccagggcaggttagagctagcccctggctgcctttcagcatcagtgtagtggattgccaggagtctctcrcctgcccttgtgctgggcacccagaaaggcacaggcacagtccattggcagcaagaggtgtgctgggcaggctctccccatgcccaccagactcttagtg

SEQ ID NO: 35484 - DNA, 201 bp, Homo sapiens
attaaattagagatacccacatctatttaggagaagccttggcccgtgggtatggggttctcaagttttttggatattacctggtgtttaaaggggacatmattgtgtaaattattatgattgttcttattatgggcatattgtatgtaatttgttgattttaatctttagtttttggaaaggaacttgcagtaaataatt

SEQ ID NO: 35485 - DNA, 201 bp, Homo sapiens
caggcgccctgggcagaggtgtcatggtgtgtgggtgtgtttggcctttctctggatgggctgctgtgtgttctcctggctctccttcagtggaggagagmatgctcccacagagaatccatccctcctgtcactctcctggtgtgagaggtgctcctgactggggttactgacagtgtcagtccagcagctctaggctct

SEQ ID NO: 35486 - DNA, 201 bp, Homo sapiens
cattttgataggttttagggcagcatatttagttttttaaaaaatatttttctttcctcatttatattaaattagagatacccacatctatttaggagaarccttggcccgtgggtatggggttctcaagttttttggatattacctggtgtttaaaggggacataattgtgtaaattattatgattgttcttattatggg

SEQ ID NO: 35487 - DNA, 201 bp, Homo sapiens
agtttttcagagaagcttccacttgtaagttgaaatcatgatagacatggagtttttgcgtgatcccttcaggacctgtctgtgctttgttgtagaactcyaggcccatgttcatcagcgccgtggaggactgtgagtacacctttgcctggcccacagccacagcctgtcccatgaagagcaacgagcatgatgactgcc

SEQ ID NO: 35488 - DNA, 201 bp, Homo sapiens
gaatgttcaattttaggacataatgtcctgctgacttacatagttgttgaaccagttaacatttcactagcaatacaggagagctctgagccacctcatgkctgacacttggtatttaatttttgccagagggatggttgtaaatggtataccattttggtcttgatttgaaattccttgatcaccagtaacattgaacat

SEQ ID NO: 35489 - DNA, 201 bp, Homo sapiens
acattctgaccctttgcttttcctaatctgcgcctcatcccacaggcacatggagacagaaatgtcacatgctgtggagtttttcagagaagcttccactkgtaagttgaaatcatgatagacatggagtttttgcgtgatcccttcaggacctgtctgtgctttgttgtagaactccaggcccatgttcatcagcgccgt

SEQ ID NO: 35490 - DNA, 201 bp, Homo sapiens
ggctgttctttaaaaaaaaaacaaaacacacacacacacagtagtgaagatagttgtgcatgtagcatttggatgatttctttcaggtaaatttgcagaaragaggcattatctggatcaaaggacataatgtttgtggtctcgatgggtaatgatgaattgctctctaaaactaggcttttgactggagtccctcctttg

SEQ ID NO: 35491 - DNA, 201 bp, Homo sapiens
acttaagtgataacagtaatattactaaaaatcaaccgtattgttgtttttcactgtggtttattccttctgactgctgtgatattttgtgtggatctgcygaagttaatttatccactcttctgttgatgggcctttggtcatttccaggtttttgctcttctgaagagcatgagatattctttcacattttctgctgtg

SEQ ID NO: 35492 - DNA, 201 bp, Homo sapiens
ccagcatcctttgcacgcctgtccccaacccctgtcctgttcctcagcctgagggagcttcctggtcccctaagtgtgttgctgcctgtgggtgtttcacytacctgcaggggaagcccatggtggcagctcaggacacattctgaccctttgcttttcctaatctgcgcctcatcccacaggcacatggagacagaaatg

SEQ ID NO: 35493 - DNA, 201 bp, Homo sapiens
aagtttctctcgtggttacaactgatttccttgaagtatttaataattaggttgtttccactgtttttggctgttctttaaaaaaaaaacaaaacacacayacacacagtagtgaagatagttgtgcatgtagcatttggatgatttctttcaggtaaatttgcagaaaagaggcattatctggatcaaaggacataatgt

SEQ ID NO: 35494 - DNA, 201 bp, Homo sapiens
ctgtgccccagacccaggaggctgggagggaagggtgggggtgtgtcgaggcccctgtgcccagggcccaggaggctgggagggaagggtgggggtgtgtsgaggcccctgtgcccagggcctgggaggctggactgcagcgtggcttatcagggtgcccagcaggaatcatggggtttacctgggaaggaaggtgctgct

SEQ ID NO: 35495 - DNA, 201 bp, Homo sapiens
gagaagttccaacgtgtcctacaaatactcaaaggtaattttctgtggcgagtctcttgaaggcctgcctccccggccccctgtgctgcgctgtccatgtmgttctcatcaggggtgccaaggaaagcagtcacaggctgactggaatccagaaaggaaagcaacacccgttgcctcagccacttacgccagcacattttt

SEQ ID NO: 35496 - DNA, 201 bp, Homo sapiens
gagggaaaggtgaagggtgtgtggaggccctgtgccccagacccaggaggctgggagggaagggtgggggtgtgtcgaggcccctgtgcccagggcccagkaggctgggagggaagggtgggggtgtgtcgaggcccctgtgcccagggcctgggaggctggactgcagcgtggcttatcagggtgcccagcaggaatcat

SEQ ID NO: 35497 - DNA, 201 bp, Homo sapiens
agggaaacagtgataagtaagctgaccacttgctgtaggagaagttccaacgtgtcctacaaatactcaaaggtaattttctgtggcgagtctcttgaagrcctgcctccccggccccctgtgctgcgctgtccatgtcgttctcatcaggggtgccaaggaaagcagtcacaggctgactggaatccagaaaggaaagca

SEQ ID NO: 35498 - DNA, 201 bp, Homo sapiens
caaaacatgtgatttcattcttttttatggccaacatgtggaatttgtccatagaaaagaatgaaatcacacacacacacacacacacacacacacaaaamacacaccacattttttgttatccagtcatccattgatggacacttaggtttattccatatctttgcaattatggatagtgctgtgataaacatatgagtg

SEQ ID NO: 35499 - DNA, 201 bp, Homo sapiens
gtaaatttgcagaaaagaggcattatctggatcaaaggacataatgtttgtggtctcgatgggtaatgatgaattgctctctaaaactaggcttttgactsgagtccctcctttgacattcctcccctgccatgcagtgggcacctttcagtctatgagtagcccggaagagccccttctcccccagctgcgctgggggat

SEQ ID NO: 35500 - DNA, 201 bp, Homo sapiens
gggagggaaaggtgaagggtgtgtggaggccctgtgccccagacccaggaggctgggagggaagggtgggggtgtgtcgaggcccctgtgcccagggcccrggaggctgggagggaagggtgggggtgtgtcgaggcccctgtgcccagggcctgggaggctggactgcagcgtggcttatcagggtgcccagcaggaatc

SEQ ID NO: 35501 - DNA, 201 bp, Homo sapiens
tgttaagttgctctagagggccctctgctgttggattccaaagcccatcttctttccactcaatcacaacaaatacattagggtatatataacctgtcacrgctactcatttgtcattcagaatgtgggagaaatgcagccaccaccagccccctggtggtgcagatgggggtggggctggcgggggtggggctcctgccc

SEQ ID NO: 35502 - DNA, 201 bp, Homo sapiens
tgcaaaacatgtgatttcattcttttttatggccaacatgtggaatttgtccatagaaaagaatgaaatcacacacacacacacacacacacacacacaamacacacaccacattttttgttatccagtcatccattgatggacacttaggtttattccatatctttgcaattatggatagtgctgtgataaacatatgag

SEQ ID NO: 35503 - DNA, 201 bp, Homo sapiens
tttccactgtttttggctgttctttaaaaaaaaaacaaaacacacacacacacagtagtgaagatagttgtgcatgtagcatttggatgatttctttcagrtaaatttgcagaaaagaggcattatctggatcaaaggacataatgtttgtggtctcgatgggtaatgatgaattgctctctaaaactaggcttttgactg

SEQ ID NO: 35504 - DNA, 201 bp, Homo sapiens
aggtgatccgcctgcctcggcctcccaaagtgctgggattacaggagtgagcccctgcgcctggccccacacacagtcatcctcaagtgtccagttggccrgatctgagttgcttcctgtgggaggtggaggctgcggtgacagtggtgccctctgctctcctgttagaccccagacctctcagtcccacagatactctcc

SEQ ID NO: 35505 - DNA, 201 bp, Homo sapiens
agggtggctcgccccatgctctccagcggtgggcagcagtggtaggggagcttgggatggggggctccaggagcttcaggcctgccctcttgcctggagcrgcagggaagtttcctcttgggaagattgtgcagaggcttagtccagactcatgagctgctggggcctctgagcattctcctctgtgacctgagaggctca

SEQ ID NO: 35506 - DNA, 201 bp, Homo sapiens
ctacagcagcgaaggctcgaggttcttagtccaaaactctctggaagcagtccccagcgttgtggtttttaaatgcctgcatttctgtctgaccaaggccraggccctcgcacatcacccgtgcctgcggcttctaggaccgtggtcctttgtgtccaaagatgagtagaacattaaacggcacctttcatgggtgccttt

SEQ ID NO: 35507 - DNA, 201 bp, Homo sapiens
gcaccaggttacatagagtggagtcagggcagatgcctgaaggaagggaggcagggcagacagaaaagcagaatgcattgcccttggatttggcaacatgratgtccgtggtgacctttcactaaggcagttagaataatgaggtttgaccacaatggatgctcgtgacatagagatggtatatgactagggactgtctga

SEQ ID NO: 35508 - DNA, 201 bp, Homo sapiens
caccagccccctggtggtgcagatgggggtggggctggcgggggtggggctcctgcccatgccctctctacactggagtaattattgtctccttttttttwatagggaaacagtgataagtaagctgaccacttgctgtaggagaagttccaacgtgtcctacaaatactcaaaggtaattttctgtggcgagtctcttga

SEQ ID NO: 35509 - DNA, 201 bp, Homo sapiens
tcccttacttgtttggcatgcacgtaagcaggtgtcgactgcatacaggtttttctgtgtgtgagattgtggtgagccccagtgctagcgtgcatgacaarctcggtggctgagttgggcattaactcgggcaagaccagctcgctgggtgtcagggtggctcgccccatgctctccagcggtgggcagcagtggtagggg

SEQ ID NO: 35510 - DNA, 201 bp, Homo sapiens
ccttcttgtctgctttctgacaaccctgccacaaactcatcatcaggaactttttgcagccctcttccatgtggagtgggacttgtggccttgttttctgkgcaggagtaagaatcacatggtgttgggaaagtcagagctgctcttgccttggggactcaggtctcaggttgtggctgtggcagcaggaccaccctgtga

SEQ ID NO: 35511 - DNA, 201 bp, Homo sapiens
gatggtcactggagttaggcttacattaaaggttaaataaatagtcctgaggattggcagtctcagagaaagaggtgcagccccttctttcctagggttcrtttcattccccaaatgtatgccttttgggtcaggatcgctatccttctgtgaagaatatgaatccaagtggattaatatatcagcaccaggttacataga

SEQ ID NO: 35512 - DNA, 201 bp, Homo sapiens
cagctgagccacaggccaatgagagaggtggtcagaaagtaccaaccatggaggttgcagtgagccaagatctcaccactgcactctagcctgggcaacasagtgagactctgtccaaaaaaaaaaaaaaagtaccgattgtggccctctacacccaaaatgcagaatggggcagaagaaggtctgggccgggaagggcat

SEQ ID NO: 35513 - DNA, 201 bp, Homo sapiens
gaagcagtgccttcttgtctgctttctgacaaccctgccacaaactcatcatcaggaactttttgcagccctcttccatgtggagtgggacttgtggcctkgttttctgggcaggagtaagaatcacatggtgttgggaaagtcagagctgctcttgccttggggactcaggtctcaggttgtggctgtggcagcaggacc

SEQ ID NO: 35514 - DNA, 201 bp, Homo sapiens
agatggtcactggagttaggcttacattaaaggttaaataaatagtcctgaggattggcagtctcagagaaagaggtgcagccccttctttcctagggttygtttcattccccaaatgtatgccttttgggtcaggatcgctatccttctgtgaagaatatgaatccaagtggattaatatatcagcaccaggttacatag

SEQ ID NO: 35515 - DNA, 201 bp, Homo sapiens
gaacggagccaggcagtcggcgcggtgctcagcctgctgctggtggcgctcacctgctgcctgctggccctgttgctctacaagaaggagaggaggtaagygggtggcagggcgaggtggggcgggtggatgcatgcctcccatagctaatcttggggtcagttttgtggggttttatttatttgtttttaagccctacag

SEQ ID NO: 35516 - DNA, 201 bp, Homo sapiens
cagcctagtcctgccgtggattgggccacctagagggggccgcgtccctcctgcctgtctcctctgtgtttgggtgaatgatagttcatggagctggaagyagtgccttcttgtctgctttctgacaaccctgccacaaactcatcatcaggaactttttgcagccctcttccatgtggagtgggacttgtggccttgttt

SEQ ID NO: 35517 - DNA, 201 bp, Homo sapiens
tcccagacagtgtttctgctgtcaaagatggtcactggagttaggcttacattaaaggttaaataaatagtcctgaggattggcagtctcagagaaagagrtgcagccccttctttcctagggttcgtttcattccccaaatgtatgccttttgggtcaggatcgctatccttctgtgaagaatatgaatccaagtggatt

SEQ ID NO: 35518 - DNA, 201 bp, Homo sapiens
gcctgtttctaaggccccctgggcccctttcgtgtggagatggtgtctcatggtgggctgcgctcactgcttccagaagaaattctgagaggaaagagctstgaccctggagagaagtgtggtgcttcgggacagcctctgccccagcctagtcctgccgtggattgggccacctagagggggccgcgtccctcctgcctg

SEQ ID NO: 35519 - DNA, 201 bp, Homo sapiens
gccccagcctagtcctgccgtggattgggccacctagagggggccgcgtccctcctgcctgtctcctctgtgtttgggtgaatgatagttcatggagctgraagcagtgccttcttgtctgctttctgacaaccctgccacaaactcatcatcaggaactttttgcagccctcttccatgtggagtgggacttgtggcctt

SEQ ID NO: 35520 - DNA, 201 bp, Homo sapiens
cccagcccacatttccttttagtgctcccccgactcccattcctttgtaccttccagctttggctgtagttcccagacagtgtttctgctgtcaaagatgstcactggagttaggcttacattaaaggttaaataaatagtcctgaggattggcagtctcagagaaagaggtgcagccccttctttcctagggttcgtttc

SEQ ID NO: 35521 - DNA, 201 bp, Homo sapiens
caggcctccaccttactgcacgatgaagagtttgaggagatcaagaaggagactggcttttcccacagtcaaatcacacgcctgtacagccggttcagcarcctggacaaaggagagaacaggacgatttccaggggattccagaacttgccatcaacccagtgggggactggatcatcaatgccttccttccagagggag

SEQ ID NO: 35522 - DNA, 201 bp, Homo sapiens
tgtggagtgctgtgtgaggcatgtcttctcttccctcctggagtagggagacagccagtagttgctacctgccccgagcagggtgcttgcagatcttgcckatgtggaatcctctaagtgtcttggtgaaatgcagctgttttcagaatgaagagttctttcattttcccttcttgccatatgccatcttgctcccttttc

SEQ ID NO: 35523 - DNA, 201 bp, Homo sapiens
cgtatatagcgatacaaaaattttgaatgtttagaaatcataagtgtttataatacataatacacatttgttagtagttaaaaatgctaacggtttgaatrtctagtatgagctaaaactaggttggttctgtctagtggatactatacagacagctgttatgaagaattatgtagatgtgtatttgatattgaaagctgt

SEQ ID NO: 35524 - DNA, 201 bp, Homo sapiens
gagcaggtgctccgtgccctggtgctgagcgcatcgccgagaaggagcaggtgctccgtgccctggtgctgagcgcatcgccgagaaggagcaggtgctcygtgccctggtgctgagcgcatcgccgagaaggagcaggtgctccgtgccctggtgctgagtgcatctccacgacggcagcacctgatggagggaagctgg

SEQ ID NO: 35525 - DNA, 201 bp, Homo sapiens
acatctgtggaagtgtggatattgtccagtgcgggccatcaagtgctgtttgtatgcacgacttgaagacacgcacttatcattcagtgggtaagtagaaytacctgaaattactggattggcaatatgattccccaattttgcaaaaatgactgtgtatagctatacgtatatagcgatacaaaaattttgaatgtttag

SEQ ID NO: 35526 - DNA, 201 bp, Homo sapiens
cgtctatccaggaggaagtctcagaatgttcagagttcctctgaagttcacattctagctgtagatcaagtgcctaaattggcataaacacacgtgtttgyttaggaaagccaaacagttgcatgaggacttggtacaggtagttcagaggtacatctttgtaaaatgtcttaacaatttttcacgggaaattgatcttgt

SEQ ID NO: 35527 - DNA, 201 bp, Homo sapiens
accaaaaataatgtactttataaaatcaacatctgtggaagtgtggatattgtccagtgcgggccatcaagtgctgtttgtatgcacgacttgaagacacrcacttatcattcagtgggtaagtagaactacctgaaattactggattggcaatatgattccccaattttgcaaaaatgactgtgtatagctatacgtata

SEQ ID NO: 35528 - DNA, 201 bp, Homo sapiens
gaccttacaagaaggccataatatcatgctcgtcctactttgaacatgctgttgtttattagcccagcagttatgggctttgaatagcgctttaggctaayccagtagaagggaatggtggagttggatccatctccaaggaaaatgttagtaatcgcggttctggtggcctcaaggggcagcgtctcttctgcctcctcc

SEQ ID NO: 35529 - DNA, 201 bp, Homo sapiens
actccagcctgggcaacacagtgagactccgtctcaaaaaagaaagaaagaaagaaagaaagaaagaaagaaagaaagaaagaaaggtacatggaagattygattgcttggattgccttagggaactatgggatccctaggtgagggttgcagttgagcatggtagctgcttttcctcttcaggttgcctttaggctgcga

SEQ ID NO: 35530 - DNA, 201 bp, Homo sapiens
gtccttttggctgagccgactgggcaaaagttttagaaaagaccctgggtgttgcagatggagaaggatgatcgtggctgacttttgcttgcaggcagaasaaccacggggccatcagcctggtgctgtgggggcgcgctgactcgtggtccgcccctgccccaagacttcaggtgtatatgggattggatcagctatcat

SEQ ID NO: 35531 - DNA, 201 bp, Homo sapiens
cagacacgcccactgcgggcgggacagtgggagctgtccaggcgcggagctgtccaggcgcgggagctgtccaggcgcgggagctgtccacgaggcactgwccttggtttcagagcctctgcagggcttctgtgtccttttggctgagccgactgggcaaaagttttagaaaagaccctgggtgttgcagatggagaagga

SEQ ID NO: 35532 - DNA, 201 bp, Homo sapiens
acctggcggccatgctgccccagtgatacctgcagcttaaagcatgtactcacttttctctcagaccctgcgggttcgagggctcaggtttttcttttaaygggtcacttttaaaagcagacagtgctcgactgaaagctagaagaccctagaaaaccacagttggtttctgtttctggcttttcactttttccattctgt

SEQ ID NO: 35533 - DNA, 201 bp, Homo sapiens
tattacattattttaaattgaggaatcatacattatccacacatccaaggagctcagaagaaattaaaaaaatcatacattagtttttccttaggcaaacratattacatatgtgaatcttagcaaatgttagccatcattttcatagggcctgtgaacaatatttggtcccatttgcaacctaattattttcacatttta

SEQ ID NO: 35534 - DNA, 201 bp, Homo sapiens
cagtgacagagactctgagtttcttggttatagttggcctttttgtggtagctttctcaaatgctagtgatagtaatgatgtgcttgggtgtgtgagcagsatcctcaccgtctcccgcggggcctggaaggcagagttctcaggaagttattttgttctcccttgctttgcactttggcagcagaatttatattgggttg

SEQ ID NO: 35535 - DNA, 201 bp, Homo sapiens
tacaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcag

SEQ ID NO: 35536 - DNA, 201 bp, Homo sapiens
ggctgtggaggagattgttgtttgactacatgcccttttgtcttcacggcggcagcttgggaagcacgagaaggttggctgggcccgggtcacaggtagcrctgccacttcccagccacataacttggttaattactcaggtagtctgccctgctcagccgttcataacatgaggcatacttgtcctgcccattgcagggt

SEQ ID NO: 35537 - DNA, 201 bp, Homo sapiens
gacgctgcctgcttcatcttcctttgcacctggctttccacctgtgttgtaccccgcttttgataagtctcctttacctgtttgcattgttaaatctctcygtccctctcctcagccttgggatgacttctggctgcaatgtgagtccaggtcaggtatcccttaaattcttttccagctcacctcagagactagattact

SEQ ID NO: 35538 - DNA, 201 bp, Homo sapiens
tcatctgccttgggatgcgagttctagagcctgggatgatgcgcccttaccagaggttgggggaacagcgtcgccgcggcctgcaatctggggaaccctcrtgctgtctggctccttagaagcttgcctggcagttcccgactcagaattggttctcttcagagtttgactcagacccctaaaggctgtggaggagattgt

SEQ ID NO: 35539 - DNA, 201 bp, Homo sapiens
gtcctgtggttgttgggtagaatgatctttaaatgtcttttaggtccatttaatcctgagtccaatttaagttcagtgttttattgttgattttctgtgtygatgatctttctagtgcttgtagtgaggtgttgaagtctctcattattattacattgctgtctatctcctcttaggtctagtggtaatgattttatgaat

SEQ ID NO: 35540 - DNA, 201 bp, Homo sapiens
ggatcttggcagtaaccactatctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattac

SEQ ID NO: 35541 - DNA, 201 bp, Homo sapiens
gttgcagctttgggaattgagcccatgtgcagggcggtgagccgcacgtcctcatctgccttgggatgcgagttctagagcctgggatgatgcgcccttaycagaggttgggggaacagcgtcgccgcggcctgcaatctggggaaccctcgtgctgtctggctccttagaagcttgcctggcagttcccgactcagaatt

SEQ ID NO: 35542 - DNA, 201 bp, Homo sapiens
ttggccaggctggtcttgaacgcctgacctcgtgatccacccacctcggcctcccaaagtgctgggattacagacgtgagccaccatgcccagccagatayttctattttgataatctttgagtcctgaggtagcttcagaatggattgaaccacagacagatggtgttagtagtttctgccctggcttctttgcaactta

SEQ ID NO: 35543 - DNA, 201 bp, Homo sapiens
aaagaatttcgactgctacagcctagctattcctctacactcacgcccgcctgccccagtccatctgtgacaaaacagcatgtaagtgagtgagaactaaygtgatgtcattgtcatctgacttatgtgaaagaaatagcaggtattttgaagtgactcttagaaagcgtatgaagttctgcagcgtgtgtgacatttatt

SEQ ID NO: 35544 - DNA, 201 bp, Homo sapiens
ctgagaggaaagagctctgaccctggagagaagtgtggtgcttcgggacagcctctgccccagcctagtcctgccgtggattgggccacctagagggggcygcgtccctcctgcctgtctcctctgtgtttgggtgaatgatagttcatggagctggaagcagtgccttcttgtctgctttctgacaaccctgccacaaac

SEQ ID NO: 35545 - DNA, 201 bp, Homo sapiens
aggcaggcggatcacgagatcaggagattaagaccatcctggctaacatggtgaaaccctatctctactaaaaatacaaaacattagctgggtgtggtggygggtgcctgtagtgccagctacgggaggctgaggcaggagaatggcgtgaacccgggaggtggagcttgcaatgagcggagattgcgccactgcactcca

SEQ ID NO: 35546 - DNA, 201 bp, Homo sapiens
tcagcctcccgagtagttgggactataagcgtgcgcgaccatgcctggctaatttttgtgtgtgtgtgtgtgtgtgtgtgtgtgtgtttttttttttttttaagtagattcagggtttcaccatgttggccaggctggtctcgaactcctgacctcaagtgatcctcccaccttggcctcccaaagtgctgtgattacagg

SEQ ID NO: 35547 - DNA, 201 bp, Homo sapiens
ctgacagcaggactggggaaaaaggttagtgggttagagcattcctgcagatttgatagcctatttctaagagaaatttgaaagctaaatattaagcagtyaacttttgtaaatagacctgtctgtgaattgcttcagtctaaaagataaaattttgggaaacttatccacagaaaataataaaactatctactttgaaat

SEQ ID NO: 35548 - DNA, 201 bp, Homo sapiens
agaaggtgcatggacgtaggccatttaaaatgttcctctgtcttaatttgggaatataaccttcatcctatatggggttcagaaagaatttcgactgctayagcctagctattcctctacactcacgcccgcctgccccagtccatctgtgacaaaacagcatgtaagtgagtgagaactaacgtgatgtcattgtcatct

SEQ ID NO: 35549 - DNA, 201 bp, Homo sapiens
ggctctgctgctccctgggccccaccctggtctgtggccgcccctgggccccgtcctggcctgtttctaaggccccctgggcccctttcgtgtggagatgstgtctcatggtgggctgcgctcactgcttccagaagaaattctgagaggaaagagctctgaccctggagagaagtgtggtgcttcgggacagcctctgcc

SEQ ID NO: 35550 - DNA, 201 bp, Homo sapiens
ctcagcctcccgagtagttgggactataagcgtgcgcgaccatgcctggctaatttttgtgtgtgtgtgtgtgtgtgtgtgtgtgtgtttttttttttttttaagtagattcagggtttcaccatgttggccaggctggtctcgaactcctgacctcaagtgatcctcccaccttggcctcccaaagtgctgtgattacag

SEQ ID NO: 35551 - DNA, 201 bp, Homo sapiens
gagctcaggctgcacctctttttaccatgtgggctctttgatgtggtagaggcgcctctgtccctccccagaatgttgccctggaggcccgctgatcaccrttggggccagtgcttgtctcagctgttggagagcctgaatatgtgcttgcctgacccagctccacccagctttccttcctcaatctgccttgctggcaga

SEQ ID NO: 35552 - DNA, 201 bp, Homo sapiens
gggctgtgctgggctctgctgctccctgggccccaccctggtctgtggccgcccctgggccccgtcctggcctgtttctaaggccccctgggcccctttcrtgtggagatggtgtctcatggtgggctgcgctcactgcttccagaagaaattctgagaggaaagagctctgaccctggagagaagtgtggtgcttcggga

SEQ ID NO: 35553 - DNA, 201 bp, Homo sapiens
attctcgtgcctcagcctcccgagtagttgggactataagcgtgcgcgaccatgcctggctaatttttgtgtgtgtgtgtgtgtgtgtgtgtgtgtgtttktttttttttttaagtagattcagggtttcaccatgttggccaggctggtctcgaactcctgacctcaagtgatcctcccaccttggcctcccaaagtgct

SEQ ID NO: 35554 - DNA, 201 bp, Homo sapiens
caggtcctagtctgtgtgtttagaggggttgggctatctcggggaagtgcgtctatccaggaggaagtctcagaatgttcagagttcctctgaagttcacrttctagctgtagatcaagtgcctaaattggcataaacacacgtgtttgtttaggaaagccaaacagttgcatgaggacttggtacaggtagttcagaggt

SEQ ID NO: 35555 - DNA, 201 bp, Homo sapiens
tatccacgagaaaagtatctaatcacctataaagaaaatcccatcaaactaataggggacttctcaggagaaacttaagagccagagagattgggtttctsttttcaaggtgcttaaggaaaaaaaatctgtcaaccctgaattttgtatcctgccagaataagtttcatgtatgaaggaaaaataaagtctttctcagac

SEQ ID NO: 35556 - DNA, 201 bp, Homo sapiens
cgggggctgtgctgggctctgctgctccctgggccccaccctggtctgtggccgcccctgggccccgtcctggcctgtttctaaggccccctgggcccctktcgtgtggagatggtgtctcatggtgggctgcgctcactgcttccagaagaaattctgagaggaaagagctctgaccctggagagaagtgtggtgcttcg

SEQ ID NO: 35557 - DNA, 201 bp, Homo sapiens
tttggctaaggaaagtgtattttctagtttgtggcagttttaagcaaatgtggcttgaataaaactagagagaagtttaatttttgataaatcagtgacaktgacaagttgtttttcttcctttccagttatacatgggaagctgttgataccaaaaataatgtactttataaaatcaacatctgtggaagtgtggatatt

SEQ ID NO: 35558 - DNA, 201 bp, Homo sapiens
ctattctcgtgcctcagcctcccgagtagttgggactataagcgtgcgcgaccatgcctggctaatttttgtgtgtgtgtgtgtgtgtgtgtgtgtgtgtktttttttttttttaagtagattcagggtttcaccatgttggccaggctggtctcgaactcctgacctcaagtgatcctcccaccttggcctcccaaagtg

SEQ ID NO: 35559 - DNA, 201 bp, Homo sapiens
tggtgactggaaacggagcctctggagctggaagaacctgggcggactgagttaggctgggtttgatttgcgtttgtgtgtagctcaggttgtgggaggcrtgtgggttttctcgggtctttggcaggagctccttaggctttgctggctggggtcagcccatggtcctgaccactctgcgtggggagcgcccgcttggcc

SEQ ID NO: 35560 - DNA, 201 bp, Homo sapiens
agaaatcaattcacagagaaactctcataactatacaaataattggaaattaaatagcctgcttctgaatgaattttgagtcaacaatgtagttaagatgraaattaaaaaaaaattgaaacaaatgaaagtggatacacagcataaaacctgcgggatacagcaaaagcagggctaagtgggaagtttatagtgttaaat

SEQ ID NO: 35561 - DNA, 201 bp, Homo sapiens
atgtgggtcttgggtgggaatggtgaactccgctggtgaggcagctggtgtgctcaagagccttctcctgggatggagcaggcttggagagaggagacccdtcgggggctgtgctgggctctgctgctccctgggccccaccctggtctgtggccgcccctgggccccgtcctggcctgtttctaaggccccctgggcccc

SEQ ID NO: 35562 - DNA, 201 bp, Homo sapiens
gaactcctgacctcaagtgatcctcccaccttggcctcccaaagtgctgtgattacaggcatgtgccactgcgcatggcctgaagttctttctttcagaaratgtattcaacacattcttttgtgtgtgtttgagtgaagacggtgtttccacacagcttgcagatactttcttccagaagcttgtttgttgctaacattt

SEQ ID NO: 35563 - DNA, 201 bp, Homo sapiens
tcagattatgcctcaggaaaatgaatgtctgctatgggtcttcaggattctgaagctagtgaggattccggtaaaccaggcgactcatttattgactttcygccatgtggcagcccaggtggggatggaggtttcttggtgagccacactcagtgccttgcccctgcggtgctcaggaagtttcatgagaggagccaactg

SEQ ID NO: 35564 - DNA, 201 bp, Homo sapiens
gtctccgtggttgtttctcattttctattattgtcccaactctgcttgagtgttcgatgtcatggaaacgcactgctttttcccacaagtgtgcatgtggrtcttgggtgggaatggtgaactccgctggtgaggcagctggtgtgctcaagagccttctcctgggatggagcaggcttggagagaggagacccgtcgggg

SEQ ID NO: 35565 - DNA, 201 bp, Homo sapiens
ttcaccatgttggccaggctggtctcgaactcctgacctcaagtgatcctcccaccttggcctcccaaagtgctgtgattacaggcatgtgccactgcgcrtggcctgaagttctttctttcagaaaatgtattcaacacattcttttgtgtgtgtttgagtgaagacggtgtttccacacagcttgcagatactttcttc

SEQ ID NO: 35566 - DNA, 201 bp, Homo sapiens
agctattctcgtgcctcagcctcccgagtagttgggactataagcgtgcgcgaccatgcctggctaatttttgtgtgtgtgtgtgtgtgtgtgtgtgtgtktttttttttttttttaagtagattcagggtttcaccatgttggccaggctggtctcgaactcctgacctcaagtgatcctcccaccttggcctcccaaag

SEQ ID NO: 35567 - DNA, 201 bp, Homo sapiens
tgttttggataatgtggtacctgtgagctgagagggtgtatgtggccactgggcagcatcttggtgctctcgtagggcatgccaggtctcaggaaggttcytggattgcgtggccaactcagcgcagctgacacttgcgttgtacctcatggctctgcacttaacgctttttgatgataagtaacctcatgaggcgggtag

SEQ ID NO: 35568 - DNA, 201 bp, Homo sapiens
tacaaaggataaaaaaaatgagaagttggttctttggaaagataatattcatagactgttggtcagattaaccagaagagagaggattcaatcagaaatargaaagtagacattacagctgataccacaaaaaagatcataagagacttctgtgaacatctgtgtactcacaactgagaaaatttagaggaaatgtgtaca

SEQ ID NO: 35569 - DNA, 201 bp, Homo sapiens
gtgtgtgtttttttttttttttaagtagattcagggtttcaccatgttggccaggctggtctcgaactcctgacctcaagtgatcctcccaccttggcctyccaaagtgctgtgattacaggcatgtgccactgcgcatggcctgaagttctttctttcagaaaatgtattcaacacattcttttgtgtgtgtttgagtga

SEQ ID NO: 35570 - DNA, 201 bp, Homo sapiens
atgtcgaaagtaggagaatcttttttggatgttcaggttggaaacacttcacattctctttgtctccaacatgttagatttgttgcttgctgtagactcaragaaacatttctctagctagtgaccatgtatcttgttatgtgaatttcacttatgtgtcaccaactgggtttctgtcttttaaggaaaccaaattacaga

SEQ ID NO: 35571 - DNA, 201 bp, Homo sapiens
cccatgaagagcaacgagcatgatgactgccaggtcaccaacccaagcacaggtgagaggtggtgccagtcgttaaccccagcgcaggtgagagacggtgyccccaccaaacccagctcatcaggggagagacccaaagagaagctatgggcagcaggcgccctgggcagaggtgtcatggtgtgtgggtgtgtttggcct

SEQ ID NO: 35572 - DNA, 201 bp, Homo sapiens
gataatattcatagactgttggtcagattaaccagaagagagaggattcaatcagaaataagaaagtagacattacagctgataccacaaaaaagatcatmagagacttctgtgaacatctgtgtactcacaactgagaaaatttagaggaaatgtgtacatttctggaaacattcaagttcctgagattcaaccaggaag

SEQ ID NO: 35573 - DNA, 201 bp, Homo sapiens
cttgttatgtgaatttcacttatgtgtcaccaactgggtttctgtcttttaaggaaaccaaattacagattcacacgtgcctacttttattattactgatyccatcctgcctttatcttgctttattaattgcaggccagtagtaaaatgtttaatagttacatgaccattagcataaccccaagattcacagggactgag

SEQ ID NO: 35574 - DNA, 201 bp, Homo sapiens
gtggaatgggctagttctcttggtatatctttttgttttgactgtgataatggattttacctcatttggtttttagaattttatcaatgatttacacattygtgtctccctgtagcccttccagcatcctttgcacgcctgtccccaacccctgtcctgttcctcagcctgagggagcttcctggtcccctaagtgtgttg

SEQ ID NO: 35575 - DNA, 201 bp, Homo sapiens
atacatttagccaaggaggtgaaaaatctctacaaggaaaactgtaaaacactgatgaaagaaattgtagatagcagaagtgggaaaacatcccatgttcrtgaattggaagaatcaatatcattaaaatgattatattgcccgaaacaatccacagattcaatgcaattcctatcaaaatgccaacgtcattttttatgg

SEQ ID NO: 35576 - DNA, 201 bp, Homo sapiens
aaattaaccacaaagcaggcaagtcagcaatttcctttttttttttttttttttttttttttttggagacagagacttgctcttttgcccaggctggagtrcagtggtgcgatcttggctcactgcaacctctgcttcccagattcaagtgattctcatgcctcagcctcctgagtagctgggattatgggcgtgtgccac

SEQ ID NO: 35577 - DNA, 201 bp, Homo sapiens
tggcacctccattggttgtcttgtgtcccacagccgttttatactttgccacgaataacatgttgtcagttgctttcctcttggatttattttcttcttaygttacccccacccatcattgtatttatatttatttttattttttatttttttgggatggactcttgctctgtcactcaggctggagtgcagtggtgcggt

SEQ ID NO: 35578 - DNA, 201 bp, Homo sapiens
attgtttctcttttagtgtaggcaacagcaagttgttgacgacagtggttaccttaggctcttgacattctgctcccaaggtccagtgtgggaaccctgcytccttgctcctcttccttgctgttttttccctttctccttagttaaggagactggtctggatttctgaaggtgactgtgctggatatgtatgagctgaaa

SEQ ID NO: 35579 - DNA, 201 bp, Homo sapiens
tatatggaacgtaataaaaaaaaaccccacaatgagataccatcttataccagtcaaaaatggcaattattaaaaagtcaaaaaacaacagatgttggcaragttgcagaaaaaaaagagaacacttatacaccattggtgggaatgtaaattagaatgacctttatggaaaatagtatggaaattaatcaaagaactaaa

SEQ ID NO: 35580 - DNA, 201 bp, Homo sapiens; identical to SEQ ID NO: 7656

SEQ ID NO: 35581 - DNA, 201 bp, Homo sapiens
cacctcccaccacccccagcagcagtgccattgtttcctttgtgtgtaccatgccccgaatagggtccagtcagggcaccccagctctgtccctctacccygttcccattgctgcctccctctccttagctcctgggaggcaagtactggtggtgcctcctctgtgtaatcctggaacatcttttgtgtcgtaatacaaat

SEQ ID NO: 35582 - DNA, 201 bp, Homo sapiens
cgtgcttccccagccttcagctcggggtaggagtcttcatgcaaatcagattgtttctcttttagtgtaggcaacagcaagttgttgacgacagtggttaycttaggctcttgacattctgctcccaaggtccagtgtgggaaccctgcctccttgctcctcttccttgctgttttttccctttctccttagttaaggaga

SEQ ID NO: 35583 - DNA, 201 bp, Homo sapiens
tgcttctatttatttgtatttgtcggccctgtatctttgtccacagctttgtgggtttgttagaataggaagtgaagtacttcctatataagctctggccrtgctgtgtcaaactcacgtgcttccccagccttcagctcggggtaggagtcttcatgcaaatcagattgtttctcttttagtgtaggcaacagcaagttg

SEQ ID NO: 35584 - DNA, 201 bp, Homo sapiens
ggggcaggaatctggcccaggcccttcatggcacctttcttagggtagcgtgccccctctctattccaggtgacctctgttacgcagtccccattgcctgycctggttccctgggctctgacatcaacttagatgtcgtgtttgacttagggcttccagccggatccctctccatacaccgggcttccttccagaccctgc

SEQ ID NO: 35585 - DNA, 201 bp, Homo sapiens
tcgaggtgtggagtttggatgggggccgggggtcaccctcctgcatgtggtggcttggtcccaggctaggctgggagaaagggggctgtcgtggttccagkgcaagaagagccgtcctccctgtttccctgtggtaggatcaggaagtctcagctaacttctgcacatggtcaagggggtcctgtcctcacttaggcctct

SEQ ID NO: 35586 - DNA, 201 bp, Homo sapiens
ggatgttctggggtagtacttgatagcattgagtcacagggaatgcatttagtacgaggtttggctgtagaaattacagggcacgctgttggtcattcatrctgtttcagcagttgggcaagatttaaatacatttaggaacttgtaaaaatgaagtcaaagtagctggtggtgagtacgtggacagccctcaggcacagt

SEQ ID NO: 35587 - DNA, 201 bp, Homo sapiens
tgcctcagcctcccaaagtgctgggattacaggcgtgagccaccgtgcccggcctcatcaactttataatgagacagttttgaaggaaatgatgtcattcraggacctcccatagtcgcttcacggaaggttgcagtttgaaggaaactgtcagcgaccctatgaggacacactgtactggacaacagtggtgtctaagct

SEQ ID NO: 35588 - DNA, 201 bp, Homo sapiens
cctgaaaaaagtcagtgtttcaagtattttaataggctcctcctttcctactcccataaccacttacatttgataaatcttgacaaaacaagtatgaaatscaagtagagaaaataatataattgaatagagcaacacttttctttctagcaaccctgatttccagattatcaggacaatatccctcattttattcttttt

SEQ ID NO: 35589 - DNA, 201 bp, Homo sapiens
atgctgtagccattgtaatgtcgtagcacaatgcattagtcacatgtttgtggtaatactgctgtaaacgaacccactgcgctaccagtcttatgaaagcrtccagtcaggtcctaggcctttaggtccactcactcactgactcacccagagccgcttccagtcctgcaggctccattcattataagtgccctaggcaag

SEQ ID NO: 35590 - DNA, 201 bp, Homo sapiens
gctgaacaattcttatcacctagtgatgctgtagccattgtaatgtcgtagcacaatgcattagtcacatgtttgtggtaatactgctgtaaacgaacccrctgcgctaccagtcttatgaaagcgtccagtcaggtcctaggcctttaggtccactcactcactgactcacccagagccgcttccagtcctgcaggctcc

SEQ ID NO: 35591 - DNA, 201 bp, Homo sapiens
atgatgtgatgtggtctgaatcttcagacagttcacagctttttcatagaggctgtcctcagatgggttcaaccattctgagaattctgcctttacgatayaagtagtatccatgacattaaaaacgagaagagaagcgttttggccaatgacggactgcataaactacagtctgcataaatgaccttggtcctagaagat

SEQ ID NO: 35592 - DNA, 201 bp, Homo sapiens
gcagaagagaaagcagaactggactgggagtatagagtagcagaagtttaagcttggggaagaagttgagcaaggaaaagcatatgatctgttgatcagcrtgatgtgatgtggtctgaatcttcagacagttcacagctttttcatagaggctgtcctcagatgggttcaaccattctgagaattctgcctttacgatat

SEQ ID NO: 35593 - DNA, 201 bp, Homo sapiens
ggaaacacttcacattctctttgtctccaacatgttagatttgttgcttgctgtagactcagagaaacatttctctagctagtgaccatgtatcttgttawgtgaatttcacttatgtgtcaccaactgggtttctgtcttttaaggaaaccaaattacagattcacacgtgcctacttttattattactgatcccatcct

SEQ ID NO: 35594 - DNA, 201 bp, Homo sapiens
aagaccaatactaggactgtggaagttggcagccagaaaccagatgggaaaaaaaaacccatacatgtattatatatatttatatatatatatatataaartatatgtattgtgtatatattatataagcatatttattatatatatattatagtgtatattatatatgtattatatataatatataatatatagttatat

SEQ ID NO: 35595 - DNA, 201 bp, Homo sapiens
tgtgtgtgtctgagtgtgtgtgtgtgagtgtgtttgtctgagtgcgtgtgtctctgtcttcatcagctcctaggagatgcctccggacaggggcctgcccrtctctccctccagttccttgccagtgtcatgtgacactcctttcagagggcaccccccgcccccagccaactcacctttttttgtaaacttagtttttaa

SEQ ID NO: 35596 - DNA, 201 bp, Homo sapiens
cttgtgaaatattcagaacatgcaccaaaaaatagagaaaatgatagaagcggaccccacatagtcagtgccccgctccgttgcttgtcagcatcctgccrctgatttttggtccatggctgcgtcacctcccaccacccccagcagcagtgccattgtttcctttgtgtgtaccatgccccgaatagggtccagtcaggg

SEQ ID NO: 35597 - DNA, 201 bp, Homo sapiens
atcacagtgctgtgaacaaaagtgaggctgagtatgggagacagagagaggtagagagtgctgttttaggtaaaggtgtcagaagaggccttactaagggygatgtttcatcagagacctgaatgaagtgagggaaagagccatgtgtatatttgggtaagcacatctcaggtagagaggacttttgagtttcaggagggt

SEQ ID NO: 35598 - DNA, 201 bp, Homo sapiens
tttaagtctttgcaaactttttagaccgtaaggagctaagctcagtctgctcgtgaaaaatgatggtgacatgccatgtgtgcccttcccgtttgacagayggcgatctcgatgtcgtgtttgcctcttcctctaagtgcggaaaggataagaccaagtctgtttcttccaccatcttcttccactgtgaccctctggtgg

SEQ ID NO: 35599 - DNA, 201 bp, Homo sapiens
ctcccttccaggtgccatgctatgtgtttgatgaagagttgaggaagcatgatctcaatcctctgatcaagcttagtggtgcctacttggtggatgactcygatccggacacttctctattcatcaatgtttgtagagacataggtatgaatctttgtggggctgagggggtggtggtgagggatttcttctatggcttca

SEQ ID NO: 35600 - DNA, 201 bp, Homo sapiens
aaaacaaaacaaaaattctttactgcatgctgactaagggcagggctctatccatgtgcatcgagtggcctcgtaagctgtgaacagagtgcctgtgggaygtgggatgaagtctcttctgcctgattttaagtctttgcaaactttttagaccgtaaggagctaagctcagtctgctcgtgaaaaatgatggtgacatgc

SEQ ID NO: 35601 - DNA, 201 bp, Homo sapiens
cgatccggacacttctctattcatcaatgtttgtagagacataggtatgaatctttgtggggctgagggggtggtggtgagggatttcttctatggcttcratatctttgcctttctacctttatttctgttttcacatccatgtttctgattaggccctctaataaagcttttgtccccaaaaatgttctatttgcacaa

SEQ ID NO: 35602 - DNA, 201 bp, Homo sapiens
tctaattctttactttgttatgaatttcttgacagtggattgagcgatacgtgtcagaactaagcatttcactgtaggcaaattgtgtcttagttatcaartaaatgtacaaaaaaactaaaacctggtctgatccagtggttctgaggttgggtggaggctgagctgtgcacagtcagaattgcctttgatttggtttta

SEQ ID NO: 35603 - DNA, 201 bp, Homo sapiens
ttacagatcatctgaatttgctgagtattttcttacaagttttttctttccaatttattggcaatttgagtagagcttgaatgactttgattcacagtagrggtgccctagtttttactcagacattctccattcccaggaaattgccctaagtctcaaaccaagattgaatgtgaccctcaaaacctcttggatagtttc

SEQ ID NO: 35604 - DNA, 201 bp, Homo sapiens
ctccaacactcgggatcacaattcatcatgagatttgggtggcgagacagagctaagccgcatcaccaggtataaatgcaaatcagagcaattatgagatytcatttttctttgagaagttggcagaaatttaaatggttgaatcatagagtgctggcaaggagcctggaaatgggcacatttatttatacgttgctgtag

SEQ ID NO: 35605 - DNA, 201 bp, Homo sapiens
catttaacttcctccaaggaaggggattaaaattttcaactaactcccttcagttgaaatctcggaccacttttaaaacaaaaaccatggtctaattcttkactttgttatgaatttcttgacagtggattgagcgatacgtgtcagaactaagcatttcactgtaggcaaattgtgtcttagttatcaagtaaatgtaca

SEQ ID NO: 35606 - DNA, 201 bp, Homo sapiens
ctgcattttctagtctctgtagcttgaaaggggatagtgctaatgttgttgtacctcaagcagaggatgggtacatttcttgattacaaataacatcatarcctgtttcctgtgcacctcttatataccagtgcagagccagtactttacagtccttcatcctgagctttgtttgcagagggttaatggcttgcccaaggt

SEQ ID NO: 35607 - DNA, 201 bp, Homo sapiens
tcccacaaagttccacatttaacttcctccaaggaaggggattaaaattttcaactaactcccttcagttgaaatctcggaccacttttaaaacaaaaacyatggtctaattctttactttgttatgaatttcttgacagtggattgagcgatacgtgtcagaactaagcatttcactgtaggcaaattgtgtcttagtta

SEQ ID NO: 35608 - DNA, 201 bp, Homo sapiens
acgagacccaggttcacagctgcgggcctgtccccccggcactgccgcctgcctggtaagaggacaccaggcgtttgatgttggccagccccgggacggastgaagctggtgcgcaaggacaggtcagtcaaggcctccgatgctgttggcgtttttaatctccagcaaggacctgactttcagggagctgcaggaacatc

SEQ ID NO: 35609 - DNA, 201 bp, Homo sapiens
tcagaggccagaactggttggggagaaagcctcttgagagggaaactggtgtcctcagaattgctgtggggtcacagacgtgctgccctagcgtgtccgtscttcctttccctaggaaaggaagcatcctggggccctgcagtgattctgaggactgagggtttatgtcatgaatgccttcttgaaggacttccatgtcac

SEQ ID NO: 35610 - DNA, 201 bp, Homo sapiens
cgatgctgttggcgtttttaatctccagcaaggacctgactttcagggagctgcaggaacatcctttttcagcaaggcttgggatagtccctgcagcattrctgcttcacatgtacttgtaagattgttggtcattgctgtgagtcacatagtctagtgtgcttgtctactttttaatcatttgtctcttacagcagtaaa

SEQ ID NO: 35611 - DNA, 201 bp, Homo sapiens
aggtggattagcactcagaggccagaactggttggggagaaagcctcttgagagggaaactggtgtcctcagaattgctgtggggtcacagacgtgctgcyctagcgtgtccgtgcttcctttccctaggaaaggaagcatcctggggccctgcagtgattctgaggactgagggtttatgtcatgaatgccttcttgaag

SEQ ID NO: 35612 - DNA, 201 bp, Homo sapiens
cagaaataggattcaggtttgactaagtaagactgtaatcttctaatacctattcatataaaacaagcctcttcttgttaatttccctgtttttaggttcrtcctatatttcagatggaaaagaatatttgttttatttgaatgtctgtggagaaactgaaatacagttctgtaataaaaaacaagctgcagtttgccaag

SEQ ID NO: 35613 - DNA, 201 bp, Homo sapiens
cttcagcctcggagatatttattttaagtaagtaaaacgttttccttctgagctgtgaaatgtgttcaaaattaaaccagcaatgccgctctttccctatyggggagcactgcaggataaataggtctgtgttttagttactgttgctggagtcatcgtcatcttttgcttaaactgaggaaaagcgttactcaatcatta

SEQ ID NO: 35614 - DNA, 201 bp, Homo sapiens
aaacatattgaaggtttatgtacttataaaaacctcatcattccctaaagaaaaaaaatctcaatttggtttagtgtcattgtagtcttgctttctacatsttactaatgtctcatttatttattcattttgctctgtcacatttagaatgattttgatgggcaaaaatcatggtagttacaaacagccctttaaaactat

SEQ ID NO: 35615 - DNA, 201 bp, Homo sapiens
cctcttcttttatgtaatgagtatcaagataatcctttttgcaaagtggtgaccctatggtagagtttggatctggggattgcagaatgtcactgggtgcrttgaagctgaaggcgtgcatttctctgagtaatgagaagcacccttgagtcaccaaggcactggcatatcaaaaagcggtgccgctgtccatatcttgac

SEQ ID NO: 35616 - DNA, 201 bp, Homo sapiens
cgtgaagcctcaggaggtgcagatggtgaatgggaccatcaccaaccctataaatggcaagagcttcagcctcggagatatttattttaagtaagtaaaaygttttccttctgagctgtgaaatgtgttcaaaattaaaccagcaatgccgctctttccctatcggggagcactgcaggataaataggtctgtgttttagt

SEQ ID NO: 35617 - DNA, 201 bp, Homo sapiens
agtttaaaacatattgaaggtttatgtacttataaaaacctcatcattccctaaagaaaaaaaatctcaatttggtttagtgtcattgtagtcttgctttstacatcttactaatgtctcatttatttattcattttgctctgtcacatttagaatgattttgatgggcaaaaatcatggtagttacaaacagccctttaa

SEQ ID NO: 35618 - DNA, 201 bp, Homo sapiens
atgttaaacctggatcacatccatttgtgtgtgtgcatttcaacagtaagtgtatgtggaagcctaaggttgttaattatggttacattagatctcatggrttaattctcagaacagcatcctgacagattcccaggaaatgaatgcctgcgttgggcctcacgtcttttgtcagcatttcatagagagagggatttttaa

SEQ ID NO: 35619 - DNA, 201 bp, Homo sapiens
ttgtttgcatgtgaatgtgtatgtagagattcttgatgctggttctttgccagttctgtgtttttcctagtttataacttacttccgttttctttaagctrttttttgatgagtataaactcttaaattgaataggtcaacctcattaatctttttgagtcttaagaaatctttctctatcttaagatttctgccaagttt

SEQ ID NO: 35620 - DNA, 201 bp, Homo sapiens
acattcttttcttgtttgtttgcatgtgaatgtgtatgtagagattcttgatgctggttctttgccagttctgtgtttttcctagtttataacttacttcygttttctttaagctgttttttgatgagtataaactcttaaattgaataggtcaacctcattaatctttttgagtcttaagaaatctttctctatcttaag

SEQ ID NO: 35621 - DNA, 201 bp, Homo sapiens
tgtaagtagctattgtctcttacgaaacaaagttcaatccctcctttagatcacatactgaaattacagctcagttaagatttgaaagtaaaaagacaatwgaacattggaaaaaaaattagtaacatatagatataatctagaagagccttccttaaggaatcctggaagccatacaggagaagaggaacatttcttatt

SEQ ID NO: 35622 - DNA, 201 bp, Homo sapiens
actttagcctccacaatgagcaccttgctggaggtggtgtggttatggatttgaatgtggacagccggctccagagcctgtgtactcactcagggctgtgyttttgtgtgagtcatggggtcacatcagacagattggagctgaaatggagaccaggatgggagatctgaatgtgtggctctgagaggacatctgagaacg

SEQ ID NO: 35623 - DNA, 201 bp, Homo sapiens
ggggtggttcagaaggaatgtgtaggacaattgaagtaggttttttgacctaaggggaggattcgtgataattacctgctcttacacaaggaacagtagakaaactggaaatcttggaggccttcctggaactggggttaatcggaagtcagcagggctgtttggcctccagaatggcgttactttagcctccacaatgag

SEQ ID NO: 35624 - DNA, 201 bp, Homo sapiens
agaactttttgatcctcccagactgaaactcagttcccattaaacacgagctctccattccctctcttctactttttgtctctacggatttgactgttctrgatacctcatataggtggaatgctacagtatttgtagggctgttttttgacccttctatgcattatacctcatttcccactgtcccttccaagtctactt

SEQ ID NO: 35625 - DNA, 201 bp, Homo sapiens
tactttcaggactctcagtaacggctccctttcttcaactggagagagcagtttgtatgagtcaatgagagtgacattcacagtagcatagggataatccsgaatcaaatctaatttgcatatacaataaaaatacctaaattttgttgcacattcatgtgctaggcctaatgtttaaaagtaaaatatctcatttaattc

SEQ ID NO: 35626 - DNA, 201 bp, Homo sapiens
tgatgtaatgccctcaggaagtccccaaattgctgcccgcaccagtgtttgggtttgtgagggcagaaaagctctcccacagttcgggtaccagcagtcgrccacagaggtgaggggcagcaacagcattcccgccacccctttcaaaggaataccaagtccctcagggctcctagccgctctctgcccctctcgtttcct

SEQ ID NO: 35627 - DNA, 201 bp, Homo sapiens
gtgaggttttcaaggtgacccgccttagaattttattcatgctgtttgaacaaaattctgaacatccgatgtttgaggcttatttgagatactgaaaataytatcttaaattcattattgaggtggttttgctgaatgcaaaaccttcggaacacaagggaataaattatgtttgaaaaggctttcgtgtgaattctaggc

SEQ ID NO: 35628 - DNA, 201 bp, Homo sapiens
gttagggaggattccctccaacttgatttttttttttttttttttttttttcagggagtagtctcagtgggattggtaccagttctttgtacctttggtaraatttggctctcaatctgtctggtcctgtgctttttcttgggagatttttaaagtactgattcaatctcactcctttttactggtcttttcaggatttct

SEQ ID NO: 35629 - DNA, 201 bp, Homo sapiens
ttatgagataaaactggctaaaatttccgtaaatgtagcatgtagttgaggaataggaatgtaagttgattttttttttaatttgatacaaaaaattttaycgtgtcaccaaggtgtgacgtgttaagctccattttaattttgttcctgggcatcagtttgctgaaatgtaaataactcggccaggtctccactgtgagc

SEQ ID NO: 35630 - DNA, 201 bp, Homo sapiens
tacacacttggtgccctggtgtcattgctcccacgaacggctgtgaagcttgttgccagtggcagccttgtcctgttgctgcactgtgcttgtgggctgckccatgaatactgttctgtctcttaaaatctgggccttcttgctttacaggtaccgctgatgcttttatcgtccgctttgtttgcaatgatgatgtttact

SEQ ID NO: 35631 - DNA, 201 bp, Homo sapiens
agtcgggggttgggccctgaggatggggctgttttattggagagtccgctgtcaccaggcctttctgtaaaaggctggaagtgagcgagtgaaccaggcascctggtggggggcctgcatgtcagacccagcgggaagcatgtctgacttggttgagaggcagctaagggcccagtgtgtctgggtgggctgagccattgg

SEQ ID NO: 35632 - DNA, 201 bp, Homo sapiens
agtgagggttgagaaatgagaaatttcctaatgggtacaatgtacagtattccagtgctggttacactaaaagcacagacctcaccactgtgcaatatccrtgtaatacaactgcactcggtcctcctaaatctaaataaaacaaacaaagaggcacccccttaaagctcagggtcttgccaactctaacagtggggtttc

SEQ ID NO: 35633 - DNA, 201 bp, Homo sapiens
gcctagagggaaggccaggagggtcttgctgttagggctgccaccttcttcatgcctgctgtgtgctgggaggagagagctccttcagagcggacccaccrttggattttgagtgtgtgcaaaattaacttgttgctatctgcatggttatctgtactccagaatcagttatacattttaaaacagctgtttagtactgaa

SEQ ID NO: 35634 - DNA, 201 bp, Homo sapiens
taacactggagttgcaaaacacaaaccctttttctttttttttttttttgagatggaatctcgctctgtttcccaggctggagtgcagtggcacgatctckgctcactgcaacctctgcctcctgggttcaagcgattctcctgcctcagcctcccgagtagctgggactacaggcgtgtgccaccacgcccggttaattt

SEQ ID NO: 35635 - DNA, 201 bp, Homo sapiens
gccaagatagggaaaaagcctcagtgtctactgacaaataaagatggatcaagaaaatgcatgtatgtatacacacacacagtggaataccaagtcttgcrgaagaaggaaatcctgtcatttgtgacaacatggatgagctgagagaacattatgctaagtgaaataagccagacacagaaagaaaaataccagatgatc

SEQ ID NO: 35636 - DNA, 201 bp, Homo sapiens
aaaggaaagaactccaaattacatcttgcaagctattgtggttttgcaagcattgagtgatggcatatatgaaaactctgagaggtgtcatattaagataycaatgtcagtttaaagatattctatatctgtatccctatgacattgtattttgaattttttatttttcatttttggacagacatttagaactcactcagt

SEQ ID NO: 35637 - DNA, 201 bp, Homo sapiens
ttaagtgagattgggctacagtttttttgctctgctgttcttgatggattttgttattaataatatgtttgctttgtggaaggagctagttagcttttagkatttttgtatgtggtgaaacagtttgtatataagatggacattttctgtttcttaaagtttggtagaattcaccagtaaaactatctggccctggcaggc

SEQ ID NO: 35638 - DNA, 201 bp, Homo sapiens
tttatatacaaggaataaaattttgattttctttgcacataaagcatttttcctagagatatgtgtatgtgtgtgtgtgtgtgtgtgtgtgtgtgtgtgtrtatatatatatatatatatatatatatatgtattttttttgagatggaatctcgctctgtcacccaggctgaagtgcagtggcgtgatcttgtctcactg

SEQ ID NO: 35639 - DNA, 201 bp, Homo sapiens
ctcagtgatatcctttgaagaacagatttaaaaaaatttgatggactataactttttatggtttgtgcttttggtagcttgagaaatcaaccttaaaactrgtgacatttgacctgggtaattttttgtttggagggctatcctgggcattgtaggatgtcagccagcattcctggcctctactcactagatgctaagact

SEQ ID NO: 35640 - DNA, 201 bp, Homo sapiens
ggctgtgggactggcctgtagaaaagacctggggcaggaaggagtgttgaaggtcagtggagggcgggaatagtagagcaagaagagagggcattcaggargagaggagcagaggccaggccatgcaaaaccaacaacagtgtctaaagtgatctcagcttgtcagtggctttacttattaccatatgctttaaactttgt

SEQ ID NO: 35641 - DNA, 201 bp, Homo sapiens
aaattttaaaaaatttatattgaatgcttgcctgctttgtcacattactgatgtgtgcaccacagtcatcttccctgtccattgtggtgatgaaaagaagygagtaaaataaccaccctcgctccgagctgccgtcagtgttgagtcgggaaattctgcctaggcctgcgcagcccggggagtgggggcctcgggacccaa

SEQ ID NO: 35642 - DNA, 201 bp, Homo sapiens
aaggagacagcaccatttcagcagcagctttaactgtgtccgtgcacgtggaggggcctgccctctgagttgtgcattgaacagcaggcacgacaaaggcwcatttcccaaagtgtatctggcttgaagcagcgctttaaataagtgcatggttttttttggagagactcagcaaagcatttttcaagtgtcaagtggatt

SEQ ID NO: 35643 - DNA, 201 bp, Homo sapiens
gacttttgatcacacaaagggcagaggaagcaccgaatggttatgtctagcctgaattcaaaagtgtctttaggtgctttcagcagacacctgtgaaaaakagagttttgcttccaaaagctcttgtttctggattgattagggggaaaaaccgatttgggagagttgctgtggatgaaccagattcaagcacacgctctc

SEQ ID NO: 35644 - DNA, 201 bp, Homo sapiens
aaatggactctgcctgcagattattagtatgtctcagatgtaaaaccagctcaaaagtactaggacgatttgtagtagtatttaattatttgtaaacttasacgtttttcttcacgtttgcagaatacaaatctttgtcagtagtgaaatgtgaatctagtaggattaaactgtgtgtaaaccttgtgggcgggatgaaga

SEQ ID NO: 35645 - DNA, 201 bp, Homo sapiens
cagctcctgtttgatttccctctctctctacaaagagaccatccagactgaaaaacctggtgagagggatttgaggcctgggattgagatctgagaaagcrctagattgttgtgaattcttgggtctgacattatccttggtgatatacttaggaaacttacaggtgagatggccagtttactcattgtgctcttttgaga

SEQ ID NO: 35646 - DNA, 201 bp, Homo sapiens
gtttttagttatgaaaccataagcaaattatttagccaccctaaatctgcaaaatggtgctaaaattgtacctttgccatggggttttgaggatcaaatasattaatatagtcatgtgttgcttaacaataggaatatgttctgagaaatgtgtcattaggcgattttgtcattgtgtgaacatcatagagtgtacttaac

SEQ ID NO: 35647 - DNA, 201 bp, Homo sapiens
actgtaacccaattatagtctgtggcaataattttcttttagttgcctttctgcatgaatctggtggtaggcttaagctccatgtgctggtaccctctgarcactagaggttctaacttcctccattattagtagaaacacttaggtgtctgagaagtattttaggcgacaggcaactttgctttgaggatatggtcaaaa

SEQ ID NO: 35648 - DNA, 201 bp, Homo sapiens
aggggtgactcagaaattgccaaaggatttatgaatgtatgagtctgagaagcttaaacaaaaatctaaaaatctaggagcaaattttccaggttttgaaygttgcacggtttacaaattttaaaaaatttatattgaatgcttgcctgctttgtcacattactgatgtgtgcaccacagtcatcttccctgtccattgtg

SEQ ID NO: 35649 - DNA, 201 bp, Homo sapiens
agcatgtgagtgtactgaatactgcatgcacttgtaacacaacggtaagtatttgagtatctaaatatatctaaacatagaaaaggtccactaaaaatacratactataatcttttgaggctaccgttttatatgcagtctgttgttgaccaaatgttgttatgcagcacgtaactgtataaagaaagtacttaaacagag

SEQ ID NO: 35650 - DNA, 201 bp, Homo sapiens
tgttttttgtttttgtttttgagatggagttttgctcttgttgcccaggctggagtgcaatggcgccatctcgatcttggctcactgcaacttctgcctcycgggttcaagcaattctcctgcctcagcctcctgagtagctgggattacaggcacctgccaccgtgcccgaataatttttgtatttttagtagagacggg

SEQ ID NO: 35651 - DNA, 201 bp, Homo sapiens
actgacggaaccacagaatttcagcactgtttggagttgtgctgctaacattgtggggctggcataggaccttggcgtgcttcactgggagcgactgactrtagatggcttccactcttgttttactttagggatgagtcccagagaacttgtcttgttcacagtcgcatcactaagtcagcagtgcacagggaactagag

SEQ ID NO: 35652 - DNA, 201 bp, Homo sapiens
ttgggtttgaccccaggtcttaggctgtgacaattgtgcagtgggccaggtgaccacccctgagtgtgggaatgcaagaacaggtcgataaacctttaggragcccaaaatttattttcttctggcctttaaaccagatttttactcctaacattgaagctttgtttgtttgttttttgtttttgtttttgagatggagtt

SEQ ID NO: 35653 - DNA, 201 bp, Homo sapiens
gttcaggagcctctgggagctgaccacagcccgggagcagaggatcccactcactgctcttgcgttcctcctgcctgcccttttaatcttatctttggagrtgctgtacacagccttctgtcaatgtctcccaaggtgaaaggcatgctggcctgccatcgaggacttagggttaagcatctgaagcttaatagaagcctg

SEQ ID NO: 35654 - DNA, 201 bp, Homo sapiens
aggagggtttgggtttgaccccaggtcttaggctgtgacaattgtgcagtgggccaggtgaccacccctgagtgtgggaatgcaagaacaggtcgataaayctttagggagcccaaaatttattttcttctggcctttaaaccagatttttactcctaacattgaagctttgtttgtttgttttttgtttttgtttttgag

SEQ ID NO: 35655 - DNA, 201 bp, Homo sapiens
agaattgggaagctgtggatggcagtcagacggaaacagagaagaagcattttttcattaatatttgtcacagagtgctgcaggaaggcaaggcacgaggrtgtcccgaggacgcggcagtgtgtgcagtgggtgagttgtgcctggatggaagatctaggtgatgcttttctagggcatccagtttggaatgagttagaa

SEQ ID NO: 35656 - DNA, 201 bp, Homo sapiens
tttctggcttttcactttttccattctgtgctctgttattactgggaggctcacatgagggtacctgtcaggaaagcacctaatatgatagagagagtttrcacaattggagcgataatgaaggctgccattacccggggtcccactgttcacatgagtttgttgggcactttctatacatgcccgaaacctgcccacttt

SEQ ID NO: 35657 - DNA, 201 bp, Homo sapiens
tgacagtaggggacaatgtcagtttacagttggtgctgatgcatgttgcaagccatttggtctttcttgccctggaagggcattgtgcatccttcatggcrctttctggctgaacctatggatgaccctggaggaccccaatgtggctgttaatgtctagccaaacgtggcactctagggaaacccatccgctgccttggt

SEQ ID NO: 35658 - DNA, 201 bp, Homo sapiens
gaggaaaatagaggtttcttagtaagagcaattaggatttgttggagggaccagtaaaggaaaatattcacctttgcctcttaggctggagtggggtttcycgagttgtcctgattcagccacagggctacttcagattagcttgagatgttgagatggagaaagagaattccgagaaaactactgccacccttgataaaa

SEQ ID NO: 35659 - DNA, 201 bp, Homo sapiens
tttggtgtgattggaaaggctattactatcttatattcagcatgagtcttgagcaattactgattaatatggtttggctgtgtctccacccaaatctcagyttgtagttcccataatccccatgtgttgtgggagggacctggtgggaggcaattgaatcatgggggcggttacccttatgctgttctcgtggtcatgagt

SEQ ID NO: 35660 - DNA, 201 bp, Homo sapiens
tgccttcccagtccacccgcggcgccacaccctcagcatgtgaacttcagactgcttgacgatggttggctcttttgggttctcaagatgggaatactatrcccatgtgaggctgatggtggttgagttgtgactgttcctggaagcagcccgcagtgtcaatcctggcacagagggtggttctgaggtcagagtgggggc

SEQ ID NO: 35661 - DNA, 201 bp, Homo sapiens
agttaaaaaatcctttggcttttcagcattttggtgtgattggaaaggctattactatcttatattcagcatgagtcttgagcaattactgattaatatgrtttggctgtgtctccacccaaatctcagcttgtagttcccataatccccatgtgttgtgggagggacctggtgggaggcaattgaatcatgggggcggtt

SEQ ID NO: 35662 - DNA, 201 bp, Homo sapiens
ctggtggttggttttgtgctgagtcattgccttggtgcactgtggaaggaagctctgggaggtggacggctccttctgtgagggagtgcttctgtcgtcamgggagtactgcatagggtgaataacacagttatgtagatatatatggtggtcttacccccagggcctccacaactcctggatgggcctagcctaagcaat

SEQ ID NO: 35663 - DNA, 201 bp, Homo sapiens
ggtttgatgggttcccagacctaggagttcttggcgcctcgtcttccagtgaccccaccagggctgctctttctcctccattgctgaaactagttcagggytggggaggagggcacgtgggggggcctggtggttggttttgtgctgagtcattgccttggtgcactgtggaaggaagctctgggaggtggacggctcctt

SEQ ID NO: 35664 - DNA, 201 bp, Homo sapiens
tgaataagagattagcatttttcctgagtagtagccaagtctttgtttacttgtttatcttgtatcctgcaacctggaatatacactccgagagggcaggrcgtctttgttttgttcattgctgtactctcctgtgcctcccgcagtaagtacttaagaaatacttgtgaaacacatgaataaaggttaacgaagggcaaa

SEQ ID NO: 35665 - DNA, 201 bp, Homo sapiens
gatactcctgcctcagcctccctagtagctgggactataggcgtgcaccaccacgcccggctaatttttgtatttttagtagagacggagtttcaccataytggtcaggctgatcttgatctcctgacctcgtgatctgcatgcctcagcctcccaaagtgctgggattacaggcatgaggcaccacgccctgccattagt

SEQ ID NO: 35666 - DNA, 201 bp, Homo sapiens
gtctgtttcgatagctctgtgttcctggtggtggttttctcctcacaatgaccttgtaggctagctgagttttgtcgaggaagttgagctgggagagactrgctcacacagcttgttagtcagcgctggggcaggaatctggcccaggcccttcatggcacctttcttagggtagcgtgccccctctctattccaggtgac

SEQ ID NO: 35667 - DNA, 201 bp, Homo sapiens
gtgtgacagcaaaaactggcctttgcagttgagttgcctgtgggctatggcctagagggaaggccaggagggtcttgctgttagggctgccaccttcttcrtgcctgctgtgtgctgggaggagagagctccttcagagcggacccaccattggattttgagtgtgtgcaaaattaacttgttgctatctgcatggttatc

SEQ ID NO: 35668 - DNA, 201 bp, Homo sapiens
aggcccatgctcatctccctggacaagcagacatgcactctcttcttctcctggcacacgccgctggcctgcgagcaagcggtgagttttcagatgggcaygggagaagtgcatgtccagtgcctggctgcacccgggccccttcgtcaggttcacttgcccactagtagatgcccagctgaactgtccactcctgatcac

SEQ ID NO: 35669 - DNA, 201 bp, Homo sapiens
tcctcacaatgaccttgtaggctagctgagttttgtcgaggaagttgagctgggagagactggctcacacagcttgttagtcagcgctggggcaggaatcyggcccaggcccttcatggcacctttcttagggtagcgtgccccctctctattccaggtgacctctgttacgcagtccccattgcctgccctggttccctg

SEQ ID NO: 35670 - DNA, 201 bp, Homo sapiens
tctttgccctaactcttcttcggtttgtctgttgcttttattatttgtatctggctgccgctgtggacaggcatgtagctggatgtcgtttgctgctgtcrcccagcttaccagttctcccatggttcagatgttcttctgcttccctgttgtcttttgttgcagaatctcagctgatgtgtagtcacagctgcctgttct

SEQ ID NO: 35671 - DNA, 201 bp, Homo sapiens
aaaattaaaactaatatcacacttgtatgcaagccaggtaaaaattttaaaaaagatgaaatcttttctggcttctgccagaggtcctgcattcttcatakctctgttcctcatcagtcactgcaaagctgatcagacagattggcatggtgttcagcattttgagttccagactctggcgatgggagataggtcatttgg

SEQ ID NO: 35672 - DNA, 201 bp, Homo sapiens
gtgtttatttcagtgatgagaagacttggaacttgggtctgagtaatgcgaagctttcatattatgatgggatgatccaactgaactacagaggcggcacrccctataacaatgaaagacacacaccgagagctacgctcatcacctttctctgtgatcgagacgcgggagtgggcttccctgaatatcaggtaggaatgt

SEQ ID NO: 35673 - DNA, 201 bp, Homo sapiens
gggaggaacgaaggagacagcaccatttcagcagcagctttaactgtgtccgtgcacgtggaggggcctgccctctgagttgtgcattgaacagcaggcaygacaaaggctcatttcccaaagtgtatctggcttgaagcagcgctttaaataagtgcatggttttttttggagagactcagcaaagcatttttcaagtgt

SEQ ID NO: 35674 - DNA, 201 bp, Homo sapiens
ataacaatgaaagacacacaccgagagctacgctcatcacctttctctgtgatcgagacgcgggagtgggcttccctgaatatcaggtaggaatgtttgtycctcatcgcgctccctgaggatactcatgcctgtggtgggcctttcatttaagcagagcttgtatcagtctgggtttccagccaaatcatcaccgtcatt

SEQ ID NO: 35675 - DNA, 201 bp, Homo sapiens
tcgagtcctacaaatgtccccgtttgtttttgctgcttggtcacatggaggcagtcccaaatgtacagaaggatcacattccaaatgtttgtaaattggtmatttcatacgtggaatgtgtttttccattgatagtattcttgttcattgtatggcccccagaaagtcattatccttgcaaaggttttggagcacccagac

SEQ ID NO: 35676 - DNA, 201 bp, Homo sapiens
tgctggtgagcgtgtgactgagctgatgatggggagtgatgctggctgtggggctgcaggaccaaggtggggcattttcagcagagtgaattctaataacwgtctggtcgcctttgggatagcaaccagtcttggccacagcagagcctcggcctttagcttcatcatttaaaacaatgactgtcagtgcagaggcacggg

SEQ ID NO: 35677 - DNA, 201 bp, Homo sapiens
ccgtctctacaaaaaatatgaaaattagagccgggcgcggtggcacactcctgtcctcccagttaagggaggctgaggtggtaggataacgttagccccgsaggtcgaggttgcagtgagttgtgatcgagtcgagttgcactctagtctgggcgacagagcaaggccctgtctcaaaaataaataaataaatacaataag

SEQ ID NO: 35678 - DNA, 201 bp, Homo sapiens
cctccagggtggggaaaatcccaggtgctctgtgaacctggccgttcagccagctgcagacctttggtaggagttttctttttccttttgtgtgcttttcratcccctgggggcaaccattattcagtacatctggagggcaagttgtccaggaagaggaagcagatcctaggagtgtcgtccttcactgggagaggtgta

SEQ ID NO: 35679 - DNA, 201 bp, Homo sapiens
gggctgcaggaccaaggtggggcattttcagcagagtgaattctaataactgtctggtcgcctttgggatagcaaccagtcttggccacagcagagcctcrgcctttagcttcatcatttaaaacaatgactgtcagtgcagaggcacgggggacagttaaggtccactgcatactgagttcagcgaaggtggagtgtaat

SEQ ID NO: 35680 - DNA, 201 bp, Homo sapiens
catggcgaaaccccgtctctacaaaaaatatgaaaattagagccgggcgcggtggcacactcctgtcctcccagttaagggaggctgaggtggtaggatarcgttagccccgcaggtcgaggttgcagtgagttgtgatcgagtcgagttgcactctagtctgggcgacagagcaaggccctgtctcaaaaataaataaat

SEQ ID NO: 35681 - DNA, 201 bp, Homo sapiens
actgtttcctggattttttttctgagtcgtacagacattatcttgcctcttagttcttgtgagttgaggatcgtggcagtggaacggggcttagagatagkttggtcctgtaggggccaagggaaagcttccctttcaccctttgaagtttccctgaaaatcagctgtcaacaggagaaaagacattaaaattttgacgtg

SEQ ID NO: 35682 - DNA, 201 bp, Homo sapiens
aatgtacagtattccagtgctggttacactaaaagcacagacctcaccactgtgcaatatccatgtaatacaactgcactcggtcctcctaaatctaaatraaacaaacaaagaggcacccccttaaagctcagggtcttgccaactctaacagtggggtttcttgatgttttttaaaataaaaagaccattagttcatag

SEQ ID NO: 35683 - DNA, 201 bp, Homo sapiens
ccgcaggaatggtcctggagttgagtgtttgtggtttcatttgctgattgatttccccccgtgggctcattttctctttaaagaatatatatatatatatwtttttagcaggcggtgacttttgtcttctttagattgggggcagggggtgtcgtccagtgtgagctttcaagacttgacccttcacttctctgagcccaa

SEQ ID NO: 35684 - DNA, 201 bp, Homo sapiens
gcccacttcttctctcagtctcaggaaggatccaggtttggtgttccacggggagatgcctaggttgcccagttcagcctgctggtctgtttttgggcacrtctgtgcattccctgcctgtggactgccccctccttctctggtttcttgttgccattgagacactgggtagttccagaaagttcttggacccttggtttt

SEQ ID NO: 35685 - DNA, 201 bp, Homo sapiens
ggtgctgtcctcatgacagtgagtgaattctcatgagatctggttgtttcaaagtttctggttgtttcactctcaccgtcttgctcctgcttttgctgtgmgatatgcttgctcccacttcaccttctgccgtgagtgaaagctttttgaggcctccccagaagccgagctatgcttcctgtacaacctgcagaactgtga

SEQ ID NO: 35686 - DNA, 201 bp, Homo sapiens
ttgcagaagatctcaggagacttcccatcgagttccatcatcaggactgggtcatacgcccttgctctggctgtaagaatgtctgggaagtgagaatctcrcacccacagcctctggtggaggtgggctttgccagcaatcaagggcatgagatgcctgcaggaaggcagccaaccacacctgcctcatgcctctaaccct

SEQ ID NO: 35687 - DNA, 201 bp, Homo sapiens
ctaccattgcctgtgtggtggtggtgctctcacaaagctaatggctctttgggggagctttttatggaaacatacacaccgaagggcacacagatgataaygtgacacagctgggtgagtgtccataaactacacatcaagaaagaacatgcttccccctaggagccctcctgtgccctcttcctgccactgctgagcatc

SEQ ID NO: 35688 - DNA, 201 bp, Homo sapiens
cattttctgtttcttaaagtttggtagaattcaccagtaaaactatctggccctggcaggctcttaggtggaatatcatcggggaggacttttgattatgkttttttctagttttattttcagttttatctagtttatttttctattcagattttctactttttcttgggccaattttggtaatctctattttcctagaaa

SEQ ID NO: 35689 - DNA, 201 bp, Homo sapiens
tttgctagagtgacttacagaactcaggaaaacactgatgattagcagtttatgaggatattacaagggatacggatgaagagatgtttagggcgaggtaytggggaaggggtgcggagcctctgtgacctccctggctcactaccctccaggaattgccgtgcattcaactatttggaagctcccccaacccagttttta

SEQ ID NO: 35690 - DNA, 201 bp, Homo sapiens
ctggtctccaactgctgacctcatgatccgcccacctcggcctcccagagtgctgggattacaggcgtgagccaccgcgcccagctatcttattttttttygtgatcattagtagattggtcaaatattgaatacccgtgtgaggaatcacctagggctgtggggttattaagaagtacgatgaaaggctgtgtgccaagg

SEQ ID NO: 35691 - DNA, 201 bp, Homo sapiens
gtgagtgccttcccagtccacccgcggcgccacaccctcagcatgtgaacttcagactgcttgacgatggttggctcttttgggttctcaagatgggaatrctatgcccatgtgaggctgatggtggttgagttgtgactgttcctggaagcagcccgcagtgtcaatcctggcacagagggtggttctgaggtcagagtg

SEQ ID NO: 35692 - DNA, 201 bp, Homo sapiens
accgggtcctggtccctggtccacaacggagtctcgtgagtgccttcccagtccacccgcggcgccacaccctcagcatgtgaacttcagactgcttgacratggttggctcttttgggttctcaagatgggaatactatgcccatgtgaggctgatggtggttgagttgtgactgttcctggaagcagcccgcagtgtca

SEQ ID NO: 35693 - DNA, 201 bp, Homo sapiens
acctacgacctgcggctgctctcctctctcaccgggtcctggtccctggtccacaacggagtctcgtgagtgccttcccagtccacccgcggcgccacacyctcagcatgtgaacttcagactgcttgacgatggttggctcttttgggttctcaagatgggaatactatgcccatgtgaggctgatggtggttgagttgt

SEQ ID NO: 35694 - DNA, 201 bp, Homo sapiens
tttaaagtacagggctttttcaaaatggagtctcttatgtcttccctttctgcatagacacagtgacagtctgatctctctctcttttccctacactcccyagcaaacagctaccggacatccagcatcatatttaagtgtgatgaagatgaggacattgggaggccacaagtcttcagtgaagtgcgtgggtgtgatgtg

SEQ ID NO: 35695 - DNA, 201 bp, Homo sapiens
gaatggcaatgacttttaccgagtatactgcttataaacattttgttaacaaggcacgtccttcacagccctagatcccttaaaccttaattttatacaayacatatttttgtgagctccaagttgggtcaaagtggctggggcagagtggctggggcaaagctacaaattaacaacatctcagcaaagcaattgtttaaa

SEQ ID NO: 35696 - DNA, 201 bp, Homo sapiens
ttatctgcaactgcataaggcagacacccctagagtggccatttaagaggcgcccctgccttcctcccgggaatgcattcttttcccagggctgttaattmttaaaattccttactggggaaagaattcagcgatatttctcttacccgttttcggtaataagagaaatatggctctgtcctcaccggcccacagtcagcc

SEQ ID NO: 35697 - DNA, 201 bp, Homo sapiens
ccgagccgcaaaaccagcaagtttttattagcaattttcaaaggggagggagtgtacgaatagggtgtgggtcatggagatcacatgcttcaaggatgacwagaggtcacaaggcagaaggtcagggcaggatcacaaggtcagcgcgaaactagaatcactaaataacttccatgtcccactgtgcacacattgtgaggg

SEQ ID NO: 35698 - DNA, 201 bp, Homo sapiens
tggggcttctgcagacactgtgagtaggacggctccgcgtccccacatggcctggggccttgatactgtcaaggctcgattcacactgagacctttgtggwtgccccagtcagtggcaggaattctcttgcataaaatattttcttactcgggctgtttcccacagagaaacgtttgaattgctctgtgggattgctgggt

SEQ ID NO: 35699 - DNA, 201 bp, Homo sapiens
atttaagttcagtgttttattgttgattttctgtgttgatgatctttctagtgcttgtagtgaggtgttgaagtctctcattattattacattgctgtctrtctcctcttaggtctagtggtaatgattttatgaatctgagtgctttggtgtggggtgcatttgtatttaggatggttatatcttgttgaattgatcccg

SEQ ID NO: 35700 - DNA, 201 bp, Homo sapiens
tctgaggtgattgtgcctggcgaggcacagctgccacactgataatgttcttcttctttccagaaaccgatgacggcgtcccctgtgtcttccccttcatrttcaatgggaagagctacgaggagtgcatcatagagagcagggcgaagctgtggtgtagcacaactgcggactacgacagagaccacgagtggggcttct

SEQ ID NO: 35701 - DNA, 201 bp, Homo sapiens
ggatggttatatcttgttgaattgatcccgttatcattatttaatggtcttttttttttcttttttaactattattgacttaaaagtctcttttatctaartgttgcttctcccgctcacttttggtttctatttgcatggaatatcttttcctacctatttaccttgagtctttgtttttaccagttaggtggttttctg

SEQ ID NO: 35702 - DNA, 201 bp, Homo sapiens
atagtaaactagaaattagacatagcagcagaaagaagctgcggagtggagctccacggtcctatgagtgctgtaaccttgggcgtgaatgtgagctgttsctctgtacacccccggtgtgaatgctggtgtgtgaatcacgctgtgttctctcagttgcctggtgagttttggcaggtgaatgccggttgtcacgtaggt

SEQ ID NO: 35703 - DNA, 201 bp, Homo sapiens
gaaaacctctcattagggagttagttttggaagtcactttcctgggcttgaatccagactcctcccctcacaggccttgggcaagtcacagaacctctgargtcttcctttccgtgtgtgtccagtcaggatgctaaccatgtttgtaggctaggcgtgggatgctaaccgtgttgtaggctaggcgtgggatgctaaccg

SEQ ID NO: 35704 - DNA, 201 bp, Homo sapiens
gagttggctgtgtccaatcacttcttttctctggacctcattttcctcctcaagaggggtgggacttagttttctttctctctttcctatttgaaaacctytcattagggagttagttttggaagtcactttcctgggcttgaatccagactcctcccctcacaggccttgggcaagtcacagaacctctgaagtcttcct

SEQ ID NO: 35705 - DNA, 201 bp, Homo sapiens
gttttcagggagactaggggatgggcaggatgtgcctctgtggctgttcttggcgctttaggtcctttccaccctcccaatgtcacccccaagcgctgttctgccaagacacagctgctaaacccctgttgattgctgctggcagcgtgtggcctgagacgggggatctggattgttgagttggctgtgtccaatcacttc

SEQ ID NO: 35706 - DNA, 201 bp, Homo sapiens
ccaccatgcccagctaatttttgtatttttagtagagacggggtttcaccatgttggccaggatggtctagatctcttgacctagtaatccacccgcctcrgcctcccaaagtgctgggattacaggcgtgagccactgcgcccggccatttgtaaagctttttgcttgaaaatgtgaatgcgtgtgtggttgcagttgcc

SEQ ID NO: 35707 - DNA, 201 bp, Homo sapiens
ttagtagagacggggtttcaccatgttggccaggatggtctagatctcttgacctagtaatccacccgcctcagcctcccaaagtgctgggattacaggcrtgagccactgcgcccggccatttgtaaagctttttgcttgaaaatgtgaatgcgtgtgtggttgcagttgcccttcacttcttccatgttcttgaagggg

SEQ ID NO: 35708 - DNA, 201 bp, Homo sapiens
atagtttcctgaactattatgttcagggaagttatgttgttgctgattctgatggggtgtgtgtgtgtgtgtgtgtgtgtgtgtgtgtgtgtgtgacagasacagagagaagtcgagtctaaagttctgtcaggcttagactatgcctgaatacttgaacgtttctagacagagtgcccaatgtttaaagagaatacgacc

SEQ ID NO: 35709 - DNA, 201 bp, Homo sapiens
gatggggggtgtgacgtggaggtcttggtgtgtgcctgcgtatgttgagagttgtatggtcggtccttttgtgatgcagggacagctcactcaaacctgcrgtggttggctgagactggatgtcagctgtacatgggaaaccaagggcacctccagggatcttggtaccactcatggcccctcggaaccctgaagatgaaa

SEQ ID NO: 35710 - DNA, 201 bp, Homo sapiens
cttcccttacttgtttggcatgcacgtaagcaggtgtcgactgcatacaggtttttctgtgtgtgagattgtggtgagccccagtgctagcgtgcatgacragctcggtggctgagttgggcattaactcgggcaagaccagctcgctgggtgtcagggtggctcgccccatgctctccagcggtgggcagcagtggtagg

SEQ ID NO: 35711 - DNA, 201 bp, Homo sapiens
tttgtatatttactctaaaagaaagtgaatttttttagttcaagacttttagattcatcgttctactttcattgtggctagctcatggccatccacgtagkgaattaataaagctttgttgagtggcacttgcttgacagcgacacttttgtccactctttcaccttgctggatttgtgctgccttccttgctgtaggaag

SEQ ID NO: 35712 - DNA, 201 bp, Homo sapiens
ctgcctgcgaggctctctctgggaggaagtcaggtctttctttccttcgtttccttcctttcattcctttcctttccttcctttttcctctttctttcttycttttctctctctctctttttctttctctctttctttcgagatggagtctcgctctgttgccaggctggagtgcagtggcatgatctcggctcactgcaa

SEQ ID NO: 35713 - DNA, 201 bp, Homo sapiens
actgcctgcgaggctctctctgggaggaagtcaggtctttctttccttcgtttccttcctttcattcctttcctttccttcctttttcctctttctttctttcttttctctctctctctttttctttctctctttctttcgagatggagtctcgctctgttgccaggctggagtgcagtggcatgatctcggctcactgca

SEQ ID NO: 35714 - DNA, 201 bp, Homo sapiens
gactgcctgcgaggctctctctgggaggaagtcaggtctttctttccttcgtttccttcctttcattcctttcctttccttcctttttcctctttctttctttcttttctctctctctctttttctttctctctttctttcgagatggagtctcgctctgttgccaggctggagtgcagtggcatgatctcggctcactgc

SEQ ID NO: 35715 - DNA, 201 bp, Homo sapiens
aaaattttcaacttttaagttcaggggtacatgtgcaggatgtgcaggtttgttgcataggtaaatgtgtgccatggtggtttgctgtatggatcatcccrtcacccaggtattaagcccagcatccattagctattctttctgatgctctccctcctcccaccccctgccctccaacaggccccagtgtattttgttccc

SEQ ID NO: 35716 - DNA, 201 bp, Homo sapiens
atcaagacttatatgttaaataactttccttagtttacctgatacgattgtcacagaaccagcctcttttaaaaaaattttcaacttttaagttcaggggyacatgtgcaggatgtgcaggtttgttgcataggtaaatgtgtgccatggtggtttgctgtatggatcatcccgtcacccaggtattaagcccagcatcca

SEQ ID NO: 35717 - DNA, 201 bp, Homo sapiens
gcgtctgttgttttttgactttttaataatacgcattctgagtgattctttacattattcagatattctttcccatgccatgtaatttctgttttcccccyttttttaaccccacgccattgaagtttcttaaacctatgtaatgcaggaccatctgttccaggtatagtttcttttccccaaacttgaagcatctaatta

SEQ ID NO: 35718 - DNA, 201 bp, Homo sapiens
ggttgcactaatttacactcccaccaacagtgtaaaagcattcctttttctccacaaccttactagctagcgtctgttgttttttgactttttaataatasgcattctgagtgattctttacattattcagatattctttcccatgccatgtaatttctgttttccccctttttttaaccccacgccattgaagtttctta

SEQ ID NO: 35719 - DNA, 201 bp, Homo sapiens
gtgaatagtgctgcactgaacatatgcgtgcgtgtatctgtataatagaatgatttatattcctgtgggtatgtacccagtaatgggattgctgggtccartggtatttctgcctctaggtctttgaggaattgccacactgtcttccacagtggttgcactaatttacactcccaccaacagtgtaaaagcattcctttt

SEQ ID NO: 35720 - DNA, 201 bp, Homo sapiens
ttgaccatatacaccatagtattccatggtgtgtatgtaccacattttcttgatccagtctatcattgttgggcacttaagttgattccatgtctctcctrttgtgaatagtgctgcactgaacatatgcgtgcgtgtatctgtataatagaatgatttatattcctgtgggtatgtacccagtaatgggattgctgggtc

SEQ ID NO: 35721 - DNA, 201 bp, Homo sapiens
gtaaatgaagttttgaactgaagtgtagacttccaccgagatgtgttgacttggagatgtatttaaatatccttcttgtttcttggtgtgattttacagtsatgtaattctcaactacattgcaatacatttctccagttagctcctcaaaagcattttttttgtgttgtttgtgaccttctgctatacttatgaatacat

SEQ ID NO: 35722 - DNA, 201 bp, Homo sapiens
aagaattcttacttcatatcttttgatggaacactgtgagacattaacatacaaatgttaccaaatagacctggtgcggtgactcatacctattatctcakcactttgggaagttgaggcggttccattgcttgagcccaggagtttgagaccagcctgggcaacatgatgaaacccatctctacaaaagatacaaaaatt

SEQ ID NO: 35723 - DNA, 201 bp, Homo sapiens
tatcattgaccatatacaccatagtattccatggtgtgtatgtaccacattttcttgatccagtctatcattgttgggcacttaagttgattccatgtctytcctattgtgaatagtgctgcactgaacatatgcgtgcgtgtatctgtataatagaatgatttatattcctgtgggtatgtacccagtaatgggattgct

SEQ ID NO: 35724 - DNA, 201 bp, Homo sapiens
atgatcttttatggctgcatagtattccatggtatacatgtaccacattttcttaatttagtctatcattgaccatatacaccatagtattccatggtgtrtatgtaccacattttcttgatccagtctatcattgttgggcacttaagttgattccatgtctctcctattgtgaatagtgctgcactgaacatatgcgtg

SEQ ID NO: 35725 - DNA, 201 bp, Homo sapiens
gttctcatccttcagctccctcttataattgagaacatgagggttcgcttttctgtttctgcattagtttgctaaggataatggcctccagctccatccaygtccctgcacaggacatgatcttttatggctgcatagtattccatggtatacatgtaccacattttcttaatttagtctatcattgaccatatacaccat

SEQ ID NO: 35726 - DNA, 201 bp, Homo sapiens
ggtttttggccagtctaaatattgtaagagagagagaagaaaagtgtacggaatataattgtctctaagctaagaaatgtggatgttcaaataaaacataygtacagaactctggctgctttcctttgtggctttgtgtgtggaggatgggtaggatcatgggcgatggtgcttctctgcagacatgaaactgagtccgag

SEQ ID NO: 35727 - DNA, 201 bp, Homo sapiens
tgtgatgctctttggaggctgtgcacctgtggaaggcaacgcaagaaagtagggctgtgcagagggtgaaggtgagctgcaatgctcagtggatgtgatgytcattggaggctatgcccactctacggaccttcttaaactagtgggagaccctctagagtggtccaggagggggcaagctgccccaggaaggaggagaga

SEQ ID NO: 35728 - DNA, 201 bp, Homo sapiens
gaaccttttttatccagtgtcgtatgtttatgtgtatgacacttctgactacacaggaagcctcttgaaatatctgattaattttgatgttttgctcaatrttcagtaaaatatttttaggtaaaaaagtagtgtttctcacccattcagttcagttgaataatttttgcactcagtttaaatgctgaactcatttaagat

SEQ ID NO: 35729 - DNA, 201 bp, Homo sapiens
tttggatgtaagtttgtcccacattgctgggaaggctcatttccggatagtcttgtcccatgtcagagggaatgagatgggcagaagtactatcacttaaraacttagtgaggttccaaggctgaattggtaggcaacaattcagggattggattgaaaaataaggggacagagcagcgggatttcaggtcattcacttac

SEQ ID NO: 35730 - DNA, 201 bp, Homo sapiens
atttaatctttagtgtcttctaccatgtctcttttgctcttaaatcattgagttaattttattcattttatttttcatttctagaaattttatttttttaytttctagatcttttttaaaataatatactgttttctgttactattatctatcttgccttatttcttattttgaacagtatttgaataaatgacaattcaa

SEQ ID NO: 35731 - DNA, 201 bp, Homo sapiens
tgtatgtgtaaagggcttgcgtatgggtggtggtcactgaagactactttcatgtttcagtgaaagagttctttaaaaaaacatatatctatatctatatmtatatatctatatctatatctatatctatatctatatctatatctatatctatatctatatatatgtagagagtccgtttggctcaagtttgaggactgc

SEQ ID NO: 35732 - DNA, 201 bp, Homo sapiens
ccctgccctccaacaggccccagtgtattttgttcccccacacgtgtttatgtgttctcatccttcagctccctcttataattgagaacatgagggttcgmttttctgtttctgcattagtttgctaaggataatggcctccagctccatccacgtccctgcacaggacatgatcttttatggctgcatagtattccatgg

SEQ ID NO: 35733 - DNA, 201 bp, Homo sapiens
ttggggctaaggcttgtagggtgaattggaacttttcagatgagcaaggcaaagaagggaccttctaacattccttggatggaacatttttgacattttcycatttacagctacttatattttctacaagtgtcactgtgaccaacttatgtacacatactttttcttgcttagttataataatctgttcttaaagaaaat

SEQ ID NO: 35734 - DNA, 201 bp, Homo sapiens
tttttttttttttttttttagtagagatggggtttcaccgtgttagccaggatggtctcaatctcctgaccttgtgatccacccgccttgtccttccaaartgctgggattacaggcgtgagccaccgtgcctggcctttttttttttttttttttggagtcttgctctgtcacccaggctggaaggcagtggcgtgatct

SEQ ID NO: 35735 - DNA, 201 bp, Homo sapiens
ccaccccctgccctccaacaggccccagtgtattttgttcccccacacgtgtttatgtgttctcatccttcagctccctcttataattgagaacatgaggkttcgcttttctgtttctgcattagtttgctaaggataatggcctccagctccatccacgtccctgcacaggacatgatcttttatggctgcatagtattc

SEQ ID NO: 35736 - DNA, 201 bp, Homo sapiens
aacagggtcccctcattactactgggcaaggtgagaattcagtttcccattaggtctttattgattcttccctggctggaatgtgcagcggcaccttttgstgcaccctgggaatctccactaatgctatgggacagagtgaccaggaagagcttcattacaccaggtgggaatgaaattcccagtagcctacacagcctt

SEQ ID NO: 35737 - DNA, 201 bp, Homo sapiens
gccggcagatcacttgagccaagagttcaagaccagcctgggcaacatggtgaaaccccatgtctaccaaaaatacaaaaattagcctgttgtcgtggcayacacctgtaatcccagctactcgggaggctgaggcaccagaattgcttgaacccgggaggtggaggttgcagtgagctgagatggcgccactgcactcca

SEQ ID NO: 35738 - DNA, 201 bp, Homo sapiens; identical to SEQ ID NO: 7675

SEQ ID NO: 35739 - DNA, 201 bp, Homo sapiens
agcgctgagtggagtgtaatggggatgaggtgggaaatgttgccagagccatctccaggcaggatttgttgttgttgttgttgttgttgttgtttgagacrgagtctctctctgtcatccaggctgtagtgcagtggcgccatctcggctcactgcaacctctgcctcccaggttcaagcgattctcctgcctcagcctcc

SEQ ID NO: 35740 - DNA, 201 bp, Homo sapiens
ttgctgatgtttgtttctagaacatatatggacttgcaacaaattcaggtgtggtgagaaaaggttgaccagaagcctctgtgcctgttcagatgactgcmaggacaagggcgactgctgcatcaactacagttctgtgtgtcaaggtcaggtgctcgttgggctctgcagcagcctggtatcttccagcgtcttagcggg

SEQ ID NO: 35741 - DNA, 201 bp, Homo sapiens
caaaaaattcagaaaatataaaaaagtataaagaagaaaatgaaaattgcttttgggttttttcccctccaggacttttctatgtgtacatatcacttttwaaaaaaaaaaaacaaagatgagatcactttgtgcatattattctgttgccttttttcatttatattccattatgaaagtttaccattgatagacagcttt

SEQ ID NO: 35742 - DNA, 201 bp, Homo sapiens
actttattagtgtgaagtcaacaatcagctgtttctgggagcttccaaagtaggtatacttttgggaaattgtgcttttcttcttagtttgagtttccttmttggcttattttgaaatgtagtagaatagaaaaatagagagttttgatagaaagtgattttgggatgtgtggtggctcatgcctctaaaggagaccgagg

SEQ ID NO: 35743 - DNA, 201 bp, Homo sapiens
gagaggagctgactgcaaggagacgaaggcttgctggggatgttctagaatggtgcttgtgctgtgtgctgaagagggctttgtgcagtactgataacacygaggttgcagtgaattagcttgcatttttttttaatcacccgagggtctgatgatagctgagtgcaggaagattgtgagttatttgtgcaagagggctac

SEQ ID NO: 35744 - DNA, 201 bp, Homo sapiens; identical to SEQ ID NO: 7677

SEQ ID NO: 35745 - DNA, 201 bp, Homo sapiens; identical to SEQ ID NO: 7679

SEQ ID NO: 35746 - DNA, 201 bp, Homo sapiens; identical to SEQ ID NO: 7680

SEQ ID NO: 35747 - DNA, 201 bp, Homo sapiens; identical to SEQ ID NO: 7681

SEQ ID NO: 35748 - DNA, 201 bp, Homo sapiens; identical to SEQ ID NO: 7682

SEQ ID NO: 35749 - DNA, 201 bp, Homo sapiens
tgagtgttctcttggtaacttttcttttatatttcctattctcctagcatgggaagcatgactcctcatgggttgaagaattgttaatgttacacagagcrcggatcacagatgttgagcacatcactggactcagcttctatcaacaaagaaaagagccagtttcagacattttaaagttgaaaacacatttgccaacct

SEQ ID NO: 35750 - DNA, 201 bp, Homo sapiens
gtactgaggacacagcagtgaacaaaatagtgagctcttctctgggcccaagagtagaatacaatgatccgtttgccatccctgatggtagtagtctttcyatatatcgttaaaattcatgaagatatgtctctccttaattgtttctatgataaactttcagaattacttgttcctatagaacacatttctcattatttt

SEQ ID NO: 35751 - DNA, 201 bp, Homo sapiens
acttcgttttgtagaaatgatatactattttaaaatagactacaacaaaactttgctatttgctatgatgttttatatcgaaataaattctttagtaaatratcataccacattttgaagaatttcaaagctgtaaattatttctcagtagaactgttacaccagtgttataaaatttaatccctatcaattgatgaatta

SEQ ID NO: 35752 - DNA, 201 bp, Homo sapiens
ttgtcaacacaattccttttagttgaaatgagggcaataacgtttgaatatgtttaatttggggctcttgttattaaagtttatgtttcgttgacatgctsatcttgaaaagacttcttaaatattttatttttgtaaaggacttgaccaaacacattacattttcccttgaccctgtacttgggaaagttttacaggttt

SEQ ID NO: 35753 - DNA, 201 bp, Homo sapiens
catggtgaaaccctgtctctactaaaaatacaaaaaattagccaggcgtggtgggtcacacctgtaatcccagcactttgagggggctgcagcggatggakcacctgaggtcaggagctcaagaccagccttgccaacatggtgaaaccccatctctaccaaaaacacaaaaattagccaggcgtggtggcagatgcctgt

SEQ ID NO: 35754 - DNA, 201 bp, Homo sapiens
agatgggattgtaacattttttgagggaatagatttaagataaaagaaaaacaacttattttccaataggtagttaagtaaggaaacccaggttctgatcyttgctctgccacaaactagctgtggctttggaaaggtcactttactggctgagtctccattttctcatctgtgaaaagagatgactcaagacctcaagaa

SEQ ID NO: 35755 - DNA, 201 bp, Homo sapiens
ttagttatatgatgtgtaccaagcccttgacatttggaaaaagggcaataaataatatctatattgttattgttttatttagtttagtctcataatttcarttctgaacttctgctttccaagtacacatatcattaaaaaaatttgctttctggagtgtgtcctaaagaataagtaattaaaatagtgcttaagaatttt

SEQ ID NO: 35756 - DNA, 201 bp, Homo sapiens
gctaatttttttttttttttttgagacagagtctcactttggcttccaggctggagtgcagtggcatgatctcggctcactgcaagctccgccttctgggytcacgccattctcctgcctcagcctcccgagtagctgggactacaggcgcccgccaccacacccggctaatttttttttttttttttttttagtagagat

SEQ ID NO: 35757 - DNA, 201 bp, Homo sapiens
tttttttttttgagacagagtctcactttggctcccaggctggagtgcagtggcatgatctcggctcaccgcaagctccgccttctgggttcacaccattytcctgcctcagcctcccgagtagctgggactacaggcgcccgccaccacacccagctaatttttttttttttttttgagacagagtctcactttggcttc

SEQ ID NO: 35758 - DNA, 201 bp, Homo sapiens
attttagcaattattttttttttttttgagacagagtctcactttggctcccaggctggagtgcagtggcatgatctcggctcaccgcaagctccgccttytgggttcacaccattctcctgcctcagcctcccgagtagctgggactacaggcgcccgccaccacacccagctaatttttttttttttttttgagacaga

SEQ ID NO: 35759 - DNA, 201 bp, Homo sapiens
attgagagaaaagtttcagcatctattattgggattgaaggattagaatattttagtaatctgggccaacatggaaatgctgtgtagtttaaagatctttmaggtcgtatcccaataatccaggtttgaaaaatttttaagaatttgtctattggcattataaaatttatatgagaagaagaaataattttaaaactattt

SEQ ID NO: 35760 - DNA, 201 bp, Homo sapiens
tcaagactgcataacattttagcaattattttttttttttttgagacagagtctcactttggctcccaggctggagtgcagtggcatgatctcggctcacygcaagctccgccttctgggttcacaccattctcctgcctcagcctcccgagtagctgggactacaggcgcccgccaccacacccagctaatttttttttt

SEQ ID NO: 35761 - DNA, 201 bp, Homo sapiens
taagcacttcaagatcttttttctcaatagattgcttttcttaagatgctgaagtaaatcagtacaatagataaagaccacaaaaacagcattttgcgacrgtgacagtcctactgaagacaggagacagttaaaaccatcagaccaagaacagaggagtggatatttaataattctatgattacttctgggggttaacta

SEQ ID NO: 35762 - DNA, 201 bp, Homo sapiens
gttgttagacaacatttcaaattttctgtgtatcacttaattataaaaaatcttttcctttcttatcgtattgtcatcccagtgtgtttgggaataattgktttatattatcttatttgctcagaattttaaaaatctacattgtagattgggacatcaagactgcataacattttagcaattattttttttttttttgag

SEQ ID NO: 35763 - DNA, 201 bp, Homo sapiens
cagtgagccaagatcatgccactgcactccagcctgggcaacagtgtgacagcccatctctcaaaaaaaaaaaaaaaaaaaaaaagaaaagaaaatagatmaaaaaattttaaaaatgaaatggaatttttttggtagaataatatggattcatgcctgtttctgttttctcttttttctttttcctttcaataaacatac

SEQ ID NO: 35764 - DNA, 201 bp, Homo sapiens
atgctaattttgaatcatggtgttaatttatttcacacgtcaacatggtcccttgttcttttgaaactacactggcttctatcttgtttcagttatatggygctactttcatgacaccctactgcgaaagtatgctgaagaaagaaatggtgtcaatgtcgtcagtggtcctgtgtttgactttgattatgatggacgttg

SEQ ID NO: 35765 - DNA, 201 bp, Homo sapiens
catttgtctggaagactgttgagcataaaaagatgcagttctatcttgtcttggacattttccacaagctaatgtttttcagtttctcaactgtccattcrttactgaggttgatctgtttcagtttgttctcactgacctctgataggaatatggagaagcgtctggaataaaaaggatcatactgattagccagatgaa

SEQ ID NO: 35766 - DNA, 201 bp, Homo sapiens
gccctgagtagatgctcctattagcagcagttacaaatgggtttttaaaggaaaaaggaagaggcagttcctaagttgtttatcaagcattcatgttacamtaacgagctattggttggctatacattgttctttgtatcacacattccaggaacatgaagatagtgggtgaggcagctgtcaggaacaaaatgcttttaa

SEQ ID NO: 35767 - DNA, 201 bp, Homo sapiens
ttggggggctgaggagggcagatcacgaggtcaggagttcgagaccatcctggctaacatggtgaaaccctgtctctactaaaaatacaaaaaattagccrggcgtggtgggtcacacctgtaatcccagcactttgagggggctgcagcggatggagcacctgaggtcaggagctcaagaccagccttgccaacatggtg

SEQ ID NO: 35768 - DNA, 201 bp, Homo sapiens
gatggttggacaggtggatggatagttaggtggatgaatggatatgtgggttaagagatggatggataggtagatgttctgtaacttgtctttccctttawcaatatgacactatatcatgggtgtcattacagggtgatccctaaaggtctgtctaattcctttcagtggctacaatgtaatgacttaaatgaactcttt

SEQ ID NO: 35769 - DNA, 201 bp, Homo sapiens
ctctactaaaaatacaaaaaaattagccgggcctggtggtgtgtgcctataatcccagctactcaggaggctgaggcaagagaatcgcttgaacccaggakggggaggtttcagtgagccgagatcgcaccactgtactccagcctgggcacagagcgggactctgtctcaaaaaaaaaaaaaagagaaaaagaaaatgat

SEQ ID NO: 35770 - DNA, 201 bp, Homo sapiens
accgcgccactgcactccagcctggtgacagagtgagactctgtctcaaaaaaaacaaagaagagtttgtgtactaagcatgggggattcaaagattaatmgtatatgatctcttggctttttaagatttagtagagtatacaactaattgtacttggggtggggcaagaactctgattagaggtgtgtaaacaaagcctg

SEQ ID NO: 35771 - DNA, 201 bp, Homo sapiens
catggaagtgtcctaggacttacttccacaagtaggactattatggaccttttttatccattaattggggtcttttgcatctattgaattggaaagaattyttacttcatatcttttgatggaacactgtgagacattaacatacaaatgttaccaaatagacctggtgcggtgactcatacctattatctcagcactttg

SEQ ID NO: 35772 - DNA, 201 bp, Homo sapiens
ggaggcagagttgaaaaggcaaggtaaggtatttcctgtcaagttttaaatttactgagtaaactttcagtgggaagtctaacagttatccagtgttatasaagttccctaccacctaccatgtatcactagatgctgaaaaatttctgagccatggccgttttggggtagccacatggccattgtccatagctattctcg

SEQ ID NO: 35773 - DNA, 201 bp, Homo sapiens
actaaatatagatgttttactatgttttattttcttatacatttataattgacagtaaaacagtttttgttgttgttttggcttgtttttttttttttttytaattttttttgagcatcttgctctgtcgcccaggctggagtgcagtggtgcgatctgtgctcactgcaacctccgcctcccgggttcaagcgattctcc

SEQ ID NO: 35774 - DNA, 201 bp, Homo sapiens
tggatggatgatggatattggttactaactggatggaaagatggttggacaggtggatggatagttaggtggatgaatggatatgtgggttaagagatggrtggataggtagatgttctgtaacttgtctttccctttaacaatatgacactatatcatgggtgtcattacagggtgatccctaaaggtctgtctaattcc

SEQ ID NO: 35775 - DNA, 201 bp, Homo sapiens
catattaaattttttgttaaagttacagcatgttttgggattttttttttctcctaggcatggaacaaggcagttgtaagaaatacatatatctgaataartatttgggggatgttaaaaatattaaagttatctatggacctgcagctcgattgagaccctctgatgtcccagataaatactattcatgtaagtatatct

SEQ ID NO: 35776 - DNA, 201 bp, Homo sapiens
gttttctgttactattatctatcttgccttatttcttattttgaacagtatttgaataaatgacaattcaagaactcatgaaagacaccaatctttagatwcaggtagcttattgaatcttaagtagaatagataaaataaatatatgttgacaacagaataacattgtagaacacaaagttgaaaataaaaaagtttaaa

SEQ ID NO: 35777 - DNA, 201 bp, Homo sapiens
ttcttttaagagacaactgttaattaggggaatagctccaaaagctacaggagttaatctctgactatttaatatgttgttgctgcttaagagtcatattrcatgattattgtcatctaagtgctgaagcttgttgaccttaaaagcattctagcactagagaggaatgcattggtgtggtatgaatacatactttcctaa

SEQ ID NO: 35778 - DNA, 201 bp, Homo sapiens
ttctttactgctcttttaccctaaggagttagttgctgaagcaaccctgtaggttactaggtgacagttaccatccctgggcaaccagaaacctgtcagtwtgtgctcttaaggttctaaaattgcagacattggttgtttcaaagccacaatgatatttttttaaacttctagatatatttttctttccatcaattgcag

SEQ ID NO: 35779 - DNA, 201 bp, Homo sapiens
ttccccaaacttgaagcatctaattaaacaaacatgcatggtatgtattagaaggaaagctactcaagaggagagatgatgcctaacaaatcatgtggcaygttccacttcagagctgaaatctcgtaaatgattaaactggggagatggagcacttatagaagtgaactgagtgttctcttggtaacttttcttttatat

SEQ ID NO: 35780 - DNA, 201 bp, Homo sapiens
agtatgtatggtttgatagcaccctctgcatagcatgtgctgtaaaaatacttaataatcaaattagaatttaggagtgggggtaggtaaacatatgtttwaattctagggggcgcatgtagatcttttgtgatatatcttttctctttctagtttttgcattttccactctatttttaattccttggagctgtgacttga

SEQ ID NO: 35781 - DNA, 201 bp, Homo sapiens
tgagccaccctgcctggcccctttgtctggtaaagatactaaaaatcagatcagaatcaaactttgtatggcttaaccactaaagtctaggtttatctgargtatggattttctctttttttaaaactggatgtataatttcaaagtgtcagcactgttataaattaaagttgttagacaacatttcaaattttctgtgta

SEQ ID NO: 35782 - DNA, 201 bp, Homo sapiens
ttatttttgagactgagtctcactctgtcgcccaggctggagtgcagtggtgtgatcttggctcactgcaacctctgcctcccaggttcaagtgattctcrtgccacagcctcccaagtagctgggatttcaagcacatgacaccatgcctggctaatttttgtgtttttagtagagacagggttttgccatgttgctcag

SEQ ID NO: 35783 - DNA, 201 bp, Homo sapiens
tgtgcagaagctctttagtttaattagatcccatttgtcaattttgtcttttgttgccattgcttttggtgttttggacatgaagtccttgcccatgcctrtgtcctgaatggcaatgcctaggttttcttctagggtttttatggttttaggtctaacgtttaaatctttaatccatcttgaattgatttttgtataagg

SEQ ID NO: 35784 - DNA, 201 bp, Homo sapiens
ccatctctactaaacacacacacacacacacacacacacacacacacacacacacacacaaaattagccaggcgtggtggcaggtgcctgtagtcccagcygctcgggaggctgaggcaggagaatggcatgaacccgggaggcggagcttgcactgagccgagatggcgccactgcactccagcctgggtgacagagcaa

SEQ ID NO: 35785 - DNA, 201 bp, Homo sapiens
taatattgaatcttttagtggaaaacataaccctttctttacaagaagattgtaacttaggacacttattattacactggataatttaccagtatgtttaygtgatggcccactaacctgcttttatgatttctgttgattgaataaaactagttttgtatggaccgttaagactatatacactggttctacagagtctct

SEQ ID NO: 35786 - DNA, 201 bp, Homo sapiens
gatcacgaggtcaggagatcaagaccatcctggctaatatggtgaaaccccatctctactaaacacacacacacacacacacacacacacacacacacacrcacacacaaaattagccaggcgtggtggcaggtgcctgtagtcccagctgctcgggaggctgaggcaggagaatggcatgaacccgggaggcggagcttg

SEQ ID NO: 35787 - DNA, 201 bp, Homo sapiens
aattttgggagagttttaaaaatttttagtttttaatttctacatggaagaagatagttttgttttgttttaatgttttgcataaaaagtctttagctttkcatggacaaagctgtgttcttcccagcaggcctgtggcctttgaagtttaaatacagccctttgttggccagtgatgatgagcattttttcatgtgtttt

SEQ ID NO: 35788 - DNA, 201 bp, Homo sapiens
gtacaatagataaagaccacaaaaacagcattttgcgacagtgacagtcctactgaagacaggagacagttaaaaccatcagaccaagaacagaggagtgsatatttaataattctatgattacttctgggggttaactatctgtgaatctaaatagaagttccagtggctggaggctgtatctgaggagggaccctttag

SEQ ID NO: 35789 - DNA, 201 bp, Homo sapiens
acttttgatttaaataagcagtagcaacagcagccaaaactaaacctcaaccaaataatttcaacagaagagcctttttttaaggaaaattttcatgtacsctaaactgtcttttaaatccaaggaatactgggaatgttagacttagtgaatttcaaatctttctttttcttctaaatattgcttataatttttcagttg

SEQ ID NO: 35790 - DNA, 201 bp, Homo sapiens
gaaatgttgccagagccatctccaggcaggatttgttgttgttgttgttgttgttgttgtttgagacggagtctctctctgtcatccaggctgtagtgcartggcgccatctcggctcactgcaacctctgcctcccaggttcaagcgattctcctgcctcagcctcccgagtagctgggattataggtgctcgtcaccat

SEQ ID NO: 35791 - DNA, 201 bp, Homo sapiens
aattgtttagaaagattcgagggcattttgtaaggtgatactattatgatgtcttgtccaggtattattattatttttttttcaaatttcttgacagaacytgactctatatgagagagaactaagacaccaaaataccaaggattttgatgagtggatagaaggggagggttgtaaattttggctgaaaatattaagaat

SEQ ID NO: 35792 - DNA, 201 bp, Homo sapiens
atgtttgtttctagaacatatatggacttgcaacaaattcaggtgtggtgagaaaaggttgaccagaagcctctgtgcctgttcagatgactgcaaggacmagggcgactgctgcatcaactacagttctgtgtgtcaaggtcaggtgctcgttgggctctgcagcagcctggtatcttccagcgtcttagcggggcttta

SEQ ID NO: 35793 - DNA, 201 bp, Homo sapiens
taaagggcttgcgtatgggtggtggtcactgaagactactttcatgtttcagtgaaagagttctttaaaaaaacatatatctatatctatatctatatatmtatatctatatctatatctatatctatatctatatctatatctatatctatatatatgtagagagtccgtttggctcaagtttgaggactgcaacccagg

SEQ ID NO: 35794 - DNA, 201 bp, Homo sapiens
ttctaattattgctctcaatctggcagagtatgttgaggtattgtgattactagcttcttatatttaattatttgtttgaatttgatttttatatgtattmaaagcatgctctactgaaatattcatcaaaaggaagatagttatttctttcttaaaatgaatattggcatgttttacagaaaaagaagagtcatccgtaa

SEQ ID NO: 35795 - DNA, 201 bp, Homo sapiens
tttttttttttttttccttgagacagagtttcactgtgtcgcccaggctggagtgcagtggtgcgatcttggctcactgcaacctctgcctcagcctcccragtagctgggattacaggagcctaccactgcacctggctaatttttgtatttttggtagagacggggtttcaccatcttggccaggctggtctttaactc

SEQ ID NO: 35796 - DNA, 201 bp, Homo sapiens
gaatcatttgctatgtgacctttgaacaattactttctttctttgactttcagtttccttaaccgtaatatgaggagttggattagatgggttccttctarttccaaaatatttgttttgagagcttacaatattttccccattgctataaaaatactatctattgcaaaaaattcagaaaatataaaaaagtataaagaa

SEQ ID NO: 35797 - DNA, 201 bp, Homo sapiens
aaccatgtgtattttaaaccaatggttaccatttaaatgcttgcttaccacctagtctttccatagtagttttcctgtccatctagttcttctactcatawactcatatccaatttgtcctgcccctttcagccattccacccatgccttaattctcttatccccttttgtattctgttttccccacctttccctctccca

SEQ ID NO: 35798 - DNA, 201 bp, Homo sapiens
taggtaaacatatgttttaattctagggggcgcatgtagatcttttgtgatatatcttttctctttctagtttttgcattttccactctatttttaattcyttggagctgtgacttgacttgggtgcaggtgtggtgaagtctagttagttgacttgggtacgggtgtggagaagtctagttcagttcttgagcatcctga

SEQ ID NO: 35799 - DNA, 201 bp, Homo sapiens
gatcacacagaccttagtggaaaatcttcactggacctgtgccaagaagggggtacatcttcattggatatgtcttgtctttgcttctttaaacatttttktttctttttcattacccaggtttgaaacgcctcctaccctcttattttctttggatggattcagggcagaatatttacacacttggggtggacttcttcc

SEQ ID NO: 35800 - DNA, 201 bp, Homo sapiens
tcatgtaacccttcggtaagtatcgtcaagaagtttggtccagtatgtatggtttgatagcaccctctgcatagcatgtgctgtaaaaatacttaataatyaaattagaatttaggagtgggggtaggtaaacatatgttttaattctagggggcgcatgtagatcttttgtgatatatcttttctctttctagtttttgc

SEQ ID NO: 35801 - DNA, 201 bp, Homo sapiens
gcagttgattattccataacccatacacagtgttggtagatggcaccgtggcctattaagaaattttacccaggacccagactccaaatccaaatacacarcttgctaaaagcagtctttgcaagcttaacacgaaataaaataatttcaaagtggtgtggttataggtataagaggattgttagcttccacttggggttt

SEQ ID NO: 35802 - DNA, 201 bp, Homo sapiens
tgcttctaactatgtcatatctttatcatcagcctatggcatcattccagagttgttgttgcctttattagatttataaactctgacattaggacttcacygcaaattattttttttttttgtatttccccacagaatctaaatacattgcatcttgcagatactcaaacctttgtttactgacagagggagaggtccctt

SEQ ID NO: 35803 - DNA, 201 bp, Homo sapiens
gggcggggagccaaggatctgaccgcgaggggcgggcgcggcggggaggggcggggcggggcgggcggcgcggggcctattaaaggcgcggccgggcagcsgggccggagcggccggggccacgatggagcgcgacggctgcgcggggggcgggagccgcggcggcgagggcgggcgcgctccccgggagggcccggcggg

SEQ ID NO: 35804 - DNA, 201 bp, Homo sapiens
ttaggtagatttcatggagctttgagtattcaggcagaatttgtttattgaagtttgcttaaggtaaataggcagagaaggagcttactgttatgctgagracccctaaaatgccagaatgaggaagagtttactctgggtcactaatacccacattagtcctgtggttgtcctgtgtactgattccaaaagtacatgggt

SEQ ID NO: 35805 - DNA, 201 bp, Homo sapiens
ttggtgtggtatgaatacatactttcctaagagatgaatgtttgcatgatttcttaattttccttcattttctgctccagatttgggtcacagctaagtakcaaggcctcaagtctggcacatttttctggccaggatcagatgtggaaattaacggaattttcccagacatctataaaatgtataatgggtatgtgaaat

SEQ ID NO: 35806 - DNA, 201 bp, Homo sapiens
tcttctaaacctccaaggagaaacgaactctaatcttaccatccttacagcctagtttatgaagttagcatggcctttcacttgaagatctttttactgtygttgtcctggaattttgcagtgatgtgaatcggtatgagccttcttctatgatttattattttggatacttgatattaggactctttgatgtgaagtttt

SEQ ID NO: 35807 - DNA, 201 bp, Homo sapiens
aatatactgttttctgttactattatctatcttgccttatttcttattttgaacagtatttgaataaatgacaattcaagaactcatgaaagacaccaatytttagattcaggtagcttattgaatcttaagtagaatagataaaataaatatatgttgacaacagaataacattgtagaacacaaagttgaaaataaaaa

SEQ ID NO: 35808 - DNA, 201 bp, Homo sapiens
gcgggcagatcacgaggtcaggagatcgagaccatcctggctaacacggtgaaactccatctctactaaaaatataaaaaaattagccgggcgtggtggcrggcgcctgtagtcccagctactcaggaggctgaggcaggagaatggtgtgaacccgggaggtggtggagcttgcagtgagccaagatggcgccactgtac

SEQ ID NO: 35809 - DNA, 201 bp, Homo sapiens
agaatggtctggaaccagacttggaacttctatagattcttttaatgtgaaatttttgtatttatcctctccattatagtgattgaacaaaaaaatgtttwctagaaatcatattcataccagaaaacagatatgtgaaatacattttaatctactagaaatggaagaatccttggaagaggcattatactcatgggatgt

SEQ ID NO: 35810 - DNA, 201 bp, Homo sapiens
acctttaacttcagagagaaatgacctgtgaaagcacttggtgagatcttagtaaagaagtgatttgcccactgaggcagaagttataggtgctggttaarttttatctttttctttgaaaatgtttggtacttattgaaacaaaaatgaatgagcatgacagaagaggagaataattgccctagaaatatcagctgtctg

SEQ ID NO: 35811 - DNA, 201 bp, Homo sapiens
tcaccatgaatagtttcatccattcgtagcagtgctgagtctgtgacatatgtgttcagtcatttatgagttaatatttgtcaaccacttagagtagaccsttgctggtagtaagtgctatgtgtgtttgttaaatacatacatatctatttgtgtttactatttgtccggccctatgctaaagacttatctcctttaatg

SEQ ID NO: 35812 - DNA, 201 bp, Homo sapiens
agatgctgaaaaatttctgagccatggccgttttggggtagccacatggccattgtccatagctattctcgtttgtcaagtatattagcatcctctgtggkttttggcctcctttttgaaatttccacactacacgttaactgtttgtatatgtatgtatgtgttgttgaaacctcattgatcattcccagctttgaatta

SEQ ID NO: 35813 - DNA, 201 bp, Homo sapiens
gtggctggaggctgtatctgaggagggaccctttagccttttaaagagtgattctgctgtgcagttgaggtgttttctgtcactctccttattgatgaaakgcttgtgtctcaagatacaatgacggtctacaagtcatggagtgaaggtgaacatgaaagctcaatgaaaccattactttatactatgagatggatgttt

SEQ ID NO: 35814 - DNA, 201 bp, Homo sapiens
ctaattttttgtatttttagtagagaatggagtttcaccgtgttagccaggatggtctcgatctcctgaccttgtgatctgcccgcctcggcctcccaaartgctgggattacaggcttgagccactgcctccagcctatcctgatttctactgtcatgcctcacatcagtccttttttttttttttgagacagagtctcg

SEQ ID NO: 35815 - DNA, 201 bp, Homo sapiens
ttgccaatcttctgtctttgctgttacctgataacattcagatgtttttccaattcagccatccatctatcaaaatatcatgtagatggtgctttccatcrcacgatcaatggaactatccaattccaagtttccactgcagtcccctctcaacaatcaacagtatacttgacacaaaaccaaaacaaaggaatcttatac

SEQ ID NO: 35816 - DNA, 201 bp, Homo sapiens
actttctccaataaaggctgttcttagcttttcaaatgcaaagtgaaacctttatttatcttgatttcttttttttttttttttttttttttttttttgaratgctctgtcacccaggctggagtgcagtggcaagatcttggctcactgcaagctccgcctcccaggttcacgccattctcctggctcagcctcccgagt

SEQ ID NO: 35817 - DNA, 201 bp, Homo sapiens
gccataaaaaatgatgagttcatgtcctttgtagggacatggatgaaattggaaatcatcattctcagtaaactatcgcaagaacaaaaaaccaaacaccrcatattctcactcataggtgggaattgaacaatgagatcacatggacacaggaaggggaatatcacactctggggactgttgtggggtggggtgaggggg

SEQ ID NO: 35818 - DNA, 201 bp, Homo sapiens
atggctgctgtaaaatccttatcagataattccaacatctgtcacctcattgtttgcatctactgatggtcttttttccattcggaaacattttcctgttycttggtgtgtggaatgattttttattgaaacctggatatttttaggtattatgttatgagactatgggtcttatttaaaccttctgctttagccaacttt

SEQ ID NO: 35819 - DNA, 201 bp, Homo sapiens
atatatactcctaagccgagactagtttttatttcccacacgcgggataacagtagacgttaatcaatgtagggctcaccatgaatagtttcatccattcrtagcagtgctgagtctgtgacatatgtgttcagtcatttatgagttaatatttgtcaaccacttagagtagacccttgctggtagtaagtgctatgtgtg

SEQ ID NO: 35820 - DNA, 201 bp, Homo sapiens
ttcagtatggagtcattaatgtctattttatactttgaattataacccagtactctgtttttcatgtttttgcttaacttgttccagccatggccacttgkcagttaatttctgtgaccctttgacgtgtgtgtgtttgtaagtgtttagcacttccttactttctggccctacaggatgttccaggcttttaggttctct

SEQ ID NO: 35821 - DNA, 201 bp, Homo sapiens
tagtattaataccttgaggtgtttcacacacgatgaggtagtcgataattgtatatggaatcagtgtgtaactcttgtgtaaaaccatttctacatgcctrtaaacctttacaggttttccaattgcaaaattcaggttttaaatttttcttgctcatttacttatacatccacaacagatatcagcaaaggtctagtttt

SEQ ID NO: 35822 - DNA, 201 bp, Homo sapiens
acagatggtaaagtgccattcttaactcatcatttcaagagtatctgctattaatgctattaataggtcttgtcattgatgatgttaaccttgactacccrgctgaggtagtctttttcaggtttctttgctgtaaagatactcttttttgtccctttccatactgtacctttggtagagagttacattccacctccttga

SEQ ID NO: 35823 - DNA, 201 bp, Homo sapiens
aggtagatacattctgatttctcctttcctcccaccctccaatgttctctttcctgttggcctctcctggtctgatgcttggagtctgggagtctgggaartgtagtagtcaaagttacttctctgagttggcggatcaaaagaaaaggcagtaacacaacttgggtttcttgggaaacagactattagatggaaatgagc

SEQ ID NO: 35824 - DNA, 201 bp, Homo sapiens
agctgggaccctgggcagatgcagccactgcaggggtcccacccggagcagggaggacaaggtagatacattctgatttctcctttcctcccaccctccartgttctctttcctgttggcctctcctggtctgatgcttggagtctgggagtctgggaaatgtagtagtcaaagttacttctctgagttggcggatcaaaa

SEQ ID NO: 35825 - DNA, 201 bp, Homo sapiens
caccattaataaaactgctttcctccctttcctatcttatgagctgaactaaactttacaattcttttctaaagtaatttaatactacttttatttaacgrcatatctttcttgatagttgctgcaaaagagaccaactattttcaggattgggggacaatttttcttttctttttttaaaccaactgaagaaagatctaa

SEQ ID NO: 35826 - DNA, 201 bp, Homo sapiens
atcccaaaatgaatgcttccttttcacttaaaagtaaagagaaatttaatcctgagtggtacaaaggagaaccagtgagttctttgtttttctactaaaakagttaattattctcatctatttcaatcagagtaaaataaccagattctctagagcttttaataactgatttcatttagtgtgtctgtggccattcttttg

SEQ ID NO: 35827 - DNA, 201 bp, Homo sapiens
acgttgcaaaccaatggagctgtttctcgtaacagacagcgttgatgtaggagtactgctgtcagtggaggtcgttctggattccgagtgggatcggaaastgatgtcccgggattagaggatgtgtttatgctggctttcaggatgttccaaggcatggtgcaatgattgtcaaattccactttgtaagaagacagcaca

SEQ ID NO: 35828 - DNA, 201 bp, Homo sapiens
caggctgcaaagaacagtgtgtgcaagagcaccaggtaggggaagaacgttgcaaaccaatggagctgtttctcgtaacagacagcgttgatgtaggagtmctgctgtcagtggaggtcgttctggattccgagtgggatcggaaactgatgtcccgggattagaggatgtgtttatgctggctttcaggatgttccaagg

SEQ ID NO: 35829 - DNA, 201 bp, Homo sapiens
taaacaatttgagaatattgtgaaggtggaatatatatatcaagttggaagaatatatcaaggttcttaggaagataactttgttaggataaataactttsttgtttaaaaagaaaatgcgtttgtcagagaagtaggtaaaggtagaggcttacatatgcttgctttttcactgatccagaatctctagggaatggcttt

SEQ ID NO: 35830 - DNA, 201 bp, Homo sapiens
gaaagtatcagacttatgttctgagaaggataatatcttacatttacccagcactttaacattttcaaaataaacttacaataattatttaatttgatccctgcatcactgtgtaaggtgggcaggatgaggtttatattgcatgtcatagatgaaaaaaaaatgttatcattcattctgttctgattgtcaaaccaagaa

SEQ ID NO: 35831 - DNA, 201 bp, Homo sapiens
agacaaaatcatattagagtgtgttaggagaagtaaattatataatgtgtacaaaatggtgcataatatgccctgaataagtggttttttcttgttattgktgataagcttcaatgtgactgagaattttttattttaccttactcagaaggcactttacatccttaactacccaaagtgtggtctgcagactgacatatc

SEQ ID NO: 35832 - DNA, 201 bp, Homo sapiens
cacaactgtagcatagagacaaaatcatattagagtgtgttaggagaagtaaattatataatgtgtacaaaatggtgcataatatgccctgaataagtggktttttcttgttattgttgataagcttcaatgtgactgagaattttttattttaccttactcagaaggcactttacatccttaactacccaaagtgtggtc

SEQ ID NO: 35833 - DNA, 201 bp, Homo sapiens
ttactaatcagtgagacaaccaaataaaaagatagggatatgtctgtttatatataatttctatgttacaaatatataatacacacatatatttatataaratttcttgaactttgatttttaaaatttttcaatactgtcttcaaacaccaaacacttaaaaaaatttttgactttgtaattgatcagtctacaccattt

SEQ ID NO: 35834 - DNA, 201 bp, Homo sapiens
agttcttctcattttcgttcttcaggacagtttctctacggaagacttctccaactgtctgtaccaggactttagaattcctcttagtcctgtccataaaygttcattttataaaaataacaccaaagtgagttacgggttcctctccccaccacgtaagttttttcctctcctgaccttcccttttctcctttttgtttt

SEQ ID NO: 35835 - DNA, 201 bp, Homo sapiens
gcgtggtggcagatgcctgtagtcccagctactcgggaagctgaggcaggagaatcgcttgaacctggggggcagagttgcggtgagccgagattgcgccrctgccctctagtctgggtgacagagtgagactccatcttaaaaaaataataataataaataaataaataaataaataaatatttaaaattgtgtagataa

SEQ ID NO: 35836 - DNA, 201 bp, Homo sapiens
tgcgatcttggctcactgcaacctctgcctcagcctcccaagtagctgggattacaggagcctaccactgcacctggctaatttttgtatttttggtagaracggggtttcaccatcttggccaggctggtctttaactcctgacctcgtgatccacctgccttggcctcccagcgtgctgggattataggcatgagccac

SEQ ID NO: 35837 - DNA, 201 bp, Homo sapiens
ggtgcgatcttggctcactgcaacctctgcctcagcctcccaagtagctgggattacaggagcctaccactgcacctggctaatttttgtatttttggtaragacggggtttcaccatcttggccaggctggtctttaactcctgacctcgtgatccacctgccttggcctcccagcgtgctgggattataggcatgagcc

SEQ ID NO: 35838 - DNA, 201 bp, Homo sapiens
agagcaattggaggccgggtgcagtggctcacgcctgtaatcccagcactttgggaggctgaggccggcagatcacttgagccaagagttcaagaccagcytgggcaacatggtgaaaccccatgtctaccaaaaatacaaaaattagcctgttgtcgtggcacacacctgtaatcccagctactcgggaggctgaggcac

SEQ ID NO: 35839 - DNA, 201 bp, Homo sapiens
gatagcaccctctgcatagcatgtgctgtaaaaatacttaataatcaaattagaatttaggagtgggggtaggtaaacatatgttttaattctagggggcrcatgtagatcttttgtgatatatcttttctctttctagtttttgcattttccactctatttttaattccttggagctgtgacttgacttgggtgcaggtg

SEQ ID NO: 35840 - DNA, 201 bp, Homo sapiens
gaggctactctgcaagtagagggtccttggatattttaagtcctgaaagccgtctaactgcacagtactgaactgttgagggagaacacagcctccctgtrtggggcagaaaagtttctcacataggggaaagataaggttccttcagattcttcaggtgaaatacccagcatgggatttttcccatttcaggatgcttca

SEQ ID NO: 35841 - DNA, 201 bp, Homo sapiens
cctcccgggttcaagtgattatcctgccttagcctcctgagtagctgggattacaggcgcacaccaccacacctggctaattttttttttttttttttttkgtatttttagtagagacagggttttgccatgttggccaggctggtctcgaactcctgacctcaagtgatctgcccgcctcggcctcccaaagtgctggga

SEQ ID NO: 35842 - DNA, 201 bp, Homo sapiens
atttacaactcaaaattatttaataatttaggaagttgctttttttttttttttttttcagtcctgcagtttcctgaagctctgtatatgatatttttttyagcctgcttctctctgttgttcagattaggtaattttattcttctgtctcgaagctcactgattctttattctgtctaatctgttctgctgttgagccca

SEQ ID NO: 35843 - DNA, 201 bp, Homo sapiens
tccttcgtgtgaccattctttaacggcctaagggccagctgcaaagacttttggaaaatacaatttacaactcaaaattatttaataatttaggaagttgytttttttttttttttttttcagtcctgcagtttcctgaagctctgtatatgatatttttttcagcctgcttctctctgttgttcagattaggtaatttta

SEQ ID NO: 35844 - DNA, 201 bp, Homo sapiens
cccacaaggtaccacagtacatgtgaggatgttaggtttgggtttgtgtagaactgttaaaagaggcatataatattccacatattgcctttaatggattratacataggaaatccagactctgtaaatagttttctctctctttcccttaataattataatttttatgactaattcatttatactaactaggagagtttc

SEQ ID NO: 35845 - DNA, 201 bp, Homo sapiens
gtccttcgtgtgaccattctttaacggcctaagggccagctgcaaagacttttggaaaatacaatttacaactcaaaattatttaataatttaggaagttkctttttttttttttttttttcagtcctgcagtttcctgaagctctgtatatgatatttttttcagcctgcttctctctgttgttcagattaggtaatttt

SEQ ID NO: 35846 - DNA, 201 bp, Homo sapiens; identical to SEQ ID NO: 7666

SEQ ID NO: 35847 - DNA, 201 bp, Homo sapiens; identical to SEQ ID NO: 7668

SEQ ID NO: 35848 - DNA, 201 bp, Homo sapiens
cagttgtaatattgaatcttttagtggaaaacataaccctttctttacaagaagattgtaacttaggacacttattattacactggataatttaccagtaygtttacgtgatggcccactaacctgcttttatgatttctgttgattgaataaaactagttttgtatggaccgttaagactatatacactggttctacaga

SEQ ID NO: 35849 - DNA, 201 bp, Homo sapiens
aaattgctatttagctactgaactgaaagtgcaaactcgtattcttctttcccttccctacttcaatacctttttcccccaaccccgccccccccccaaaracttccccaaataatgggcttccaaatggaaaaggccccaaaagcatcctgacaattgtcgtcaaagagctctgggatatgtcttctagaaaggagctgc

SEQ ID NO: 35850 - DNA, 201 bp, Homo sapiens
tgagcagggaaaaaagtggagttatggtcattaggaaaagatcaaggaaagttctgtgtctttcaggtatgtgatttacctaattcatttgaattttttttagtttagcatacatacacgttttgacattagcttttatattttctttcaacagttccttaagagaaaaaaatttacagaatttctctgttaaacatttta

SEQ ID NO: 35851 - DNA, 201 bp, Homo sapiens; identical to SEQ ID NO: 7670

SEQ ID NO: 35852 - DNA, 201 bp, Homo sapiens
tgacactccattaaaattacttagtttgggattaatattctgttgtgaggaggagtgctggcagaaatgattaattctataggcaattgattcctgtcctyccttaaaccatttcagaaacaataaagaatgtatcttttacatagggaagaatgaatttcacatctcttgaccacatgtggaacataaactgccaaaaga

SEQ ID NO: 35853 - DNA, 201 bp, Homo sapiens
tttcagccattccacccatgccttaattctcttatccccttttgtattctgttttccccacctttccctctcccagggcatgtcgtcttttttttttttttcccccattttcccacttccactcttagaatttcaggccattcaagtttgttatattccatgatttcagattaagctgggctcccagagctggagggtctt

SEQ ID NO: 35854 - DNA, 201 bp, Homo sapiens
tttttgggataacaacctatttgtgagagatgatacatttttttaaaataattcatatttggtttttttgtccttcagatattttgtacagggtcttccakatatgacaccatcaaaaagagtatgtgtggaatttaaagggtgaagattttataaaggtgttaagtgtatttatctttgttccatttgaggtctaccatc

SEQ ID NO: 35855 - DNA, 201 bp, Homo sapiens
taggaacaaataagcatttggaatacaacttgtaattagagatctgcttttggttaaaataagcatgcctccatcaaccataaaataccccccaaacaagwaaaaataaacaagaaaccttttagcaaatgagctcagggccgaacatagattactcttctaagcataaatcttgtgcaacaaaacctgatactcagaatt

SEQ ID NO: 35856 - DNA, 201 bp, Homo sapiens
tattctagataagtttacagataaatacaatttcaattcttcatggtttttttttttttttttttttttttttttccttgagacagagtttcactgtgtcscccaggctggagtgcagtggtgcgatcttggctcactgcaacctctgcctcagcctcccaagtagctgggattacaggagcctaccactgcacctggcta

SEQ ID NO: 35857 - DNA, 201 bp, Homo sapiens
atacatacccctgtcaagcaaaacctaagcagtgaaccaaaattcagtaaacagaattatactgtctccactcttattggagagctgggcttttagttttsaaaaaatatatatatatatgaaaggagaaatggtcctatcttcatgagagaactaatatttagtaaatatctaaacaccatgttgcaagcatttctttag

SEQ ID NO: 35858 - DNA, 201 bp, Homo sapiens
ttcttttgaaactacactggcttctatcttgtttcagttatatggcgctactttcatgacaccctactgcgaaagtatgctgaagaaagaaatggtgtcartgtcgtcagtggtcctgtgtttgactttgattatgatggacgttgtgattccttagagaatctgaggcagtaagaacatatttcattactcttaaaaata

SEQ ID NO: 35859 - DNA, 201 bp, Homo sapiens
ttcatgaagatatgtctctccttaattgtttctatgataaactttcagaattacttgttcctatagaacacatttctcattatttttccctttattctttrgaattaaatacagaatagcaagattttagttggttgcctgatgattatctgactccactgaaagttgtcagttttgtgggcattgttggaaacatgcagc

SEQ ID NO: 35860 - DNA, 201 bp, Homo sapiens
catgttgctggcaggaatgtacaatggtacagccacattgggaaacagtttctctgtttctcaaaaatttaaatatacgctttgcatatgacttaacaatkaaactcccagttatctacccaagggaaatgaaaatgcagattcacacaaagacatgtacatgaatgttcatagaagcattatttataatagctcaagctg

SEQ ID NO: 35861 - DNA, 201 bp, Homo sapiens
aaagatgaatatactagtaggaaaatagggaaggacatgagctgacagctagagcttcataattttatgatgtagttcacctttaaatattaataaagcarttttcttctctgtgcctgatatctgagagttcttctcattttcgttcttcaggacagtttctctacggaagacttctccaactgtctgtaccaggacttt

SEQ ID NO: 35862 - DNA, 201 bp, Homo sapiens
gaggcggaggttgcagtgagccaagatcacaccatcgcattccagcctgggcaacagggcaagaccctttctcaaaaaaaaaaaaaaaaaaaaaaaaaaawaaatatatatatatatatatatatatatatatagcaatttggagagtagtttatttcatgctttacattttgttttagacttgagttagaatagaagaaa

SEQ ID NO: 35863 - DNA, 201 bp, Homo sapiens
tataatgcacactaactacatttattttcatcctgtgacccaagagaagattattaagcatgaaactttaccctatggaagacctagagttctccagaagraaaacaccatctgtcttctttcccagcaccagtttatgagtggatacagccaagacatcttaatgcccctttggacatcctataccgtggacagaaatgc

SEQ ID NO: 35864 - DNA, 201 bp, Homo sapiens
agggcagattctcaatattaataggaccccaaaagagctgctctaggttagataatgccccagtttatccaggaatgtaagtaatgttattgtgccataastttaagcaggaaagattctgaagatgctgacagccaatgatctcttccacagttttaaggttattttcctttaggtctaactcatgcaaattattcaggc

SEQ ID NO: 35865 - DNA, 201 bp, Homo sapiens
agtagagaatggagtttcaccgtgttagccaggatggtctcgatctcctgaccttgtgatctgcccgcctcggcctcccaaagtgctgggattacaggctygagccactgcctccagcctatcctgatttctactgtcatgcctcacatcagtccttttttttttttttgagacagagtctcgctctgtggcccaggctag

SEQ ID NO: 35866 - DNA, 201 bp, Homo sapiens
ttgaacctgggaggcggaggttgcagtgagctctcatcactgtactccagcctgggtgacagtgtgagactctgtctcaaaaaaaaaaaaaaaaaaaaaaacccaaccagccaaccaaacaaacaaaccaaagtttataaaataactcttccattacttctttactacttccccttccttctatcattgtcattttcaacc

SEQ ID NO: 35867 - DNA, 201 bp, Homo sapiens
aggagtcctttatttgatggtattttctattaaacaaaatcttccaggttggagaccatgatctttgatgtttttgtctcctaagagcttgctgttaaaakaatccttaattaatttagaattttcagtgagaaacttataaggccttgacaatagtgaagagtatcaccttgttaatggaaaaaccaaactctgtaaaat

SEQ ID NO: 35868 - DNA, 201 bp, Homo sapiens
gcagcctcaacttcctgggctcaagtgattctcctacctcagcctcctgagtagctggaactactggcatgtgccaccacacctggctaattaaaaaaaawtttttttggtagacatgggatcttgctatgttgagcaggctggtctcaaactcttgctctcaagctcccactgctgccttccaaagtagtgggattacag

SEQ ID NO: 35869 - DNA, 201 bp, Homo sapiens
ccatacctccacccattgtccattcccgtttgcattttcttggtttcagctaagataggctgttcattatttatctgccaccttccatgtgcctgccttcstggaacccttctttatgctgccctttctcctagaagtttgctgtgttctgtcctctctttccttcctccagttccacctggcaacatcacgccatcattt

SEQ ID NO: 35870 - DNA, 201 bp, Homo sapiens
ggaaagctactcaagaggagagatgatgcctaacaaatcatgtggcacgttccacttcagagctgaaatctcgtaaatgattaaactggggagatggagcrcttatagaagtgaactgagtgttctcttggtaacttttcttttatatttcctattctcctagcatgggaagcatgactcctcatgggttgaagaattgtt

SEQ ID NO: 35871 - DNA, 201 bp, Homo sapiens
ggtgctaccgctggttgcatttggcccctttccttccatgaacctcagtggcacatggatacaagtagccccattgctcttgcacatacagaacatggcayagtctcctccctttgcatataccatctctgtctttcaggaacctgcctgtgctctcgtgtgttgcttataatttaattgccttcttttactctgcactgg

SEQ ID NO: 35872 - DNA, 201 bp, Homo sapiens
taccattcacttcctcttaagtctttgcagtcacttgacagtaggcacctcgagagcagaggtcatgtctgttttattactgaatgtccagtacatagtcmgtactcaatactcttcatctgaaggaatgaattcttataaaagcctccaccaaccatctacttggtcctattcacccattcctcctgtctctattatctc

SEQ ID NO: 35873 - DNA, 201 bp, Homo sapiens
tttgaacctgggaggcggaggttgcagtgagctctcatcactgtactccagcctgggtgacagtgtgagactctgtctcaaaaaaaaaaaaaaaaaaaaaaacccaaccagccaaccaaacaaacaaaccaaagtttataaaataactcttccattacttctttactacttccccttccttctatcattgtcattttcaac

SEQ ID NO: 35874 - DNA, 201 bp, Homo sapiens
ttgtccaccaagaacaagagtgagttttctagcttatttggggttcctgttgtcattgtgtgtgtgtgtgtgtgtgtgtgtgtgtgtgtgtgtgtgtgtgkagtttgataaattacttaaaagtttataaaggccagacacgatggctcatgcctgtaatcccagcactttgggaggccaaggcgggcagatcacctgagg

SEQ ID NO: 35875 - DNA, 201 bp, Homo sapiens
cttgtccaccaagaacaagagtgagttttctagcttatttggggttcctgttgtcattgtgtgtgtgtgtgtgtgtgtgtgtgtgtgtgtgtgtgtgtgtgtagtttgataaattacttaaaagtttataaaggccagacacgatggctcatgcctgtaatcccagcactttgggaggccaaggcgggcagatcacctgag

SEQ ID NO: 35876 - DNA, 201 bp, Homo sapiens
gtgacatatgtgttcagtcatttatgagttaatatttgtcaaccacttagagtagacccttgctggtagtaagtgctatgtgtgtttgttaaatacatacrtatctatttgtgtttactatttgtccggccctatgctaaagacttatctcctttaatgggtacagttctgtgaggtaggagggagcaaatctgttggctt

SEQ ID NO: 35877 - DNA, 201 bp, Homo sapiens
gattgattcgaccaattctctggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactc

SEQ ID NO: 35878 - DNA, 201 bp, Homo sapiens
atttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagatgtgtttcccgatccccctcctgcttagaaagctttttttgacgt

SEQ ID NO: 35879 - DNA, 201 bp, Homo sapiens
acaggtgtctctcccgcactaggtcagtgcttgagatgtagtaggatctcaagaaatatttgttcaatgctgaataatgaattgaaaggtggaatttgaaycaaagtcattttgaacttgaagctctttctaccaggcaggtgtcaatttctttagttttagtgtttcactgagagattgtgagatttgtccctatgtgat

SEQ ID NO: 35880 - DNA, 201 bp, Homo sapiens
tgagaccagcctgggcaacatgatgaaacccatctctacaaaagatacaaaaattagctgggtatggtagcatgcgtctatgtcccagctacttgggaggmtgacatgggaggttcagctgagccagggaaagttaaggctgcagtgaactgtgattgtgccactgcacttcagcttgggtgacacggtgagaccctttat

SEQ ID NO: 35881 - DNA, 201 bp, Homo sapiens
gctgtctatgataaaatctgagcttccaagcaaaaattagaattttgaaaaacttgtatttgccatttgagtgtaacagcttcctgatccttacacaaaaytgatgaagatagcgaggaatgtggttttttttcatgttgtttaatgacatgcgttaacatttggaagaatgatagaacttagtgaaccaatattttccaa

SEQ ID NO: 35882 - DNA, 201 bp, Homo sapiens
tgtccagttgtctgcttcatagagcagacatttaccttcctcatccaccagccattggaggaggactggggccacgcaaatgattgattcgaccaattctytggggagagtttcccagtggccctcttccatcatcatatctggaatcagatgagtttccatagcttcttttttttttttttcgcatcttgctgaagcaga

SEQ ID NO: 35883 - DNA, 201 bp, Homo sapiens
tttttttcagtcctgcagtttcctgaagctctgtatatgatatttttttcagcctgcttctctctgttgttcagattaggtaattttattcttctgtctcraagctcactgattctttattctgtctaatctgttctgctgttgagcccatttattcctgatttttatattttagttattgtatgttttatttctaaaatt

SEQ ID NO: 35884 - DNA, 201 bp, Homo sapiens
aattcttctgaattggaaatttgttctcccccttatatttatttattcagtctttttcagtatggagtcattaatgtctattttatactttgaattataamccagtactctgtttttcatgtttttgcttaacttgttccagccatggccacttggcagttaatttctgtgaccctttgacgtgtgtgtgtttgtaagtgt

SEQ ID NO: 35885 - DNA, 201 bp, Homo sapiens
cttaataagatgtctttttatttctattttttttttctattcccctctcccctttaccgttctgtgttgatcttagacttttgtcttaggcttacctccartgactggtgaatcatggtggttcatttatatttaaggatgagagattaggtagatttcatggagctttgagtattcaggcagaatttgtttattgaagtt

SEQ ID NO: 35886 - DNA, 201 bp, Homo sapiens
aaataatgtagtttgctgcataggaaaagctgctagggcagattctcaatattaataggaccccaaaagagctgctctaggttagataatgccccagtttrtccaggaatgtaagtaatgttattgtgccataagtttaagcaggaaagattctgaagatgctgacagccaatgatctcttccacagttttaaggttattt

SEQ ID NO: 35887 - DNA, 201 bp, Homo sapiens
tgttacgcctcaactccaaaagggagggagtagaattaagtgcgtttgacctctcttcctattttgactgagagctcagtttttgaggtttctctggggtytccttggcagagagtgggtccactcagttggtcgagggctttggattttatttttagtttacaacttttcaggagagctggttcgtagtctccttcatcc

SEQ ID NO: 35888 - DNA, 201 bp, Homo sapiens
tatgtgtaaagggcttgcgtatgggtggtggtcactgaagactactttcatgtttcagtgaaagagttctttaaaaaaacatatatctatatctatatctmtatatctatatctatatctatatctatatctatatctatatctatatctatatctatatatatgtagagagtccgtttggctcaagtttgaggactgcaa

SEQ ID NO: 35889 - DNA, 201 bp, Homo sapiens
agattacaggcgtgagccaccgtgcccggccttggctcatttttattcttccgattttagacttccaattgggtttttataattacccatattaagtcccrcctggcacagatgaggcatgagcattaggcagaggccacatcctggtgacgtgtgtgccaggtctgtcctgcagatgtgctacattttgtttggctttta

SEQ ID NO: 35890 - DNA, 201 bp, Homo sapiens
gcagtcagcaccgggcaccggagagaggcatggtccgggagtgcttcttcgcccgcgcgctctcctccgcagcctttgcaagtgccctacacagccgcccytgccaggtaccttgccagggcaggatggttcactctcacttgaattatggatgcctgtgaaagcaggctgttcaaaacggtcatccttagaaatactcga

SEQ ID NO: 35891 - DNA, 201 bp, Homo sapiens
aagcagagttttgaaaagcaaaaccacaaactcagctgttccccataagaaatctgttatcaaagataatctccatggagactgactccagctgtccagcrcttgtccatttgcgatgtaaaccatcttgccccccttccctgcttcggagcgactggtcatagtttaagagattactacttttagaattttggtgtggtt

SEQ ID NO: 35892 - DNA, 201 bp, Homo sapiens
tttttgttcttagtgacaagttctgatttacttttggaaaaatcattttataatagctttagtggcacaaacaaatcaacgggaccctgaaaactataatrgctttagtgacactaacaaatcaaagggagcctgaaaatagaagagcacactgtctttttgttgttgttgttgttaattgaccacttcgtaacttttttt

SEQ ID NO: 35893 - DNA, 201 bp, Homo sapiens
atatggacttgcaacaaattcaggtgtggtgagaaaaggttgaccagaagcctctgtgcctgttcagatgactgcaaggacaagggcgactgctgcatcarctacagttctgtgtgtcaaggtcaggtgctcgttgggctctgcagcagcctggtatcttccagcgtcttagcggggctttacataggtgttatcttttat

SEQ ID NO: 35894 - DNA, 201 bp, Homo sapiens
gtttgttcccctccagttaactatgaaggcattgcccgaaatctttctgtgagtatctttattttccattatctagttatttttacttttgtataatatayattgagagaaaagtttcagcatctattattgggattgaaggattagaatattttagtaatctgggccaacatggaaatgctgtgtagtttaaagatcttt

SEQ ID NO: 35895 - DNA, 201 bp, Homo sapiens
aagtgaaacctttatttatcttgatttcttttttttttttttttttttttttttttttgagatgctctgtcacccaggctggagtgcagtggcaagatctyggctcactgcaagctccgcctcccaggttcacgccattctcctggctcagcctcccgagtaactgggactacaggcacctgccgtcacgcctggctaatt

SEQ ID NO: 35896 - DNA, 201 bp, Homo sapiens
tgtgattatcagtctttttaatgtttgttcattttgttgggtaggaaagggactcattgatttgtagttctttgattttttttaatgaaaatgaatgtttyatatttttattagctattttctttaaatagttggtttattacttttggtatttttaaaaattggattttttttctacttgatttttataccctattatct

SEQ ID NO: 35897 - DNA, 201 bp, Homo sapiens
taacaagcacctcaagttattcagatgtaggtggttgatttactctacttctagcaacaatgggctaaatttataggcaaaagccacaccattagtacataatagactatgatggtaactggaaggacttttatctacagatttttatcacggactaatagctaatgccatcccattcatttgctaaatgttatatcctat

SEQ ID NO: 35898 - DNA, 201 bp, Homo sapiens
ttaacaagcacctcaagttattcagatgtaggtggttgatttactctacttctagcaacaatgggctaaatttataggcaaaagccacaccattagtacataatagactatgatggtaactggaaggacttttatctacagatttttatcacggactaatagctaatgccatcccattcatttgctaaatgttatatccta

SEQ ID NO: 35899 - DNA, 201 bp, Homo sapiens
gcgccactgcactccagcctggtgacagagagagactccatctaaaaaaaaaaagctctacaggcaatagcagtctccagagatgtttgggatgggatagytaagctgtaccatacccttatcttaggccctcaagtttcccaaattaaagcaaaaactatatatgtatgtcactttacataaatatataaaatatatgta

SEQ ID NO: 35900 - DNA, 201 bp, Homo sapiens
cgggtgtagggcggggagccaaggatctgaccgcgaggggcgggcgcggcggggaggggcggggcggggcgggcggcgcggggcctattaaaggcgcggcsgggcagcggggccggagcggccggggccacgatggagcgcgacggctgcgcggggggcgggagccgcggcggcgagggcgggcgcgctccccgggagggc

SEQ ID NO: 35901 - DNA, 201 bp, Homo sapiens
tccggggcgttgagtcgctttgccctgactgcgagagccgggtgtagggcggggagccaaggatctgaccgcgaggggcgggcgcggcggggaggggcggrgcggggcgggcggcgcggggcctattaaaggcgcggccgggcagcggggccggagcggccggggccacgatggagcgcgacggctgcgcggggggcggga

SEQ ID NO: 35902 - DNA, 201 bp, Homo sapiens
tgtcctctctttccttcctccagttccacctggcaacatcacgccatcatttcccccccattcagagccatgccaaaagcttgctctaggaaactctttckgatctccctctccctaaccaccccaacctttctccttctttaaacaactgtagaactttgcaggcggtttgtagggcctaccaaatatgggccactgatg

SEQ ID NO: 35903 - DNA, 201 bp, Homo sapiens
aggaagccaaataatccggggcgttgagtcgctttgccctgactgcgagagccgggtgtagggcggggagccaaggatctgaccgcgaggggcgggcgcgkcggggaggggcggggcggggcgggcggcgcggggcctattaaaggcgcggccgggcagcggggccggagcggccggggccacgatggagcgcgacggctg

SEQ ID NO: 35904 - DNA, 201 bp, Homo sapiens
gcccgaaatcagacaggaagccaaataatccggggcgttgagtcgctttgccctgactgcgagagccgggtgtagggcggggagccaaggatctgaccgcraggggcgggcgcggcggggaggggcggggcggggcgggcggcgcggggcctattaaaggcgcggccgggcagcggggccggagcggccggggccacgatg

SEQ ID NO: 35905 - DNA, 201 bp, Homo sapiens
cactaaatatagatgttttactatgttttattttcttatacatttataattgacagtaaaacagtttttgttgttgttttggcttgtttttttttttttttttaattttttttgagcatcttgctctgtcgcccaggctggagtgcagtggtgcgatctgtgctcactgcaacctccgcctcccgggttcaagcgattctc

SEQ ID NO: 35906 - DNA, 201 bp, Homo sapiens
gtttttttttttttttttttttttttttttccttgagacagagtttcactgtgtcgcccaggctggagtgcagtggtgcgatcttggctcactgcaacctytgcctcagcctcccaagtagctgggattacaggagcctaccactgcacctggctaatttttgtatttttggtagagacggggtttcaccatcttggccag

SEQ ID NO: 35907 - DNA, 201 bp, Homo sapiens
gaagagcacactgtctttttgttgttgttgttgttaattgaccacttcgtaactttttttattcctgctagattttgagtccgtagatgtgttcactccargatgataaccactagctacatgtggctatttaaattaaaatttcatctaattaaactttaatgaagcaaaaagtttatttcctcaatcactcttgccaca

SEQ ID NO: 35908 - DNA, 201 bp, Homo sapiens
tgaggggacaaattcatcaagctacttttccccaaaggtaaacattgcagctttttgcactgaaacagcccatctggtagcatctcactgttgttgttggytacagcacagtactgcaaattactcagatactggatttcttctggaatgaaggtcaagtggttatagcttagattcaaataatgtagtttgctgcatagg

SEQ ID NO: 35909 - DNA, 201 bp, Homo sapiens
ttacagcacagtactgcaaattactcagatactggatttcttctggaatgaaggtcaagtggttatagcttagattcaaataatgtagtttgctgcatagsaaaagctgctagggcagattctcaatattaataggaccccaaaagagctgctctaggttagataatgccccagtttatccaggaatgtaagtaatgttat

SEQ ID NO: 35910 - DNA, 201 bp, Homo sapiens
aattacttaaaagtttataaaggccagacacgatggctcatgcctgtaatcccagcactttgggaggccaaggcgggcagatcacctgaggtcaggagttwgagaccatcctggccaacatggtgaaaccccgtctctactaaaaatacaaaacttagccgggtgtggtggcgcatgcctgtagtcccagccactcgggag

SEQ ID NO: 35911 - DNA, 201 bp, Homo sapiens
gcagaaatctatccagcattgacaagattataataaataattaaactggatcacagtaaatcgtagtggttattatcttgtctttgaggtagttccccccmcatcccctcgcaataaaatcattgatggtcattctagagaattcagctttgaaaattgaacaggttcttctgtttggctattctgtgattgtaatattaa

SEQ ID NO: 35912 - DNA, 201 bp, Homo sapiens
gaggccggcagatcacttgagccaagagttcaagaccagcctgggcaacatggtgaaaccccatgtctaccaaaaatacaaaaattagcctgttgtcgtgrcacacacctgtaatcccagctactcgggaggctgaggcaccagaattgcttgaacccgggaggtggaggttgcagtgagctgagatggcgccactgcact

SEQ ID NO: 35913 - DNA, 201 bp, Homo sapiens
taattcagatatgaaaccattgagagttactggtctctttgtgattatggtcacgatttcaccaaacttatatttttaattgaatatggctggaattttartgtgtaatttacttacagtttaagtggtaaaatatgaatcattcctgctttcttaagccagtcttttaatttgatgtttcattttaacctttccttctaa

SEQ ID NO: 35914 - DNA, 201 bp, Homo sapiens
aacttttcttttatatttcctattctcctagcatgggaagcatgactcctcatgggttgaagaattgttaatgttacacagagcacggatcacagatgttkagcacatcactggactcagcttctatcaacaaagaaaagagccagtttcagacattttaaagttgaaaacacatttgccaacctttagccaagaagactg

SEQ ID NO: 35915 - DNA, 201 bp, Homo sapiens
ccaggtaggggaagaacgttgcaaaccaatggagctgtttctcgtaacagacagcgttgatgtaggagtactgctgtcagtggaggtcgttctggattccragtgggatcggaaactgatgtcccgggattagaggatgtgtttatgctggctttcaggatgttccaaggcatggtgcaatgattgtcaaattccactttg

SEQ ID NO: 35916 - DNA, 201 bp, Homo sapiens
ttactaagcacttcaagatcttttttctcaatagattgcttttcttaagatgctgaagtaaatcagtacaatagataaagaccacaaaaacagcattttgygacagtgacagtcctactgaagacaggagacagttaaaaccatcagaccaagaacagaggagtggatatttaataattctatgattacttctgggggtta

SEQ ID NO: 35917 - DNA, 201 bp, Homo sapiens
gtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctccat

SEQ ID NO: 35918 - DNA, 201 bp, Homo sapiens
agtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctcca

SEQ ID NO: 35919 - DNA, 201 bp, Homo sapiens
tttttttgtttttctttccttaaacttattataattccatgtagcttcagttatcggtttctttttgatgatttttttctgtgaatgtatttaacattaartaaacacaacttgcatataatctgttttatcttttttagggattgtatccagaatctcatggcataatcgacaataaaatgtatgatcccaaaatgaatg

SEQ ID NO: 35920 - DNA, 201 bp, Homo sapiens
cagtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctcc

SEQ ID NO: 35921 - DNA, 201 bp, Homo sapiens
ttgtgattatcttaatttttcatttaaagaaaggttaaaggcccagatcccctaagtgacatatgggcaccacttaaggatttccatttcgtgtcgtaatygtaaaacttctcaaccttctctgactttatttctcttgtcttctgttcttttaaaagaaagatgtgacagaaagcacaaaagatccccaaaaagagtgtg

SEQ ID NO: 35922 - DNA, 201 bp, Homo sapiens
ggctgaggccggcagatcacttgagccaagagttcaagaccagcctgggcaacatggtgaaaccccatgtctaccaaaaatacaaaaattagcctgttgtmgtggcacacacctgtaatcccagctactcgggaggctgaggcaccagaattgcttgaacccgggaggtggaggttgcagtgagctgagatggcgccactg

SEQ ID NO: 35923 - DNA, 201 bp, Homo sapiens
tatttttttcagcctgcttctctctgttgttcagattaggtaattttattcttctgtctcgaagctcactgattctttattctgtctaatctgttctgctrttgagcccatttattcctgatttttatattttagttattgtatgttttatttctaaaatttccattcagtttttctttatatcttctatttgctgagaat

SEQ ID NO: 35924 - DNA, 201 bp, Homo sapiens
atcatatcatacttgaaaattaaaaaaatatacttgtgattatcttaatttttcatttaaagaaaggttaaaggcccagatcccctaagtgacatatgggsaccacttaaggatttccatttcgtgtcgtaatcgtaaaacttctcaaccttctctgactttatttctcttgtcttctgttcttttaaaagaaagatgtga

SEQ ID NO: 35925 - DNA, 201 bp, Homo sapiens
tgtaaagggcttgcgtatgggtggtggtcactgaagactactttcatgtttcagtgaaagagttctttaaaaaaacatatatctatatctatatctatatmtctatatctatatctatatctatatctatatctatatctatatctatatctatatatatgtagagagtccgtttggctcaagtttgaggactgcaaccca

SEQ ID NO: 35926 - DNA, 201 bp, Homo sapiens; identical to SEQ ID NO: 7672

SEQ ID NO: 35927 - DNA, 201 bp, Homo sapiens
catctacttggtcctattcacccattcctcctgtctctattatctcttcaccttagctttccggaaatactacaccatctttccatacctccacccattgkccattcccgtttgcattttcttggtttcagctaagataggctgttcattatttatctgccaccttccatgtgcctgccttcgtggaacccttctttatgc

SEQ ID NO: 35928 - DNA, 201 bp, Homo sapiens
tttctgtgaccctttgacgtgtgtgtgtttgtaagtgtttagcacttccttactttctggccctacaggatgttccaggcttttaggttctcttgacttgyttttttttttccttacagatttcttaatattatataaccataaaactagtgtgtataatcaaaagtcagtttctccaccctgcaaattaggagtggactt

SEQ ID NO: 35929 - DNA, 201 bp, Homo sapiens
ttctcttttctccctacaggtattgtcagtatgtgtgttaacaacaatacttggttgtatatttgggttgaaaccaagctgtgccaaagaaggtaattagktgtgtgtgtgtgtgtgtgtgtgtgtgtgtgtgtgtatgtgtgtgcacagccttattaagaatgtgattgaggtaaacattatctcctattcctatgggta

SEQ ID NO: 35930 - DNA, 201 bp, Homo sapiens
ttccctcctagtaaatggggacactgtctgctgtgcattgagagagtcgatgtgaaattgtttagaaagattcgagggcattttgtaaggtgatactattrtgatgtcttgtccaggtattattattatttttttttcaaatttcttgacagaacctgactctatatgagagagaactaagacaccaaaataccaaggatt

SEQ ID NO: 35931 - DNA, 201 bp, Homo sapiens
gaaattgctatttagctactgaactgaaagtgcaaactcgtattcttctttcccttccctacttcaatacctttttcccccaaccccgccccccccccaaraacttccccaaataatgggcttccaaatggaaaaggccccaaaagcatcctgacaattgtcgtcaaagagctctgggatatgtcttctagaaaggagctg

SEQ ID NO: 35932 - DNA, 201 bp, Homo sapiens
aagtactgtttggactattctagataagtttacagataaatacaatttcaattcttcatggtttttttttttttttttttttttttttttccttgagacaragtttcactgtgtcgcccaggctggagtgcagtggtgcgatcttggctcactgcaacctctgcctcagcctcccaagtagctgggattacaggagcctac

SEQ ID NO: 35933 - DNA, 201 bp, Homo sapiens
tgattagaaacatctgacttatcgttcaattttttcagttaaaagttgcaaaggtcgctgtttcgagagaacatttgggaactgtcgctgtgatgctgccygtgttgagcttggaaactgctgtttagattaccaggagacgtgcatagaaccaggtaaggatgagcagggaaaaaagtggagttatggtcattaggaaaa

SEQ ID NO: 35934 - DNA, 201 bp, Homo sapiens
gttgaaattgctatttagctactgaactgaaagtgcaaactcgtattcttctttcccttccctacttcaatacctttttcccccaaccccgccccccccccaaaaacttccccaaataatgggcttccaaatggaaaaggccccaaaagcatcctgacaattgtcgtcaaagagctctgggatatgtcttctagaaaggag

SEQ ID NO: 35935 - DNA, 201 bp, Homo sapiens
tggcagttaatttctgtgaccctttgacgtgtgtgtgtttgtaagtgtttagcacttccttactttctggccctacaggatgttccaggcttttaggttcycttgacttgtttttttttttccttacagatttcttaatattatataaccataaaactagtgtgtataatcaaaagtcagtttctccaccctgcaaattag

SEQ ID NO: 35936 - DNA, 201 bp, Homo sapiens
atttctaaaatttccattcagtttttctttatatcttctatttgctgagaatttctgtctctttgctgagactttctacgttttcatttgtttcaagtgcrtttatacttgcttgttgaagaatttttatgatggctgctgtaaaatccttatcagataattccaacatctgtcacctcattgtttgcatctactgatggt

SEQ ID NO: 35937 - DNA, 201 bp, Homo sapiens
tgggaggtggaggttgcagtgagccaagatcatgccactgcactccagcctgggcaacagtgtgacagcccatctctcaaaaaaaaaaaaaaaaaaaaaaagaaaagaaaatagatcaaaaaattttaaaaatgaaatggaatttttttggtagaataatatggattcatgcctgtttctgttttctcttttttctttttc

SEQ ID NO: 35938 - DNA, 201 bp, Homo sapiens
cttcaatacctttttcccccaaccccgccccccccccaaaaacttccccaaataatgggcttccaaatggaaaaggccccaaaagcatcctgacaattgtsgtcaaagagctctgggatatgtcttctagaaaggagctgcaattatagaattccttttgttttcagattaaacctcagcacacttttcataaagctgcag

SEQ ID NO: 35939 - DNA, 201 bp, Homo sapiens
gattttcctgggtggaagccaaaattagtgcactttattagtgtgaagtcaacaatcagctgtttctgggagcttccaaagtaggtatacttttgggaaawtgtgcttttcttcttagtttgagtttccttcttggcttattttgaaatgtagtagaatagaaaaatagagagttttgatagaaagtgattttgggatgtg

SEQ ID NO: 35940 - DNA, 201 bp, Homo sapiens
tatgtaaagttcagtaataccttttccatttttatgccataatttacttctttcaaaagacaaatataagataaaaattaattcaagagcacagatatatrcattctatcgaaatgaatacaatgtgatttataaatgagaacaaattaccaatgaacagtatttcagaagttgaaaaggtgacactaaatgttaaataca

SEQ ID NO: 35941 - DNA, 201 bp, Homo sapiens
tttttttttcagtcctgcagtttcctgaagctctgtatatgatatttttttcagcctgcttctctctgttgttcagattaggtaattttattcttctgtcycgaagctcactgattctttattctgtctaatctgttctgctgttgagcccatttattcctgatttttatattttagttattgtatgttttatttctaaaa

SEQ ID NO: 35942 - DNA, 201 bp, Homo sapiens
agagggaattcccagcattacctcattcatctgtgagaacacagagcagtccctatttagacacacacatttgtctactgctccagcatggccagcccccyacttcttgatggtttctttctgctatgaatatgcatgtccagttgtctgcttcatagagcagacatttaccttcctcatccaccagccattggaggagga

SEQ ID NO: 35943 - DNA, 201 bp, Homo sapiens
atttatattccattatgaaagtttaccattgatagacagctttctaatgtacttttcataagtaggattttgagacttttattttagtatcctcaattcartaggtaatctttgaaactatttctatgcatactttagacattctcagtccccaagaatttccagctttttggtacatgtttgttttctgttttattcatt

SEQ ID NO: 35944 - DNA, 201 bp, Homo sapiens
taggattttgagacttttattttagtatcctcaattcaataggtaatctttgaaactatttctatgcatactttagacattctcagtccccaagaatttcyagctttttggtacatgtttgttttctgttttattcattcctcagctccatctctattgcttatgtctctttttcatggttaaattactagtttttctaaa

SEQ ID NO: 35945 - DNA, 201 bp, Homo sapiens
tgattttacagtcatgtaattctcaactacattgcaatacatttctccagttagctcctcaaaagcattttttttgtgttgtttgtgaccttctgctatayttatgaatacatatatctgtgtatctgtgtatgtgtaaagggcttgcgtatgggtggtggtcactgaagactactttcatgtttcagtgaaagagttctt

SEQ ID NO: 35946 - DNA, 201 bp, Homo sapiens
gaaacaaaaattgtatatagaatcatttctcagttatatatgtatatgggtttgagtgtgtaaatgcatttaaaacaataataaaaaaaatagggccaggstgggtggctcacgcctgtaatcccagcattctggaaggccgaggtgggtggattgcttgagctcaggagttcaagaccagccgtggcaacatgatgaaac

SEQ ID NO: 35947 - DNA, 201 bp, Homo sapiens
aaaaaaaaaaaaaaaaaaaaagaaaagaaaatagatcaaaaaattttaaaaatgaaatggaatttttttggtagaataatatggattcatgcctgtttctsttttctcttttttctttttcctttcaataaacatactgtttgagaatagttctagatttacagaaaagctgtgaagcttgtgcagagttccatatactcc

SEQ ID NO: 35948 - DNA, 201 bp, Homo sapiens
tgtgtgtatttgtgaaaagatttttgccttactttattaccccatctgtattttctaaagtagtatttgaacctagtgtacacctaacttagttgtattcrttgatgtttactttgaattatataatgattagaaacatctgacttatcgttcaattttttcagttaaaagttgcaaaggtcgctgtttcgagagaacatt

SEQ ID NO: 35949 - DNA, 201 bp, Homo sapiens
ccacaaaaacagcattttgcgacagtgacagtcctactgaagacaggagacagttaaaaccatcagaccaagaacagaggagtggatatttaataattctrtgattacttctgggggttaactatctgtgaatctaaatagaagttccagtggctggaggctgtatctgaggagggaccctttagccttttaaagagtgat

SEQ ID NO: 35950 - DNA, 201 bp, Homo sapiens
gttctggaccacaaagcaaggcagacttacagcttatctgctttatatttttgctttccctcggtcccgccatcctgactccttttccctaattagaaccscacactctctttggatggtacatgcgttttccattttcccaggttctattactctcctttggatcttacacttctgaattctctctattcgttttgttac

SEQ ID NO: 35951 - DNA, 201 bp, Homo sapiens
tgccaccatgccctgctaatttttgtatttttagtggagactggttttcatcatgttggccaggttggtctcagacacctgacctcaagtgaaccacccgygtcagcctcccaaaatgctgagattacaggcgtgagccaccgtgcccggccttggctcatttttattcttccgattttagacttccaattgggtttttat

SEQ ID NO: 35952 - DNA, 201 bp, Homo sapiens
ggtgacatccgaggttcttggtctcacggccacaaagatcaaatatgtggacacacacaaagggtgaggtttggagcagaatttttaataggcaaaaggargagaatagctctgctacagagaggggtcccaaaaaatgggttgcaatacgtggtgaaatgcaggggtttttatagatgagctagtggggaggcggtgtct

SEQ ID NO: 35953 - DNA, 201 bp, Homo sapiens
gtcctatcttcatgagagaactaatatttagtaaatatctaaacaccatgttgcaagcatttctttaggctatatcattgaatttttacaaataaccgacwtgagaaattgaaatcaaagaagacagttaaatctatctaaactcacaagtagttaatcacacagccaatgttcaaaaccacttctgtcttgatgctagtg

SEQ ID NO: 35954 - DNA, 201 bp, Homo sapiens
tcgagaccagcctggccaacatggtgaaaccctaaaaatacatatacgatactatactatatctatactaaaaatacaaaaattagcctggcttggtggcrgctgcctgtaatcccagctgctctggaggctgaggtacaagaatcgcttgaacccaggaggcggaggttacagtgagctaagatcatgccactgtactcc

SEQ ID NO: 35955 - DNA, 201 bp, Homo sapiens
cagagcaagactctgtctcaaaaaaaaaaaagggatgttgtaagttaagcatgatgctatgtagcaaaattgatgggtgtgcagacatgacttaaccctcyccttgcatacccttaaggtcttgtttataacttggtgtcttattgccacagagacgttttcgcggtcttatttctattgtaacattaatgctggtcaatt

SEQ ID NO: 35956 - DNA, 201 bp, Homo sapiens
attggccaactatattagctgaaaaaaataattttaaaactttttattaaagaaacttttaaacatacacatggggagagagagtatgtaatgaacattayacccatcacccagcttcataattatgattatgtgcacacggccaataatattttatctataaccactcattcccctgccaccaccctctcatgttatttt

SEQ ID NO: 35957 - DNA, 201 bp, Homo sapiens
ttttaaaaaagtaaagatcatggcacaagtctactatttgtttgatttgaaacatctaagtaactctaccatcttgaaattatgcagatttactgaatttsacaccggctcctaataacggaactcatggaagtcttaaccaccttctaaagaatcctgtttatacgccaaagcatcccaaagaagtgcaccccctggtac

SEQ ID NO: 35958 - DNA, 201 bp, Homo sapiens
ctctgtgtcccttatggtatttgtttcacatgttctaataaaatacataaaggattcctaggaacccaagactgttgtttttactattaggcagaggatartacctgacactcaatgtcagcttttaattgcttgaatgaatgtactgcattttttgttagactgagccacactttgatttggaaaaggggaagatgggaa

SEQ ID NO: 35959 - DNA, 201 bp, Homo sapiens
ggctattggccaactatattagctgaaaaaaataattttaaaactttttattaaagaaacttttaaacatacacatggggagagagagtatgtaatgaacrttatacccatcacccagcttcataattatgattatgtgcacacggccaataatattttatctataaccactcattcccctgccaccaccctctcatgtta

SEQ ID NO: 35960 - DNA, 201 bp, Homo sapiens
catcttacattagtaaggtccatttgttacagctcatgaatcaacagtgatacatgattattaactaaagtccatactttattcagaattacttgtttttyccctaatgtctttttttgtttttttgttccagtaccccatccaggaataccacattacactgagttgtcaggcctccttaggcttttcttggcgaagcgt

SEQ ID NO: 35961 - DNA, 201 bp, Homo sapiens
tttttgtccctttccatactgtacctttggtagagagttacattccacctccttgatggtggagtatctgcataaattatttggaattcttctgaattggraatttgttctcccccttatatttatttattcagtctttttcagtatggagtcattaatgtctattttatactttgaattataacccagtactctgttttt

SEQ ID NO: 35962 - DNA, 201 bp, Homo sapiens
atcagggtctttcatgcagctgcagttagatggtgacttagagttggaacagcaagggctggggcatttaggggctggccaggcatctttctgtctcttcwtgcagtcttagggcctccccatgtggtctctgtgcacggaatggttgggattcctcatagcatggtggcctccgtgtaagggtaactgcttacatggagg

SEQ ID NO: 35963 - DNA, 201 bp, Homo sapiens
tgtgaagttttgtatatgtctttttgaatcccattgaatatacttaataagatgtctttttatttctattttttttttctattcccctctcccctttaccrttctgtgttgatcttagacttttgtcttaggcttacctccaatgactggtgaatcatggtggttcatttatatttaaggatgagagattaggtagatttc

SEQ ID NO: 35964 - DNA, 201 bp, Homo sapiens
taaaactttttattaaagaaacttttaaacatacacatggggagagagagtatgtaatgaacattatacccatcacccagcttcataattatgattatgtrcacacggccaataatattttatctataaccactcattcccctgccaccaccctctcatgttattttgataatagcagcacacttgatgttgtatttgtgg

SEQ ID NO: 35965 - DNA, 201 bp, Homo sapiens
ccctttgaatatcttgtagaagtttcttggcactggatttactcaataggatcgaatccccatcctccagcaaacgaaatcccgtgaagactcccagcacsaggctggtctgaatcctcacagttctttttcagaaagcatgcaactttggtcaaagatcagaggactgataggcaatgtagtcagctgattcatttcaaa

SEQ ID NO: 35966 - DNA, 201 bp, Homo sapiens
gaactgagtgttctcttggtaacttttcttttatatttcctattctcctagcatgggaagcatgactcctcatgggttgaagaattgttaatgttacacasagcacggatcacagatgttgagcacatcactggactcagcttctatcaacaaagaaaagagccagtttcagacattttaaagttgaaaacacatttgcca

SEQ ID NO: 35967 - DNA, 201 bp, Homo sapiens
tatggagcatggtaagagctgcagtaactaggggtgagggaagacctagagaaacatggtgctagcatctcctcggtgaggagggtctagcaagtccaagdcctcatttcccaccggactcataacatagccttccacaatgatcccaagggatcgttctgggattattaaatccagtcctgtcactttcatatttcagcg

SEQ ID NO: 35968 - DNA, 201 bp, Homo sapiens
taatattttattgaggtgccctgtaatctgacattccagggagctttcaaggaaactttgtcacactaaaaaaaattgaggattgttttgtgggttattcygctcctttgtcttctaactcacagaagttctgtcatggttcttaggggttgtagggtgtgtccacttattttaaaatgtcaaagaccagaagagtggaga

SEQ ID NO: 35969 - DNA, 201 bp, Homo sapiens
gaatttgacaccggctcctaataacggaactcatggaagtcttaaccaccttctaaagaatcctgtttatacgccaaagcatcccaaagaagtgcaccccstggtacagtgccccttcacaagaaaccccagagataaccttggctgctcatgtaacccttcggtaagtatcgtcaagaagtttggtccagtatgtatggt

SEQ ID NO: 35970 - DNA, 201 bp, Homo sapiens
ggagtatctgcataaattatttggaattcttctgaattggaaatttgttctcccccttatatttatttattcagtctttttcagtatggagtcattaatgkctattttatactttgaattataacccagtactctgtttttcatgtttttgcttaacttgttccagccatggccacttggcagttaatttctgtgaccctt

SEQ ID NO: 35971 - DNA, 201 bp, Homo sapiens
tctagaaaaataagcaaatatacatacaaacaatagcgagaagactccagaaaccacataaaaccgtgggaatcgaaatatcccttacgtgtgttcagtayatgtgaacccacgtattttaagtggacgatttctctctcagagtaccgtaggtagtgggggacggggcgcagagggggagaaacagaaagtcgccttcct

SEQ ID NO: 35972 - DNA, 201 bp, Homo sapiens
ggcggaggttgcagtgagccaagatcacaccatcgcattccagcctgggcaacagggcaagaccctttctcaaaaaaaaaaaaaaaaaaaaaaaaaaaaawatatatatatatatatatatatatatatatagcaatttggagagtagtttatttcatgctttacattttgttttagacttgagttagaatagaagaaaga

SEQ ID NO: 35973 - DNA, 201 bp, Homo sapiens
ggctgaggcaggagaattgtttgaacctgggaggcggaggttgcagtgagccaagatcacaccatcgcattccagcctgggcaacagggcaagaccctttytcaaaaaaaaaaaaaaaaaaaaaaaaaaaaaaatatatatatatatatatatatatatatatagcaatttggagagtagtttatttcatgctttacattt

SEQ ID NO: 35974 - DNA, 201 bp, Homo sapiens
aactctagcagtgaggtgatgagcacatagtaaaccaatcacaatgtacctttttaaaaatacaattcagattgtttaaatgtagggagaaaaaagatttyttggtatgaaatgaatatattacactgtccttttttacttccatgttaatatgtcattattataaaaagataaaaatactagacaagttatgaacaaaat

SEQ ID NO: 35975 - DNA, 201 bp, Homo sapiens
gggtctttttactcttccctcgttgacagtctttgttgtcgccactggtttgttgccatctttcacatgggatgccctaagccctctctattccttccacrctcccacccagatgcttcttacttggccaagaagattgaagaggttcctcatcagctgtttctagcttcctgttgctataccttagtttgttttgtgtgt

SEQ ID NO: 35976 - DNA, 201 bp, Homo sapiens
acacaacttgcatataatctgttttatcttttttagggattgtatccagaatctcatggcataatcgacaataaaatgtatgatcccaaaatgaatgcttycttttcacttaaaagtaaagagaaatttaatcctgagtggtacaaaggagaaccagtgagttctttgtttttctactaaaatagttaattattctcatct

SEQ ID NO: 35977 - DNA, 201 bp, Homo sapiens
ttcagccattccacccatgccttaattctcttatccccttttgtattctgttttccccacctttccctctcccagggcatgtcgtcttttttttttttttyccccattttcccacttccactcttagaatttcaggccattcaagtttgttatattccatgatttcagattaagctgggctcccagagctggagggtcttt

SEQ ID NO: 35978 - DNA, 201 bp, Homo sapiens
ttctagcaacaatgggctaaatttataggcaaaagccacaccattagtacataatagactatgatggtaactggaaggacttttatctacagatttttatyacggactaatagctaatgccatcccattcatttgctaaatgttatatcctattcatcaagcttggcctgctgttgggtttccaactctcctttgcctgct

SEQ ID NO: 35979 - DNA, 201 bp, Homo sapiens
catggtgttaatttatttcacacgtcaacatggtcccttgttcttttgaaactacactggcttctatcttgtttcagttatatggcgctactttcatgacmccctactgcgaaagtatgctgaagaaagaaatggtgtcaatgtcgtcagtggtcctgtgtttgactttgattatgatggacgttgtgattccttagagaa

SEQ ID NO: 35980 - DNA, 201 bp, Homo sapiens
ggcaaacatcctataacaggtgtgatttgagagtcttaaaaaaaaatcactatcttggttttcaggtgaatatttttgagaaactagcttgttcctaaagrtgtgtttcccgatccccctcctgcttagaaagctttttttgacgttagcaagcatctgggggatcttgatgctctcttatggttagagagagagaattga

SEQ ID NO: 35981 - DNA, 201 bp, Homo sapiens; identical to SEQ ID NO: 7686

SEQ ID NO: 35982 - DNA, 201 bp, Homo sapiens
tccatttgttacagctcatgaatcaacagtgatacatgattattaactaaagtccatactttattcagaattacttgttttttccctaatgtctttttttktttttttgttccagtaccccatccaggaataccacattacactgagttgtcaggcctccttaggcttttcttggcgaagcgtctcagactttccttgttt

SEQ ID NO: 35983 - DNA, 201 bp, Homo sapiens
gagatcgagaccatcctggctaacacggtgaaatgccgtctctactaaaaatacagaaaaaattagccgggcatggtggtgggcgcctgtagtcccagctmcttgggaggctgaggcaggagaatggcatggacccaggaggcggaggttgcagtgagccgagatcgtgccactgcactccagcctgggtgacacagcgag

SEQ ID NO: 35984 - DNA, 201 bp, Homo sapiens
gtccatttgttacagctcatgaatcaacagtgatacatgattattaactaaagtccatactttattcagaattacttgttttttccctaatgtcttttttkgtttttttgttccagtaccccatccaggaataccacattacactgagttgtcaggcctccttaggcttttcttggcgaagcgtctcagactttccttgtt

SEQ ID NO: 35985 - DNA, 201 bp, Homo sapiens
ggtggaggttgcagtgagccaagatcatgccactgcactccagcctgggcaacagtgtgacagcccatctctcaaaaaaaaaaaaaaaaaaaaaaagaaargaaaatagatcaaaaaattttaaaaatgaaatggaatttttttggtagaataatatggattcatgcctgtttctgttttctcttttttctttttcctttc

SEQ ID NO: 35986 - DNA, 201 bp, Homo sapiens
gggaggtggaggttgcagtgagccaagatcatgccactgcactccagcctgggcaacagtgtgacagcccatctctcaaaaaaaaaaaaaaaaaaaaaaaraaaagaaaatagatcaaaaaattttaaaaatgaaatggaatttttttggtagaataatatggattcatgcctgtttctgttttctcttttttctttttcc

SEQ ID NO: 35987 - DNA, 201 bp, Homo sapiens
cctacttagctttttttctgtggttcttacacagtattcctttttttcttttcttgaaagagactcctcctttcttttcttttcttgaaagagttttaaasagataagatggcaaaagtgactgatctctactcccccagtttgaatggtaaatttgaatggtaaattcccatgaacatatatggaaatgtctttatccta

SEQ ID NO: 35988 - DNA, 201 bp, Homo sapiens
ctgagatgggaggatcacttgagcctgggaggtggaggttgcagtgagccaagatcatgccactgcactccagcctgggcaacagtgtgacagcccatctytcaaaaaaaaaaaaaaaaaaaaaaagaaaagaaaatagatcaaaaaattttaaaaatgaaatggaatttttttggtagaataatatggattcatgcctgt

SEQ ID NO: 35989 - DNA, 201 bp, Homo sapiens
ggctgagatgggaggatcacttgagcctgggaggtggaggttgcagtgagccaagatcatgccactgcactccagcctgggcaacagtgtgacagcccatytctcaaaaaaaaaaaaaaaaaaaaaaagaaaagaaaatagatcaaaaaattttaaaaatgaaatggaatttttttggtagaataatatggattcatgcct

SEQ ID NO: 35990 - DNA, 201 bp, Homo sapiens
caaaatagtattacatgcaaaaagatgaaacaaaaattgtatatagaatcatttctcagttatatatgtatatgggtttgagtgtgtaaatgcatttaaamcaataataaaaaaaatagggccaggctgggtggctcacgcctgtaatcccagcattctggaaggccgaggtgggtggattgcttgagctcaggagttcaa

SEQ ID NO: 35991 - DNA, 201 bp, Homo sapiens; identical to SEQ ID NO: 7688

SEQ ID NO: 35992 - DNA, 201 bp, Homo sapiens
aggtaagtactgtttggactattctagataagtttacagataaatacaatttcaattcttcatggtttttttttttttttttttttttttttttccttgaracagagtttcactgtgtcgcccaggctggagtgcagtggtgcgatcttggctcactgcaacctctgcctcagcctcccaagtagctgggattacaggagc

SEQ ID NO: 35993 - DNA, 201 bp, Homo sapiens
atctatccagcattgacaagattataataaataattaaactggatcacagtaaatcgtagtggttattatcttgtctttgaggtagttccccccccatccyctcgcaataaaatcattgatggtcattctagagaattcagctttgaaaattgaacaggttcttctgtttggctattctgtgattgtaatattaattattt

SEQ ID NO: 35994 - DNA, 201 bp, Homo sapiens
tgtgttctcatccttcagctccctcttataattgagaacatgagggttcgcttttctgtttctgcattagtttgctaaggataatggcctccagctccatmcacgtccctgcacaggacatgatcttttatggctgcatagtattccatggtatacatgtaccacattttcttaatttagtctatcattgaccatatacac

SEQ ID NO: 35995 - DNA, 201 bp, Homo sapiens
atcccgtcacccaggtattaagcccagcatccattagctattctttctgatgctctccctcctcccaccccctgccctccaacaggccccagtgtattttsttcccccacacgtgtttatgtgttctcatccttcagctccctcttataattgagaacatgagggttcgcttttctgtttctgcattagtttgctaaggat

SEQ ID NO: 35996 - DNA, 201 bp, Homo sapiens
aggtaaatgtgtgccatggtggtttgctgtatggatcatcccgtcacccaggtattaagcccagcatccattagctattctttctgatgctctccctcctyccaccccctgccctccaacaggccccagtgtattttgttcccccacacgtgtttatgtgttctcatccttcagctccctcttataattgagaacatgagg

SEQ ID NO: 35997 - DNA, 201 bp, Homo sapiens
tgcataggtaaatgtgtgccatggtggtttgctgtatggatcatcccgtcacccaggtattaagcccagcatccattagctattctttctgatgctctccytcctcccaccccctgccctccaacaggccccagtgtattttgttcccccacacgtgtttatgtgttctcatccttcagctccctcttataattgagaaca

SEQ ID NO: 35998 - DNA, 201 bp, Homo sapiens
atacaaggctgcagtaagctatgaactgcaccactgcactccagcctgggcaacagagtgagactctgtctctaaaaaataaaaattaaaaaaaaaaaaawtaaggaaaaaggacagaaaatccaggcactggctgtgcagtggagctaacagctaagtttgatgttatgatgggttatgtgtgaatgatgttagtgcctg

SEQ ID NO: 35999 - DNA, 201 bp, Homo sapiens
ttgagatggggtctcactctgtcacccaggctggagtgcagtggcacgatctcggctcactgcagcctccgcctcctgggttcaagtgattctcctgcctyagcctcctgagtagctgggactacaggcatgcaccaacatgcccagctaaattttttatttttagtagagacggggttttgccatgttggccaagctggt

SEQ ID NO: 36000 - DNA, 201 bp, Homo sapiens
gccgaggtaaggaaccattctaagcatgaattacgtgttaggtatgcccccagcagtgatcttttatgcttacaggaagcattgatggtggggtctgtctsttttttattttgttaagctgcccaggtgtcatcccactagcacagattagaactcaggggtgccagcataggccagggagaaaaagctgaagaggttgat

SEQ ID NO: 36001 - DNA, 201 bp, Homo sapiens
aggccagtagctggaggttctttggtaccccctccttttaggtggggtcagcagacacaggggcgccatgtggccgagttaccaagatgaacacgagttcracgcccacctggtttgtcgcatgtgctgtatgggttagtatgtgaagtttttttttttttttgcttgtccgggcctgaggatcccaaatagcccttgctc

SEQ ID NO: 36002 - DNA, 201 bp, Homo sapiens
ctcaattagttcacttagtaagaagaacatatactaatttggaacagacaataaatgtatatgtcaaaagcctgaaatgcctaaaaagtaaataatgagcygtgcgtggtggctcacgcctgtaatcccagcactttgggaggctgaggcaggcggatcacctgaggtcgggagttcaaggccagcctgaccaacatgaag

SEQ ID NO: 36003 - DNA, 201 bp, Homo sapiens
ttttcttttctttttttttttttttttttggagacagggtctcactgggtcacccaggctggattgcagtggcatgatcttggttcactgcagcatccacytcccgggctcaagcaatccagccacctcagcttccctagtagctgggtcatatgccaccatgcctggctaatttttttatgttttatagagatggggttt

SEQ ID NO: 36004 - DNA, 201 bp, Homo sapiens
aacgctctgctgatcggcagaatcttcattggttttttgcattccctaacaccgtttgtgtacaaggattcattcattcatggaacaaaaaaaagtttttktttttttttttagacagagtctcactctgttgcccaggctggagtacagtggcacaatcttggctcactgcagcctctacctcccgggttcaagcaattc

SEQ ID NO: 36005 - DNA, 201 bp, Homo sapiens
ttatcatcaccattatcatgtgtggatttcaagcatctgggctctttcttctccatttccaaagataataacagcagtctggtgaaggagctctcaaaccraaacctgaactagaaacattctcataattatcctgattatccaatccatagacccagatcaatggactgtccaaatgaggggagctttccgaatatgatt

SEQ ID NO: 36006 - DNA, 201 bp, Homo sapiens
cccaccccagaggagcccacctccccagctgctgcagtgcccaccccagaggagcccacctccccagctgctgcagtgcccaccccagaggagcccgcctycccagctgctgcagtgcccaccccagaggagcccgcctccccagctgctgcagtgcccaccccagaggagcctgccttcccagctcctgcagtgcccacc

SEQ ID NO: 36007 - DNA, 201 bp, Homo sapiens
tccagggggctgcccgggcggggcggcgcagcgcggcggcgcggggaagggggaggagagccgcccgccagccgagcacttccagcgagctagcgagctakcgggtcgcgctgcgcgggggaggaggactcgccccccgcccgaccctagcggagccttttgttcccagccagaagtttgcatgccgggaccgtgacagct

SEQ ID NO: 36008 - DNA, 201 bp, Homo sapiens
tgacggatttctgtggtagttggatctttgatttcaaacccaatataaagtttccttaataaatgcaaagtatagcctatgattctatgtatttttctgtrtctcaatatctagctccttatttatcctctagttaccatttctttttttatctttatatgcatgttgttccctcttgtccatctggcaaactcttatctt

SEQ ID NO: 36009 - DNA, 201 bp, Homo sapiens
aagttgcagtgagccaagataccgccattgtactccagcctggatgacaggagtaaaactctgtctcaaaaggaaaaaaaaaaaaaaaaatgtttgtttgktttttttaaacttttcactgagttgcatatttattgttttgatctagcatttgacctggcaagcatacctctttccttattcctttttagagtatattta

SEQ ID NO: 36010 - DNA, 201 bp, Homo sapiens
taagatgttgttcagtcaatacttattgaattattaggaaaacattcagcttctgggaatacttcagagaagcaattaaccaagctttgggaagtgtgagwtgaaaggaaattcaagtggaatttgcatattctcaggcatactgttgaggctgttctccctctccaaatggcttcctccttaaaaagcccagatgaggga

SEQ ID NO: 36011 - DNA, 201 bp, Homo sapiens
atcttgctatctgtatactcagtcctctgactaactgaaaaatatcagaaagaacttagtgaggaagagtattattatggggagaaaaaaagcaaatggcyttttttttttttttttttttttgagacagagttttgctctgttgccaagactggagtacagtggtgcaatctcagctcactgcaacctccacttcctggg

SEQ ID NO: 36012 - DNA, 201 bp, Homo sapiens
taagtggtgtgtcttttcttgttcttctccatggtgccagtcatagtgctaagatgttgttcagtcaatacttattgaattattaggaaaacattcagcttctgggaatacttcagagaagcaattaaccaagctttgggaagtgtgagttgaaaggaaattcaagtggaatttgcatattctcaggcatactgttgaggc

SEQ ID NO: 36013 - DNA, 201 bp, Homo sapiens
gttgttgctgagcaatcctctggcattgctagtttggattacttgcttacctctgtcacaacattgatctctttgtatagtaaattgtctccctgattaaattgcttgaacttgaggcctgaggctgtgtttttttattttgagatatcaagaatttaagcacagctcctagaatataatggttgctcaaaaaatattaac

SEQ ID NO: 36014 - DNA, 201 bp, Homo sapiens
ttttctttttccttctcttttctctttccttttcttcctcttttttccttccttccttccttttctttttccttctcttttcattttccttctcttttctytttcctttccttccccttctttccttccttcccttttctttttccttctcttttccctttcctttcctttctttcctctttcttttctttcctctttttt

SEQ ID NO: 36015 - DNA, 201 bp, Homo sapiens
aatatgactcagaaatttgttgtctaagcttctgttttcttagagcaaccaatccatatctctatctagacataatatttgcatagttgcaaccataacaygtagtttacttactctttctctaatgtatttttatttcattcttttttaatcagggaaagatgtcccagaatttccataccagctatgctgaaactcttg

SEQ ID NO: 36016 - DNA, 201 bp, Homo sapiens
gtgctttcggagcagctcagccagcagacggtgagtgtggtagtagctctggcgagaagagttagaaatttaaattttctttatcataaaagaaaatgatrtactggcaattaaagcttcctccaaatggaagatatccaaattcccttttctttgagtggtttgagcaggatcgtcccaagatactggttttgcatttag

SEQ ID NO: 36017 - DNA, 201 bp, Homo sapiens
tctacctcccaggttgaagcgattctcgtgcctcagcctcctgagtagctgtgaccacaggtgcatgccatcacacccggctaatttttgtatttttagtrgagatggggttttaccatgttgaacagactggtctcgaactgctgacctcagatgatccacccgcctcggcatcccaaagtgttgggattacaggtgtga

SEQ ID NO: 36018 - DNA, 201 bp, Homo sapiens
tacaagaatgtaaaacattaacatggttctaaaagtcaaatctatacaaaaagaagtgtattcccctctagctagtccttttatcccctttgccttccttygatcctttcaattccatccttttcatctcattagtttctggttatcctttctgtctgtctctttgtataaacatatacacatatattttctcattttccc

SEQ ID NO: 36019 - DNA, 201 bp, Homo sapiens
gtggctcgcgcctgtaatcccagcactttgggaggccaagatgggtggatcacttgaggccaggagttcaagaccagcctggccaacatggcaaaacctcrtctctactaaaaatacaaaaaaaattagccgggcctggtgacaggcgcttgtattcccagctactctggaagctgaggcaggagaatcacttgaaccagg

SEQ ID NO: 36020 - DNA, 201 bp, Homo sapiens
acacttgcagtcctagctacttgggaggctgaggtgaatcacctgagcctggggaggtcaaggcctgcagtaagctgtaatcgtgccagtgaactctagcrtgggcaacagagtgagactctgtctcaaaaaaaaaaaaaaaaaagacagtggttaaccagaggttttcagctgggaaacaatatgatttggtctgtgttt

SEQ ID NO: 36021 - DNA, 201 bp, Homo sapiens
ccagaaggcagcaagtcttgtgttaagagaccaggttagatgagaaaaggtcttggggaaaggtctcgtaatcagaattaacttagttgaaaatacatctratatacctactgaaaactatagtttagcctatcttaaatgtattccgaacacttatattagctaaccgttgagcatttggccaaaatcatgtaacacaaa

SEQ ID NO: 36022 - DNA, 201 bp, Homo sapiens
ccaaagtgctaggattacaggtgtgagccactgcacccagccatttttttttttttttgaaatggagtctcgctctgttgcccaggctgaagtgcagtggygccatcttggctcactgccacccctgcctcctgggttcaagcaaattctcctgcctcatcctccccagtagctaggattataggcgtgtgccaccatgcc

SEQ ID NO: 36023 - DNA, 201 bp, Homo sapiens
tgatctcgaactcctgacctcatgatccacccgccttggcctcccaaagtgctaggattacaggtgtgagccactgcacccagccatttttttttttttttgaaatggagtctcgctctgttgcccaggctgaagtgcagtggcgccatcttggctcactgccacccctgcctcctgggttcaagcaaattctcctgcctc

SEQ ID NO: 36024 - DNA, 201 bp, Homo sapiens
attttataaattacttagagagggtaagtaatttgttcaagatcatgctgctagaaaaaggcagaactgaaattttaaaattcaggcaacctaaagtctagaaaccgtgctcttaacccatgcagaactggctctggttgctgcctacctttccaggctcatagcaccaagtttccctcataccttgagttcttgctgaac

SEQ ID NO: 36025 - DNA, 201 bp, Homo sapiens
taagaaatagttttacatttagtatttagttcaaatcaattttatattctttttctccaatgaattatttcttcaggagtgctggtaattaaattagcagraagactacttatatttagtgaatgtatattacacagagttggcaagacaaggctcaagctacatctcaaattaaaatagaaatgtatatgcaatagggaa

SEQ ID NO: 36026 - DNA, 201 bp, Homo sapiens
atatataaattttttttttttttttttttttttgagagagtctcgctctgttgcccaggctggagtgcagtggtgcgatcttggctcactgcaacctctayctcccaggttgaagcgattctcgtgcctcagcctcctgagtagctgtgaccacaggtgcatgccatcacacccggctaatttttgtatttttagtagaga

SEQ ID NO: 36027 - DNA, 201 bp, Homo sapiens
aggcaataacaatactaaatgaccttttgtagtcacattaaacattgaaatggtactgagactgccttggtggggagttttggcctatgggaatgatgtgrgttttggtttctactcctttctctgttttcagataaatcctcctacatgtcccattctctggctctgggaagtactgacagtagggaaaagttagtacac

SEQ ID NO: 36028 - DNA, 201 bp, Homo sapiens
ctactcctgacctcaagtagtcctcccaccttggcctcccagtgtcttggaattacaggcatgagccaccatgcctagtctaaatcagacattctgtataytaagtcctttacatggattatttcatttaatccttcagtgatcttatgctgtgggttctgttaatatccccattttataaattacttagagagggtaagt

SEQ ID NO: 36029 - DNA, 201 bp, Homo sapiens
atctttgatcttgtttcactccctggtttggcttgtccagtgcaatttgtctctcaacctgcaagaggtgtgtgtgtgtgtgtgtgtgtgtgtgtgtgtgkacttgggtgtcccttgcctgtggcttcacctgttgccatgaatggttgacttcagggcatgcccctttgtgtatacagacttcctctactattgttatca

SEQ ID NO: 36030 - DNA, 201 bp, Homo sapiens
atttcctcgttagtagtggggagaatagttcttaccttgcagggatattgtgaggtttgaataagataatacgtattagcacctagcatatgtgaaacatrcagtggatactcaatatccgtgagttgtcttttcttccttccattcattcgggagatgcttagggaagcagatataccagattcaaaaggatttagaccc

SEQ ID NO: 36031 - DNA, 201 bp, Homo sapiens
gctgtattgtgtgtgtacactctttggtgttttgcctagcattatttaatggtagttatagcagcagcattaacacatcttgtacttattaatgtgccagkcataatttttatgtactttatgcatatattatttcattcagtccttagagcaaccatgtgaaataaatattatctccattttcggatgaagaaacagaac

SEQ ID NO: 36032 - DNA, 201 bp, Homo sapiens
ctgtttatcaagattgtccagagtaggacagcccaggaccattctttatccaaggagcaccacaaaggccttatgaattctgttttctacttaggattgaraagagttctgggagtcttatatcaaacttgtacaaaagttgaatccatggggaaaaatccagagattaagagcaaattaatttcctgagttattctctcc

SEQ ID NO: 36033 - DNA, 201 bp, Homo sapiens
cttcctttctcttttcttgtcttttctttctttctttctcttcttttctgtgtgtgtgtgtgtgtgtgtttgttttttttttttttttttttttttttgayggaatcttgctttgtcacccaggttgaagtgtagtggcgtgagtagctgggactacagatgtgcatccccacacccagctaacttattgtattttttcat

SEQ ID NO: 36034 - DNA, 201 bp, Homo sapiens
atagttattagtttgtggctcagatgtcctggaataagtgaaccaggagctgacagacgtgttcttcatgacagaaattgaagcaggacattgctcggcaraagagcagcttggaggccacccgtgagatggtgacccgattcatggagacagcagacagtactacagcagcagtgctgcagggcaaactggcagaggtga

SEQ ID NO: 36035 - DNA, 201 bp, Homo sapiens; identical to SEQ ID NO: 7926

SEQ ID NO: 36036 - DNA, 201 bp, Homo sapiens
cctttagattttcaacttacttcacatagcctggcaactgcttgtgctgtgctctaacgaaaggctggatgttcattctctgaggaaagtaattcaaagtrtctcttgactagggagagcagccatttattgaaggtaaatattccatacagaaatcagtaggattaactggaagttcacatacatactgaattttgagct

SEQ ID NO: 36037 - DNA, 201 bp, Homo sapiens
attatttagaaactaagatctgggtaccaaatgtattcattgttgttggagtattattgcttataggcccacttagcagacagagctagaaaacataggcygggtgtggtggctcacgcctataatcccagcactttgggaggccaaggcaggtggatcacctgaggtcaggagttggagaccagcctggccaacatggta

SEQ ID NO: 36038 - DNA, 201 bp, Homo sapiens
aggtgaaaaattacctctcatggttttaatttgcatttatttgactagcaagagggggaatatatgttggaatagtcctctaaagtgcttccagccttggmccttcgttttactaagagccataatgtatggagaagagaaggctaaaagactttgtcttatttataatgaattattctgtgtcccatcttttggcagatc

SEQ ID NO: 36039 - DNA, 201 bp, Homo sapiens
cggggtttcaccatgttggccaggctggtctcgaactcttgagctcaggtgatccacctgcttcggcctcccaaagtgttaggattataggcgtgagccaycatgcccggcccattgtcagatttcatttaatatccctgttttcactgagacacctggctcctgacctcacacgggcctgaagacttccaaccaatcttg

SEQ ID NO: 36040 - DNA, 201 bp, Homo sapiens
ttacagtgagttgtctgtaacaaagccaggcctctttctttgggcagctgctgcctttggcctgaccttgcttaagtctgcttacctttctttctctggcwcagtgtacacgattaggatctcacctgaatatgctgttaggccagtatcatcaattccaaaacagtgctgacagcctgcaggcctggatgcaggcttgtg

SEQ ID NO: 36041 - DNA, 201 bp, Homo sapiens
cagtctggtgaaggagctctcaaaccaaaacctgaactagaaacattctcataattatcctgattatccaatccatagacccagatcaatggactgtccamatgaggggagctttccgaatatgatttctatgtcttttcctattctagtctcccaccaacttttccatccttgagatataaccttcctgttttacatttc

SEQ ID NO: 36042 - DNA, 201 bp, Homo sapiens
atacagttttctcatttgaaaccctttggaatcttttccctcagctaactgtactctgagtgagagcttggtgaaaattgcaatgtctttacatctgttayctttttttttaattaaaaaaattttttgtgggtacatagaaggtacatatatttatacgatacatgagatattttgatacaggcatgtaatgcataataa

SEQ ID NO: 36043 - DNA, 201 bp, Homo sapiens
cagagtgttccagtcggaagaaatacaaatgcaaagggcctggagtgagggcttgcttagagtggtttagggacagcaggtggctgaagtgaggtgaggamgataggaattctgaatgacaaaaataaaaattgttgagttcttagtggtcataaacatgccccaattttcagttctaaccgacgatatttttcccatgac

SEQ ID NO: 36044 - DNA, 201 bp, Homo sapiens
gagaaaccacccgctctgctctgggtgcgagcttcctcccagaggggctcggacctctgtgtgcccgcggagagtccctccctcgcccccttttgtctctytgagtctcggatgagtcgcgtggaagccgaggttggaaagcaccttggtgtcttcggggtggggtgggcagcggtgtgggtgagtgtgcagtttttggtg

SEQ ID NO: 36045 - DNA, 201 bp, Homo sapiens
gatagaaatttttgtaagctactaaaaagataagctagagaagatgttggataggcaaagtgtcaaactgtataagaacaatttttgatgtggctttttcrtagattttgtcttaacctttagtaataacaggaaaagggtctttttacttcttaactacagtttacttttcaaaggctttctccattgacattattcgac

SEQ ID NO: 36046 - DNA, 201 bp, Homo sapiens
ttacaaaacccagtgtggagtagaaaaagcactggaggccgggcgcggtggctctgcctataatcccagcactttgggaggccgaagcgggtggatcacarggtcaggagatcgagagcatcctggccaacatggtgaaatcccgtctctactaaaatgcaaaaaattaactggatgtggtggcgcatgcctgtagtccca

SEQ ID NO: 36047 - DNA, 201 bp, Homo sapiens
ggtaggggcgaggaggaaagactagtggcagacaagttaggaagctgtcacaggaatttaggcagggagtgaaactaaggttgtgaaaatagtaatgtaawaaagcaggcaaatcaagaaatgtgaaggggtaacatccatgtgttttgatgactaattgtatgtggtatatgagggggagagggaagaacctaggatgac

SEQ ID NO: 36048 - DNA, 201 bp, Homo sapiens
ggagcttacgatttagtaaggatgagagacactgtaccataacttcaagtgtgatgagtattaccaaagggtagaggaggacctattaattggaggggggsggggtcaaggaaggctttcccctggggagtttcagcagaagcatgggtaggagtgagccaggccaaaggagagtgatgaagggttataatctgggaggaa

SEQ ID NO: 36049 - DNA, 201 bp, Homo sapiens
aaaattacctctcatggttttaatttgcatttatttgactagcaagagggggaatatatgttggaatagtcctctaaagtgcttccagccttggaccttcrttttactaagagccataatgtatggagaagagaaggctaaaagactttgtcttatttataatgaattattctgtgtcccatcttttggcagatctctgac

SEQ ID NO: 36050 - DNA, 201 bp, Homo sapiens
tattaaatctcacattgtgatagtgtaaacaggaaaagagctttatggtttttttcctctctagggtcttgttttccttacctgtaaagtgaaggagttgrataatatgatcttttaaagttctctccgttttcagcatcccactaggaggaacagccataatccctggatccaaactatatgaaatacagtctaagattg

SEQ ID NO: 36051 - DNA, 201 bp, Homo sapiens
ctagcctgggcaacagagtgagactctgtctcaaaaaaaaaaaaaaaaaagacagtggttaaccagaggttttcagctgggaaacaatatgatttggtctrtgttttagtaaatcactgtgactactataaatagtcacacttccctttgtatagcaatttgtttagaatctaagacaataatctaaacataggaaaactt

SEQ ID NO: 36052 - DNA, 201 bp, Homo sapiens
accccacagccaaatgctgtacctagccagaagtcaagaggaaagagcagtgatttctgagggggtgaaacaggctaacttttcggtagggtagggtttgkggtagtcagcactaatattttgctgcatggctttttaagcccttcggtttatgtttcagtggtccttgtaataaactgtcactaatgcagtagggtgtaa

SEQ ID NO: 36053 - DNA, 201 bp, Homo sapiens
tttgagacggactcttgctctgtcacccacgctggagtgcagtggtgtgatctcggctcactgcaacctctgcctcccaggttcaagtaattctcctgccytggcctcctgagtagctgggattacaggtgcccaccaccacgcccggctaatttttgtatttttagtagagacggagtttcaccatgttggccaggctgg

SEQ ID NO: 36054 - DNA, 201 bp, Homo sapiens
ccattctccttactactaaggaatctttctaaaatgccatatccttgcttagccctttttatggttccctgttgccctcaagattacctggttaactctcytctcagcccctacccactgggatctagtctacttatttggccttatctgtcaccttcctttatacttgagcatctgcttatattgattcctttcagttta

SEQ ID NO: 36055 - DNA, 201 bp, Homo sapiens
tcttgcatgacgcttttcgaaggtccattatactgtgtcccccaaagccctggtagtcttataagaggacagagcaaaaatggttctgctgtcatagggckcctctgacaccttttgctggcagcagtcaacctaatgaagtggtatctccattctaggaaggaaactgccttataggtagatgagttggaaggtgagaat

SEQ ID NO: 36056 - DNA, 201 bp, Homo sapiens
aggctggtctcaaaaacctagcttcagtgatactcctgcatcagcctcctagtcactcagctttcttgaaatgatgtgggaagctgaggctatcaggttgytgttgatacaggctaaaactagacgatgatctgtagtccttctctaagtagtggcataaacagtataggtagtaaggaacactgacaactcccactgtct

SEQ ID NO: 36057 - DNA, 201 bp, Homo sapiens
tcagctttcttgaaatgatgtgggaagctgaggctatcaggttgttgttgatacaggctaaaactagacgatgatctgtagtccttctctaagtagtggcrtaaacagtataggtagtaaggaacactgacaactcccactgtcttctagattcaggaagaacatcccaatatatgtttcaaaacaaaaactcacagctct

SEQ ID NO: 36058 - DNA, 201 bp, Homo sapiens
cagctttcttgaaatgatgtgggaagctgaggctatcaggttgttgttgatacaggctaaaactagacgatgatctgtagtccttctctaagtagtggcawaaacagtataggtagtaaggaacactgacaactcccactgtcttctagattcaggaagaacatcccaatatatgtttcaaaacaaaaactcacagctctc

SEQ ID NO: 36059 - DNA, 201 bp, Homo sapiens
aaacgaaagataattattcttccttctgggcttctcgaggacagtacttctagtattaatataccacttaagatttgatttttatcattaattgtgatgcrtcttcctctgcctatgctctgttttaaagtcttaagttgtagatgtcagataagatacttaagtatctttagtcctcagcatctagtacaatttctggtt

SEQ ID NO: 36060 - DNA, 201 bp, Homo sapiens
ctttttgacatgtcttcctcagcataagagcacttttggaacttaagatatttgtggcacaataatgtatttccttgtcccctatctgaaatcagctattyatccaaggagtcccacttttagtggggaatgatatttagaaaccaaatctggacactagatgagctactggagtgtcactacttttaggttctttttaat

SEQ ID NO: 36061 - DNA, 201 bp, Homo sapiens
aggatatccaacctgtatcatttatttgaaaagtccatattttccccagatttaagaaaccatcttcatcatatacacaatttttatatgtctttgagtckatttctggattttcttttttttctttttttttttgagatgggatcttgttctgtcacccaggctggggtgcagtggcatgatcttggctcactgcaacct

SEQ ID NO: 36062 - DNA, 201 bp, Homo sapiens
tttaactacttcgttgtttgatttcgttttattgttgattatcttgggttttacaaatatacttttttttttttttttgagacagagacttgctctgttayccaggctggagtgctatggcacaatctcggctcactgcaacctccgcctcctgggttccagcaatttccagctaatttttgtgtttttagtagagacagg

SEQ ID NO: 36063 - DNA, 201 bp, Homo sapiens
cggcctggtggcgggcgcctgtagtcccagctactcggaaggctgaggcaggagaatggcatgaacccaggaggcggagcttgcaatgagccaagatcgcrccactgcactccagcctaggcgacagaacgagactccatctcaaaaaaaagaaaaagaaaaagaaaatcctaccaactccatacccgaggaacccttgaa

SEQ ID NO: 36064 - DNA, 201 bp, Homo sapiens
acagaataattttgaaagaagagaaaaattggaagagacttcctagacataattaagggtgatgttggcagtcccctggcttttttttttttttttttttwaagatatggggtcttgctatgttgaccaggctacttgtgaactcctggcctcatcgatcctactgccttggcctcccaaagtgctgggattacaggtgtg

SEQ ID NO: 36065 - DNA, 201 bp, Homo sapiens
agcttttagtcatgtgtaaaaaaatgaaaatattttactagctagatttgccagtctcctggtactgccaaaatcagatatttcagtttctgaatgtatcygtggcacaggaaatcatgatgttttggatagagagaaaaaaagtgctcctgcctaaataatgggtatacttgtacctaaggtactgtgtatgtttttgat

SEQ ID NO: 36066 - DNA, 201 bp, Homo sapiens
cattaacatttaaaagttttataatcaccaccctaattcagctaatttttttccttccttttagagacagggtctcgctctgtcacccaggctggagtacrgtagtgtgatcatggctctctgtagctttgacctcctaggcccacgcaatcagcccacctcaagctcctgagtagctaggaccacaaatgtgcactgtca

SEQ ID NO: 36067 - DNA, 201 bp, Homo sapiens
gtcttcatgagggattcctttttttttttttttttttgagacggactcttgctctgtcacccacgctggagtgcagtggtgtgatctcggctcactgcaayctctgcctcccaggttcaagtaattctcctgccttggcctcctgagtagctgggattacaggtgcccaccaccacgcccggctaatttttgtatttttag

SEQ ID NO: 36068 - DNA, 201 bp, Homo sapiens
tagactgaataattttaccagtacttgcttcacaaaattagggcggcatccagagaattcaagttggagatttaataaaaagggaatacgaatttcctctrgaagggattaagaatcattcctgctaagaaccttgagtgacgttttgttgcctggcagctaaaataatttgtctctttccatgagtatgttgtcttgtgc

SEQ ID NO: 36069 - DNA, 201 bp, Homo sapiens
gggtcatgatataggagatcagcataggatcctgtgatagaattaaacaggtcctcagatcacaaaatgcaaaggttgctgttaacatgggataatcttcyttcttgtagtatctttcttatggaaagctattctatctgctcttttaaattgctttaatattctatatatagtaggtgttggcagtcacaaatttaactt

SEQ ID NO: 36070 - DNA, 201 bp, Homo sapiens
gcggcatccagagaattcaagttggagatttaataaaaagggaatacgaatttcctctagaagggattaagaatcattcctgctaagaaccttgagtgacrttttgttgcctggcagctaaaataatttgtctctttccatgagtatgttgtcttgtgctgtgttaacttcctgatacctaagcttaaagtgagggccaaa

SEQ ID NO: 36071 - DNA, 201 bp, Homo sapiens
gaaaaatgtcagaagatataagaccacagaaaatcctgtaggcaagtttcaccaaaacttttaatattcccattgagcgtagcatctcatctccttcaagwtatgttatcatcatatcttggtatttttagtttattttgattaataattccttcttattgagttctactgatgtattatacataaaagaaactcagatcc

SEQ ID NO: 36072 - DNA, 201 bp, Homo sapiens; identical to SEQ ID NO: 7723

SEQ ID NO: 36073 - DNA, 201 bp, Homo sapiens
ctgctacagggaaggtctgaagcccctataacttgaagggtgatgattatgagctgaagcttctgtcttaagctgtgccccacccctaccccagaagataycaggcttttgccttgtggtcaggggaggattctgcctggggcctcagtggatgtctctgggatgccctcccccactcattcacacatttcttcatgtgct

SEQ ID NO: 36074 - DNA, 201 bp, Homo sapiens
caggccagcaaaacttgatgggaaaagatatgattaatgacttgctcacctgatttctgatcagggtgtggtgtggaaacaaccagcatgcacctattagygaaaagcgtcatttgttttacttgttaccaatgtgctgagcattgaccaaaatacttggcactactcacaaggtacaaagacaccttccctagcctgggg

SEQ ID NO: 36075 - DNA, 201 bp, Homo sapiens
ccccactttccattcattagaagaatgcattatttcaaaatctcctgggagcatttaaatgcaaattttgtcaagaaagcaatttgagtcttagagaagcyctctagccacaacctaaagcagaagtttcttctttgatttgtgtgtttcttaaaaggaatctcaaccccttgccttctccctgcaacgcccccaggtctt

SEQ ID NO: 36076 - DNA, 201 bp, Homo sapiens; identical to SEQ ID NO: 7733

SEQ ID NO: 36077 - DNA, 201 bp, Homo sapiens
cccctgggctgcggggtggtcaggagcagagtgtgggggactgtggactcccaggcgctgccttcaccctgccccagacacacccaggagtaagaattagrtgatgtctttgcccacctgggctgccccgggaagacagcctggtcctggggagacaggtgagtaaacagaggccgggatgctgtcactgtgataaggaca

SEQ ID NO: 36078 - DNA, 201 bp, Homo sapiens
atagttttaaagtagttggcactatttggcacaatccaacatcagtttttgttttgacactgctttttcttttttggagacaaggtctcactctgttgccyaggctggagtgcagtggtgctgcctcagctcactgcaacctcggcctcctgggttcaagcaattctcgtgcctcagcctcccgagtagctgggactacag

SEQ ID NO: 36079 - DNA, 201 bp, Homo sapiens; identical to SEQ ID NO: 7692

SEQ ID NO: 36080 - DNA, 201 bp, Homo sapiens; identical to SEQ ID NO: 7695

SEQ ID NO: 36081 - DNA, 201 bp, Homo sapiens; identical to SEQ ID NO: 7696

SEQ ID NO: 36082 - DNA, 201 bp, Homo sapiens; identical to SEQ ID NO: 7698

SEQ ID NO: 36083 - DNA, 201 bp, Homo sapiens; identical to SEQ ID NO: 7699

SEQ ID NO: 36084 - DNA, 201 bp, Homo sapiens
cagcctgggcgacagagcgagactccgtctcaaaaaaaaaaaaaaaaaaaaaagcttcccagatgattttgagatggctggtttacagactgatatttagsaactattggcctaactcctcattttatttgcagagttggagataaaaataaaattttaaaaataacaaaggacaaatgcctaattttatagatgaaactc

SEQ ID NO: 36085 - DNA, 201 bp, Homo sapiens; identical to SEQ ID NO: 7701

SEQ ID NO: 36086 - DNA, 201 bp, Homo sapiens
atttcattaaaataattttattgttttctgacctgaaaaaattcagaatatgtatatctgcttgatattttcttttgggcatcttggtacaacacttaaartctatttcattttgtagtttgggagccataattgcagcttcaccaggcttggttcttcttggcccgggcccttcccttcccttgctggttagtaccagcc

SEQ ID NO: 36087 - DNA, 201 bp, Homo sapiens; identical to SEQ ID NO: 7703

SEQ ID NO: 36088 - DNA, 201 bp, Homo sapiens
tgtttgtctcataggtgggaggtaaggagaatttattcactgtctctattcaccccaactactacaactaaattaatttcctttttttttgaccgagtttygctcttggattgcaatgatgtgttcttggctcactgcaacctccgcctcctgggttcaagagattctcctgcctcagcctcccaagtagctgggattaca

SEQ ID NO: 36089 - DNA, 201 bp, Homo sapiens
tcatagccaaattcgtttcactgatttctaaaaataagccttccacctcagatactctggatgtgaaggctgggactggacactgatcggctgggctcttrcagagtgtgttcatcaacagtggactggtgttgacaaggcaagcctggaagaagagtgggagaagggagaagggtggtggagtgtcctgtgtgtagtcca

SEQ ID NO: 36090 - DNA, 201 bp, Homo sapiens
ttcactgatttctaaaaataagccttccacctcagatactctggatgtgaaggctgggactggacactgatcggctgggctcttgcagagtgtgttcatcmacagtggactggtgttgacaaggcaagcctggaagaagagtgggagaagggagaagggtggtggagtgtcctgtgtgtagtccattgtcaagtcagtagg

SEQ ID NO: 36091 - DNA, 201 bp, Homo sapiens
atataaataagtcttgtaacgaggaagtataaacacctcaagttgcttaccctaaagttagtgtacttattttgacagaatttttttcttttttgagatgragtctcgctctgtcgcccaggctggagtgcagtggcgcgatctcggctcactgcaagctctgcctaccaggttcacaccattctcctgcctcagcctccc

SEQ ID NO: 36092 - DNA, 201 bp, Homo sapiens
atacaaaaattagccgggtgtggtggtgtgtgcctgtaatcccagctactcaggaggctgaggcaggagaattgcttggagccgggagacggaggttgcastgagctgagatcacgccattgcactccagcctaggcaacagagcaagagcgaaactccgtctcaaaaaaaaaaaaaaaaaaattagctgggcgtggtggc

SEQ ID NO: 36093 - DNA, 201 bp, Homo sapiens
aaattagctgggcgtgccgggcgcggtggctcactcctgtaatcccagcactttgggaggctgaggcgggtggatcatgaggtcaggagttcgagaccagmctaaccaatgtgatgaaaccccgtctctactaaaaatacaaaaattagccgggtgtggtggtgtgtgcctgtaatcccagctactcaggaggctgaggca

SEQ ID NO: 36094 - DNA, 201 bp, Homo sapiens
ctcccagccaagcagtttaatttctgaattaataaactatcttccttccagctccaaggaaaagcaaaacttacacttgtgttcttggagacacttttttsttttaaattcccaggtagatttggaagttcactgttaaaggtggttcgacacccttgttagtgtatgttacctactaggcctctctagaagagcattttg

SEQ ID NO: 36095 - DNA, 201 bp, Homo sapiens
ctgagattgggcttttcatcagggctgtgccacagggtgtgatgctgtgtgatagcagatggctctgcttcatgcccattactttttgttttatccaaagyagaagctgtggtccccagattttagagagtaagggcttaatcatactcattggcttttctgcctttgcctgtttctgcattgccacctggctgccattag

SEQ ID NO: 36096 - DNA, 201 bp, Homo sapiens
aaatacaaaaattagccgggcgtggtggtgtgcctgtaatcccagctacttgggaggctgaggcacgagaatcgcttgaacctgggaggtggagtttgcaktgagctgagatcgcaccactgcactccagcctgagtgacagagtgagactgtgtctcaaaaacaaacaaacaaaaaaaccccaaaacaacaacaacaaaa

SEQ ID NO: 36097 - DNA, 201 bp, Homo sapiens
agtacctaggcaactaaatatttcacagaaccacagaattttagagctggaaaagaatttagagatctagaatgtgaactcattttatgaatgagtaaacmgatccagtgtagttaaacgatcctgaagtcatttaataagccaagaacagaactggacctataatcgtctctagttctgtaatgtctaaatgcattgata

SEQ ID NO: 36098 - DNA, 201 bp, Homo sapiens
gctaatactgccttttaagtctctctaaggatattaattagaggctgtctttctctctctctctctctgtctctctctctctctgtctctctctctctctstctcctctctccttccttccttccttctttcccctttcccttcccttcccttcccttccctcccctcctctcccctcctctcccctcccctcccctcccc

SEQ ID NO: 36099 - DNA, 201 bp, Homo sapiens
tctctctctctctctctctctctctctgtgtgtgtatgtgtgtgtgtgtgtgtgtgtgtgttttggtggggggtgaaatgacttttttttttttttaattkgagacagagtctcactctgtcaccaggctggagtgccgtggcatgctcggctcactgcaaccaccaactccctggttcaaatgattctcctgcctcagcc

SEQ ID NO: 36100 - DNA, 201 bp, Homo sapiens
tatatcagaagcaagaaggaaaagttaaaaaacaacaactataatttgaaagggaggaaggaaagctttatttatttcttgacacagtctttaattgttasgttcttctggctgatcatgagttttgtttttagacaatattactaggtacactgtaggatgtaaacagatctttggagtaggataagaaggaaatgagtc

SEQ ID NO: 36101 - DNA, 201 bp, Homo sapiens
ggaggatttacagcaattgaggtcagacttggatgcagtttctatgaaatgtgacagctttctccatcagtctccatctagttcaagtgtcccaactctgygctcagaactgaatctgctggtggagaagatggaccatgtctatggtctctctactgtatatctgaataagtgagtgagctgaggttttgggtccaagag

SEQ ID NO: 36102 - DNA, 201 bp, Homo sapiens
gcctggaagaagagtgggagaagggagaagggtggtggagtgtcctgtgtgtagtccattgtcaagtcagtaggtagttaccataaaatgatcagtatccmccctcaagttggggatgcaaatcaaaagccctgttccacctgtccaccttgtagggaagtcaaaagctttggaaagagtttttgccttctcccagcaaaa

SEQ ID NO: 36103 - DNA, 201 bp, Homo sapiens
aatctcttcaggaaattccgttttcctgaacaagggagtctggttattgaggaaaaggaattgtatgtgtctaacaggaggctaacaagaaaggaaggacstttttatcactgaaacttgagccaaagaattcccctagagtgaccttcctgggaagggtaaaaaaaaaaaaaaaaaatatatatatatatatatatatat

SEQ ID NO: 36104 - DNA, 201 bp, Homo sapiens
caggaggctaacaagaaaggaaggacgtttttatcactgaaacttgagccaaagaattcccctagagtgaccttcctgggaagggtaaaaaaaaaaaaaawaaatatatatatatatatatatatatatgttaagtctctgatgataacaagagattttcctcattttgaaattccctacgtaggttttacttgaactgag

SEQ ID NO: 36105 - DNA, 201 bp, Homo sapiens
ggaactagggtccaaggaaataaagacagtatcctaaaatggatttctcaatttcggcactattgacattttttgggggtgggtggggaggaaaggggcakccactcacgccaccacctctgcctgccactatcaacattttggactggataattctttgttgtgagaagctgtcctgtgcattgtaggctgtttagcagc

SEQ ID NO: 36106 - DNA, 201 bp, Homo sapiens
tttttgggggtgggtggggaggaaaggggcagccactcacgccaccacctctgcctgccactatcaacattttggactggataattctttgttgtgagaarctgtcctgtgcattgtaggctgtttagcagcatttctgacctagtaacttcccagttgtacaactaaaaatgtctccctggaaggcagaattaccctctg

SEQ ID NO: 36107 - DNA, 201 bp, Homo sapiens
ttgtaggctgtttagcagcatttctgacctagtaacttcccagttgtacaactaaaaatgtctccctggaaggcagaattaccctctgttgagaactatakccctggaagaaattgccacctatacatgggaaacttagaattcaggtggaataggttactagttaaatatttatgtaacaagcagccttctgataatctg

SEQ ID NO: 36108 - DNA, 201 bp, Homo sapiens
cttgtgttaaggatttacaggatgacattcagaatcgtgccacctcatttgccactgttgtcaaggacattgaggggttcatggaagagaatcagaccaarctgagcccacgtgagttgacagctcttcgggaaaagcttcatcaggctaaggagcaatatgaggcgctccaggaagagacacgtgtggcccagaaggaac

SEQ ID NO: 36109 - DNA, 201 bp, Homo sapiens
ggctagagtgcagtggcacaatcatggctcactgcagcctcgacctcccagtctcaagtgatcctcctgcctcagccccacaagtagctggaattacaggkgcatgctgccattcctggctaatttttgtattttttgtagagatagagtttcaccatgttgccaaggccggccttgaactcctgagctcaaatgatctgc

SEQ ID NO: 36110 - DNA, 201 bp, Homo sapiens
gaatcattcctgctaagaaccttgagtgacgttttgttgcctggcagctaaaataatttgtctctttccatgagtatgttgtcttgtgctgtgttaacttyctgatacctaagcttaaagtgagggccaaaggacaaattcagtgcctatatgtattcctaacacgttggtcttgccctgtttgtctccctgtccttctgc

SEQ ID NO: 36111 - DNA, 201 bp, Homo sapiens
ggattagattactatatgtaatttctctttaggttgtatttaaatttgttttcctaacaccctaattagagagagtgtgactgcagataataagtaattcraatctgaatttcatagtcgtaggaatgctccatttatttatttatatggatcactgatgagagtagtaagaatattggtagatagacatgggagggaatt

SEQ ID NO: 36112 - DNA, 201 bp, Homo sapiens
tacccagctccaccaagatcctcacttctttcatcatttgcccatttttccccaggctatgtttgatcttgctctgaggccttctttcttgggaggtatarcgagagtagctgcagaaacctctgggtggcaccctgcccccacaggattaccaaagaatgacatgtgtggaagaggctcaggcctgtgttggcaggaaga

SEQ ID NO: 36113 - DNA, 201 bp, Homo sapiens
acttcatacccactagaatggctttaataaaaaagagagtgaggatgtggagaaattggaacacccccaacattgctggtgggaatataaaatggtgcacytgctttagaaaacagtttggtggttcttcaaaaagtagagttgccacatgacccagcaattccaaagtatatatccaaaagaaatattatattcatagaa

SEQ ID NO: 36114 - DNA, 201 bp, Homo sapiens
tatatacagaacagatgtccctacttatgaggaaaaagccccagatactacatttggccattttcttctttaaacagagtctactagatgactgggcaagyaagggaactctggtggaagaaatcaattgcaaaggtacttctttagaaaatctcatcatggaaatcacagcacctgattcccaaggcaagacaggtgagt

SEQ ID NO: 36115 - DNA, 201 bp, Homo sapiens
aaaaaaaaaaaaaaattctcactttcttcttctaaatccattttatagcacacaacaattcttctcttacccagaatgcttatttgtgtgttagcttgtcscatttcttagtcattttcgttattcaaaattatttaaaggagaattgagagtaggaagggaagacttctaatagtcctcttcgtttaaattctgtaatca

SEQ ID NO: 36116 - DNA, 201 bp, Homo sapiens
ttgcgccactgtactccagcctgggcgacagagcgagactccttctcaaaaaaaaaaaaaaaaaaaaaaaaaaaaaaaaaaagccaggtgtggtggcaggygcctgtaatcccagctactcaggagggaggctagtgcaggagaatcacttgaacccgggagacccaggttgcagtgagccgagatcacacctctgcactc

SEQ ID NO: 36117 - DNA, 201 bp, Homo sapiens
aatcccagcactttgggaggccaaggagggtggatcacaaggtcaggagatcaagaccatcctggctaacatggtgaaaccctgtctctactaaaaatacmaaaaaaaaaaaaaaaaattagccaggtgtggtgacgggcacctgtagtcccagctactcgggaggctgaggcaggagaatgtcatgaacccgggaggcgg

SEQ ID NO: 36118 - DNA, 201 bp, Homo sapiens
gtaatcccagcactttgggaggccaaggagggtggatcacaaggtcaggagatcaagaccatcctggctaacatggtgaaaccctgtctctactaaaaatmcaaaaaaaaaaaaaaaaaattagccaggtgtggtgacgggcacctgtagtcccagctactcgggaggctgaggcaggagaatgtcatgaacccgggaggc

SEQ ID NO: 36119 - DNA, 201 bp, Homo sapiens
tgatgagaaatggcacagatagttcttttgttctttttgggtctcccgggcttatagtttgtagtctttctgttcagtttttggggaaaatatactttaaktttgtctggtgaaagactttataatttcatgcttcgttttttattcagataagccaatcccacggaaaacagggatataaacagttgttgatttacattt

SEQ ID NO: 36120 - DNA, 201 bp, Homo sapiens
tttgtctctggcttctttcacttagcatatgcacatatttacatgccttttccatgtaacattataaggattttttaagtgtttcgttacagacattatarttttcttttttggacacagtctcgctctgtcgcccaagctggagtgcagtggtgctatcgcggctcactgcaacctctgcctctcgggttcacgccattc

SEQ ID NO: 36121 - DNA, 201 bp, Homo sapiens
taacagacgttgggacttgtctgcgttcctttctggtccatatttacttttacataattgtaatctttctgtttgtgtgtgtgtgtgtgtgtgtgtgtgtrtgtgtgtgtgtatttttctcccgatccagttttattgtggtaaaatacacatgacaaaaaattgatcattgtaagtactttaaagtgtacagttcattga

SEQ ID NO: 36122 - DNA, 201 bp, Homo sapiens
atccgcccgcctctgcctcccaaagtgctgagattacaggcgtgagccaccgtgcccagcctctccttgccctttagttctctttacctggaatgcccttsttctttatacttaactgaaatctgtctattccttcaagtttcacttcaggtctttcttctgatgaagacttctctgattatcgtagtccaagttgatgta

SEQ ID NO: 36123 - DNA, 201 bp, Homo sapiens
attgcttgaggtcaggagtctgagaccaggctaggcaacatagggaaactgtgtctctacaagaaaaaaacatttttttttaagtagccagacctggtggygtgtgcctgtagtcccagctactcaggaggatgaagtgggaggattgcttgaagcccaggaggtccaggctgcagtgagccatgaccctgtcactgcact

SEQ ID NO: 36124 - DNA, 201 bp, Homo sapiens
tcagtcctggatgaggaaattgccaaggccaaggtagtggcagagcagatgagtcgtctgacaccagagcgaaatctggatttggagcgctatcaggaaawaggctcccagctgcaggagcgttggcaccgagtcattgcccagctcgagattcggtgagtggtggccccacctttttctcctattagagttcagggacta

SEQ ID NO: 36125 - DNA, 201 bp, Homo sapiens
ctcttctccctaaaaatacctttaatcttattacaataaattcttcaaattttcagattccaaaatcaaatgagtaagaaagacataaaaattagaggcartttttaaaaaatgaaattcaaatttaataataatttttaatattgtatgttttagttgcattacttgaagatatattttgaaggctggcataaacaaact

SEQ ID NO: 36126 - DNA, 201 bp, Homo sapiens
ttagtgtgccagcttaaggagatacccagaacaagtttccttcctcccacgtctcagcccttcagatacttcatgctaattacatctcctagaactttctmtaggtcagacattattgggtcttgcactgtttgttcttcataggacagggtttctagtgtcttggcagtatacgaccaagaggacacaggattctggggc

SEQ ID NO: 36127 - DNA, 201 bp, Homo sapiens
cagcccttcagatacttcatgctaattacatctcctagaactttctctaggtcagacattattgggtcttgcactgtttgttcttcataggacagggtttmtagtgtcttggcagtatacgaccaagaggacacaggattctggggcagtgcctttaaaagttttagaactaaaaaatattaaaactagaaagggtgtcaa

SEQ ID NO: 36128 - DNA, 201 bp, Homo sapiens
actctcggagtcgctcctctccccggccccgcccccgccgggccccgcccccgccctcgtcctcctccctgtgctctccgcgtcgcgcgctccctggcttycagggggctgcccgggcggggcggcgcagcgcggcggcgcggggaagggggaggagagccgcccgccagccgagcacttccagcgagctagcgagctagc

SEQ ID NO: 36129 - DNA, 201 bp, Homo sapiens
cgcccccgccgggccccgcccccgccctcgtcctcctccctgtgctctccgcgtcgcgcgctccctggcttccagggggctgcccgggcggggcggcgcascgcggcggcgcggggaagggggaggagagccgcccgccagccgagcacttccagcgagctagcgagctagcgggtcgcgctgcgcgggggaggaggactc

SEQ ID NO: 36130 - DNA, 201 bp, Homo sapiens
cccccgccctcgtcctcctccctgtgctctccgcgtcgcgcgctccctggcttccagggggctgcccgggcggggcggcgcagcgcggcggcgcggggaarggggaggagagccgcccgccagccgagcacttccagcgagctagcgagctagcgggtcgcgctgcgcgggggaggaggactcgccccccgcccgacccta

SEQ ID NO: 36131 - DNA, 201 bp, Homo sapiens
taccaaggctggtaatactgaaccagttttagaggaatggatacccgtcctccagagaccttcccggactgctgcagtacccactgtcaaagatgccctakatgctgcactgcccagcccagaggagggtacctcaattgctgcagtgcctgccccagagggaactgctgtagttgctgctttagtgccctttccacatga

SEQ ID NO: 36132 - DNA, 201 bp, Homo sapiens
tgttgcagtgcccacccccgaggaatctgcctccccagctgctgcagtgcccaccccagcagaatctgcctcctttgcagctgtggtggccaccctggagraacccacttccccggcagcttcagtgcccacccctgcagctatggtggccaccctagaggaattcacttccccggcagcttcagtgcccacctctgagga

SEQ ID NO: 36133 - DNA, 201 bp, Homo sapiens
ttgagactgatggatttttgattcatttttccgagttttattgaatttggaatgacaccgagatcccaatagcctgtacaaagtgaagacagtaggtcaasaacagagccattcttgataatacagaatatttcacaccaggcacagtggctcacacctctaatcccaacatttgggaagccaagggaagaggattgcttg

SEQ ID NO: 36134 - DNA, 201 bp, Homo sapiens
gaagccaagggaagaggattgcttgaggccaggagttcgagaacagcctaggcaacatagtaagaccccatctctgagaaaataaaaagaaaaaaaaaaamacagaatatctccagtataaagcttatatagcagtaatcatgaaatataaggattaaatttatagtgaggcaatcaaatctgcataaaggggaaaaagtc

SEQ ID NO: 36135 - DNA, 201 bp, Homo sapiens
gaactcctgggctcaaactatcttcccgcctctgcagagctccctgagagctgggattacaggcgtgagccactgcgcctggctcaaatctgtgtttctayatttatcagctgagtgacctggggcaagttactcacttttcctgagcctcagttttttcatctgtaaaatggggataataatatcttccatataaaatta

SEQ ID NO: 36136 - DNA, 201 bp, Homo sapiens
ggtccagggctccatctttgcataactttttacagatagatttgaagtgccaacttcattctgttttggagtactggcattggacacaattgattacatcsctgcctgtttaaaatattctcttcttttaccttcaatgagagtatttcatggttttccttaacctatctgattgctgtttgtctgctttgttgggtcttt

SEQ ID NO: 36137 - DNA, 201 bp, Homo sapiens
atcgtgccactgcactccagcttgggcgacagagcgagactctgtctcaaattaattaattaataataaaataaattaaaaaaaaaaaactagccgggcaygatggtgtgcgcctatagtttcagtttcagctactcaggaggctgaggtgggaggattacttcagctgggggtttcaaggctggagtgagctatgatcat

SEQ ID NO: 36138 - DNA, 201 bp, Homo sapiens
ttagttactgactgttgcttttcttggcatggttcagcttgtaaacattcctccatctagtgggtaactgttgaagggaatccagtgggagaatagagacrttgtacaagtttttgaagttctgatccccaaattcctatgaatttttggtgttttgatccagaattggggtgcaatattttccactgctcgtgctttttc

SEQ ID NO: 36139 - DNA, 201 bp, Homo sapiens
caagaggagcagtaatcccagtggagcctgggctggggtctagagagaaggtggcagatgaggtggcagatgacaggcaggggcggttgtggtcctgtagytcatttgcacaaaggaggggctggcctctcctggggaggtatttccgctcactggaacaaatgagggcgctcaaaaggctgtaatgtaatgaggcttctc

SEQ ID NO: 36140 - DNA, 201 bp, Homo sapiens
ttaagcaagaggagcagtaatcccagtggagcctgggctggggtctagagagaaggtggcagatgaggtggcagatgacaggcaggggcggttgtggtccygtagctcatttgcacaaaggaggggctggcctctcctggggaggtatttccgctcactggaacaaatgagggcgctcaaaaggctgtaatgtaatgaggc

SEQ ID NO: 36141 - DNA, 201 bp, Homo sapiens
ggggttttgccatgttgctcaggctggacttctgtctgttttctcatctgataatgaaaagttgcaattattttcacaagatactttcaaagatgagtctwataatgcagatgagccattttgagttccttacaacaaagatgctgtggaaatttcaggattttccccctttagttataatatgggtagcttatcctaaga

SEQ ID NO: 36142 - DNA, 201 bp, Homo sapiens
tgttccagggatctgactcaattgacagctcctgaatttctaatatgccaaggcttttgtggtaagatgagcaagaatttttcaagctcagatttggggawcatagcttcttgccatgctatctcattggcatgatgtgtgacttttgggcagattacttaacctctgtctatttactttttctttttttgagacagggcc

SEQ ID NO: 36143 - DNA, 201 bp, Homo sapiens
cctcaacttcctgggctcaagtgatcctcccaccttagcctccccagtagccaggactacagtcatgggacagcacacctagttaacatttttagtttttrtagagatgaggtctcactatattgcccaggcaggtctcaaacttctgagctcaagcagtccgcccaccttaccctcccaaagtattgggattacaggtgt

SEQ ID NO: 36144 - DNA, 201 bp, Homo sapiens
ggtctccaaggagttccaagtataaagagccttagcagaagggccttgacagcttagacagtctcttacaatgtctaccaaaattctgaagaaagactgcyatccagctgtgatttttctgccttccaggttagacctgaaaaagtccaggagcctagcttctgtgtcctgtgcttatgctggacatgggtggagggtgag

SEQ ID NO: 36145 - DNA, 201 bp, Homo sapiens
cacgatcttggctcactgcaacttccgcctccgggtttcaagcaattctcctgcctcagcctcccaaatagctgggattacaggggtccaccaccgtgctyggctaattgttttgtttttttttttgagatggagtcttgctctgtcgcccaggctggagtgcagtggcgcgatctaggctcactgcaagcttcgcctccc

SEQ ID NO: 36146 - DNA, 201 bp, Homo sapiens
aaacttcttttactcaatgaagcttaggatttggcgggttggtttcttttgttttttttctttcttcctagttcagatttcaaaatgatcctgtgttacarcttttcattctctttataatagttgctccagcggctcctagatgatcgaaaggccacagtagacatgcttcaagcagaaggaggcagaatagcccagtca

SEQ ID NO: 36147 - DNA, 201 bp, Homo sapiens
cataacgtgtgttctgtttactattggtatttaaactatacctggaaaagactattcttttactgagtatagtactattaccagttttaatgtgacttttyttcctgagcagcttgttctatatatttgtgtaggcaaaaacagctggaagacatcctggttctggccaaacagttccatgagacagctgagcctatttct

SEQ ID NO: 36148 - DNA, 201 bp, Homo sapiens
gtatgggataggtgaaatcattaccacagagagagagagagcgtctatgaaattaaagctctgatttgaagaaaggggatcagagactcctcattcctagrtctcttaaatatgagtaattgtgtgctatcttccataggtgaggaggtgttacttatccaggaaaaactagatggtataaagactcgttacgcagacatc

SEQ ID NO: 36149 - DNA, 201 bp, Homo sapiens
aacatatgctttttgaatcacacagaaatttgctctgagtccaggtatatccccagtgtgtctttagagttatcccttatcttggccagatatttcaataygaaatgtattgtgcttgggagaagcgtatttttaaatgtaagtgtatattggccaagttgaagaggaagagataaaagactggagaggtcaggcatagga

SEQ ID NO: 36150 - DNA, 201 bp, Homo sapiens
ttatcctcactccacagggagcaagctttgagttacttttcaaggtatttatggtagatttttttcagaaccatatgcagatattaattccttcattatakccttctaaaaggtcgtacctagttttaaaaggattggtcaagatggtttgtagacaagttttttcatttcgttttgttttgtttcataaaggatatgttt

SEQ ID NO: 36151 - DNA, 201 bp, Homo sapiens
gtctggggaggtagacaattattaaaccatgtagagtaaaatagagtacatagaagtacttatgattacagaagagtgtggagtagacttgtatgacacasctggtaggggaagagaagagaggatgtttccaggaaggctgctagggtgatgagacatcagaactgactttcaaaaattaaattgggtaatgtcagaacc

SEQ ID NO: 36152 - DNA, 201 bp, Homo sapiens
agcctctttggaaccatcactcattccatagttccaaacatccttgtttttgtttaatttttatctgataaatgttatgaaacaattttaatggtgaaacmcacagaggaaatgacaaactagcatgtgttgtcttttaaatgcacttagttcaagtggttaagtcagttgttcctgttgttagattgctgttgtgtagtc

SEQ ID NO: 36153 - DNA, 201 bp, Homo sapiens
tcttttctttcctcttttttcccctcccttccttccttctttcccttctttctttcttttcctcctttcttttccttctttcttcttcaacagggtcttgstctgttgcccaggctggagtacagtggcacaatcatagctcactgcaacctgaacatcccaggctcaagctctcctcctgcctcacccctcatgtagctg

SEQ ID NO: 36154 - DNA, 201 bp, Homo sapiens
tgaacctggaaggtgaaggttgcagtgagctgagattacgtcactgcactccagcctaggtgacagagcaagactctgtctcctctcccaaaaaaaaaaaraaagaaagaaagaaagaaaatgtacatatacacaatagagtactagtcggccataaaaaagaatgacattctgtcatttacaacaacatggatggaactg

SEQ ID NO: 36155 - DNA, 201 bp, Homo sapiens
tctcctgacctcgtgatccgcccgcctcggccaccaaggtgctgggattacaggtgtgagccacggcgcttttttttttttttttttgagacggagtcttkctctgttgcctaggctggagtgcaatggcacgatctcggctcactgcaacttccgcctcccaggttcaagcgattctcctgcctcagcctcccaagtagt

SEQ ID NO: 36156 - DNA, 201 bp, Homo sapiens
tcagtaagtggtagcaattgctttgattatattttaatgttcttactactatttttttatgggttccttcacaaattcattccttgttttccttctacccrgagtttttttaagtagacagcagaaggacgttttaggcaaaggaactgcataatcccaggcagagaagaatgaaaatacttgattatatgaggaaataga

SEQ ID NO: 36157 - DNA, 201 bp, Homo sapiens
gagaattactaccagctagaagagctggcttttaggtgaggaacaagggactcaaatggagggcttgcttgcttactgctgaggctcatggatcaagagtwgagcaagagtcaggcacttaatcttttaacctggacatttgaggtcagtgtctcaatggggatactacaggtctcttgggcaggaatgttttgtcagtag

SEQ ID NO: 36158 - DNA, 201 bp, Homo sapiens
tgggggagtctctcccaccttaaaatcctggatggatggagtatttgggcccaggaacaagatgtatcctgttaaaaaaaatttaacaccttcatcaagtrtactccaaatgacagcttacagtgctatgaatgtacctctagctcatgggtaaggagcagtgtttatttttgggtgccctgaagaaaatatttgggggaa

SEQ ID NO: 36159 - DNA, 201 bp, Homo sapiens
gcttttgttgctttagaatatctatatgggaagcaaataataatctgaaggttgtcaggtgaacatgcagtcagagcagagaggtggtgagtagaggaatratttgtaggatgggcttattagctggcatcatcaaagtagaatagtctgatttcttctgtagaaatgtacctgtcaagggcataagatcctatgtccctt

SEQ ID NO: 36160 - DNA, 201 bp, Homo sapiens
tgttaaattcctcctgaatgcctgtctgtcttgggtgtagctcaaagaatgaaaagcagaagcagcataacttgttgaatatactcttgagcctgcgtcaraatcacctgcagggcatgttaaaacacagattgctgggtcccatcctcagttctgattcagtaggtctggggtggggcttgagaaattatatttctaaca

SEQ ID NO: 36161 - DNA, 201 bp, Homo sapiens
cattttacactggagtaaactgaagaacaggagggcatagtgatttgcccagggacacacagctgttaagcagcagagttaggtttcacaatttgctctaraattctcatgtactcaaacattatgctataatcagttgttcataatattttcacgctgttaaattcctcctgaatgcctgtctgtcttgggtgtagctca

SEQ ID NO: 36162 - DNA, 201 bp, Homo sapiens
tctctactaaaaatacgaaaattagcagggcttggtggcacacgtctgtaatcccagctacttgggaggctgaagcaggagaatctcttgaacccaggagkcggaggttgcagtgagccgagattgcaccactgcactccagcctgggtgacagagtgagactctgtctcaaaaaaaaaaaaaaaaaaaaaaaaaaaagtg

SEQ ID NO: 36163 - DNA, 201 bp, Homo sapiens
tggatgggagttggaaaggaaaattaagattgatctgcagacaagctgttgtatcgtaaacgcaaaacttcctaattatttgcttaattaaatggagggayttttttacccatttgtggtttggccctgtcctcagcagtctggttattagaggtctgtttgctcagctgaatcaaaatgaggctcttgaaggactcagaa

SEQ ID NO: 36164 - DNA, 201 bp, Homo sapiens
atggtgaaaccccgtctctactaaaaatacgaaaattagcagggcttggtggcacacgtctgtaatcccagctacttgggaggctgaagcaggagaatctyttgaacccaggaggcggaggttgcagtgagccgagattgcaccactgcactccagcctgggtgacagagtgagactctgtctcaaaaaaaaaaaaaaaaa

SEQ ID NO: 36165 - DNA, 201 bp, Homo sapiens
gcttgtgtcacatttattaatgtgcctttggttaaagccagacatgtggctgtgcctggcttcaaggtgaggagaaatagactccacctcttgatgggagkagctgtaaaatattatgaccttttttttcttttttcaatctgtcagaacatgaaagagtgtactgctggccgggcaccatggctcacacctgtagtctta

SEQ ID NO: 36166 - DNA, 201 bp, Homo sapiens
gtgagccaccactccaggcctaaagtttctttttaagtgagacattctccaattgaaaaaaacctgctcattatattacatttcttaaatgtagaaaaatwgatggtagaaaataaaaatcaattttggactcattatctagagataacagttgttacattgacatacttttttctagtttttggtgctatttttcttttc

SEQ ID NO: 36167 - DNA, 201 bp, Homo sapiens
attgagatggagaagcttaatcaccagggtgaactgatgttaaagaaagctactgatgagacggacagagacattatacgagaaccactgacagaactcaracacctctgggagaacctgggtgagaaaattgcccaccgacaggtaaggcaggtggtagatgacatcagtgaactactctccgctcttttctaatttcgt

SEQ ID NO: 36168 - DNA, 201 bp, Homo sapiens
ggctcatcaagccacagtggaaacagtcaacaaagctggcaatgagcttcttgaatccagtgctggagatgatgccagcagcttaaggagccgtttggaarccatgaaccaatgctgggagtcagtgttacagaaaacagaggagagggagcagcagcttcagtcaactctgcagcaggtacatgtgacatccaagtaagg

SEQ ID NO: 36169 - DNA, 201 bp, Homo sapiens
aacagaaagcctatctaagtcagagagaagagatcaatttgaaaagcaaagaatcccttatgtcttgaggggaaggttaatactgtgctgtaacttatctrgaaagagcagcttttgattgggtagttcttttctgaattcatttctagctcagtctctttattcacattcaaagttagcagatcttcactataacagatt

SEQ ID NO: 36170 - DNA, 201 bp, Homo sapiens
cttttcttgtaggaactctattcccagctgaaagccaaggaagagacttataatcaactacttgacaagggcagactcatgcttctaagccgtgacgactstgggtctggctccaagacagaacagagtgtagcacttttggagcagaagtggcatgtggtcagcagtaagatggaagaaagaaaggtacagtgtatgatc

SEQ ID NO: 36171 - DNA, 201 bp, Homo sapiens
aagattttttgaagaccagggtattgtaacagaagttgcagaactgattccatctgtgttgagttgcattgatggtataagtttctgttgttatttgcttytataattattcattccttacctgttaagacattactgccattatcgcttcgtgatgggctttatgtcctatattaatcaccaatttgtgttctacttaaa

SEQ ID NO: 36172 - DNA, 201 bp, Homo sapiens
ctttatgtcctatattaatcaccaatttgtgttctacttaaaaacaaggttttgctggagttggtatcttggggttgagagattggggacagggcatatakggactgacgaataattctccacaaggaatttggttcctaacgtaaatgtagtgtgcaaggaaatttactagaaatcaggagagaagtaaattatatgacc

SEQ ID NO: 36173 - DNA, 201 bp, Homo sapiens
agttggtatcttggggttgagagattggggacagggcatatagggactgacgaataattctccacaaggaatttggttcctaacgtaaatgtagtgtgcamggaaatttactagaaatcaggagagaagtaaattatatgacctcttcccactcatcctcaaaaatcaaattctcttctctacaaaataatgaaagatgac

SEQ ID NO: 36174 - DNA, 201 bp, Homo sapiens
cttggggttgagagattggggacagggcatatagggactgacgaataattctccacaaggaatttggttcctaacgtaaatgtagtgtgcaaggaaatttwctagaaatcaggagagaagtaaattatatgacctcttcccactcatcctcaaaaatcaaattctcttctctacaaaataatgaaagatgactagggatca

SEQ ID NO: 36175 - DNA, 201 bp, Homo sapiens
atcactcctgttttacagctgaggaaattaaggcttaaggagattaagtaacttgcctgaggttacccataattagaactaaatcttttttttttttttawttttttttagagacaaggtcttggctgttgcacaggctgcagtgcagtggtgtaaacatggctcacagcagcctcaaactcctgggctcaagagattgtc

SEQ ID NO: 36176 - DNA, 201 bp, Homo sapiens
acatggtgaaaccccgtctctactaaaaatacgaaaattagcagggcttggtggcacacgtctgtaatcccagctacttgggaggctgaagcaggagaatytcttgaacccaggaggcggaggttgcagtgagccgagattgcaccactgcactccagcctgggtgacagagtgagactctgtctcaaaaaaaaaaaaaaa

SEQ ID NO: 36177 - DNA, 201 bp, Homo sapiens
actgtaacgtgtctaccaggctcaacagatcctcccacctcagtttctcaagtatctgagactacaggcatgtgccattacacctggctaatttttaaatkttttgtaaagacgaagtctcattttattgcccaggctggtctcaaactcctgggctcaagccatccttctgccctggcctcccaaagagctgggattata

SEQ ID NO: 36178 - DNA, 201 bp, Homo sapiens
gtgagccaccatacccagtctttttttatttttttaaagacaggttcttgctctgtcgcacagagtggagtgcagtggcacaatcatagctcactgtaacrtgtctaccaggctcaacagatcctcccacctcagtttctcaagtatctgagactacaggcatgtgccattacacctggctaatttttaaattttttgtaa

SEQ ID NO: 36179 - DNA, 201 bp, Homo sapiens
gtgaatattacgaacagcttttcctagtttgctagggatttgcgtggccaggtatttgctgcatttaaagttcttagatattatcatcagaagaacagtcytttttttttttttttttttttttgagatggggtctcgctctgtccgccaggctagagtgcagtggcgggatctcagctcactgcaagctccgcctcccgg

SEQ ID NO: 36180 - DNA, 201 bp, Homo sapiens
cagatttcctgtcctctgtcctcactagccgacttggctgcttccaccctggggctgggggtatggggtgtggtgggagctggttgctaacaagcagcgcygcctgtggacctgcacagccacttgttttcctagccaagagctacccgtccagtctggcctgttcctgatccatctggagtgagagcagagacctggaag

SEQ ID NO: 36181 - DNA, 201 bp, Homo sapiens
gtccagatttcctgtcctctgtcctcactagccgacttggctgcttccaccctggggctgggggtatggggtgtggtgggagctggttgctaacaagcagygccgcctgtggacctgcacagccacttgttttcctagccaagagctacccgtccagtctggcctgttcctgatccatctggagtgagagcagagacctgg

SEQ ID NO: 36182 - DNA, 201 bp, Homo sapiens
agatgtatgcttagcatatttaattgggagacattattagaaagtggagatggataaagaaaggaatttttgtggatatgatatagagaatttttgtttcytaaggatttaaaatttttgtttgtttatttatttgtttattttttagagatggggtcttgcagtgttgcctaggcttgtcttgaactgctgccttcaagt

SEQ ID NO: 36183 - DNA, 201 bp, Homo sapiens
cctcaggtgaaccacccacctcagcctcccaaagtgctgggattacaggtgtgagccactgcgcccggccttttttttttttttttttttttttttttaaragacagagtcttgttctttcacccaggctggggtgcagtgacatgatcataactcactgtaaccttgaactcctgggctaaagcgatcctcctgcctcca

SEQ ID NO: 36184 - DNA, 201 bp, Homo sapiens
gaagaaagtgaaaatattttcagagattccttgagaaaagggttccttttgctgggtaaatcaacgttccctagatgctgtggctaagaagtgaagaattytaagccaacttttttttaccccttttcttttctttacttttttttttttcgagatggagtttgctcttgttgcccaaggctggagtgcaatggtgtgatc

SEQ ID NO: 36185 - DNA, 201 bp, Homo sapiens
tgcaaaccagttgttaattgccatttattttctttgctataaaactgtaccagccatctacttactttctcattagagtgaatctggagaaaaggcttagrttagatttaggaaatccaggagaaaaatgcaggacagtcagagtaagaccagggatgggcataatcctttctctcacttgtcttaccagccctagacctt

SEQ ID NO: 36186 - DNA, 201 bp, Homo sapiens
ggggtttcactgtgttagtcaggatggtctcgatctcttgacctcatgatccacctgcctcggcctcccaaagtgctgggattacaggcgtgattcaccgygccaggctgagcaatccttttaaaacctaagttaaatcgtgttactgtctcacacaaagccctccaatggcttcccgtttcacctagaataaaagccaaa

SEQ ID NO: 36187 - DNA, 201 bp, Homo sapiens
aagcttgttgtgagggaagtggggaatcagtctgctccctgctctgctcaaattattgtgctaaggagactttgccatggtatgatttttgaggcacgtgrtgattctgtctgatttgtaaactgacaacgtgatcagggccaaagaggaagttcagctaggccaaaccttcctaagaagaagtcactgtcccacagttat

SEQ ID NO: 36188 - DNA, 201 bp, Homo sapiens
agaaccctagagttaatttatctagaatgcatttagaaaggcagtgtcttgggtgaatagagcagcaacctgtaaattgagtcatttcagaagcaatacarcattgtggttaagattataggctttggagtgcctaagttcaaattcttattcttctactaactagctctataaccttgggaagtcatttaatctctctgg

SEQ ID NO: 36189 - DNA, 201 bp, Homo sapiens
gggtcacacaactgatacagagctaggagttgaactgattccagatcactaccaaaactatcatcttttacttagagtggtatatgaggtgattaacacasaccttgggttgttagggtgtgcctgtgtgtcactgggctataagatgcctaaagggtatctctacctgtcccctgtgctacccttaatccattctagagg

SEQ ID NO: 36190 - DNA, 201 bp, Homo sapiens
catacctctgtgtgtcctattctttgttgtcatctccaccagagaaagtcattcttgtgtaaacccctcaccttcccacatcttttagaatgaaaatgccrtaaataactatacaggcttttagaggtctgcgttaacacatggaggaaaaagaaaacattgaaatttatcccccctcagtgtaaactaacagtgctgcta

SEQ ID NO: 36191 - DNA, 201 bp, Homo sapiens
tctgcctgccacagcctgtttttattgaccatcatttgagccagggtcccactggtccccattatacctggttcagaaagctctctcgcatgaacccagtkgtcagtgaaggtgcacattagactaaactgaatggaggaaagctcaggtgggccatcttcataatatatccttaagaggcaaatactatttttaaccata

SEQ ID NO: 36192 - DNA, 201 bp, Homo sapiens
taagtatggtgggtttcattcccttatggctcagcacttgaactgaatccaaaagaatggcttgtaatcaagatgagcccttcctggactttcccagactstgctacagaatctatatgtaggtgtcttccagagaattcgtagaattgatatctttcctgccttttcttgtaggaactctattcccagctgaaagccaag

SEQ ID NO: 36193 - DNA, 201 bp, Homo sapiens
cactatgggaggccaaggcaggaggatcacttgagttcaggagttggagaccagcctgggaaacatagtaagaccttgtatctactaaaactaaagaaacmattaggcatggtggcacatgcctatagccgcaactactagggaacttaaggtgggaggatcacttgagcctgggaagtcaaggctacagtgagccacgat

SEQ ID NO: 36194 - DNA, 201 bp, Homo sapiens
aagcttctgcatctttttcatcttcagcactatcatctcctaaagtccagacatacagtaaactagaagcagttctaaaatttccactttatctttgcccscttgcctgacgtcatttgtccattccagatctgccccccctttcctcattcagaggcctgtgatgtctggagttcctccttttcctcacatctagccact

SEQ ID NO: 36195 - DNA, 201 bp, Homo sapiens
gggagagagagaaagaggaggagatagcaggctccttttaaacagccagttctcatgtgaactaacagcaagaactcactcattaccatggggagggcacsaaggccattcatgaggaatttgcccccataactcaatcacatcccgttagaccccacctccagcattggaaatcacatttcaacatgagatttggagggg

SEQ ID NO: 36196 - DNA, 201 bp, Homo sapiens
atcttgccaggaacagttggatgaattccggaagctggtcaggaccttccagaaatggttgaaagaaactgaagggagtattccacctacggaaacttctrtgagtgctaaagagttagaaaagcagattgaacacctgaaggtaggtgaacaaagggactccaagaattgggctaggcactggtttgaatacttgtatta

SEQ ID NO: 36197 - DNA, 201 bp, Homo sapiens
ctttgcccccataagagtaaaaatacaatatttaactctttttcctattttttgtgtttaacagacatttatggaggagatgactcgcaaacagcctgacrtggaccgggtcaccaagacatacaaaaggaaaaacatagagcctactcacgcgcctttcatagagaaatcccgcagcggaggcagtatgtttccagcccc

SEQ ID NO: 36198 - DNA, 201 bp, Homo sapiens
agcactttgggatgctgatggatcacaaggtcaggagatcaagaccatcctggctagcacggtgaaacctcgtctctactaaaaatacaaaaaaaaattasccaggcgtggtggcgggcgcctgtagtcctagctactcgggaggctaaggcaggagaatggcgtgaacccaggaggtggagcttgcagtgagccgagatc

SEQ ID NO: 36199 - DNA, 201 bp, Homo sapiens
tatctttgtgtattccagaagggctgatggaaagaggtaattggctcccctcttcatttagttactgactgttgcttttcttggcatggttcagcttgtaracattcctccatctagtgggtaactgttgaagggaatccagtgggagaatagagacattgtacaagtttttgaagttctgatccccaaattcctatgaat

SEQ ID NO: 36200 - DNA, 201 bp, Homo sapiens
ctgcaccactgcactgggctgccttacttttgagtctccctttgatacttaagagttctgccatagggccaggcatggtggctcacgcctgtaatcccagyactttgggatgctgatggatcacaaggtcaggagatcaagaccatcctggctagcacggtgaaacctcgtctctactaaaaatacaaaaaaaaattagcc

SEQ ID NO: 36201 - DNA, 201 bp, Homo sapiens
cccctgagtagctgagactacaggactgcaccactgcactgggctgccttacttttgagtctccctttgatacttaagagttctgccatagggccaggcayggtggctcacgcctgtaatcccagcactttgggatgctgatggatcacaaggtcaggagatcaagaccatcctggctagcacggtgaaacctcgtctcta

SEQ ID NO: 36202 - DNA, 201 bp, Homo sapiens
tgttttttttttttttttttttgtccgaggcagagtcttgttctgtcacccaggctgaagtgcagtggcatgatcttggctcactgcaacctctgcctccygggttcaagcaattctcctgcctcagcctcctgagtagctggggattataggcgcatgctaccatgcctggctaattttttttgtatttttagtggagat

SEQ ID NO: 36203 - DNA, 201 bp, Homo sapiens
ttcttgaggcagagtcttactctgtcacccagcctggagtgcagtggtgtgatgacagctcactgcagcctcaatctccccgggctcaggtgatcctcccmcctcagcctcccaaatagctgggactacaggctcgtgccaccatgcccggctaattcttgttttgttttttttttttttttttttgtccgaggcagagtc

SEQ ID NO: 36204 - DNA, 201 bp, Homo sapiens
aattacactctaagttattttaaaatgtatagttaagttattattgactatagtcacccttttgtgctatcaaatagtaggtcttattctaactatttttwaaaaatgtggaacacttcacgaatttgtgtgtcatccttgtgcaggggcctccctaacctctctgttgttccaattttagtatatgtgttgcttaagtga

SEQ ID NO: 36205 - DNA, 201 bp, Homo sapiens
tcaccgcaacctctgcctcccaggttcaagcgattctactgcctcagcctcctgagtagctgggattacagacatgcggcaccacgcttggctaattttgkattttttagtagagacggggtttctccatattgatgaggctggtcttgaacttctgatctcaggtgatccacctgtcttggcctccgaaagtgctgggat

SEQ ID NO: 36206 - DNA, 201 bp, Homo sapiens
aaaatacaaaattagctggcgtggtggcccatgcctgtaatcccagctacttgggaggctgaggcaggagaatcgcttgaacccgggaggcggaggttgcrgtgagccgagatcgcaccattgcactctagcctgggcaacaagagcgaaactccgtctcaaaaaaaaaaaaaaaaaaaaacaaccagaaaaacaaacaag

SEQ ID NO: 36207 - DNA, 201 bp, Homo sapiens
agtatctgcttgtaggtactagtagaatatagtgcacacagtgagcttattcatggttgttgactgactaaaaagcacagaaaaaaaaatcacttcctatrtgtctcaatccaacatgttcctgcaggttgaaaactataaactccaaaaaacacttcaagcaagccctttcctttcatcaacacaaacgaattgtgttta

SEQ ID NO: 36208 - DNA, 201 bp, Homo sapiens
tttaaaagatttttattaaagaagtaagatgtaatcccagcattttgggaggccaaggcgggcagatcacttgaggccaggagttcgagaccagtcaacayggtgaaaccctgtctctactaaaaatacaaaaattagtcaggcatggtggtgcaatcccgtggtcccagctacttggatggctgaggcacaagaattact

SEQ ID NO: 36209 - DNA, 201 bp, Homo sapiens
tgtggagaggaggaggtaattttgggatttctgcccaccaccatgatattggttattatttcctactgctatcacttttcactgctgtcatttggtctgtrtagtctattcctcccttctaatcttcactgagctagaaaatgagataaacaggcctgttaaaattgcattagatatgagctaaaatgtacaaaagagtcc

SEQ ID NO: 36210 - DNA, 201 bp, Homo sapiens
tacactgtcttttggaaagtctacaggcaggaaagggcttacaggggtcatgagagttcctgcagagtgtgtggaaagttttctcatgggttcacgagtayatgagagctcaaatagcatcaaaatccttagtatcccacttaaagcaaacttcgtgtcatgctatgttgctttatgagccactccgtagccatgtttata

SEQ ID NO: 36211 - DNA, 201 bp, Homo sapiens
caagatggtttgtagacaagttttttcatttcgttttgttttgtttcataaaggatatgtttaagcacagtttcctcagaaatattcataaactgactgarctactcatcctaaacatttgaagcataaatggcaggtttctggagacttttttttaatcagaagaaaaatgacaggcaaaacttgataggcaaagattcc

SEQ ID NO: 36212 - DNA, 201 bp, Homo sapiens
aatctctgattctttgtctctttcagggcttttcataatttgacttactctgcacacccaactataccatctgttactgcctaacacatctctcttctccwtttggactggtcttagcaaccttagcaacccttccccctgtgtcctgtgcctttgtttacattctcttttccaggaatgccctctcccttcctgattatt

SEQ ID NO: 36213 - DNA, 201 bp, Homo sapiens
tttatttatttatttttggagacggagtctcactctgtcacccaggctggagtgcagtggtgcgaactcggctcactgcaagctccgcctcccaggttcaygccattctcctgtctcagcctcccgagtagctgggactacaggcgcccaccacacacccggctaattttttgtatttttagtagagagggggtttcaccg

SEQ ID NO: 36214 - DNA, 201 bp, Homo sapiens
gattaaaggtgcatgccaccatgcccagctaattattttatttatttatttatttatttatttatttttggagacggagtctcactctgtcacccaggctrgagtgcagtggtgcgaactcggctcactgcaagctccgcctcccaggttcatgccattctcctgtctcagcctcccgagtagctgggactacaggcgccc

SEQ ID NO: 36215 - DNA, 201 bp, Homo sapiens
agggtcacccatgtcagagtgcagttgataccattgtgtagctcactctaacctcaaacccccgggctcacatgatcctcccatctcagcctccggagtasctaggattaaaggtgcatgccaccatgcccagctaattattttatttatttatttatttatttatttatttttggagacggagtctcactctgtcaccca

SEQ ID NO: 36216 - DNA, 201 bp, Homo sapiens
ggagacagggtcacccatgtcagagtgcagttgataccattgtgtagctcactctaacctcaaacccccgggctcacatgatcctcccatctcagcctccsgagtagctaggattaaaggtgcatgccaccatgcccagctaattattttatttatttatttatttatttatttatttttggagacggagtctcactctgt

SEQ ID NO: 36217 - DNA, 201 bp, Homo sapiens
agtggatgttgttcttttttttttttttttttttttgagacagggtcttgctttgttgcccaggctagagtgcagtgtggtgagatcagggctcactgcarccttcacctctcaggctcaagtgatcttcctacctcagcctcccaagtagctgggactaacaggcatgtgccaccatgcctggctaatttttaagtattt

SEQ ID NO: 36218 - DNA, 201 bp, Homo sapiens
cctttttagtggatgttgttcttttttttttttttttttttttgagacagggtcttgctttgttgcccaggctagagtgcagtgtggtgagatcagggctmactgcagccttcacctctcaggctcaagtgatcttcctacctcagcctcccaagtagctgggactaacaggcatgtgccaccatgcctggctaattttta

SEQ ID NO: 36219 - DNA, 201 bp, Homo sapiens
aaaagaaacatttatttaactacttttctaggaactgggtacaagtagcagtgaagaaaacagcgaaagttcttgctctcatggaacttatctttcagtarggagaataggtaataaatgtatgccatcaagcagtggtaaatgcaatggcaggattagaaagtggcagaggtttgtggtactttggacagggtggtcaga

SEQ ID NO: 36220 - DNA, 201 bp, Homo sapiens
gttccattttattttactttactttattttgaggtggaatcttgctctgttgctcaggctgggatgcagtggcacgatctcacctcactgcaacctctgcytcccaggttcaagcaattctcctgcctcagcctcctgaatagctgggattacaggtgcacgccaccatgcctggctaattttttctatatttttttttag

SEQ ID NO: 36221 - DNA, 201 bp, Homo sapiens
gcacctcactggatggtagtactggtgacctccagcggaaaggaagttggactcctagcaaatgaggctgggaaagaagggggcagtagggcttgttccargagagacctcttttgttcagttttttttttttagctgtctcactcagtttggctttcctctgaagggccttgatcaggtgtataggaacttaatccttcc

SEQ ID NO: 36222 - DNA, 201 bp, Homo sapiens
gcgagcggactgaggagcggagcgcgactgccgggccgggcgaggcgggcggacggcggagagcgagggcgccgtcgccgtctctgagacgcacaaagggycgaggctggggccgccgccgcctcagcgcgcgggcctggaaccggcagcccccggggctcggcgagaaggcggtgcgggcggccatggccggctacgtgc

SEQ ID NO: 36223 - DNA, 201 bp, Homo sapiens
agtagtttgtatttaagttttaagataggagatatttcagagctgtcacttcacatctgacaaagttcctagggggatgaaggtacctttggaaacaattrtatctattgactgaccacttgcccacaaagagatggtcattgtgagcctgagtggctcccaggctagagaggcctggggaaactgtgttgaagccccaac

SEQ ID NO: 36224 - DNA, 201 bp, Homo sapiens
atactcagtcctctgactaactgaaaaatatcagaaagaacttagtgaggaagagtattattatggggagaaaaaaagcaaatggcttttttttttttttkttttttttgagacagagttttgctctgttgccaagactggagtacagtggtgcaatctcagctcactgcaacctccacttcctgggtttgagtgattctc

SEQ ID NO: 36225 - DNA, 201 bp, Homo sapiens
aggagtttaagtcaggacagttggtaaaaagtacatattcctattcctccccaaacccccaaacatcttgctatctgtatactcagtcctctgactaactraaaaatatcagaaagaacttagtgaggaagagtattattatggggagaaaaaaagcaaatggctttttttttttttttttttttttgagacagagttttg

SEQ ID NO: 36226 - DNA, 201 bp, Homo sapiens
tgagctgagatcgtgccactggactccagcctgggtgacagagcgcgactctgtctcaaaaaaaaaaaaaaaaattcagagcaggaatgaaaggaagtaargtacacttggaagagggccaaacgggcaacttgagagatccaagtgtgctgtctgtcctttgacttggggttttatatgttggcatgcttccaggggtta

SEQ ID NO: 36227 - DNA, 201 bp, Homo sapiens
tgccgcagcctcccaagtagctgggattacaggcacccaccaccatgccaggctaaattttttgtattttcagtagagaggggtttcaccatgttgcgtaragtggtctcgaactcctgacctcaggcaatccacccaccttggcctcccaaaatgctgggattacagacatgagccaccgcgtctggccagcaaactttt

SEQ ID NO: 36228 - DNA, 201 bp, Homo sapiens
tgatatttgctcatttaaataacagtttaaggaaagtagttatgggagtaactagttaaaactgtaggctttcacaaattgtcaggcacttctatatatgrtataaacaaaaaattataaatttcttaaggataagctatggttaattttagttcaaaaaaagtggtgatattcatactttatttggtttctagcctgaaa

SEQ ID NO: 36229 - DNA, 201 bp, Homo sapiens
ttttttgtgacagagtctctctctgtcacccaggctggagtgcagtggtgcgatctcagctcactgcaacctccattctcctgccgcagcctcccaagtarctgggattacaggcacccaccaccatgccaggctaaattttttgtattttcagtagagaggggtttcaccatgttgcgtagagtggtctcgaactcctga

SEQ ID NO: 36230 - DNA, 201 bp, Homo sapiens
cctgtgaaatcgccgcagtgctttccaccatgactgaactcaggagagtttttgattggttatttacagcatgggttggcaaacttttttttttttttttktgtgacagagtctctctctgtcacccaggctggagtgcagtggtgcgatctcagctcactgcaacctccattctcctgccgcagcctcccaagtagctgg

SEQ ID NO: 36231 - DNA, 201 bp, Homo sapiens
ttagtgcagtttattatgccagtttcatttggggtggaacctagaagtgagagagtgatgggaagtgatgttgttaaggaatcccaccatgttttttctawaggacacttgaaattgataagcctttctttaactaaaaccagagttggtttgagatagatttttcttaggaggcatgcttatctgttttgctcttttctc

SEQ ID NO: 36232 - DNA, 201 bp, Homo sapiens
gctgtactgaacatacacacacatgtgtctttatgatagaatgatttacattcctttgggtatatacccaataacgggatagctaggtcaaatggtaattytaagttcctgtgaaatcgccgcagtgctttccaccatgactgaactcaggagagtttttgattggttatttacagcatgggttggcaaactttttttttt

SEQ ID NO: 36233 - DNA, 201 bp, Homo sapiens
gaaactccgtcttaaaataaaaaaaatcatatccctggagcttcagtgataatgatcatttctcctttcagctattctctgagagaccatctactgaatgmcctgttattatcaatctcatcctctctttataaatgagcatctaggatccgtcctttgtttcttttttgaccacgatccaatcctacgtgcacacacaca

SEQ ID NO: 36234 - DNA, 201 bp, Homo sapiens
tgaaactcacttttcttacattgacagacagtagctgtactccatattctttggtatgattggtatgaaattacgaggtggttaagcttattttttaacartggcctttccattgttttggttatcagccctagctgtttacatttggcttgtactaatttaatcaacacaacagcttctacagaatatgttgctttttta

SEQ ID NO: 36235 - DNA, 201 bp, Homo sapiens
caggtcctgaagcggtcaggccgagagctgattgagaatagtcgagatgacaccacttgggtaaaaggacagctccaggaactgagcactcgctgggacaytgtctgtaaactctctgtttccaaacaaagccggcttgagcaggccttaaaacaagtaagggatatttgctgtcccaacccaagggatagatctgagtgg

SEQ ID NO: 36236 - DNA, 201 bp, Homo sapiens
ttgtgaggatggatccagaatttgaccaaaatacttgacccctttgagtagagaagtacttggagaagagtctacatgaggccttttcttagctaatgccmtgctaagaaggctgatggtgatgggagtagataatatctagattcaaaaggtccaaatgcaccacaatcttagtttgacataattaactctcttagcatt

SEQ ID NO: 36237 - DNA, 201 bp, Homo sapiens
aaaaaggtttcaggtggagcagatcggagagaataaataccgggtaaggaagagaaaaagcagtcctttgttgtggtggtttctcatatgtggctgatccyaccttttcctcctgatgcttagaggcccagagcccatcggacttgagatgtggtcactctctgacctcatctctatagatgccaagtgtcaggtaccctg

SEQ ID NO: 36238 - DNA, 201 bp, Homo sapiens
gtctgaaactcctgggctcaagtgatccatccccttggcctcctaaagtgctgggattacaggtgtgagccactgtgcccagcccaaactcagtattttcraaccaagcttaaatttggcttttctatcctagtccccattttttgacagttgaactcacattcttccagtctctgagattagaaaccttgcagacatctg

SEQ ID NO: 36239 - DNA, 201 bp, Homo sapiens
ttttttttttttttttttgagagagtctcgctctgttgcccaggctggagtgcagtggtgcgatcttggctcactgcaacctctacctcccaggttgaagygattctcgtgcctcagcctcctgagtagctgtgaccacaggtgcatgccatcacacccggctaatttttgtatttttagtagagatggggttttaccatg

SEQ ID NO: 36240 - DNA, 201 bp, Homo sapiens
gacagagagaatgaaaacagacaactttttgcctcctttaaaccttattttggtcagatgttcaggtgatatatatactacattctgttttgatttgtgtyaaataaggagaacattagaagatttgattctactgttgctactcaccaggtgattggacaaatctttctttaagccttctgactgaactttctcttttat

SEQ ID NO: 36241 - DNA, 201 bp, Homo sapiens
ggggcctcccacccagcgggactcccgcgtgggccggcctctcgcgcccctcggctcgggccccagtccgggccgggcgggggtcggcagcccctgggggmcccgtgtgggcagcccgggcccagccggccgcagcctggggccgaggactcgccgggacccggaggcggcggggagagggggcggggaacgggccgggcc

SEQ ID NO: 36242 - DNA, 201 bp, Homo sapiens
gtgaaccccggggggcggagcctgcagtaagccgagatcgcgccactgcactccagcctgggcgacagcgagactccgtcaaaaaaaaagaagaaaaagaragagagagagagagagagagagaaagagagagagaaagaaaagaaaagaaagacgaaatagttaatgagtgccctatatgtgccagatcatttgctaggt

SEQ ID NO: 36243 - DNA, 201 bp, Homo sapiens
gaaagaaagggagggagggagggaaagaaagaaaagagagagagaaagaaagaggctgggcgcggtggctcgcgcctgtaatcccagcactttggaaggcygatgcgggcggatcacgaggtcaggagatcgagaccatcctggctaacacagtgaaaccccgtctctactaaaaatacaaaaaattagccgggcgaggtg

SEQ ID NO: 36244 - DNA, 201 bp, Homo sapiens
cctgggtggtgacagagcgagactccatctcaaaaaagaaaggaaagaaagaaagggagggagggagggaaagaaagaaaagagagagagaaagaaagagrctgggcgcggtggctcgcgcctgtaatcccagcactttggaaggccgatgcgggcggatcacgaggtcaggagatcgagaccatcctggctaacacagtg

SEQ ID NO: 36245 - DNA, 201 bp, Homo sapiens
ctcatgcctgtaatcccagaactttgggaggctgaggcgggcagattacctgaggtcaggagtttgagactagcctggccaacaaggtgaaaccccatctytacgaaaaatacaaaaattagccgggggtggtggcaggcgcctgtaatcccagctactcgagaggctgaggcaggagaatggcttgaactcaggaggtgg

SEQ ID NO: 36246 - DNA, 201 bp, Homo sapiens
gagagtttggtaacttgctcaaggtctcccagccagtaaggggccaagcttggaatggtgctagctctgcctagggcaacccactgcctcccccattacawggaacagtagtttaataacagctaacatctgtgtagcacttcaaggttcacggagtgccttaacatccattatctctactgtgccttgggaagccggtgc

SEQ ID NO: 36247 - DNA, 201 bp, Homo sapiens
agtgctgggattacaggtgtgagccaccgcgcctggcctcttcatgagggattctaacacccagatgttcaggctccaggggcagtgtgtccctcctagcrttgcttggctgatcctctggtccttccagcttgaggttcaggctctatccccagaacacacagagctaggctagagcatatctggttctgttctgccagt

SEQ ID NO: 36248 - DNA, 201 bp, Homo sapiens
ggtgtggtggtgcatgcctgtagtcctagctacttgggggctgagaaaggaggatcccttgagcccaggaggtcatggctgcagtgagctatgattgtacyactacactccagcgtaggcaacagagtgagatggctgtctcaaaaaaaaaaatggctgggtgcaatggctcatgcctgtaatcccaacactttgggaggc

SEQ ID NO: 36249 - DNA, 201 bp, Homo sapiens
aggcagaggctgaagataccatgggatgattttaaaaattcgaagaacagtttattcctagctttatacattgctttataagcctgtttctttttttttttaatttattaatttattttaaaatagacacagggtctcactatgttgcccactctggtatcaaactcctgggctaaagcgatcctcctacctctgcctccc

SEQ ID NO: 36250 - DNA, 201 bp, Homo sapiens
tgaataaggcagaatgtcattaaatatattttaatatgtattcaaagaagaagggactgagaagtatgtctagctagaaagggaagagaaaggactaggtwtttctatttattttttcccttttcaccttaataaaatcatggattaattggatacagtcagtggttgtgccataagtttataaatcacttagctgttatc

SEQ ID NO: 36251 - DNA, 201 bp, Homo sapiens
caacagatcgagaccatcctggccaacatggtgaaaccctgtctctattaaaaatacaaaaaaattagctaggcatggtggtgcgcgcctgtagtcccagytactcagtaggctgaggcaggagaatcatttgaacccaggaggaggaggttgcagtgagctgagatcgcgccactgcactccagcctggtgacagagtga

SEQ ID NO: 36252 - DNA, 201 bp, Homo sapiens
cgttatttatcttaaaaacatggatgcagaggtaatgttgacaccagctcagagccacgtagtcctagagacgtcacagttttgtagacaggatccaagtrcaaaaatgtggctgtttcagaagggcccctctaggagcttgggagaaattcagcactaaagtgggacattggctgaaggccttcttaccatgtttggaga

SEQ ID NO: 36253 - DNA, 201 bp, Homo sapiens
aattattaagagttatgtccagtggggcacaaagggtggttctggggtgctggtaatgttctgcttcttaatctgaatgctgactaaatggaggaattcarattataaaaatcaacatgtttacgattatggtttatgcactgttttgtatatatgttacttcagtaaaatggaggaaaagaggaagtgttacatttttat

SEQ ID NO: 36254 - DNA, 201 bp, Homo sapiens
agaattctccaaaaattcaaaaagtaaaggaagccctggctggattactggtgacatatcccaactcacaggaagcagaaaattggaagaaaattcaggargaactcagtaagttttcacaagagtgttacaaatttgctaagttacttgtcttcaaagcaagtagagaatttcagcacatcctataaaacaggaattatt

SEQ ID NO: 36255 - DNA, 201 bp, Homo sapiens
tactttctccaagaaacctaccccacctcagttcccttccagtcctaatgttctggattccactcacatgtggtctgctcccacttccccgctcctctgcycttccagccactttgctggctcctctgggagcacagctttcattttgctttgggaaattgccgtgttcaccagctgtcacccctgttgctgtgggggctg

SEQ ID NO: 36256 - DNA, 201 bp, Homo sapiens
tagtaaatggcagagatgagattcaaattcagggcaatctgggtctggagtatgtgcccctagtcagcatgttatatctttcagaggctgacacacctttktgtatgtttattattggatcacctgcataattattaaggtttatttataaacctagcagaaatgtttgctgtacagtacataacttctttggaaatgatt

SEQ ID NO: 36257 - DNA, 201 bp, Homo sapiens; identical to SEQ ID NO: 7707

SEQ ID NO: 36258 - DNA, 201 bp, Homo sapiens
gagcacaaggtaagtatgatattatgatgctgcattctttttgaaagcactaattgaaagaaatgcccctttatcttatcttaagctaaaaaagagcactrttgttccctcaggtttttgctaatgaagtaaatgctcatcgagaccagatcattgagctggatcaaactgggaatcaattaaagttccttagccaaaagc

SEQ ID NO: 36259 - DNA, 201 bp, Homo sapiens
ggagcaaaaaactgtattacaggtgaattacatttatttatttgccatattgttcctgtttttatcatggtgaattagaagcacaattgtgaaatgatggkttaaggctttttccctcctggacttttcttatgattgttattaaagtccagcttgatgttctggggaattcagaatcttaaccctgtgtccacaaatgtt

SEQ ID NO: 36260 - DNA, 201 bp, Homo sapiens
tcatactcttaatgtggcagaagtaccattctcttctgacccttttttccttttagacatgtctaaatcgtaatggagcttaactgtagtagagcaaaatrtacacgttgcttgttacacctattcacattgttttaaaattctgttgcaccatggtaaacgtggataatacagtatcatttttgagcagttttttaaatg

SEQ ID NO: 36261 - DNA, 201 bp, Homo sapiens
aagaccagcctggccaacatggtgaaaccctgtctctaccaaaaaatacaaaattagctgggtgtggtggcgcatgcctgtagtccccgttacttgagagrctgaggtgagagaatcacttgaacctgggaggcagaggttgcagtgagctgagattatgtcactgcactccagcctgggcaacagtgtgagaccctgtct

SEQ ID NO: 36262 - DNA, 201 bp, Homo sapiens
ggctcacgcctgtaatcccagcactttgggaggccgaggcgggcggatcatgaggtcaacagatcgagaccatcctggccaacatggtgaaaccctgtctytattaaaaatacaaaaaaattagctaggcatggtggtgcgcgcctgtagtcccagctactcagtaggctgaggcaggagaatcatttgaacccaggagga

SEQ ID NO: 36263 - DNA, 201 bp, Homo sapiens
ttgaagccaggagttcgagaccagcctggataatatagtgagaccccgtctccacaaaaaataaagcaaaattagccaggcaggagaatcgcttgaacgcrggaggtggaggttgtggtgaactgagctcacgccattgcacttcagcctgggcaacaagagtgaaattttgtctccaaaaaaaaaaaaagaaaagaaaaa

SEQ ID NO: 36264 - DNA, 201 bp, Homo sapiens
gctcactgcaacctccgcctcccgggttcaagcaattctctgcctcagccccccgagtaactgggattacaggtgcctgacaccatgcccagctaattttwttgtattttttagtagagacggggtttcaccatcttggccaggctggccttgaactcctgacctcatgatccacccgcctgggcctccgaaagtgctggg

SEQ ID NO: 36265 - DNA, 201 bp, Homo sapiens
ctaagaaaatgggcttggcatcaactgtctacacggggttcctactccaccacttaacaacaaaaccaactggggacattgcttaacctttctctagctcrgttacctcattttttatttttctttttttcatatcaccgtaaaataaaatcacttgtatagggagaatgaatgaagattagcagtggattttcatgttat

SEQ ID NO: 36266 - DNA, 201 bp, Homo sapiens
ggccccctgggctgcggggtggtcaggagcagagtgtgggggactgtggactcccaggcgctgccttcaccctgccccagacacacccaggagtaagaatyaggtgatgtctttgcccacctgggctgccccgggaagacagcctggtcctggggagacaggtgagtaaacagaggccgggatgctgtcactgtgataagg

SEQ ID NO: 36267 - DNA, 201 bp, Homo sapiens
ggaaaaaacacagttcctgttttttcttttttcttttctttcttttttttttgagatggagtctctctctgttgcccaggctagagtgctgtggtgccatytcagctcactgcaacctccgcctcccgggttcaagcaattctctgcctcagccccccgagtaactgggattacaggtgcctgacaccatgcccagctaat

SEQ ID NO: 36268 - DNA, 201 bp, Homo sapiens
gactaatagctaagaaaatgggcttggcatcaactgtctacacggggttcctactccaccacttaacaacaaaaccaactggggacattgcttaacctttytctagctcggttacctcattttttatttttctttttttcatatcaccgtaaaataaaatcacttgtatagggagaatgaatgaagattagcagtggattt

SEQ ID NO: 36269 - DNA, 201 bp, Homo sapiens
accatgttggccaggatggtctggatctcctgactttgtgatccgcccaccttggcctcccaaagtgctgggattacaggcatgcaacactgtgcccggcrtgcacagtgtatatctttaggtaaaattcttaaatgtgaattgctgtttcaaaaggtatgtgtacttgtaaatttgatggataatttgattcattgcttt

SEQ ID NO: 36270 - DNA, 201 bp, Homo sapiens
agtagttgctattctcaacagaaatgttaagtaacttgtctgaggttatacactgagcaaataatggagctgggattcagcattacttaatgtgcatggcrccccctggccctcaacatgtacaatatgccctttgcagttattcaagtgctgagtttctggtcagcctaactccaaagccctggcacttttcaggatatt

SEQ ID NO: 36271 - DNA, 201 bp, Homo sapiens
atgaacgagaatcagaatgtgctggaaaaacacaggttcacatggcccgttactgcacttaacagtgtcattccttgtaacctccctggcagccagatgargcagtggagactcaggaggccagcagtttcccaggccagcaaagaaggagcccaagcctcttatttctgtccccttcttttgttctttaggcctttgtca

SEQ ID NO: 36272 - DNA, 201 bp, Homo sapiens
aagataaatgaattcaaatattttattctttcctgctgttgttttataataagtactactatgcccctagtaacctaagagtaacactatatggcattatytttgtttttttccctctaacctctaccttctctctggtcagttgtgaagcccaaatattcttcctctgcaattactttcacagccctcttcctcattttt

SEQ ID NO: 36273 - DNA, 201 bp, Homo sapiens
gagacagagtctcactttgccacccaggctggagtgcagtggcgcaatctcaactcactgcaaccttcacctcccgggttcaagcaattcttctgcctcarcctcccgagtagcagggattacaggcgtgtgccaccatgcccagctaatttttgtatgtttagtagagatggggtttctttttttttttggagatggagt

SEQ ID NO: 36274 - DNA, 201 bp, Homo sapiens
cagctctttgccaagcagcagcacagtgctgtagttatgagtgtaagctttggaatcagagagggtagggtgctggatcgtggccctgccactgaccaacygtgtgactctgggcaagtcccttattctttctcagtgtcactttccttgtcttaagaatgcccactgtgcagggatgccttgaaggttagatgaaataat

SEQ ID NO: 36275 - DNA, 201 bp, Homo sapiens
agagagtcagctccaagaggtaactgggaaacatctcagttttgctccgggcactatttcctttgccatctataccagaagctgtggtgaatgggaaagcyattgctttctgaagtgcccttaggcctttctcagtgactcttaagttttaagaatcatttgggtgagcataatgctgaaatcctgtagctatgaaagctg

SEQ ID NO: 36276 - DNA, 201 bp, Homo sapiens
ctggaccctgcagagcgtgctgtggtcagagtcgctggtaagagaggtcccccagcaggctggacgctgtgggtgtgagggaggaatgggccagggcacakcagctgtgtggggagccgaggggtcctcaccagggcctctgacaaagcagccatcatctgatttgttattattattcttggaaagacgttgaaataacat

SEQ ID NO: 36277 - DNA, 201 bp, Homo sapiens
cagagaggtgaagtgacttgcccaagatcacagcaattgtaagtggccaaaccagaatatatacccaggtctgtcttacttcaagtctggtacattttctmatatatctgctggagacagagtgggagaaaccagagaatttctgcctattctagcccatggtttgcttcttgcctgctattgagatcatgctttagcttt

SEQ ID NO: 36278 - DNA, 201 bp, Homo sapiens
gcaaatgcttacataaaataaaggcagtggttgggatgccttggacaagatctgagtgctaaacacttgcttctaatatttatggctatggttaaacttasaattattctgtaaagctgttcagtagctccggattcctagaatcatctttgattacttagatgtttttcttttgtttttttcatggacaagcagcagttg

SEQ ID NO: 36279 - DNA, 201 bp, Homo sapiens
tgcccatgaagatggagaaggtatcaggaaaaggacataattgggctgggcatagtggctcacgtgtacaatcccaacactttgggaggcctagtagggargatcacttcaggccaagaatttaagaccagcctgggcaacatagcaagaccccatctctgttttaaaataaaatacaggccgggtgcagcagctcatgcc

SEQ ID NO: 36280 - DNA, 201 bp, Homo sapiens
gtagttcttttctgaattcatttctagctcagtctctttattcacattcaaagttagcagatcttcactataacagattccctttttttcttggatcaagwcaggtctcttcctattcaacagtaccttaatcaatagtcaattcatctgatcgtatcaggcatttataatatgttatagtgaggtctgaaggattctgct

SEQ ID NO: 36281 - DNA, 201 bp, Homo sapiens
gccaggagttcgagaacagcctaggcaacatagtaagaccccatctctgagaaaataaaaagaaaaaaaaaaaaacagaatatctccagtataaagcttayatagcagtaatcatgaaatataaggattaaatttatagtgaggcaatcaaatctgcataaaggggaaaaagtcatagaaatcctgtatcagtctctggaa

SEQ ID NO: 36282 - DNA, 201 bp, Homo sapiens
gagtctcagagaggtgaagtgacttgcccaagatcacagcaattgtaagtggccaaaccagaatatatacccaggtctgtcttacttcaagtctggtacaktttctaatatatctgctggagacagagtgggagaaaccagagaatttctgcctattctagcccatggtttgcttcttgcctgctattgagatcatgcttt

SEQ ID NO: 36283 - DNA, 201 bp, Homo sapiens
aaaatatatcctaaaaccacttaattcacagaaatctttctcatttcatttacagctgcataattctccatcgtatgtctgcttcatagtttattcaaccrgcctcctatatatgggcatttaggtggtttccaatatttagctattacaaatgtggacttctttctaccttttttgttcaattctgtctccctctttatg

SEQ ID NO: 36284 - DNA, 201 bp, Homo sapiens
ccgcggggccggggcggagaggtcgcagagcagagggcggagaatttgggggtgtggttggcctgcgggggacaccggaggccactagggaggagttgcakaggggagggaccgagggagggcctgggggcggccagaggacgcggggtcagtgaggagggggcgccgggcgacggactggcaggggcgcgcggggcgggc

SEQ ID NO: 36285 - DNA, 201 bp, Homo sapiens
gtttcagtgagtggaaaacatcccttcccatctctatcgtccctgctccagttgacagcctcattacctttggctgggactagtacagtagcctcctagcrtaaccatccacacccatctggtacctgtccttgggttacttttgctgttactttgacacctttcttggctgcttataataattaaatttaggtcaaattt

SEQ ID NO: 36286 - DNA, 201 bp, Homo sapiens
gtgttacatatacacacatatacatgtacgtaagtttacagatatagatcaatatatttattgatctctcaatttctctttctctctctctctctctctcwcacacacacacacacacacacacacacacacacacaaattcatatgtatttgtctccccatccagttcccaacccatagcacagggattattctagcctc

SEQ ID NO: 36287 - DNA, 201 bp, Homo sapiens
ggatggggtcacagggaagtgggggatggttaatggatgcaaaaaaataaaaagactaaataaaacctagtatttgctagcacaacaaggtgactatagtraaaataatttaattattcatttaaaaataactaaaagagtttaattggattgtttgaaacacaaattgcttgaggtgatggataccctatttaccctgat

SEQ ID NO: 36288 - DNA, 201 bp, Homo sapiens
gaactgtcttcagggagctgctcccctccctaacaggctgttcacaggcttgaggacagtagcagccagagaaacagagagggcaacgcatactgaaaccrataggcagggcaagagcatctctgctaaagtgggaaagctgggagggcaagggtcagaagagcagctgctgctgttcacacaccaactcctgtctaaaca

SEQ ID NO: 36289 - DNA, 201 bp, Homo sapiens
gccttggatgaatttttagtgaaaaatgatccctgccgaggtaaggaaccattctaagcatgaattacgtgttaggtatgcccccagcagtgatcttttaygcttacaggaagcattgatggtggggtctgtctgttttttattttgttaagctgcccaggtgtcatcccactagcacagattagaactcaggggtgccag

SEQ ID NO: 36290 - DNA, 201 bp, Homo sapiens
ttttcattttttaaaaagcaaagtagagacaaggtcaaataatggatgtttaaaacatttaaggatcagcctggtcaacatggcaaaaccccatctctacwaaaaatacagaattagctgggtgtggtggcaggcgcctgttgtcccagctacatgggaggctgaggcaggagatcacttgaacctgggaggcagaggttg

SEQ ID NO: 36291 - DNA, 201 bp, Homo sapiens
gattacaggtgtgagccactgcgcccagccacagctattattaaaaattaaattatgtaaacatacaattaaataaattatatttaaagtaaatgtaatayatcctcaaagctgttcatttcataattgttttgctgcatgttagtattgtctgtactcttgaggttatgtctgttgtgtctctgtgatggaaatactgta

SEQ ID NO: 36292 - DNA, 201 bp, Homo sapiens
atttaaggtaccaagcgtataagattaccaatcactggccatatcctccccattcttttcaaataggtatgttggttggttgaaagaatttaccaaagtarattggagagaagcaataaagctaaatgattaagaacttttaaatgcaaatatgtgtttctgaaaaccagagctaggcataatgtttatgaaaaatagaga

SEQ ID NO: 36293 - DNA, 201 bp, Homo sapiens
aagggtctaaagagtaaagtgagatttgcagggctgacctggtggtgatgagaaatggcacagatagttcttttgttctttttgggtctcccgggcttatrgtttgtagtctttctgttcagtttttggggaaaatatactttaattttgtctggtgaaagactttataatttcatgcttcgttttttattcagataagcc

SEQ ID NO: 36294 - DNA, 201 bp, Homo sapiens
ctgacaccagagcgaaatctggatttggagcgctatcaggaaaaaggctcccagctgcaggagcgttggcaccgagtcattgcccagctcgagattcggtsagtggtggccccacctttttctcctattagagttcagggactaggtcttaaacaaaaacagagttatatctgtacatttatatttaaaggtggaaatgga

SEQ ID NO: 36295 - DNA, 201 bp, Homo sapiens
gtcctccccagaggagactgctccagctgttgcagcagccatcacacaggagggtatgtcagctgtcgcagggttctccccagagtgggctgctttagctrttacagtacccatcacagaggaggatggtacaccagaagggcctgtcaccccagctaccacagtgcatgctccagaggagcctgatactgcagctgtcag

SEQ ID NO: 36296 - DNA, 201 bp, Homo sapiens
agaagcatgggtaggagtgagccaggccaaaggagagtgatgaagggttataatctgggaggaaagtcggttggatggccctgaggcgagataacacattrgaggcgctgaaagaaatagaaagtggcagggctttagggataggggtatttgatgaggctttaattgggaggacaccaaggataaagggcattaatttcc

SEQ ID NO: 36297 - DNA, 201 bp, Homo sapiens
gaagggtaaaaaaaaaaaaaaaaaatatatatatatatatatatatatatgttaagtctctgatgataacaagagattttcctcattttgaaattccctaygtaggttttacttgaactgagatcattctgaatcttaaaccaacccctcctttgccccctgctccccgcaagaaccatgtgacttctcactcagaaagta

SEQ ID NO: 36298 - DNA, 201 bp, Homo sapiens
gccgaacggggaatcacagacggtggacgcgaaccacaggggagtgggaccgccgtggttagggaaggtctaagggtcatgggggccccctgggctgcggrgtggtcaggagcagagtgtgggggactgtggactcccaggcgctgccttcaccctgccccagacacacccaggagtaagaattaggtgatgtctttgccc

SEQ ID NO: 36299 - DNA, 201 bp, Homo sapiens
aagctggctgcaggggaggggcgcgcatccgcgggcggtgccgggccctggccgaacggggaatcacagacggtggacgcgaaccacaggggagtgggacygccgtggttagggaaggtctaagggtcatgggggccccctgggctgcggggtggtcaggagcagagtgtgggggactgtggactcccaggcgctgccttc

SEQ ID NO: 36300 - DNA, 201 bp, Homo sapiens
accctcggagtaagctggctgcaggggaggggcgcgcatccgcgggcggtgccgggccctggccgaacggggaatcacagacggtggacgcgaaccacagkggagtgggaccgccgtggttagggaaggtctaagggtcatgggggccccctgggctgcggggtggtcaggagcagagtgtgggggactgtggactcccag

SEQ ID NO: 36301 - DNA, 201 bp, Homo sapiens
tgagcttcgtcaacatgggtgagtgcggccgcccgcgcggggaccctcggagtaagctggctgcaggggaggggcgcgcatccgcgggcggtgccgggccstggccgaacggggaatcacagacggtggacgcgaaccacaggggagtgggaccgccgtggttagggaaggtctaagggtcatgggggccccctgggctgc

SEQ ID NO: 36302 - DNA, 201 bp, Homo sapiens
cgcccgccgagccccgccccctgctcgccgaactcagctccccgttcgccgtcggggcgtccccgggcccaggggcggcggcggagctgatgtgcgcccgmtgagcgcccccggcccgccatggccgcgcgccccggaccgctctggcttctgggcctgacgttgtgcgcgctgggcgggggcggccccggcctgcgaccc

SEQ ID NO: 36303 - DNA, 201 bp, Homo sapiens
tgtgcctcagtttcctcatttattaaaagaggaggttccagtggtatgtaccccctaacgatgtgcgagcatcacagaaatgacacgagacacacactcakaacatgccttggcgtggcaagtgctgactgttgccattattaggctccccagccggggtctcagggccttggcacaagctattccctctgcctggagcac

SEQ ID NO: 36304 - DNA, 201 bp, Homo sapiens
ccatattccgctctgcttccaagctctggtcttgggtactttcaacggttattctgcattatccttagctcagtatccttatgggacagtcccagtccgcrgggtagccccggcttctaggcggtggcatccacatctgctctgcccggagctgatgcaggtgcctcatggggggcgctctggggaccgcgcagaaaattt

SEQ ID NO: 36305 - DNA, 201 bp, Homo sapiens
caccacacccagctaattttgtatttttagtagaggcggggtttcaccatgttggccaggctggtctcgaactcttgagctcaggtgatccacctgcttcrgcctcccaaagtgttaggattataggcgtgagccaccatgcccggcccattgtcagatttcatttaatatccctgttttcactgagacacctggctcctg

SEQ ID NO: 36306 - DNA, 201 bp, Homo sapiens
atttgaatttctttttcctttactcattcaccataattgtttgttgtaactattgtattcttactgaggattttttttttttcatttctaggggaaattaktaaaacaaaaggtatttgaagacattttgaaatttttatttggaacataaaactttgattttgggaattatcaaaatatatgacctaggatactttaaga

SEQ ID NO: 36307 - DNA, 201 bp, Homo sapiens
cgtcgcgcgctccctggcttccagggggctgcccgggcggggcggcgcagcgcggcggcgcggggaagggggaggagagccgcccgccagccgagcacttycagcgagctagcgagctagcgggtcgcgctgcgcgggggaggaggactcgccccccgcccgaccctagcggagccttttgttcccagccagaagtttgca

SEQ ID NO: 36308 - DNA, 201 bp, Homo sapiens
gtcttaaagttaacagaagttcatgttctggctttgtcacttactagctgtgtaacctagggctattaatcaactttcttaaacctcagtttcttttttcytttttggagacagagtcttgttctgttggccaggctggagtgcagtgacatgatcttggctcactgcaacctccacctcccagttcaagcaattctcatg

SEQ ID NO: 36309 - DNA, 201 bp, Homo sapiens
ggtggaggttgcagtgagctgagatggtgccactgcactccagcctgggtgatagagagtgagactctgtctcaaaaaaaaaaaaaaaaaaaaagagtgaytaattaaagaactgacaagcagtgaccaagggtcagtttgaaattaggcaatatgagtagagctctgtgcctttctctgcagcttaaagtcaaaagcaaa

SEQ ID NO: 36310 - DNA, 201 bp, Homo sapiens
ctgctgttttccatcaaggccaaatatttaacatggaggtcagatgggcaatttgctctctggtgccattccaaagaaacatgcttggatacaacattggrttcccaatgcttccatccagaactcagattttctcattgaaatctcagaagatagtggtaaacacgagcctcctgatatgagccctatgtgtgattataa

SEQ ID NO: 36311 - DNA, 201 bp, Homo sapiens
ggcaggaggattgcttgagcctaagaggcagaggtgtcagtgagccaagattgtgccaccgcactccagcctgggtgatagagtaagacgctgcctctaartaaataaatagaaaaaaaatttcacgtcatttggggtgaactttcaaggtagatttcagtaggtggagttgggggatgggacattctaggcaaagcctca

SEQ ID NO: 36312 - DNA, 201 bp, Homo sapiens
gcggtttcaccatattggtcaggctggcctcgaactcctgacctcaggtgatctgcccgccctggcctcccaaagtgctgggattacaggcatgagccacygcacctggcctaagaatttctttataaagcatcagttaacacataaaataatgcagcatgaaccaaaggtgaagaaaagctgggaataaactttctagag

SEQ ID NO: 36313 - DNA, 201 bp, Homo sapiens
tcacttgagcctgggaggttgaggcagcagtgagccatgttcatgccactgtactgtagcctgggtgacaaagtgaaaccctgtctcaaaaaaaaaaaaawtcatcaagggaatgagttccatttttgttataggggcctgtgccccaggactgccctgatgctggtgaactgcttcacgtgactctgatctcaactgaga

SEQ ID NO: 36314 - DNA, 201 bp, Homo sapiens
gaggtcgaggctgcaatgagccatgaagtatgccactgtgctccagtctgggtgatggagcaagactctgtctcaaaaaaaaaaaaaaaaaaaaaaaaaamcccacacatttaaaatactctttttcctccagttaagcctactatctaaaaaaccaaaaaaaatcactcaaataggaaacatagcacctattggtagcag

SEQ ID NO: 36315 - DNA, 201 bp, Homo sapiens
gaaagtggacaaaatttcctgccaccttctagatttatggtttctgaccagttaaacatctgttatagaaaagaatgacaaatattttgttcataatgatkcccttttctccagcagtcccatttgtttagctgtgtctagtacttcataaagagtgcacagtttagggtggatgaggaggtagagggtttctgcaggatt

SEQ ID NO: 36316 - DNA, 201 bp, Homo sapiens
tcgcccggccaagggtcatgtattgttgaggcttgaggaggaaggaaacactggatcatggaaggaaacagcttagcatttcagggaccattaagtcataratcatccagacaacagggctcttagagatcggttgacctgatcgcctctggtgagcctgaggaaactgaggccagagcaggaaaaaaatcacagttggca

SEQ ID NO: 36317 - DNA, 201 bp, Homo sapiens
ccgcctcctgggttcaagtgattctcctgcctcagcctcctgagtagctgggactacaggcatgcaccaacatgcccagctaaattttttatttttagtaragacggggttttgccatgttggccaagctggtcttgaactcctggcctcaggtgatctacctgccttggcctcccaaagtgctgggattacagacatgag

SEQ ID NO: 36318 - DNA, 201 bp, Homo sapiens
caactgcaatgcaatttcaaagttttcctcttatatcttttttttttttttcctggcagagtttgctcagaagtgaatttttttttttttttttttttgaratggggtctcactctgtcacccaggctggagtgcagtggcacgatctcggctcactgcagcctccgcctcctgggttcaagtgattctcctgcctcagcc

SEQ ID NO: 36319 - DNA, 201 bp, Homo sapiens
cttcctaaaacatttaaaatgtcacttccttcaactgcaatgcaatttcaaagttttcctcttatatcttttttttttttttcctggcagagtttgctcaraagtgaatttttttttttttttttttttgagatggggtctcactctgtcacccaggctggagtgcagtggcacgatctcggctcactgcagcctccgcct

SEQ ID NO: 36320 - DNA, 201 bp, Homo sapiens
tagagaatgcccttcctaaaacatttaaaatgtcacttccttcaactgcaatgcaatttcaaagttttcctcttatatcttttttttttttttcctggcaragtttgctcagaagtgaatttttttttttttttttttttgagatggggtctcactctgtcacccaggctggagtgcagtggcacgatctcggctcactgc

SEQ ID NO: 36321 - DNA, 201 bp, Homo sapiens
agtcccgttctccctcttagatatatatacacacacatatatacacttagtgtatatatatatatatatatatatatatatatatatatatatatatacayacacacacatatatacacttagtgtatatatatatatatatacacacacacacacacacagatgtgcaaaggagtaagacacaccattataatagtgatg

SEQ ID NO: 36322 - DNA, 201 bp, Homo sapiens
gcctcagcctccaatcctctccaccgctccctccactctcggagtcgctcctctccccggccccgcccccgccgggccccgcccccgccctcgtcctcctycctgtgctctccgcgtcgcgcgctccctggcttccagggggctgcccgggcggggcggcgcagcgcggcggcgcggggaagggggaggagagccgcccgc

SEQ ID NO: 36323 - DNA, 201 bp, Homo sapiens
acagtcccgttctccctcttagatatatatacacacacatatatacacttagtgtatatatatatatatatatatatatatatatatatatatatatatayacacacacacatatatacacttagtgtatatatatatatatatacacacacacacacacacagatgtgcaaaggagtaagacacaccattataatagtga

SEQ ID NO: 36324 - DNA, 201 bp, Homo sapiens
tgaggtgggaggatcatttgagccagggagatggaggctgcagtgacccatgatcgcaccactgcagctgtgatcatcatcatccagcctgggtgacacartgagaccctgtctcaaaaaaaaaaaaaaaaaattgcaggaaagattgagtcttgctttgggaggaaaaagaaacaggtgaaaggagggcaggagggcaga

SEQ ID NO: 36325 - DNA, 201 bp, Homo sapiens
cccttcaggaatcttcacgagttgttatcctggaagctccctgaatcttaggcctttcatggagacttccttgggtaggcatgattgacaaccatgcagamatgtgattgggcaaaaagggtatgtctaacactaacagtgtggaaacccagcaaagcctggctgttcagattctgcttgaattttctatgtagtattcct

SEQ ID NO: 36326 - DNA, 201 bp, Homo sapiens
ctgggcctccgaaagtgctgggattacaggtgtgagccaccgcgcctggcaagttcctgtttttccattctcttactcaacaatcaacacaagaagacttytgtgacgccaagatatgtggggacttctccccgccagcaagttaaacaatagttctgcagtggacaccagcggggtgtcctccagttcaattacaacact

SEQ ID NO: 36327 - DNA, 201 bp, Homo sapiens
ttgccatggtatgatttttgaggcacgtgatgattctgtctgatttgtaaactgacaacgtgatcagggccaaagaggaagttcagctaggccaaaccttmctaagaagaagtcactgtcccacagttatgtgggtaagttgttctagagaaacagagatgtgggcagggcagcagcgtgggaacctgttacctgggtagc

SEQ ID NO: 36328 - DNA, 201 bp, Homo sapiens
cagcgcctgggccgcgccgacctggtcatgagcttcgtcaacatgggtgagtgcggccgcccgcgcggggaccctcggagtaagctggctgcaggggaggkgcgcgcatccgcgggcggtgccgggccctggccgaacggggaatcacagacggtggacgcgaaccacaggggagtgggaccgccgtggttagggaaggtc

SEQ ID NO: 36329 - DNA, 201 bp, Homo sapiens
gcatgaactgagctacgttgcaagtccaaagagttttgaggaagttctggaagggaaggcacttctactcctgcccctccctggcttagagcaatgatagyatttcttctggggctgggaaaagaaataggaattagccaggacaacctgaagagacagggcacttcccggtggtttgcatctattcttgctctcctttct

SEQ ID NO: 36330 - DNA, 201 bp, Homo sapiens
acaaatatccctagggctactttgctctaggctcagactgcacttcagagcccagctcctgcctatgaagaccgttagaatgcagcatgaactgagctacrttgcaagtccaaagagttttgaggaagttctggaagggaaggcacttctactcctgcccctccctggcttagagcaatgatagtatttcttctggggctg

SEQ ID NO: 36331 - DNA, 201 bp, Homo sapiens
gctgccagaatcctactcgttatccaaggtttagttcagacaccgttcacttcgtagccttttgtctaagatcaggtatagttctatcacgccttccatgracacctcctacctctctgtgaggattaatcaactctatgcttgtgctatagtgtcattttgtgcagcttgtgtctggtgtgttatttgcttggtgttatt

SEQ ID NO: 36332 - DNA, 201 bp, Homo sapiens
aagaaatttatcctaaggaaatatcgtggatacatgcaaaatgttttacaaattgtcacagcattggctacaatgtttaaaatatttaaacaaaaatgcartattggactggttaaataaattcacatccatatgatgaaataatacttagcagctagttaaaattttgcatgagacatgtagggcatggagtaaagtttc

SEQ ID NO: 36333 - DNA, 201 bp, Homo sapiens
tttgtagagacagagttttgtcatattgcccaggctggtcttgaactcctgagctcaagtgatccacacaccttaacctctgaaagtgcagggattatagrcatgagccaccatgcccagcctacttgtgctttttttaagtttggaatcctttgactcctttttgggctgccagaatcctactcgttatccaaggtttag

SEQ ID NO: 36334 - DNA, 201 bp, Homo sapiens
gatgtttttaccttaggtatgcatcctttctccccagaaaatctacatgtagatatttatcctaggctgggcgcggtggctcatgcctgtaatcccagcastttgggaggccgaggcgggcagatcacgaggtcaggagatggagaccatcctggctaacatggtgaaaccccatctctactaaaaatacgaaaaattagc

SEQ ID NO: 36335 - DNA, 201 bp, Homo sapiens
catggttgacattcatcagttgatgtttttaccttaggtatgcatcctttctccccagaaaatctacatgtagatatttatcctaggctgggcgcggtggytcatgcctgtaatcccagcactttgggaggccgaggcgggcagatcacgaggtcaggagatggagaccatcctggctaacatggtgaaaccccatctcta

SEQ ID NO: 36336 - DNA, 201 bp, Homo sapiens
tctgggaggctgagccgggcggatcacccgaggtcaggagttcaagaccagcctggcccacatggtgaaaccctgtctctactaaaaatacaaaaattaayggcctggtggtgtacacatgtaaccccagctactcgagagactgaggcagcagaatcacttgaaccggggaagcggaggttgtggtgagctgagattgtg

SEQ ID NO: 36337 - DNA, 201 bp, Homo sapiens
atgaccctgttgtcccagctactcgagaggctgaggcaggagaatcgcttgaacccaggaggcagaggttgcagtgagccgagactatgccactgcactcygtcctaggcaatagagggagactctgtcgcaaaaaataataataaataaatatatggccaggcacagtggctcacacctgtaatcctagcactctgggag

SEQ ID NO: 36338 - DNA, 201 bp, Homo sapiens
ctcctcccatcccagccttttctattatcaaagtaaaagtattaattgcccccttaacaccttttttaattcttaaaattggccgctttaagtttatttckgaagaaagagctttcatttcttccaagtgatatgtatataaaatgttccttaccaagaatcgtttcattgccttgcatcttcaaatattttcttttaaaa

SEQ ID NO: 36339 - DNA, 201 bp, Homo sapiens
gtatttctaactgttctaacatagaagtcactctctatatagggttcaagcaatattccctttcagcgaggcagaattgtgggccatttgtaaaaggaatmcctaaaaatggtagcgtttgtgtgcatttctcaggcagcacaagttggaggaagccctgctcttttcgggtcagttcatggatgctttgcaggcattggt

SEQ ID NO: 36340 - DNA, 201 bp, Homo sapiens
tccacagaactctcttcatcttgtaaaactgaaactctatacccattaaacaatagcttagaactgaattttaacatgcccgcatcagccagtttcaggtrgccagcataactcccttagcaaagacagcctctttggtggtcaatgaactgaacttgaggtggctgccgtcatgtctggttctgtaggttcaatggtaga

SEQ ID NO: 36341 - DNA, 201 bp, Homo sapiens
aacaagagtgaaactctgtctcacaaagaaaaaagtatatcaagacaccagtctttagcttgatatttctgcttttctatttttaaaatccttttgtgaawtatataaaaatgcaaaattgtgagagttaacaattcttctgtagctatcaaattgtcattcctgtctgaatacagtctgctttgggagaaaaacatagat

SEQ ID NO: 36342 - DNA, 201 bp, Homo sapiens
cttcggcgcctcagcctccaatcctctccaccgctccctccactctcggagtcgctcctctccccggccccgcccccgccgggccccgcccccgccctcgycctcctccctgtgctctccgcgtcgcgcgctccctggcttccagggggctgcccgggcggggcggcgcagcgcggcggcgcggggaagggggaggagagc

SEQ ID NO: 36343 - DNA, 201 bp, Homo sapiens
ggtggagcagatcggagagaataaataccgggtaaggaagagaaaaagcagtcctttgttgtggtggtttctcatatgtggctgatcccaccttttcctcytgatgcttagaggcccagagcccatcggacttgagatgtggtcactctctgacctcatctctatagatgccaagtgtcaggtaccctgttacatctgaaa

SEQ ID NO: 36344 - DNA, 201 bp, Homo sapiens
gctcctcacttcccagtaggggcagccgggcagaggtgcccctcacctcccggacggggcggctggcctggcggggggctgacccccccacctccctcccrgacggggcggctggccgggcggggggctgacccccccacctccctcccggacggggcggctggccgggcggggggctgacccccccacctccctcccgga

SEQ ID NO: 36345 - DNA, 201 bp, Homo sapiens
acaaatagcaaatttttcttttttcttttttttttttttttttgagacggagtctcgctctgtcgcccaggccggactgcggactgcagtggcgcaatctyggctcactgcaagctccgcttcccgggttcacgccattctcctgcctcagcctcccgagtagctgggactacaggcgcccgccaccgcgcccggctaatt

SEQ ID NO: 36346 - DNA, 201 bp, Homo sapiens
tacaggtgtgagccactgcttctggcctttaatgaatttttttttttttttttttttaagacagaatcttactctgccacccaggcgggagtgcagtggcrcaatctcagctcactgcagcctctgcctcccgagttcaagcgattctcctgcgtcagcctcccgagtagctgggattacatgcgtgcaccaccacacctg

SEQ ID NO: 36347 - DNA, 201 bp, Homo sapiens
gcttgcaagtatttaggtgctttttgaggaaaaaaagctgccatagcaataatgcttggggcacagagggggcaattttagtggtctacttttttttttttatctttcctgtatcattgagatttcttccctggaacctagaagaaagaattgcctatatctaaaagtgcttggagataaacgtatagcaaaagggccttt

SEQ ID NO: 36348 - DNA, 201 bp, Homo sapiens
ttttggccgtaggtttccttggtttcaaaattgtagggtatacagactggtgctagactgagagacatcaattctctgtaaaatgaaaaaagataaagaaaatgtagtgtgtctttcataaagctaaacttaaagaattgtcttttattctgaaattgtctctcctactttctaatgttaaaatatcctttattttatgaa

SEQ ID NO: 36349 - DNA, 201 bp, Homo sapiens
atatacacacatatatacacacacacacatatatatcgtatacttgaaaatggctgtgagagtatattttaagtgttttcaccacaaaaaaatgataagtrtgtgaggtaatgcatatgttaaatagcttagcttagccatcccactcctcaaaagaaacgaaagataattattcttccttctgggcttctcgaggacagt

SEQ ID NO: 36350 - DNA, 201 bp, Homo sapiens
tttttggccgtaggtttccttggtttcaaaattgtagggtatacagactggtgctagactgagagacatcaattctctgtaaaatgaaaaaagataaagaaaatgtagtgtgtctttcataaagctaaacttaaagaattgtcttttattctgaaattgtctctcctactttctaatgttaaaatatcctttattttatga

SEQ ID NO: 36351 - DNA, 201 bp, Homo sapiens
ctttttggccgtaggtttccttggtttcaaaattgtagggtatacagactggtgctagactgagagacatcaattctctgtaaaatgaaaaaagataaagaaaatgtagtgtgtctttcataaagctaaacttaaagaattgtcttttattctgaaattgtctctcctactttctaatgttaaaatatcctttattttatg

SEQ ID NO: 36352 - DNA, 201 bp, Homo sapiens
caagatgagcccttcctggactttcccagactctgctacagaatctatatgtaggtgtcttccagagaattcgtagaattgatatctttcctgccttttcktgtaggaactctattcccagctgaaagccaaggaagagacttataatcaactacttgacaagggcagactcatgcttctaagccgtgacgactctgggtc

SEQ ID NO: 36353 - DNA, 201 bp, Homo sapiens
ttagtacacctccgtatctaaatattgccaagtcccgtatttcttttctcagttattgactggatattattataaagatcttctaggtttatacatacagstatttctctttgtatactaaccagctgttctaatcttgtgattatttttccttttagggaaatccctaagtcagccaacccctcctcccatgccaatcct

SEQ ID NO: 36354 - DNA, 201 bp, Homo sapiens; identical to SEQ ID NO: 8042

SEQ ID NO: 36355 - DNA, 201 bp, Homo sapiens
acagtttcttttttttttgagacggagtctcactctgtcgcccaggctggagtgcagtggcacaatctctgctcactgcaagctctacctcccaggttcaygccattctcctgcctcagcctactgagtagctgggactacaggcacccgccaccatgcccggctaattttttgtatttttagcagagacggggtttcacc

SEQ ID NO: 36356 - DNA, 201 bp, Homo sapiens
ttacaggtgcatgctgccattcctggctaatttttgtattttttgtagagatagagtttcaccatgttgccaaggccggccttgaactcctgagctcaaakgatctgcctacctcagcctctcagagtgctggtattacaggaatgagccacagtgcctggcccagagacattttttattgttatgactggaaaagctgct

SEQ ID NO: 36357 - DNA, 201 bp, Homo sapiens
agagatgcagctgcctctggtggacagtttcctgggttgccctttgtactttctttgtttaacagtcaccaggtgaccaagtggcttttctaaaagccaarggccgtggacgacgggattgtgagcgacttttctctagtgttttctatttgagatttgaaatacccatgcttttcatctggtccaaggaggctcaggttt

SEQ ID NO: 36358 - DNA, 201 bp, Homo sapiens
cggatcaaccagctttctgcccgctggcagcaggtgtggctgttagcactggagcggcaaaggaaactgaatgatgccttggatcggctggaggaggtaaygccctgctgagtggccttccctgaaacaaagtgcttttttcaatcaaaacacagcccttctgaggctctcttaatgtgaaccttgtgtcttaatttactt

SEQ ID NO: 36359 - DNA, 201 bp, Homo sapiens
gcgccatgtggccgagttaccaagatgaacacgagttcaacgcccacctggtttgtcgcatgtgctgtatgggttagtatgtgaagtttttttttttttttgcttgtccgggcctgaggatcccaaatagcccttgctctcattgactcataggaatgcatggacttcgaagccttgtggtgttacaacctttaggcttgt

SEQ ID NO: 36360 - DNA, 201 bp, Homo sapiens
gagagagtctcgctctgtggcccaggctggagtgcagtggcacaatctcggctcactgcaacttctacctcccgggttcaagcagttctcctgcctcagcytctcaagtagctgggattacaggcatgtgccaccacgcccagctaattttttttgtattttagttagagtcggggttttaccgtgttggccccagggtgg

SEQ ID NO: 36361 - DNA, 201 bp, Homo sapiens
aagaaagatgtttgtgtcttttatatccttaatagtgggtgattttggcattttaggaaagacattaagtatataccttcaattttctttgtttctgtaaraaagccagtagctgtcaattctcagataacttctgaccacatgtggaaatactggcctgaacctcttccctccactcacccttttcaagatctgcaggta

SEQ ID NO: 36362 - DNA, 201 bp, Homo sapiens
cctcccgggttcaagtgattctcctgcctcagtctcctgagtagctggtaatacaggcatgtgccaccacagccggctgattttgtatttttagtagagayggggtttctccatgttggtcaggctggtctcgaactcctgacctcaggtgatccacctgcctcggcctcccaaagtgctgggattataggtgtgagccac

SEQ ID NO: 36363 - DNA, 201 bp, Homo sapiens
ttttgttttgttttttgagacagagtcctgctttgctctgttgtccaggctggagtgcaatggggcgatctcggctcactgcaacctctgcttcccaggtycaagtgattctcctgcctcagcctcccaagtagctgggattacaggcgtgtgccaccacacctggctgatttttgtacttttagtggagacggggtttca

SEQ ID NO: 36364 - DNA, 201 bp, Homo sapiens
aagccgggaggcacaggttgcagtgagccaagatcatgccactgcactccagcctgggcaacagagcaagactctgtctcaaaaaaaaaaaaagtaaactwtcccccattgacattgacactccatctcctcttcgtctcctttagtattctccatagcatttatgtgacaagctatgtatttacctgtttatatttcttt

SEQ ID NO: 36365 - DNA, 201 bp, Homo sapiens
agtcttaaagttaacagaagttcatgttctggctttgtcacttactagctgtgtaacctagggctattaatcaactttcttaaacctcagtttcttttttyttttttggagacagagtcttgttctgttggccaggctggagtgcagtgacatgatcttggctcactgcaacctccacctcccagttcaagcaattctcat

SEQ ID NO: 36366 - DNA, 201 bp, Homo sapiens
gggaggattacttgagcccggtagtttgaggctgcagcgagctatgattgtgccactgcattccagcttggactacagagtaagaccctgtctcaagaaayggtgatagaaacagcactagcaggctgggcgcggtggctcatgcctataatcccagcagtttgggaggcccaggcggatggatcacctgaggtcaggagt

SEQ ID NO: 36367 - DNA, 201 bp, Homo sapiens
acacttttttcttttaaattcccaggtagatttggaagttcactgttaaaggtggttcgacacccttgttagtgtatgttacctactaggcctctctagargagcattttgagttatttctgccataagatgaatggttttccaggcacttgttctcggttgtatgtttttgtggtcaaaaaagatgcattaccagaagaa

SEQ ID NO: 36368 - DNA, 201 bp, Homo sapiens
agtgttattatgttttggagagatggggtcttgctatgttgcccagggtggtcttaaactcctgtcctcaggcagtcctcctgcctcagcttctcaaagcrctgggattacaggggtgagccactgctcccagccaagcagtttaatttctgaattaataaactatcttccttccagctccaaggaaaagcaaaacttaca

SEQ ID NO: 36369 - DNA, 201 bp, Homo sapiens
gagcccaggagttcaagactagcctgggcaaccccatctgtacaaaaaattacaaaaatgagctggatgtggtggcgcatggaggctgaggtgggcagatygcttgagccccggaggttgaagctgtagtaagctgagactgcgccactacactccagcttgggcaacagagtgagaccctgtctccaaaaataaaaaaag

SEQ ID NO: 36370 - DNA, 201 bp, Homo sapiens
tgcatgagtctgtgaggagtcttaaagaaaagattgttaggagaaacctttggaccatgatctgtagtgtgaccatattggcaacagtatgattcctttgytgttcagtatgattcaaattggtgtgtggcattttctgggtagccaacctctgcatctattccttctaccttttcactgcagacacagtcatactactta

SEQ ID NO: 36371 - DNA, 201 bp, Homo sapiens
ggagtgcagtggtgtgatcatggctcactgcacccttgaactcctgggctcaagggatcttcccacctcagcttcctgagtagcttagactataggtgtgyaccactgcgcctggctaatttttttttctttttgtagagttgggggtcttgttttgttctccaggctagtctcaaactcctggcctcaaatgatgctcct

SEQ ID NO: 36372 - DNA, 201 bp, Homo sapiens
  misc_feature (1)...(201): n = A,T,C or G, or insertion/deletion polymorphism (see Tables 1-2)
aacatttttgttggctgtgcgtgagatcttcctatggaatccacattttaagttctgggtgtgcagccccagaaagccataagacagcgctaactggcttnccgtgccgactccacgttctttgcatcttgatgttcctcctacttgcagttactcctttggccttttattgctttcagtttttcacttaacagtttctca

SEQ ID NO: 36373 - DNA, 201 bp, Homo sapiens
tattagaaagtggagatggataaagaaaggaatttttgtggatatgatatagagaatttttgtttcctaaggatttaaaatttttgtttgtttatttattkgtttattttttagagatggggtcttgcagtgttgcctaggcttgtcttgaactgctgccttcaagtgatcctcctgcctcagcctcctgagtatgtggaa

SEQ ID NO: 36374 - DNA, 201 bp, Homo sapiens
cttaagaaagtgatggggaaaatgttaatattgcagattaaatttaaaagtgtgggccgggtgtggtggctcacgcctgtaatcccagcacttggggaggytgaggcgggtggatcacaaggtcgggagattgaggccaacatggtgaaaccccgtctctactaaaaatacaaaaattagctgattgtggtggtgcgcacc

SEQ ID NO: 36375 - DNA, 201 bp, Homo sapiens
gtgcagtggtgcaatctcggctcactgcaagctctgcctcccgggttcgcgccattctcctgcctcagcttcccgagtagctggaactacaggcacccacsaccatgcccggctaattttttgtatttttagtagagacagggtttcaccgtgttagccaggatggtctcgatctcctgacctcgtgatctgcccacctcg

SEQ ID NO: 36376 - DNA, 201 bp, Homo sapiens
ccttaatccattctagagggtggtttgatttaaaatgtctcaccatctctcagtcactttttactctatttcttttttttttttttttttttgagatggartctcgctctgtctcccaggctggagtgcagtggtgcaatctcggctcactgcaagctctgcctcccgggttcgcgccattctcctgcctcagcttcccga

SEQ ID NO: 36377 - DNA, 201 bp, Homo sapiens
tctctactaaaaatacaaaaaaattagctgggcgtggtggcgggtgcctgtagtcccagctacacgggaggctgaggcaggagaatggcatgtacctgggwggtggagcttgcagtgagccgacatggcaccactgcactccagcctgggcgacagagcgagactccgtctcaaaaaaaaaaaaacaaaaaaggaaaaaga

SEQ ID NO: 36378 - DNA, 201 bp, Homo sapiens
tggatgtggtggcgggcgcctgtaatcccagctactcgggaggctgaggcaggagaatcgcttgaacccgggaggcagaggttgcagtgagctgagatgaygccattgcactccagcctgggcaacagagcaagactccaccttaaaaaaaaaaaaaaaaagaatttaaaccctgacctcacacaacatataaaacttaac

SEQ ID NO: 36379 - DNA, 201 bp, Homo sapiens
aggtggatcacgagatcaggagttcgagaccagcctggccaacattgtgaaaccccatttctactaaaaatacaaaaattagctggatgtggtggcgggcrcctgtaatcccagctactcgggaggctgaggcaggagaatcgcttgaacccgggaggcagaggttgcagtgagctgagatgacgccattgcactccagcc

SEQ ID NO: 36380 - DNA, 201 bp, Homo sapiens
gctaggaaaataaagaccacttaggaccattcagggccacacactgcttacaaaacccagtgtggagtagaaaaagcactggaggccgggcgcggtggctytgcctataatcccagcactttgggaggccgaagcgggtggatcacaaggtcaggagatcgagagcatcctggccaacatggtgaaatcccgtctctacta

SEQ ID NO: 36381 - DNA, 201 bp, Homo sapiens
agccaggatggtctcgatctcctgaccttgtgatccgcccgcctctgcctcccaaagtgctgagattacaggcgtgagccaccgtgcccagcctctccttrccctttagttctctttacctggaatgcccttgttctttatacttaactgaaatctgtctattccttcaagtttcacttcaggtctttcttctgatgaaga

SEQ ID NO: 36382 - DNA, 201 bp, Homo sapiens
cgagtagctgggactacaggcacctgccaccatgcccagctaatttttttttttttgtattttttagtagagatggggtttcaccttgttagccaggatgktctcgatctcctgaccttgtgatccgcccgcctctgcctcccaaagtgctgagattacaggcgtgagccaccgtgcccagcctctccttgccctttagtt

SEQ ID NO: 36383 - DNA, 201 bp, Homo sapiens
gctgggtgtggtgacaggcacctataatctcagctattcaggaggctgaggtaagagaatcgcttgagccaaggctttggaggttgcagtgagctgagatygcgttactgcactccagcctgggcaacagggcgagactccgtctcaaaaaaaaaaaaaaagagagagagaatttggtttttaaaaatattttatgttgaa

SEQ ID NO: 36384 - DNA, 201 bp, Homo sapiens
tacaggtgtgagccaccatgccctactggcactagatatttatttatttatttaaccatgccctgccagcactagatatttatttatttatttatttattyattcattcattcattcattcgagatggaatttcgctcttattgcccaggctggagtgcagtggtgcgatcttggctcactgcaacctccgcctcctgggt

SEQ ID NO: 36385 - DNA, 201 bp, Homo sapiens
tatgatcatgccactgcactacagcctgggtgacagagtacaccctgtctctctgtcttttttttttgcaatctccgcctcccgggttcaagcaattcttrtacctcagcctcctgagtagctgagattacaggcatgagccactgtgcctggctaattttttgtatttttagtagagatggggtttcgccatgttggcca

SEQ ID NO: 36386 - DNA, 201 bp, Homo sapiens
ctttgggaagctgaggcaggaggatcagttgaggctaggagtttgagaccatcctgggcaacagtagcaaaaccctgtctctaaaaacaagcaaacaaacraaaaaacaatacaaaaactagccggtggctgggcacggtggctcacacctgtaatcctagcacttcaggaggctgaggcgggcggatcacaacgtcagga

SEQ ID NO: 36387 - DNA, 201 bp, Homo sapiens
gtaggcaaaaacagctggaagacatcctggttctggccaaacagttccatgagacagctgagcctatttctgacttcttatctgtcacagagaaaaagctkgctaactcagaacctgttggcactcagactgccaaaatacagcagcagatcattcggcacaaggtagggagtggttacagtaaatgaaaatagaaaactg

SEQ ID NO: 36388 - DNA, 201 bp, Homo sapiens
ggccgagggaggcggatcacttgaggtcaggaggtcaagaccagcctggccaacacggtgaaactccatttctactaaaaatacaaaaaaaaaaaaaaaaatttgccgggcgtgatggcaggcccctgtaatcccagctactcgggaggctgaggcaggagaatcagagaatcgcttgaacctgggaggtcgagtttgcag

SEQ ID NO: 36389 - DNA, 201 bp, Homo sapiens
atgtggtggtgcacgcctgtagtcccagctacttgggaggcttaggcatgagaattgcttgaccaaggaggcggagtttgcagtcagctgagattgcgccmctgcactctagctgcctgggcaacagagcgagactctgtctcaaaaaaaaaaaagattgggctgggcacagtggctcatgtctgtaatcccaacactttg

SEQ ID NO: 36390 - DNA, 201 bp, Homo sapiens
atggtctcaattttctgacctcgtgatccacccgcctcagcctcccaaagtgctgggattacaggcgtgagccaccgcgcctggcatttttttttttttttgtcatgttgagacagggtctagctctctggcccaggctggagtgcagaacttactgcagcctccaactcctgggctcaagggatcctcccacctcagcct

SEQ ID NO: 36391 - DNA, 201 bp, Homo sapiens
cacccaggctggagtgcagtggcgcgatctcggctcactgcaagctccgcctcccaggttcacgccattctcctgcctcagcctcccgagtagctgggacyacaggcacccgccaccacgcctggctagttttttgtatttttagtagagaagggatttcactgtgttagccaggatggtctcaattttctgacctcgtga

SEQ ID NO: 36392 - DNA, 201 bp, Homo sapiens
caaaaatcaaattctcttctctacaaaataatgaaagatgactagggatcaaggtgtttgcccaaaaagattattttttatgagtacagagtttcactgtrttttttgctgctcagatcaagtatgaaatatatacatacacaaacctgttgaccacattcactcaatgaatagttattgagcaagtgtgtgccaagtcct

SEQ ID NO: 36393 - DNA, 201 bp, Homo sapiens
ctcattatctagagataacagttgttacattgacatacttttttctagtttttggtgctatttttcttttcttttcttttcttttcttttcttttcttttyttttttttttttttggagacagggtctcactgggtcacccaggctggattgcagtggcatgatcttggttcactgcagcatccacctcccgggctcaagc

SEQ ID NO: 36394 - DNA, 201 bp, Homo sapiens
aaaggattcccaatatggccaaacaccacaggcaattttcatttttcttttggaaacatttattctggaccattctatctttttttttttttttttagtcyggacctgttctgtaggcctgattcagtcagtactgtctctgtgatacgtggacccactaattactagattccaagtcttatttattagtgtactccctgg

SEQ ID NO: 36395 - DNA, 201 bp, Homo sapiens
gtgagccactgcacctggcccctgttttatttactttcttatataatttttgtttccttggagtgggtaattgttttgttttttagtttgcttagttgtcyccaaactctcctacattactgtaaaaggattcccaatatggccaaacaccacaggcaattttcatttttcttttggaaacatttattctggaccattcta

SEQ ID NO: 36396 - DNA, 201 bp, Homo sapiens
tgggaggccgaggcgggtggatcacctgaggtcaggagttcgagaccagcctggccaacatggtgaaaccccgactctaccaaaaatacaaaaattagccrggcatggtggcacatgcctgttatcctagctacttgggaggctgaggcaggagaatctctggaacctgggaggcagaggttgcagtgagccaagattgcg

SEQ ID NO: 36397 - DNA, 201 bp, Homo sapiens
ctggagtgcagtggtgctatctcagctcactgcaacctctgcctctcgggttcaagtgattgtcatgcctcagcctccctagtagctgggactacgggcgygcgccaccacacccggctaattttttgtatttttagtagggacggcgtttcaccatgttggccaggctggtcttgaactcctgacctcaggtgatccaca

SEQ ID NO: 36398 - DNA, 201 bp, Homo sapiens
cccaggaaaagccaagcttagttatggatcttatattaaataagagttaagattccaagtgagctataaagtctgtagttttttttgtttggtttttttttggggggggtgctttttgtgttggcaaattcagccagcgtgaggttttttgtttgtttcttttttgtttttttgccttaaatctggattcaaagttatgtt

SEQ ID NO: 36399 - DNA, 201 bp, Homo sapiens
ttgtatttttagtagagacggggtttcaccatgttggccaggctggtctcgaactcctgacctcaagtgatccacccacctcggcctctcaaagtgttggkattacaggcgtgagccactgcacctggcccctgttttatttactttcttatataatttttgtttccttggagtgggtaattgttttgttttttagtttgc

SEQ ID NO: 36400 - DNA, 201 bp, Homo sapiens
agtgagccaagataccgccattgtactccagcctggatgacaggagtaaaactctgtctcaaaaggaaaaaaaaaaaaaaaaatgtttgtttgttttttttaaacttttcactgagttgcatatttattgttttgatctagcatttgacctggcaagcatacctctttccttattcctttttagagtatatttataaggat

SEQ ID NO: 36401 - DNA, 201 bp, Homo sapiens
aatcctactcttttttcactttttggctatattagacaatgctgctgagaacatggttaagaatgatttgacttctgttatttccttataatgaaatcctyggagagtacagttttacttgtatcgccttccaaaagtgttctacatgctgacctttcacacgacgtgaaggctggggctacctcctgtggtgggatgtgc

SEQ ID NO: 36402 - DNA, 201 bp, Homo sapiens
gacctctgtgtgcccgcggagagtccctccctcgcccccttttgtctctttgagtctcggatgagtcgcgtggaagccgaggttggaaagcaccttggtgkcttcggggtggggtgggcagcggtgtgggtgagtgtgcagtttttggtggcgagaccttaccccctccatctccccgggggtctgggcctgctggaggta

SEQ ID NO: 36403 - DNA, 201 bp, Homo sapiens
gatgcttgcttatggggggaaattgaacagattttttttcctcttgtttaccctttaccttttttaaaatgttatctgccactgttttttttttttttcaracagtctcgctctgtcgctgcaacctctgccttccaggttcaagcgattctcctgcctcagcatcccaagtaactgggattacaggtgtcccctaccacg

SEQ ID NO: 36404 - DNA, 201 bp, Homo sapiens
atccttcagttaagcagatgtgtatttcctgcaaccccatgtttggggttgcttggagaagtagcagacgttggctgtgatttgaggagtctccatttgcrtgaccgtaggccctttaaacttaacatggcaaaaacagaatgtttgagttttcttcttaaatatgcttcttacttgtctttcctatctcaggaaatagta

SEQ ID NO: 36405 - DNA, 201 bp, Homo sapiens
gtctttaaatataacaagtgttataggccacggtggctcacacctgtaatcccagcactttgggaggccaaggcgggcagatcacctgagatcaggagttytagaccagcgggaccaacatggagaaaccccgtctgtactaaaaatacaaaattagctggcgtggtggcccatgcctgtaatcccagctacttgggaggc

SEQ ID NO: 36406 - DNA, 201 bp, Homo sapiens
gactgactggatgaacattctttatttctcataagccatgtgagctctaggattcaaaatgctatctactctgcaagacttgaggtatatatccttgtgtrtcctgaagaaattctaatcttagcctgatttcctcagttctccatctttcttctgggcttccttccttctctgctagttagtatatgttaagggaacaca

SEQ ID NO: 36407 - DNA, 201 bp, Homo sapiens
ccacacacccggctaattttttgtatttttagtagagagggggtttcaccgtgttagccaggatggtctcgatcttctgacctcgtgatctgcccgcctcrgcctcccaaagtgctgggattacaggcgtgagccaccgcacctggcaattattttattttttttatagagatgggatcttgcaatgttttctaggctagt

SEQ ID NO: 36408 - DNA, 201 bp, Homo sapiens
gatcgcgccactgcactccagcctgggcgacagcgagactccgtcaaaaaaaaagaagaaaaagaaagagagagagagagagagagagaaagagagagagaaagaaaagaaaagaaagacgaaatagttaatgagtgccctatatgtgccagatcatttgctaggtgctaaggatcctgtggtgaattagacgacaaacag

SEQ ID NO: 36409 - DNA, 201 bp, Homo sapiens
agatcgcgccactgcactccagcctgggcgacagcgagactccgtcaaaaaaaaagaagaaaaagaaagagagagagagagagagagagaaagagagagagaaagaaaagaaaagaaagacgaaatagttaatgagtgccctatatgtgccagatcatttgctaggtgctaaggatcctgtggtgaattagacgacaaaca

SEQ ID NO: 36410 - DNA, 201 bp, Homo sapiens
ctgaaaataatacttaatggcataaagacaaaggaagagacactaaagaataaaaagaaaagtttttagttacactaggtattagactttgaaggtcttcmctcttcccacccatctctacctatgaccttgaagagtagcgcatcttaaactcttcatagtgtaaaatgggtttctggcttcatgcctttcttccatgag

SEQ ID NO: 36411 - DNA, 201 bp, Homo sapiens
agtaagccgagatcgcgccactgcactccagcctgggcgacagcgagactccgtcaaaaaaaaagaagaaaaagaaagagagagagagagagagagagaaagagagagagaaagaaaagaaaagaaagacgaaatagttaatgagtgccctatatgtgccagatcatttgctaggtgctaaggatcctgtggtgaattaga

SEQ ID NO: 36412 - DNA, 201 bp, Homo sapiens
aacttcttttactcaatgaagcttaggatttggcgggttggtttcttttgttttttttctttcttcctagttcagatttcaaaatgatcctgtgttacagyttttcattctctttataatagttgctccagcggctcctagatgatcgaaaggccacagtagacatgcttcaagcagaaggaggcagaatagcccagtcag

SEQ ID NO: 36413 - DNA, 201 bp, Homo sapiens
cagtaagccgagatcgcgccactgcactccagcctgggcgacagcgagactccgtcaaaaaaaaagaagaaaaagaaagagagagagagagagagagagaaagagagagagaaagaaaagaaaagaaagacgaaatagttaatgagtgccctatatgtgccagatcatttgctaggtgctaaggatcctgtggtgaattag

SEQ ID NO: 36414 - DNA, 201 bp, Homo sapiens
cctgcagtaagccgagatcgcgccactgcactccagcctgggcgacagcgagactccgtcaaaaaaaaagaagaaaaagaaagagagagagagagagagagagaaagagagagagaaagaaaagaaaagaaagacgaaatagttaatgagtgccctatatgtgccagatcatttgctaggtgctaaggatcctgtggtgaa

SEQ ID NO: 36415 - DNA, 201 bp, Homo sapiens
agcctgcagtaagccgagatcgcgccactgcactccagcctgggcgacagcgagactccgtcaaaaaaaaagaagaaaaagaaagagagagagagagagagagagaaagagagagagaaagaaaagaaaagaaagacgaaatagttaatgagtgccctatatgtgccagatcatttgctaggtgctaaggatcctgtggtg

SEQ ID NO: 36416 - DNA, 201 bp, Homo sapiens
tacagtggcacaatcttggctcactgcagcctctacctcccgggttcaagcaattctcctgccccagcctccgaagtagttgggattacaggaatgtgccmccacacccagttaatttttttttttttttttttttttttttttttggatttttagtagagacagggtttcactgtgttggccaggctggtctcgaactcc

SEQ ID NO: 36417 - DNA, 201 bp, Homo sapiens
cattataaaacaagaaaattgggctaaatgtcctcttgggtctctcttggctctaagattctttttattttttttttttagatggagtctggctctgtcastcaggctggagtgctagagtgcagtggtgcgatctcagctcactgcaagctccacctcccgggttcacgccattctcctgcctcagcctcccgagtagct

SEQ ID NO: 36418 - DNA, 201 bp, Homo sapiens
cccaccccagaggagcccgcctccccagctgctgcagtgcccaccccagaggagcccgcctccccagctgctgcagtgcccaccccagaggagcctgcctycccagctcctgcagtgcccaccccagaggaatccgcctccgcagctgttgcagtgcccacccccgaggaatctgcctccccagctgctgcagtgcccacc

SEQ ID NO: 36419 - DNA, 201 bp, Homo sapiens
cagtgcccaccccagaggagcccgcctccccagctgctgcagtgcccaccccagaggagcccgcctccccagctgctgcagtgcccaccccagaggagccygccttcccagctcctgcagtgcccaccccagaggaatccgcctccgcagctgttgcagtgcccacccccgaggaatctgcctccccagctgctgcagtgc

SEQ ID NO: 36420 - DNA, 201 bp, Homo sapiens
agtgcccaccccagaggagcccacctccccagctgctgcagtgcccaccccagaggagcccacctccccagctgctgcagtgcccaccccagaggagcccrcctccccagctgctgcagtgcccaccccagaggagcccgcctccccagctgctgcagtgcccaccccagaggagcccgcctccccagctgctgcagtgcc

SEQ ID NO: 36421 - DNA, 201 bp, Homo sapiens
ctccccagctgctgcagtgcccaccccagaggagcccacctccccagctgctgcagtgcccaccccagaggagcccacctccccagctgctgcagtgcccmccccagaggagcccacctccccagctgctgcagtgcccaccccagaggagcccacctccccagctgctgcagtgcccaccccagaggagcccacctcccc

SEQ ID NO: 36422 - DNA, 201 bp, Homo sapiens
agtgcatgctccagaggagcctgatactgcagctgtcagagtgtccaccccagaggagcccgcctccccagctgctgcagtgcccaccccagaggagcccrcctccccagctgctgcagtgcccaccccagaggagcccacctccccagctgctgcagtgccccccccagaggagcccacctccccagctgctgcagtgcc

SEQ ID NO: 36423 - DNA, 201 bp, Homo sapiens
gaggtaagtgagcttatcctttgctgagacttggggtttgctggtctgtactgttgttgcttcttgattatagattccttgtattcttttcccaaactgcrttaatagaagtactctcctggtgacaaataatagcaccactctcaggctggtcttaaaatgttgtggtaaaggggcaatgtcagccatctctgtttttta

SEQ ID NO: 36424 - DNA, 201 bp, Homo sapiens
tcaacatagtacctaggcaactaaatatttcacagaaccacagaattttagagctggaaaagaatttagagatctagaatgtgaactcattttatgaatgrgtaaacagatccagtgtagttaaacgatcctgaagtcatttaataagccaagaacagaactggacctataatcgtctctagttctgtaatgtctaaatgc

SEQ ID NO: 36425 - DNA, 201 bp, Homo sapiens
aaaatggttgcccaaagtaaattacctcgagttgtatacggtggtcgtgcagtctgctcttctgatcggtgcagaacaatctctcttccccccactgcacmgttctcactgggaggtcagagtggcttagcatccgggcctttgttactttgcttatggaattcctgcattttccagacttagaaatccccgtactacctt

SEQ ID NO: 36426 - DNA, 201 bp, Homo sapiens
ccaagtgacaatatgaatgttattgttagcagtatgattactttgaagtcacttgaaataatttctctctattgttgttaagccacaaattcaatacacarttaaggttcatttgtttttatttgctttcagttttggggggttgcttttttcctttcaattttaccttacattatgtagatcatttatattgttccaaag

SEQ ID NO: 36427 - DNA, 201 bp, Homo sapiens
ccgttctccctaaaaacgacttctcatggaataaaaaaggatttaaaaattgccagagggagcaccgagctttgactgcagttttccctgtcatctcttaratgaagggaaggtgtgagaaatgtgcgtctgtccctgactgctgtcaccgcttctgagtttagtaaaaagatgagaaatgaaggtagcagacttctcatc

SEQ ID NO: 36428 - DNA, 201 bp, Homo sapiens
gttcactcatcgatgttctctgttacagtactcattgaggactgggattgtattatgctactttctctgttaagtgctgcacatagcacatgagaagtatmcaataagtacttgttaccttgagtaactaatatttcaatagtgttatagcgtatgaagcacattcttatctgtcttaatccttaaaataaccctgaagta

SEQ ID NO: 36429 - DNA, 201 bp, Homo sapiens
gctactcgggaggctgaggcaggagaatggcgtgaaccccggggggcggagcctgcagtaagccgagatcgcgccactgcactccagcctgggcgacagcragactccgtcaaaaaaaaagaagaaaaagaaagagagagagagagagagagagaaagagagagagaaagaaaagaaaagaaagacgaaatagttaatgag

SEQ ID NO: 36430 - DNA, 201 bp, Homo sapiens
tgcgccattgcactctagcctgggtgacagagtgagactccgttgcaaataaataaataaattaaattaaattaaataaagtaaacaaatatacaaacgcrcgcgcgcgtgtgtgtgtgtgtgtatgtatatttttagagaccaaattttgccatgttacccaggctggtcttgaactcctgggctcaagcgatcctcctg

SEQ ID NO: 36431 - DNA, 201 bp, Homo sapiens
gactgcgccattgcactctagcctgggtgacagagtgagactccgttgcaaataaataaataaattaaattaaattaaataaagtaaacaaatatacaaaygcgcgcgcgcgtgtgtgtgtgtgtgtatgtatatttttagagaccaaattttgccatgttacccaggctggtcttgaactcctgggctcaagcgatcctc

SEQ ID NO: 36432 - DNA, 201 bp, Homo sapiens
atgtgcatgtgtgcacacacacacactcactactagcaaagaatttcttttttttgagatggagttttgctcttgttgcccaggttggaatgcaatggcaygatctaggctcactgcaacctctgcctcctgggttcaagcgattctcctgcctcagcctcccaagtagctgggattacaggtgaccaccatcacgcccgg

SEQ ID NO: 36433 - DNA, 201 bp, Homo sapiens
cagatctgccccccctttcctcattcagaggcctgtgatgtctggagttcctccttttcctcacatctagccactcaccagggcttgtcagtcccactttmaaaatacctcttggttccatctttcctgccctggctctggccctcaccatgttttgcctcagttgctgcaatggtttcttaacctgtcttctcactgcta

SEQ ID NO: 36434 - DNA, 201 bp, Homo sapiens
aggatcacttgagcctgggaggttgaggcagcagtgagccatgttcatgccactgtactgtagcctgggtgacaaagtgaaaccctgtctcaaaaaaaaaraaattcatcaagggaatgagttccatttttgttataggggcctgtgccccaggactgccctgatgctggtgaactgcttcacgtgactctgatctcaact

SEQ ID NO: 36435 - DNA, 201 bp, Homo sapiens
ggaggctgcagtgacccatgatcgcaccactgcagctgtgatcatcatcatccagcctgggtgacacagtgagaccctgtctcaaaaaaaaaaaaaaaaaattgcaggaaagattgagtcttgctttgggaggaaaaagaaacaggtgaaaggagggcaggagggcagaaagattctgttttctaagacttgacttgcttc

SEQ ID NO: 36436 - DNA, 201 bp, Homo sapiens
tgatctgcccaccttggcctcccaaagtgctgggattacaggtgtgagccatcacgcccggccaagggattcttttcttttttttgagacggagtcttgcrcttttgcctaggctggagtgcagtggtgtgaacttggctcactgcaacctctgcctcccgggttctcctgtctcagcctcctgagtagctgggattacag

SEQ ID NO: 36437 - DNA, 201 bp, Homo sapiens
caggctggagtgcagtggtgcgatctcggctcactgcaacttctgcctgccgggttcaagtgattctcctgcttcagcctcccgagtagctgggactacasgcacacgccatcacacccagctaatttttgtatttttagtagacacggggtttcatcatgttggccaggatggtcttaatctcttgaccttgtgatctgc

SEQ ID NO: 36438 - DNA, 201 bp, Homo sapiens
ctcctgggttcaagggattctcctgcctcagccttctgagtagctggaataacatgtgcgcgccaccacgcctggctaattttttttttttttttttttttgagacggagtcttgccctgtcaccaggctggagtgcagtggtgcgatctcggctcactgcaacttctgcctgccgggttcaagtgattctcctgcttcag

SEQ ID NO: 36439 - DNA, 201 bp, Homo sapiens
ctgtctacctggaaatagcatcagatctcacagtttgagggttcagtccccaagacattcccctactccacttctttttttttttttttttttttttttttgagatgatgtcttgctcttgttgcccaggctggagtgcaatggctcaatctctgctcattgcaaccaccgcctcctgggttcaagggattctcctgcctc

SEQ ID NO: 36440 - DNA, 201 bp, Homo sapiens
aagcccctccttcggcgcctcagcctccaatcctctccaccgctccctccactctcggagtcgctcctctccccggccccgcccccgccgggccccgcccycgccctcgtcctcctccctgtgctctccgcgtcgcgcgctccctggcttccagggggctgcccgggcggggcggcgcagcgcggcggcgcggggaagggg

SEQ ID NO: 36441 - DNA, 201 bp, Homo sapiens
gagcgagatcgtgccactgcattccagcctggcaacagagtgagactctgcctcaaaaaaataaataaataagtaagtaaataaataaataaataaataaataaataaataaaatgaaatagaataaaacggtttttttttgctgggcatggtggctcatgctgtaagcccagttgggaggcttaggcaggtgcatcactt

SEQ ID NO: 36442 - DNA, 201 bp, Homo sapiens
tgagcgagatcgtgccactgcattccagcctggcaacagagtgagactctgcctcaaaaaaataaataaataagtaagtaaataaataaataaataaataaataaataaataaaatgaaatagaataaaacggtttttttttgctgggcatggtggctcatgctgtaagcccagttgggaggcttaggcaggtgcatcact

SEQ ID NO: 36443 - DNA, 201 bp, Homo sapiens
atgagcgagatcgtgccactgcattccagcctggcaacagagtgagactctgcctcaaaaaaataaataaataagtaagtaaataaataaataaataaataaataaataaataaaatgaaatagaataaaacggtttttttttgctgggcatggtggctcatgctgtaagcccagttgggaggcttaggcaggtgcatcac

SEQ ID NO: 36444 - DNA, 201 bp, Homo sapiens
aatgagcgagatcgtgccactgcattccagcctggcaacagagtgagactctgcctcaaaaaaataaataaataagtaagtaaataaataaataaataaataaataaataaataaaatgaaatagaataaaacggtttttttttgctgggcatggtggctcatgctgtaagcccagttgggaggcttaggcaggtgcatca

SEQ ID NO: 36445 - DNA, 201 bp, Homo sapiens
ctcatgcctgtaatcccagcattttgggaggctgaggcaggtggatcacgctgtcaggagatcgagaccattctggccaacatggtgaaaccccatcttakccgggcatggtggcatgcgcctgtagtcccagctacacaggaggctgaggcaggagaatcgcttgaacccaggaggtggaggttgcagtgagccgacatc

SEQ ID NO: 36446 - DNA, 201 bp, Homo sapiens
taccgggggacctaggtatcctactatgaaaacagaataagaaagtcttgtaaacgccttcatttgattgattgattgattgattgattgattgattgatttattgccacatagaaagcaagcttaggcatcttcatgtgcacatgagaaaagccctggaagaggctgggggcggtggctcacgcctgtaatcccagtact

SEQ ID NO: 36447 - DNA, 201 bp, Homo sapiens
ctaccgggggacctaggtatcctactatgaaaacagaataagaaagtcttgtaaacgccttcatttgattgattgattgattgattgattgattgattgatttattgccacatagaaagcaagcttaggcatcttcatgtgcacatgagaaaagccctggaagaggctgggggcggtggctcacgcctgtaatcccagtac

SEQ ID NO: 36448 - DNA, 201 bp, Homo sapiens
tctaccgggggacctaggtatcctactatgaaaacagaataagaaagtcttgtaaacgccttcatttgattgattgattgattgattgattgattgattgatttattgccacatagaaagcaagcttaggcatcttcatgtgcacatgagaaaagccctggaagaggctgggggcggtggctcacgcctgtaatcccagta

SEQ ID NO: 36449 - DNA, 201 bp, Homo sapiens
ttctaccgggggacctaggtatcctactatgaaaacagaataagaaagtcttgtaaacgccttcatttgattgattgattgattgattgattgattgattgatttattgccacatagaaagcaagcttaggcatcttcatgtgcacatgagaaaagccctggaagaggctgggggcggtggctcacgcctgtaatcccagt

SEQ ID NO: 36450 - DNA, 201 bp, Homo sapiens
ataggtgtgagccaccgcgcctggcccgagatggggtttcaccatgttggtcaggctggtcttgaactcctgacctcaggtgatccgcttgccttggcctyccaaaatgctgggattacaggcgtgagccaccgcacccggccctgtacattgttatttctatttccttaggcaatacctggcaaccagcccagtctgaat

SEQ ID NO: 36451 - DNA, 201 bp, Homo sapiens
ttttagtagagacggggtttcaccatgttagccaggatggtctccatctcctgacctcgtgatccgcccgcctcagcctcccaaagtcctgggattatagrtgtgagccaccgcgcctggcccgagatggggtttcaccatgttggtcaggctggtcttgaactcctgacctcaggtgatccgcttgccttggcctcccaa

SEQ ID NO: 36452 - DNA, 201 bp, Homo sapiens
ctctttgtcagccacgcttggcgggcgcgcggacccacccgcgccgccccaggctcgcgggcgcgcccctcctccgccgtggggaaacgggtgggggccakgtggggagggtcgcagggggtgagagcacctggtgaggtgcctgtcgccgaccggcctgcggcctagggggtgggctggggcttgggcgggcactcctgt

SEQ ID NO: 36453 - DNA, 201 bp, Homo sapiens
tcgcccccggcggccgcgccccagctcccggcagccggcggccgcggacaggcggcttgacaggcgcgggcacagcggcagtgcgggcctcgcacctgcakcccccgcggccggcgccggggagcggcgaagactcggagctggggtttcccctctgcgggcgctgccagggtggaagggaggcgtgttccccgggaaaat

SEQ ID NO: 36454 - DNA, 201 bp, Homo sapiens
cttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgcccatatggtagctgttgctacgcaggttact

SEQ ID NO: 36455 - DNA, 201 bp, Homo sapiens
tcttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgcccatatggtagctgttgctacgcaggttac

SEQ ID NO: 36456 - DNA, 201 bp, Homo sapiens
atcttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgcccatatggtagctgttgctacgcaggtta

SEQ ID NO: 36457 - DNA, 201 bp, Homo sapiens
ggtcaacaggcagggatgaaatgcatcttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgcccata

SEQ ID NO: 36458 - DNA, 201 bp, Homo sapiens
tggtcaacaggcagggatgaaatgcatcttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgcccat

SEQ ID NO: 36459 - DNA, 201 bp, Homo sapiens
atggtcaacaggcagggatgaaatgcatcttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgccca

SEQ ID NO: 36460 - DNA, 201 bp, Homo sapiens
caggcaattctcctgcctcagcctcccgagtagctgggactacaggcacacaccaccacacccagctaattttttgtacttttagtagagacggggtttcrccatgttggccaggctggtcttgaactcctgacctcgtggttcacctgccttagccttccaaagtgctggaattataggcatgagccaccttgcccagtc

SEQ ID NO: 36461 - DNA, 201 bp, Homo sapiens
tgccaccgcagtccagcgtgtaacagagtgagaccctgtctcaaaaaaaaaagaaagaaagacagagagagagggagggagggagagagagagagagagaraaagaaagagagaaagaaaagaaaggaaggaaggaaagaaaagaaagaaagagaaagaaagaacgaacgaacgaacaatgggaaaaattgactgacagac

SEQ ID NO: 36462 - DNA, 201 bp, Homo sapiens
ccagaatgagacgggcagtggagtttaatttaagaaattgacaaagtagtgctggttagatgctaaggaaaggagtgttacctttgttgcctacatgtgaytatatggtagtggtttgtggctgtctttgcctggacctgattttttagggcttaatttcactctaaatgcttctcaggtctacatatgggcctatatttg

SEQ ID NO: 36463 - DNA, 201 bp, Homo sapiens; identical to SEQ ID NO: 7691

SEQ ID NO: 36464 - DNA, 201 bp, Homo sapiens; identical to SEQ ID NO: 7694

SEQ ID NO: 36465 - DNA, 201 bp, Homo sapiens
cccacctcagcctcccaagtagctgggactatagacacacgccaccatgcccagctgatttttttttcttttttttttttgagacagagtctcactctgtygccccagctggagtgcagtggcacgatcttggatcactgcaacctccgcctcctcggttcaagcaatcctcctgcctcagcctcccaagtagctgggact

SEQ ID NO: 36466 - DNA, 201 bp, Homo sapiens
tagccgggtgtggtggcgggtgcctgtagtcccagctgctcgggaggctgaggcaggagaatggcatgaactcgggaggcgaagctgacagtgagccgagwtcgcaccactgcactccagcctgggcaacagagcgagaatccgtctcaaaaaaaaaaaagtggcattgttttatgtctttgcaaatcttaatttctggct

SEQ ID NO: 36467 - DNA, 201 bp, Homo sapiens
ttgggaggctgaggcaggagaatcatttgaacccaggaggctgaggttgcagtgtcctgtccggacagtagagcgtgactccgtctcaaaaaaaaaaaaawtttttttttacttgtaatcccctgtgatagtgatccacattacttaatatcttatatctgccggctttacataggattttctgtgatcaaacctcaaaaa

SEQ ID NO: 36468 - DNA, 201 bp, Homo sapiens
gcaacatagcaagatcctgtctctacaaaaagcaaggaaaaacaaattagccaggtgtggtggcatgagcctggagtcctagctactggggaggctgaggygagacgattgcttgagcccaggagttcaaggctgcagtgagctatgattgtgccactgaactccaacctgggcaacagagagggaccttgtctccaaaaa

SEQ ID NO: 36469 - DNA, 201 bp, Homo sapiens
aaacgtggaatttttttttttttttgagacggagtctcgctctgtcgcccaggctggagtgcagtggcgcgatctcggctcactgcaagctctgcctcccrggttcacgccattctcctgcctcagcctcctgagcagctgggactacaggtgcctgccaccgcgcctggctaattttttgtatttttagtagagacgggg

SEQ ID NO: 36470 - DNA, 201 bp, Homo sapiens
ccagcactttgggaggccgaggaaggtggatcacttgacaccagaagttcaagaccagcctgagcaacatagtgagaccaccatctccacaaaaaaaaaaattaggtgtggtggtgcatgcctgtagtcctagctacttgggggctgagaaaggaggatcccttgagcccaggaggtcatggctgcagtgagctatgattg

SEQ ID NO: 36471 - DNA, 201 bp, Homo sapiens
aaggccaggagttcaagaccagcttgggcaacatattaagaccacatccatataataataataataataataatttttattatttattatttaataatattaataataaagtctttaaaagcataatacaaaaattgtctccactctttcttttcatggcctgatttttcagattccatactcagccacttccaaagcctc

SEQ ID NO: 36472 - DNA, 201 bp, Homo sapiens
cttactcctctgggcccatgtgtctctcctccaagttgggagctctgagaagacatctcacaggcacctctctgcttcattcattcattcaataaaaaaaatggattaagctcctgccatgtgccaggcactgcggagataactgaatctggagttacaagacttaggcaaatgacctcacttcttggatcctcagtttcc

SEQ ID NO: 36473 - DNA, 201 bp, Homo sapiens
tgtttgggtggtctctcctctaaaaagtcattgtgttggccgggagcagtggatcacgcctataatcctagaactttgggaggcttgaggcggtcagattmcctgactcaggagttcaagacaagcctgggcaacatggtgaaacccatctctactaaaatacaaaaaattagctgggtatggtggcacaagtctgtaatc

SEQ ID NO: 36474 - DNA, 201 bp, Homo sapiens
catggtcaacaggcagggatgaaatgcatcttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgccc

SEQ ID NO: 36475 - DNA, 201 bp, Homo sapiens
tccttcctctctttcttgatggaattttcactcttgttgcccaggctggagtgcaatggcacaatctcggctcatcacaacatccgcctcccgggttcaartgattctcctgcctcagcctcctgactagctgggattacaggcatgcgccacaacgcctggctaatttttttgtatttttagtagagacagggtttctcc

SEQ ID NO: 36476 - DNA, 201 bp, Homo sapiens
ttacttttgctgttactttgacacctttcttggctgcttataataattaaatttaggtcaaatttcttttccttccttccttccttccttccttccttccttcctctctttcttgatggaattttcactcttgttgcccaggctggagtgcaatggcacaatctcggctcatcacaacatccgcctcccgggttcaagtga

SEQ ID NO: 36477 - DNA, 201 bp, Homo sapiens
gttacttttgctgttactttgacacctttcttggctgcttataataattaaatttaggtcaaatttcttttccttccttccttccttccttccttccttccttcctctctttcttgatggaattttcactcttgttgcccaggctggagtgcaatggcacaatctcggctcatcacaacatccgcctcccgggttcaagtg

SEQ ID NO: 36478 - DNA, 201 bp, Homo sapiens
ggttacttttgctgttactttgacacctttcttggctgcttataataattaaatttaggtcaaatttcttttccttccttccttccttccttccttccttccttcctctctttcttgatggaattttcactcttgttgcccaggctggagtgcaatggcacaatctcggctcatcacaacatccgcctcccgggttcaagt

SEQ ID NO: 36479 - DNA, 201 bp, Homo sapiens
gggttacttttgctgttactttgacacctttcttggctgcttataataattaaatttaggtcaaatttcttttccttccttccttccttccttccttccttccttcctctctttcttgatggaattttcactcttgttgcccaggctggagtgcaatggcacaatctcggctcatcacaacatccgcctcccgggttcaag

SEQ ID NO: 36480 - DNA, 201 bp, Homo sapiens
tgggttacttttgctgttactttgacacctttcttggctgcttataataattaaatttaggtcaaatttcttttccttccttccttccttccttccttccytccttcctctctttcttgatggaattttcactcttgttgcccaggctggagtgcaatggcacaatctcggctcatcacaacatccgcctcccgggttcaa

SEQ ID NO: 36481 - DNA, 201 bp, Homo sapiens
tgcctggcttatttcacttaacagtgtcctccaggttaatccatgttgtcacaaatgacaggatttctttctttctttctttctttcttttttttttttttgagacagtgtcttgctcttgcccaggctggagtacagtggcttgatcacaactcactgtagcactgtagcttcaaaatctcctgggctcaagtgatcctc

SEQ ID NO: 36482 - DNA, 201 bp, Homo sapiens
tatctttctgtgcctggcttatttcacttaacagtgtcctccaggttaatccatgttgtcacaaatgacaggatttctttctttctttctttctttctttyttttttttttgagacagtgtcttgctcttgcccaggctggagtacagtggcttgatcacaactcactgtagcactgtagcttcaaaatctcctgggctca

SEQ ID NO: 36483 - DNA, 201 bp, Homo sapiens
tatttatctttctgtgcctggcttatttcacttaacagtgtcctccaggttaatccatgttgtcacaaatgacaggatttctttctttctttctttctttyttttttttttttttgagacagtgtcttgctcttgcccaggctggagtacagtggcttgatcacaactcactgtagcactgtagcttcaaaatctcctggg

SEQ ID NO: 36484 - DNA, 201 bp, Homo sapiens
accaccatccccactaactgcatgccactctctgtcttctttactcattttatttttcttcagaactcttaatactgcctaacagattgtgtgtttgtttmttctctcctattagagatttttgtccattttgtttacctctgtatctttagcacttagaaccattcctagcacatagcaggtattcaataaatggttatt

SEQ ID NO: 36485 - DNA, 201 bp, Homo sapiens
agacctccaggactctgaatgtgaatactgaaaggagcactcccttttacctaactctaatattggtaataaacaccttctttatctctgttcctcaccawcatagctgccattagatccctctagctgggcatttgtagaaccactgcattgtgccttcatctgcttcttcttcttcttctttttttttttttgagaaag

SEQ ID NO: 36486 - DNA, 201 bp, Homo sapiens
ccttcctccacgttaccttctgccacggcctctcttctttttccctccattttcaatttacacttacattttccctcctcctcctggccctccctagtttytcccctcccctggtttctagctcctttttgctttctgtttgtgttactgagggcagtgctccaattacctcatatttggagagaggaagctgcagccaat

SEQ ID NO: 36487 - DNA, 201 bp, Homo sapiens; identical to SEQ ID NO: 7920

SEQ ID NO: 36488 - DNA, 201 bp, Homo sapiens
gcttaaggccaggagttcaagaccagcttgggcaacatattaagaccacatccatataataataataataataataatttttattatttattatttaatawtattaataataaagtctttaaaagcataatacaaaaattgtctccactctttcttttcatggcctgatttttcagattccatactcagccacttccaaag

SEQ ID NO: 36489 - DNA, 201 bp, Homo sapiens
agattgcttaaggccaggagttcaagaccagcttgggcaacatattaagaccacatccatataataataataataataataatttttattatttattatttaataatattaataataaagtctttaaaagcataatacaaaaattgtctccactctttcttttcatggcctgatttttcagattccatactcagccacttc

SEQ ID NO: 36490 - DNA, 201 bp, Homo sapiens
gaagattgcttaaggccaggagttcaagaccagcttgggcaacatattaagaccacatccatataataataataataataataatttttattatttattawttaataatattaataataaagtctttaaaagcataatacaaaaattgtctccactctttcttttcatggcctgatttttcagattccatactcagccact

SEQ ID NO: 36491 - DNA, 201 bp, Homo sapiens
aggaagattgcttaaggccaggagttcaagaccagcttgggcaacatattaagaccacatccatataataataataataataataatttttattatttattatttaataatattaataataaagtctttaaaagcataatacaaaaattgtctccactctttcttttcatggcctgatttttcagattccatactcagcca

SEQ ID NO: 36492 - DNA, 201 bp, Homo sapiens
agtaggaagattgcttaaggccaggagttcaagaccagcttgggcaacatattaagaccacatccatataataataataataataataatttttattatttattatttaataatattaataataaagtctttaaaagcataatacaaaaattgtctccactctttcttttcatggcctgatttttcagattccatactcag

SEQ ID NO: 36493 - DNA, 201 bp, Homo sapiens
ggaggcggagcttgcagtgagctgagatcgtgccactgcactccagcctgggcgacacagcaagactccgtctcaaaaaaaaaaaaaaaaaaaaaaaaaaatatatatatatatatatatatatatatatatatatacacacacacacacacacatatgtatatacacacatatatacacacacacacatatatatcgtat

SEQ ID NO: 36494 - DNA, 201 bp, Homo sapiens
gggaggcggagcttgcagtgagctgagatcgtgccactgcactccagcctgggcgacacagcaagactccgtctcaaaaaaaaaaaaaaaaaaaaaaaaawatatatatatatatatatatatatatatatatatatacacacacacacacacacatatgtatatacacacatatatacacacacacacatatatatcgta

SEQ ID NO: 36495 - DNA, 201 bp, Homo sapiens
ctgggaggcggagcttgcagtgagctgagatcgtgccactgcactccagcctgggcgacacagcaagactccgtctcaaaaaaaaaaaaaaaaaaaaaaawaaatatatatatatatatatatatatatatatatatatacacacacacacacacacatatgtatatacacacatatatacacacacacacatatatatcg

SEQ ID NO: 36496 - DNA, 201 bp, Homo sapiens
acctgggaggcggagcttgcagtgagctgagatcgtgccactgcactccagcctgggcgacacagcaagactccgtctcaaaaaaaaaaaaaaaaaaaaawaaaaatatatatatatatatatatatatatatatatatatacacacacacacacacacatatgtatatacacacatatatacacacacacacatatatat

SEQ ID NO: 36497 - DNA, 201 bp, Homo sapiens
atattcccccatatgctcttctttcttttcttttatttatttatttatttattttttgagacagagtcttgctctgttacccaggctggagtgcagtggcrcgatcccagctcaccgcaacctccatctcctggagtcaagcaattctcatgcatcagcctcccaagtagctaagattacaggcatgtgccaccatgccta

SEQ ID NO: 36498 - DNA, 201 bp, Homo sapiens
ttaagacttgattcaaaactgacatccagagaagttatgccattttatactctcactagtggcggtgtatgatgatacccagttgtagatcttctctccartcgtgaataatatcattaaaaacaaacatttcctagtttgataggtgaaaaattacctctcatggttttaatttgcatttatttgactagcaagaggggg

SEQ ID NO: 36499 - DNA, 201 bp, Homo sapiens
ctgggactgcaagcacaccaccatgcctagctaagataccattttatacccatcagattggcagaaggtaaaaattctgaaaataccaagtgtaggcgagratgaagagtgatgggaaaacctcttcatagcacttaagtggaagtataatttgctactgttctttagaaagtagtttgacaatattttgtagagttgaaa

SEQ ID NO: 36500 - DNA, 201 bp, Homo sapiens
tgaagtagaataatgatgtacctgtagacatggatggtagttttcacctcaagggaatattcagttgaaggagaagggagaggctggatccagattaaagrtttgtgactgctgatgaggctggtaatattgataacttcatgcagaggtttatggtttctaaaatgctttaacacattttttttaatgtgctaaatggta

SEQ ID NO: 36501 - DNA, 201 bp, Homo sapiens
gcagtatttatctttctgtgcctggcttatttcacttaacagtgtcctccaggttaatccatgttgtcacaaatgacaggatttctttctttctttctttctttcttttttttttttttgagacagtgtcttgctcttgcccaggctggagtacagtggcttgatcacaactcactgtagcactgtagcttcaaaatctcc

SEQ ID NO: 36502 - DNA, 201 bp, Homo sapiens
tacagatatagatcaatatatttattgatctctcaatttctctttctctctctctctctctctcacacacacacacacacacacacacacacacacacacaaattcatatgtatttgtctccccatccagttcccaacccatagcacagggattattctagcctctttccatatttttaacccccttccccaagagagaaa

SEQ ID NO: 36503 - DNA, 201 bp, Homo sapiens
tggaagatattaaatggtgtggctgcctgggcagtcagaatgattgaccagcataaatcacaggaaacatcacctgttttttagttcctatttcatgagcsctggtgtgggcagtgctgttcatgtgccctcagagcatatggttgagtctatgcatgtcttgggtatactgtgtttgtatctgggtgagatggctcacaa

SEQ ID NO: 36504 - DNA, 201 bp, Homo sapiens
gaccttgaagagtagcgcatcttaaactcttcatagtgtaaaatgggtttctggcttcatgcctttcttccatgagtccaccacatgtatgcatgttccartgccacttagaactttattttgaattggcttaaattggcagcataaaaaccacatttacttgttttcacaaaaccctgtcaacatctaaaaatggtgaca

SEQ ID NO: 36505 - DNA, 201 bp, Homo sapiens
tcaggcattggttttgcttagaagcctaccagaattgctggaaacacaggatagtgaggtctgttgtttgtaattaccctgctcaactgttgctcacttartgctgctccaagttataaaatatgactcagaaatttgttgtctaagcttctgttttcttagagcaaccaatccatatctctatctagacataatatttgc

SEQ ID NO: 36506 - DNA, 201 bp, Homo sapiens
taacggagggggcccagctatttgttaatttttactcattcttcagatctcagcttagagttcacttcctctaggaagcccttaattcaccaccactcacmaaagttagggtatatattcccccatatgctcttctttcttttcttttatttatttatttatttattttttgagacagagtcttgctctgttacccaggct

SEQ ID NO: 36507 - DNA, 201 bp, Homo sapiens
agaatcattagtgccagttatgaaaatacaggaaattagcctctctgattctgttggttttcttcatgaactgagaaatggaagtatcatggttttttgtkttttgtttcctttttccatttaccttaggatttgaaacagcccatggctgaaaggaaagctcagctggatgctcttgcttttgatattcagttctttatc

SEQ ID NO: 36508 - DNA, 201 bp, Homo sapiens
gttccaataaaactttatttacaaaaaaacacgtgacagaccagattttgcttgggggccacagtttgttgacccccctgctctagagagttgcttttctycttcttaagccccagattaattgattctttttattagtcaataagagaaaagaccatgagacacatgtgagccagagagttttctccccaatattgttct

SEQ ID NO: 36509 - DNA, 201 bp, Homo sapiens
gtaggtctagaggaatgcagtaatgagaattaagagtgtattggtgttactcgaatgtttgtttggggtattaaattaacactatcctagaaaggagcccrgtgaagccctttaggttccctcttagtgcctcagatccctttgcctgtaattcctgtggctgttactcagggagagtgttaggcccttctcatacaggga

SEQ ID NO: 36510 - DNA, 201 bp, Homo sapiens
tttgtatttttagtagagacggggtttcgccacgttggccaggctagtcttgaactcctgacctcaagtgatcctcccacctcggcctcccaaagtgctgygattacaggcatgagccactgtgcctggcctgacactgcttttagatagatctgtttttttcctgtctaaacatcttggtgtcatttctatttcagttta

SEQ ID NO: 36511 - DNA, 201 bp, Homo sapiens
tatcatttttttctccatttctttaagatgttggctaccagagtttcctggaaaaagcttactagatagatattatttcattggggaaaagggtcaaaatkccagagagagagattacttaaaatggtaatatggctgttgaggttgactagatattcttgtcctttccctttttgaagcaatgctgtcgaagcctaattt

SEQ ID NO: 36512 - DNA, 201 bp, Homo sapiens
tgaaggctttcctttagttaataacagaacactcactgtaagaaagaattgagttcaaacccttcaccattttccaggcttactttgagtatgcacttagmctatgtttctgttactgtatctataaagtgagaacaataatacctcactgagtgattgtaaagattaaatgagataatgtatacataggaccatgcctca

SEQ ID NO: 36513 - DNA, 201 bp, Homo sapiens
atgagaaaaggttgaaaagaaaatcaaaagaataatattttatgatgtgaaaataatatgaacttcagtttttagtgttcataaataaagttttattctamcaaccacaccctttcatctatatattgcctatggctgctttcacttataatgagagagatagtatggcctgatattttctgtctggccttttacaggaaa

SEQ ID NO: 36514 - DNA, 201 bp, Homo sapiens
cgcggcggcgcggggaagggggaggagagccgcccgccagccgagcacttccagcgagctagcgagctagcgggtcgcgctgcgcgggggaggaggactckccccccgcccgaccctagcggagccttttgttcccagccagaagtttgcatgccgggaccgtgacagctgcgggcggggaggacggcggggccgcggggc

SEQ ID NO: 36515 - DNA, 201 bp, Homo sapiens
tgaaggtgccgtatttaaggggtgtaggggaaggaatgatagctaaatagaactaagggagacttaatcgtgctttaccgcacatttgtgcagagattaamaacagcaacaaaatctacccagtttttggtcattgcttctactagcctttctttcttcctgtcttttatgaaatctacccaaaacagtagttcccaaagg

SEQ ID NO: 36516 - DNA, 201 bp, Homo sapiens
gcctgggcaacatggtgaaacccatctctactaaaatacaaaaaattagctgggtatggtggcacaagtctgtaatcccagttacttgggaggctgaggcrggagagtcacttgaacccgggaggcagaggttgcagtgagccaagattgtgccactacactccagtgtgggtgacagagcgagagtctgtctccaaaaaa

SEQ ID NO: 36517 - DNA, 201 bp, Homo sapiens
taaaaacgtagaaagacagccttgagagggaggaagagtggctatttcactgaaattggaggttaagagttgtcataggattggagtcaccatgaagacarattgtagtggtttactggttctctcaatatctagtgtgtggccttgggtagggtggctgaaccggggctgaggatgatgccccaaagaactatgtcaagt

SEQ ID NO: 36518 - DNA, 201 bp, Homo sapiens
cagccatttattgaaggtaaatattccatacagaaatcagtaggattaactggaagttcacatacatactgaattttgagctatatccttgctcccgctatggtttgaccagcccaagggggaagacctaatggtactgatataagtggtttcccaactgtatggcccagctccatcaccctcagtgaagactacagccag

SEQ ID NO: 36519 - DNA, 201 bp, Homo sapiens
ataagaggagagaagaagcccgtttagctctggacagggcctctgtttcctctgagatctcttgtctactctccctggtccagggctccatctttgcatamctttttacagatagatttgaagtgccaacttcattctgttttggagtactggcattggacacaattgattacatccctgcctgtttaaaatattctcttc

SEQ ID NO: 36520 - DNA, 201 bp, Homo sapiens
gagtaattatgttgacagccctacactatcaaagttttgtttgctgtgggtatttcatgctggagtaaagggtgcccttccttcagtggcagctatgttcytgggaaactggttgcttcctaatttttgcctcccattttggattttttcacttgtttcttgagcatatgtaacttctcatttcctatggttaaaaatcag

SEQ ID NO: 36521 - DNA, 201 bp, Homo sapiens
tttcctttgcagcactctagaaggcttttctgactctggctggactcatctacccatcattcgccatgctattacattttggctcatagtaactcctaagrtgtctcaggataattaagactccccatcttcttgtccaaactttctaggacgttgttgcatgttggttagagtgtgtaatagatctggcatcaatttaaa

SEQ ID NO: 36522 - DNA, 201 bp, Homo sapiens
tttgccagaagaaaagcgcttttgattaaggctgccttttctctctctcttttttttttcttaagctgttgtgggaagacttcagagcctctgaaggtgcygtatttaaggggtgtaggggaaggaatgatagctaaatagaactaagggagacttaatcgtgctttaccgcacatttgtgcagagattaacaacagcaac

SEQ ID NO: 36523 - DNA, 201 bp, Homo sapiens
tcatttgtataagaaggaagaaatatatttccagaaaaactagaatgtatcctgtgcagaacttgtatgtattgatcgtttagtagttgattagtaaacayggttaagataagcacagacttgcagaaaaggactgatcctcactgtgcctagaaatgaatggtaaatggtctcagccttaggctggttctggagcttcag

SEQ ID NO: 36524 - DNA, 201 bp, Homo sapiens
gggagatatccttgactcccccacccctcttatcctccacagctaataggaccatcaagtttgtactaatttgtaaatatcccttaaacgtactttttctrtccctgctaatattaccctaagagcataagtggctgggtggagaggctcatgcctgtaatcccagcactttaggaggctgaggcacatggatcacttgag

SEQ ID NO: 36525 - DNA, 201 bp, Homo sapiens
ttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgcccatatggtagctgttgctacgcaggttacta

SEQ ID NO: 36526 - DNA, 201 bp, Homo sapiens
tcctggcctcaagcaattctcccaccttggcctcccaaagtgttgggattacaggtgtgagccaccacacccagccaggattttcttctttttaaaggctraatagtattctattgtcccatagggactttagaatcaggctgtagaattctctggtgctgaggcctctgcaggcttctgtggagaagatatcccacagag

SEQ ID NO: 36527 - DNA, 201 bp, Homo sapiens
tgcagccttgagccttaaactcctgggctaaagcagtcctcctgtctcagcctcccaaagcactggtattacaggtgtgagccattgcacctggcctcctsctctactttcagagctactttgaatattataattggaaaggacttcagttttccacacaaatgtaaaaatccccaaatccccagcctctactcaaaaaat

SEQ ID NO: 36528 - DNA, 201 bp, Homo sapiens
tccctgtatcttttaataagtgtaggagagagtaaataacattacttttctctttaaaactttctcctctgccctatatattgctcttcaacatagtttgrgtcaaggaaattgggctgcttacgtttccttttaattgtttagaggaaagatttctagatcaagttttcggcaggtgtcaatactacgaggccaggcatg

SEQ ID NO: 36529 - DNA, 201 bp, Homo sapiens
tccgtccgtctttctgtctttctgttttaagagacaagttatccctatgttccctaggctggtctcaaactcctgtgctcaaggaatctttggccttcccragtgctaggattacaggcatgagccaccacacctggcccacttacactttctctatttctgtttgagactctctagttgaatatggggtagcactgattc

SEQ ID NO: 36530 - DNA, 201 bp, Homo sapiens
tagctggaattacaggcacgcatcaccacacctggctaatttttgtatttttggtagagatggggtttcgccatgttgccttggctggtcttgagttcctsacctcaagtgatccctctcaaaaaaataaaaataaataaaattactattcaaacctcattgcttaaaaaagggattaaaacagactctaaatcagccggg

SEQ ID NO: 36531 - DNA, 201 bp, Homo sapiens
agaaaaatgctttttctggtcagttcctgttgacttcacaggttagtagttagaaaggaaaagcccagtatttaatctagcagatagagcagttctttccmtttttgtatatgcaatctagaagcccctggctttcctggaattttagataaaatttccatatataccagcaaaagttttcaaatttttaataatgcttac

SEQ ID NO: 36532 - DNA, 201 bp, Homo sapiens
aagcctttgaagaagttatttagcttctcagtgttctacttccttatcagtaaaatggacatagtttgttatttatttaacctaccttatgagattatcgktgctaggattaactgaagtgatacatgtaaaatacttagaatagtggttctcaaagtgtggaccccagactagcagcatccgtatcacctggggacatgt

SEQ ID NO: 36533 - DNA, 201 bp, Homo sapiens
cctgggccatgtcttcctcagatgaagagacgctcagtgagcggtcatgtcggagtgagcggtcttgtcggagtgagcgatcttacaggagcgagcggtcrgggagcctgtctccctgtcccccaggggacaccttgccctggaacctgccactgcatgagcagaaaaagcggaaaagccaggattcggtgctggaccctg

SEQ ID NO: 36534 - DNA, 201 bp, Homo sapiens
tagatcatttttttaaaaaaaaaccagaaatctcatatagaacagaaatctcatatagaaccctactacgtaaaacaaaacattttgttggctgccgggcscagtggctcacgcctgtaatcccagcactttgggaggccgagacgggtggatcatgaggtcaggtgatcgagaccatcctggctaacacagtgaaacctc

SEQ ID NO: 36535 - DNA, 201 bp, Homo sapiens
acaagagtgaaactccatctaaaaaaaaaaaaaatcagtaaatattaacttgaataaaaaattaaagatggcactagctgtaaactgtagcaggaaccatsccctgttcatttgtctattaagagggtttggttgagtttaatgtgtgatctaaggtaggatgctcagtataggttaattagatgatacagagttgccctg

SEQ ID NO: 36536 - DNA, 201 bp, Homo sapiens
ggcaacatattaagaccacatccatataataataataataataataatttttattatttattatttaataatattaataataaagtctttaaaagcataayacaaaaattgtctccactctttcttttcatggcctgatttttcagattccatactcagccacttccaaagcctctcctatagcctggctgagcgatcttc

SEQ ID NO: 36537 - DNA, 201 bp, Homo sapiens
gcagaaccacccagcaggatctctctgctttgcagaagaaccaaagtgacttgaaggtcagtgtgaatctgtcaattttgacacaaagtctcgctctatcrcttaggctggagtacagtggtgttatcttggctcactgcagcttcgatctcctgggctcaggcaatcctcccacctcagcctccccaggagctgggacaa

SEQ ID NO: 36538 - DNA, 201 bp, Homo sapiens
gagccacgacggccctgaccacgctgacgcccaggctgcgggctcctcgcccggaccaaccgccagccacgccgaggtcgcacctcggggtcgccccaccygcaacacctgccgccgcccggggctcctagcgggcgcggcctccgcgcccaggccccgcccccgcgcccccattggtcagtcccgggggtgggcgggcgg

SEQ ID NO: 36539 - DNA, 201 bp, Homo sapiens
ctcagtctcactcagggaatttaaatctgataaaggaagaggttactagatatgagtcaggaaatgttcattcctttttttctctcttccctatttcttaygcattccttttcccagtacgaggcaaattctaggaggacccttcatctccaaggctaaaaagagtcttataagagggacaaactgagtacagttgtcaca

SEQ ID NO: 36540 - DNA, 201 bp, Homo sapiens
actaacagttatagtaaatgttcagttaattttagcttaggttattgagtaccttctaaatgtgatagagatggggttatggagacaaaagagtccctacrctcagataatttatttttttattttttatttttgagagagtctcgctctgtggcccaggctggagtgcagtggcacaatctcggctcactgcaacttcta

SEQ ID NO: 36541 - DNA, 201 bp, Homo sapiens
aaaaggaaaaaaagaaaaaaagaaagacaggacaggctgctgagcaccactacattgagcatgatgtgtctcctgtatgtgtgtttcatgtgaagtattgktctgattaactgacatccttgcttacaagtttcactaaccctttggagtttaagcacaaatgcacaaagggaaaagaggacgacctgtttggggttcttt

SEQ ID NO: 36542 - DNA, 201 bp, Homo sapiens
gtgaaagcctctctctactaaaaatacaaaaattagccgggtgtggccaggtgcagtggctcacgcctgtaatcccagcactttgggaggccaaggagggyggatcacaaggtcaggagatcaagaccatcctggctaacatggtgaaaccctgtctctactaaaaatacaaaaaaaaaaaaaaaaaattagccaggtgtg

SEQ ID NO: 36543 - DNA, 201 bp, Homo sapiens
taattcttgggttttgaagctttttctctttatttctaccatgtaggttctgtcagaagagctgacaacaaagaaagaacaagtctctgaagctattaaarcatcacagatcttcttggccaagcatggtcataagtgagtattaaatgagagattatggcacatctggggcacctggtctatcagtctaaaacttacagc

SEQ ID NO: 36544 - DNA, 201 bp, Homo sapiens
ggattacaggtgtgagccaccatgccctactggcactagatatttatttatttatttaaccatgccctgccagcactagatatttatttatttatttattyattcattcattcattcattcattcgagatggaatttcgctcttattgcccaggctggagtgcagtggtgcgatcttggctcactgcaacctccgcctcct

SEQ ID NO: 36545 - DNA, 201 bp, Homo sapiens
gcatttcaaagagtcccagaggatctctgacatctgagctctagctcaggctagatggattactcaagtgagtcatgtctgtgtggtgctctgaagtttayagagaacctttgcagggcagcatactcatcctggttcactcgtcctgtgtttgggatggactcatctcactcttgagcatgctgcctggaatctagggaa

SEQ ID NO: 36546 - DNA, 201 bp, Homo sapiens
agattctgcattttaataaattatatggggatataatttatatgcatgttggtgtttgaaaagctctattctagatcattgaaagctttttaaggagaagagtgatgtggtcatctttgggttttagaaaaagtattctggtggaacaatagagaataaattgagattagactagaagcagtgaaagtacctaagaggcta

SEQ ID NO: 36547 - DNA, 201 bp, Homo sapiens
taaattagctggatgtagtggtgtgcacctgtagtcccagctcctcaagaggctgaggtaggaggctcacttgagcctgggacattgaggctattgagccrtgattgtgtcactgcacttcaacctgggcaacagagaaagactgtgtctccaaaaaaaagaaaaaaataacttgagattattacatatttatttgtttat

SEQ ID NO: 36548 - DNA, 201 bp, Homo sapiens
gagtgagataggatttggttattgagtaaaagagggccctgtaatgtggacttgacatcttccctccataccttggctttctgccttctttgccttttcawtccttcaccttcaccaccaccattttattgtaccaaaagcagctttaaacttgggatgtttttcctgcctctatctgatttttcttcagcagaaacatct

SEQ ID NO: 36549 - DNA, 201 bp, Homo sapiens
tcaccttacaaggttgatacgaggattaaataagatagtgtacatgaaggagcctaattatatgcctctttttggtaggccctcaagtaacattagttccyttcccccaagattagaccgtatactctcagcaaacattttaaatgccagggttcaggctttattgatttcaattttattttctcatttcagccgatcgca

SEQ ID NO: 36550 - DNA, 201 bp, Homo sapiens
ccagccactagggaggctgaggtgggaggattgcttgagcctgggaggtcgaggctgcaatgagccatgaagtatgccactgtgctccagtctgggtgatrgagcaagactctgtctcaaaaaaaaaaaaaaaaaaaaaaaaaaacccacacatttaaaatactctttttcctccagttaagcctactatctaaaaaacca

SEQ ID NO: 36551 - DNA, 201 bp, Homo sapiens
tcttcggggtggggtgggcagcggtgtgggtgagtgtgcagtttttggtggcgagaccttaccccctccatctccccgggggtctgggcctgctggaggtrggggtctgtttttttcctcccacataaagatttgccttggagctcggatttcagccctgaaggctctcttgcgagacacttctgcaagttaatgcctaat

SEQ ID NO: 36552 - DNA, 201 bp, Homo sapiens
agcttatgcagtacactgatgtttactggatctggaagcttatctaagaggaccaaattgctttgtgttccctgtgcagattcccttaattattattattmttttatttgagtgatggggtcttgctatgttgcccaggctggactggaactcctgggctgaagtgatcctcctgcctcagtctcttgagtagctgggaca

SEQ ID NO: 36553 - DNA, 201 bp, Homo sapiens
ttttacagctgaggaaattaaggcttaaggagattaagtaacttgcctgaggttacccataattagaactaaatcttttttttttttttaattttttttaragacaaggtcttggctgttgcacaggctgcagtgcagtggtgtaaacatggctcacagcagcctcaaactcctgggctcaagagattgtcccactccagc

SEQ ID NO: 36554 - DNA, 201 bp, Homo sapiens
tctccgcctcctgggttcaagtgattctcctgcctcagccttccgagtagctgggattacaggtgcatgctaccatgcctgactaatttttgtattttttyagtagagatggggtttcaccatgttggccaggctgatctcgaactcttgatcacctgtttcggcctccctaagtgctaggattacagatgtgagccactg

SEQ ID NO: 36555 - DNA, 201 bp, Homo sapiens
agtatgtaattgtagcttgttttttattagtaggagtcataataacaatacgcttgatttttttatgataaaatacactaatataacatttagcattttasccatctgtaagggtaaatatagtggcatcaagtacattcacttgattgttgtgcagccgtcactattatctatctctagaactttttcatcttctcaaac

SEQ ID NO: 36556 - DNA, 201 bp, Homo sapiens
aaacgacagcaaaaacatataatttatgacaggataaatgccattttttttgaccagctgggcaacatagtgagaccctgtctcatagtaataacaataaygaagtaccacaaactgggtggcttaaacaacagatatttattgtcttacagttctggaggcgagaagtctgaaatcaagttgtcagcagagttgattcct

SEQ ID NO: 36557 - DNA, 201 bp, Homo sapiens
aataccactttccccatcatagtatctgcttgtaggtactagtagaatatagtgcacacagtgagcttattcatggttgttgactgactaaaaagcacagraaaaaaaatcacttcctatatgtctcaatccaacatgttcctgcaggttgaaaactataaactccaaaaaacacttcaagcaagccctttcctttcatca

SEQ ID NO: 36558 - DNA, 201 bp, Homo sapiens
atccctgcactttaggaggccaaggcaagagggttacttgatcccagaagtttgagaccagcctgggcaacatatcaagatcccatctgtaaaaaaaaaaattttaaattagctggatgtagtggtgtgcacctgtagtcccagctcctcaagaggctgaggtaggaggctcacttgagcctgggacattgaggctattga

SEQ ID NO: 36559 - DNA, 201 bp, Homo sapiens
cgcggggcgcggggttggatgcaggcgccctgcccgctgcgcgggatgcgcagcggcggctggggagcggtgattgatcgcccccggcggccgcgccccakctcccggcagccggcggccgcggacaggcggcttgacaggcgcgggcacagcggcagtgcgggcctcgcacctgcagcccccgcggccggcgccggggag

SEQ ID NO: 36560 - DNA, 201 bp, Homo sapiens
tcttttctcaaggacaaaacctatactctagttcttgttttattagctttgtatccaaatatgagccattttttatgatggagctttacagaatttcttgytttcatctcatttgctaattcagtaatttttcatctctgttactagaggtcctgcttctaatgacagatgtaaataggaaggacagaaactgcacctttt

SEQ ID NO: 36561 - DNA, 201 bp, Homo sapiens
tatctgcgtggttttggattgatttaggtaagttcaaaggcagagtgattggttaggaaactattgcagtaattcaagcaagaaatgttggaggcttaaamcagtagattagatatgtaagttaatctctcttacttcctaaaactatactaagacatcaggaaaaaggttttttgggtttttttttttagtgcataaatt

SEQ ID NO: 36562 - DNA, 201 bp, Homo sapiens
catttccaaagataataacagcagtctggtgaaggagctctcaaaccaaaacctgaactagaaacattctcataattatcctgattatccaatccatagayccagatcaatggactgtccaaatgaggggagctttccgaatatgatttctatgtcttttcctattctagtctcccaccaacttttccatccttgagatat

SEQ ID NO: 36563 - DNA, 201 bp, Homo sapiens
gtctctacacagccctgtgagccggtattccctataagggaaaatcaacagctcttgccctccctggaccctacagccaaagtcaaagctgggtacccagsttggctttgcggcctgtaggaaggctggtagctgaaggcacataccatttgtgctctgatggagcccttggggtggtgggccatgtgtagcagatggttc

SEQ ID NO: 36564 - DNA, 201 bp, Homo sapiens
gtggctttcagagtaaagcagcaaaggaactggcagagaacaagaagaagatcgatgctctcctggattgggtaacttcagtaggatcatctggtggacakctgctgaccaaccttccaggaatggagcagctctcgggagctagcttggagaaaggagccttggacaccactgatggttacatgggggtgaatcaagccc

SEQ ID NO: 36565 - DNA, 201 bp, Homo sapiens; identical to SEQ ID NO: 7706

SEQ ID NO: 36566 - DNA, 201 bp, Homo sapiens
gaggagcatattcttggctgaactcatgctgagctcatcggaagtgaaaacaatgagaggagaaaaattctgtgtgtcagttccatagtccccaggaggcygcataaagggaaggtctttttggacccattctgaggactgagtcattttcatgatttgagtgtggagttcctgggttaatgtattatagtccagccatag

SEQ ID NO: 36567 - DNA, 201 bp, Homo sapiens
tgagcaagaggagtcatcgtatttgggtttcttgaggcacccagataaggaaagggtaggtagagaaaacgtaaacccgtgaagcagtgcattcctcttakaaacttcctttctagtggtagtgtggccttccctgtttcagcttgcacatttttctttcctcttttgttataagtgtctcaaaagcagagactttcttct

SEQ ID NO: 36568 - DNA, 201 bp, Homo sapiens
gccgacttcaagatctgagagcctgggttggcaataaaaatcttattctgaacagcaagggatctaacagtgaaatagatgttgacagcctgaacctctgyctccaacagtatgaggtaaactcaagcacattttctttgtcctttgagttgtatcaattttatttccctgctaggcaaaccaatatccatatttatcttt

SEQ ID NO: 36569 - DNA, 201 bp, Homo sapiens
actgacagaactcaaacacctctgggagaacctgggtgagaaaattgcccaccgacaggtaaggcaggtggtagatgacatcagtgaactactctccgctsttttctaatttcgtattgaatattccctttctgtcttttcctgagtagcacaaactagaaggggctctgttggcccttggtcagttccagcatgccttag

SEQ ID NO: 36570 - DNA, 201 bp, Homo sapiens
catgttttcttgatgcttcacgtgcaaatgcttgttctttctttttattcctggtcgtctttcattaagtcataaatgccccaagaataaccagtctctgygtggtatagagagtctaatagcctttgtattaaatcttctttggcttgtaattatctagatgtttcagaaagaacaagtggatcctcttcagatgaaatt

SEQ ID NO: 36571 - DNA, 201 bp, Homo sapiens
tcccagctactcaggaggctgaggcaggagaattgcttgaacccgggaggcagaggttgcagtgagctgagatcatgccattgcgctccagcctgggcaaygagcgaaacttcgttccaaaaaaaaaaaaaagtagctactgaccatcatagctcagcttagcctaccttaaacatactcagacacttacattagcctaca

SEQ ID NO: 36572 - DNA, 201 bp, Homo sapiens
actcaattcagagcgttatgcccgcctagagcgggcccaggtcttagtaaaccagttttgggaaacttatgaagagctcagcccctggattgaggaaactygggcactaatagcacagttaccctctccagccattgatcatgagcagctcaggcagcaacaagaggaaatgagggtaaggagcatgccaagtttcatttt

SEQ ID NO: 36573 - DNA, 201 bp, Homo sapiens
caacaagagcgaaactccatctcaaaaaaaaaaaaaaatgtaaataatgaatagcctccctgttaatgtataaaaatctttgtttctctgaataggaagtyttgctctaccctttacactttcctttttgttcacacccaataggttacaagacaagtggctcagtgcaaatgtgcaaaaaggtttcaggtggagcagatc

SEQ ID NO: 36574 - DNA, 201 bp, Homo sapiens
gtcatcttgcaattcattcccaaaggataagctctggttttggtctaattctttaaattcatacctaagctgtttgtttctttgtcatcaatgataagaaktttccttagtaacgaaatgaaagagatggtttttagaaatctcttctctctgtattatttattctgccttcttttctaatattgaggagcaggggctgga

SEQ ID NO: 36575 - DNA, 201 bp, Homo sapiens
agaaagaaagaaaatgtacatatacacaatagagtactagtcggccataaaaaagaatgacattctgtcatttacaacaacatggatggaactggaggacrttatgttaagcgaaataagccaggcacagaatgacaaacattgcatgttcttacttatttgtgggaactaaaaattaaaataattgaactcatgaggata

SEQ ID NO: 36576 - DNA, 201 bp, Homo sapiens
aggagaaacctttggaccatgatctgtagtgtgaccatattggcaacagtatgattcctttgctgttcagtatgattcaaattggtgtgtggcattttctkggtagccaacctctgcatctattccttctaccttttcactgcagacacagtcatactacttatgtatagccaaggctgaaaaactaagtgaccgagtctc

SEQ ID NO: 36577 - DNA, 201 bp, Homo sapiens
ttagtgatgtgaaggacaagaattcagtgttttcagtcctggatgaggaaattgccaaggccaaggtagtggcagagcagatgagtcgtctgacaccagarcgaaatctggatttggagcgctatcaggaaaaaggctcccagctgcaggagcgttggcaccgagtcattgcccagctcgagattcggtgagtggtggccc

SEQ ID NO: 36578 - DNA, 201 bp, Homo sapiens
acgggcagtggagtttaatttaagaaattgacaaagtagtgctggttagatgctaaggaaaggagtgttacctttgttgcctacatgtgactatatggtartggtttgtggctgtctttgcctggacctgattttttagggcttaatttcactctaaatgcttctcaggtctacatatgggcctatatttggacttgggct

SEQ ID NO: 36579 - DNA, 201 bp, Homo sapiens
tctgtcgcccaggctggagtgcagtggcgcgatcttggctcagtgcaatctctgcctcctgggttcaggcaattctcctgcctcagcctcccgagtagctrggactacaggcacacaccaccacacccagctaattttttgtacttttagtagagacggggtttcaccatgttggccaggctggtcttgaactcctgacct

SEQ ID NO: 36580 - DNA, 201 bp, Homo sapiens
gaatcacttgaacccgggaggtggaggttgcagtgagccgagatcacaccactacactccagcctgggcaacagagcaaacctgtctcaagcaaacaaacmaacaagcaaacaaacattgatataatactgctatccaagctcacgcctcattaaaatttcatcagttgaccaaataatgctctttacatcctcataccat

SEQ ID NO: 36581 - DNA, 201 bp, Homo sapiens
cacttgaacccgggaggtggaggttgcagtgagccgagatcacaccactacactccagcctgggcaacagagcaaacctgtctcaagcaaacaaacaaacmagcaaacaaacattgatataatactgctatccaagctcacgcctcattaaaatttcatcagttgaccaaataatgctctttacatcctcataccatccat

SEQ ID NO: 36582 - DNA, 201 bp, Homo sapiens
ctcttcttttcttttttaatagagaaggggtcttgccatgttgctcaggctgttctcaaactcctgggctcaagcaatcctactgcctcagcctccaaagkgctgggattacaggcatgagccaccatgcccagctttttgaaaactaatatagtcataatggcatggaaacttgtattaatctgcttcttggtgaagaca

SEQ ID NO: 36583 - DNA, 201 bp, Homo sapiens
tctcgctctgtcgctgcaacctctgccttccaggttcaagcgattctcctgcctcagcatcccaagtaactgggattacaggtgtcccctaccacgtccarctaatttttgtatttttagtagagatggggtttcaccatgttggccaggctggtctcaaattcctgacctcaagtgatcctcccatctcagcctcccaaa

SEQ ID NO: 36584 - DNA, 201 bp, Homo sapiens
cttttttttttttcgagatggagtttgctcttgttgcccaaggctggagtgcaatggtgtgatctcggctcactgcaacctccgcctcccgggttcaagcrattctcctgcctcagcctcccgaggagctgggattacaggcattacagacgtgtgccaccatgcctggctaattttttgcatttccagtagaaacggggt

SEQ ID NO: 36585 - DNA, 201 bp, Homo sapiens
tactttcaacggttattctgcattatccttagctcagtatccttatgggacagtcccagtccgcagggtagccccggcttctaggcggtggcatccacatstgctctgcccggagctgatgcaggtgcctcatggggggcgctctggggaccgcgcagaaaatttacgagcagtgtggaaatatacctgttgggtaaaaga

SEQ ID NO: 36586 - DNA, 201 bp, Homo sapiens
tctagctgggagcccagaattgcacaaaacaaacctgagaattgtacaggctggatctagggcctcaagtgatgtgcagtggattcaaaaggggcgtgcasagaggacagtgaagggggtgtgggcaggagattccgagactctgaccaagatgacatggggacaaagccctgtggattcagcctcctaaacagctttctc

SEQ ID NO: 36587 - DNA, 201 bp, Homo sapiens
ccattctttatccaaggagcaccacaaaggccttatgaattctgttttctacttaggattgagaagagttctgggagtcttatatcaaacttgtacaaaasttgaatccatggggaaaaatccagagattaagagcaaattaatttcctgagttattctctcctttgatgtcaaatgtgctatcttctacagatacaaagg

SEQ ID NO: 36588 - DNA, 201 bp, Homo sapiens
gggaaggctgcccagtctggctggtggagcccagctggccttagagcaattgtattttcactcaactctctccactagctaaactgaccagaaaaaatggrctttctgtcccatccccccaccccatcctcatgctgtgccacgtattcccacaacagcccttggaataagcaaatgaacatttaatctaatgcctgctgg

SEQ ID NO: 36589 - DNA, 201 bp, Homo sapiens
taagaggacagagcaaaaatggttctgctgtcatagggctcctctgacaccttttgctggcagcagtcaacctaatgaagtggtatctccattctaggaargaaactgccttataggtagatgagttggaaggtgagaatgaaggacacctaggtgatatacagacaaggttgtagtaccgctcccacttcactatctaat

SEQ ID NO: 36590 - DNA, 201 bp, Homo sapiens
agctcacggtggttgttgctgaactgaagcgtgggcagaggcccttggaatggctaaaatctgctgtttaggtttatgggaatgtgaagcccgttgtttakaaaacacagctctatctccacatcctaaattgagaaatgatttctgttataagaatcagcccagcactgggcagcttgcagtctagctgggagcccagaa

SEQ ID NO: 36591 - DNA, 201 bp, Homo sapiens
ttctccaagaaacctaccccacctcagttcccttccagtcctaatgttctggattccactcacatgtggtctgctcccacttccccgctcctctgcccttmcagccactttgctggctcctctgggagcacagctttcattttgctttgggaaattgccgtgttcaccagctgtcacccctgttgctgtgggggctgctca

SEQ ID NO: 36592 - DNA, 201 bp, Homo sapiens
ctggggccttgaatgatgcaataactagctcatatttattgactgcttactgtaagccagtgattgtgctaagtgctctatatacattctcactgaatacscttaacagttctatgatcattagcccccttttcttgataagacactgagcctgagagaggttaagatcacagagttgccaggtggctagggaaaaccctt

SEQ ID NO: 36593 - DNA, 201 bp, Homo sapiens
gaatctaaggtttcccgaaacctgaatggaaataaaaatttagcagttgcaatctataattactaaaagaggtcagtagtaatttgaaaactactttctcygttctcataatgaacctacatgttcatgatacaggtcgcacaaagaattgcacagctacaggaagctttgttgcattgtgggaagtttcaagatgccttg

SEQ ID NO: 36594 - DNA, 201 bp, Homo sapiens
gcaagaaaagagaaactccatctcaaaaaataaataataagtaaataaatatatatatatataatcacagtcctgtgatagaaatgctaaatgaggaaggraaatttggtgtctgctggggccttgaatgatgcaataactagctcatatttattgactgcttactgtaagccagtgattgtgctaagtgctctatataca

SEQ ID NO: 36595 - DNA, 201 bp, Homo sapiens
acttgagcctgggaagtcaaggctacagtgagccacgattgcaccactgcaccccagcctgggtgacacagcgagaccctgtctcaaaaaaaaagacaagmtattaacatgaacatgtaggatatctgtcctacttacatgattaaacaaatagtattatgtaaaaagatactagaaatcatggagatcctgggttctcag

SEQ ID NO: 36596 - DNA, 201 bp, Homo sapiens
ccacagcactggcttagtgatgtgaaggacaagaattcagtgttttcagtcctggatgaggaaattgccaaggccaaggtagtggcagagcagatgagtcrtctgacaccagagcgaaatctggatttggagcgctatcaggaaaaaggctcccagctgcaggagcgttggcaccgagtcattgcccagctcgagattcgg

SEQ ID NO: 36597 - DNA, 201 bp, Homo sapiens
gagatggagtctcgctctgtcacccaggctggagtgcagtagtgcagtctcggctcaccgcaacctctgcctcccgggttcacgccattctcctgcctcakcctcccaagtagctgggactacaggcgcctgccactacgcctggctaattttttgtatttttagtagagacggggtttcaccgtgttagccaggatggtc

SEQ ID NO: 36598 - DNA, 201 bp, Homo sapiens
tagcactgattccaggtattctgtcctatacagcctctgttttggccacatgagtcaattcactggctccctaatcactgggtggaacttcatactttttrcgtattcatgtctatgggaaataccagaatgagacgggcagtggagtttaatttaagaaattgacaaagtagtgctggttagatgctaaggaaaggagtg

SEQ ID NO: 36599 - DNA, 201 bp, Homo sapiens
aaatcagacgtattctctctctgtgtgtgtgacagggtttactctgttgccaggctagagtgcggtggtacaatcatagctcactacagcctccaactccygggctcaagtgatcctcccaccacagcctcccaaatagctaggtttataggcacatgccactgtgcctggctaatttttgtgtgtgtgtttgtagagatg

SEQ ID NO: 36600 - DNA, 201 bp, Homo sapiens
agctaaaaccacgcagtccagaccatgtgttaaagaacaccatttctgtcaaggctgtctgtgactacaggcagatcgaggtgaggaggtagaaagggtayctctgggccacagggggaaggaagaaagaagggaagccttcagttagggttatgatgataaaagatcaaattacagcgtttttaaaattagaatttaaac

SEQ ID NO: 36601 - DNA, 201 bp, Homo sapiens
tggttcagaggaggactgcacacgcccagtaaactatcactatagtatagtatagtatttttcccccaggtaaggaatctttcactcactgtgaataactyagcaaaaattaagttaacattttagtaaagactgttttcttggtaatgtgtggcaacctggaggagtagtgttggcatagtgctatgttaatgtgacttc

SEQ ID NO: 36602 - DNA, 201 bp, Homo sapiens
tagatggtggcgtttcatgtgccttgctggacttttacagacccgatctagtagacatggagagggtgcaaatccaaagtaaccgagagaatctggaacargcttttgaagtggcagaaagactgggggtcactcgcctgctggatgcagaaggtgagagggagtttactgaacttgagtaaggaacacgtattcagtatt

SEQ ID NO: 36603 - DNA, 201 bp, Homo sapiens
aaagcgagtggacgttaactcagcagtagccatgggagaagtcatcctggctgtctgccaccccgattgcatcacaaccatcaaacactggatcaccatcrtccgagctcgcttcgaggaggtgagtccctggttcagaggaggactgcacacgcccagtaaactatcactatagtatagtatagtatttttcccccaggt

SEQ ID NO: 36604 - DNA, 201 bp, Homo sapiens
cactcaatgaatagttattgagcaagtgtgtgccaagtcctgtgcctgatttatggtggaaacactaaagacgaccctatctttgggaaattaatgaacaraagggcataaaacacatgaacatcttgagagaagcattaatttcctaaaaaccttctagcatgggattgggtaatttgattatattaagaatggctaaag

SEQ ID NO: 36605 - DNA, 201 bp, Homo sapiens
ttggactcattatctagagataacagttgttacattgacatacttttttctagtttttggtgctatttttcttttcttttcttttcttttcttttcttttytttttttttttttttttttggagacagggtctcactgggtcacccaggctggattgcagtggcatgatcttggttcactgcagcatccacctcccgggct

SEQ ID NO: 36606 - DNA, 201 bp, Homo sapiens
gagtggttctgaactcctgacctcaggtgatccacccaccttggcctcccaaagtgctgggattacaggcgtgagccaccactccaggcctaaagtttctytttaagtgagacattctccaattgaaaaaaacctgctcattatattacatttcttaaatgtagaaaaatagatggtagaaaataaaaatcaattttggac

SEQ ID NO: 36607 - DNA, 201 bp, Homo sapiens
ccaaagtgctgggattacaggtgtgagccaccacccctggcccaaaacagtttcttaaccaaactcaacacttaatagccattgggctaaactgagcacargttatcctaaacagtagtaggataatatcttgtccttattccctaacacttctccaagaagagtgatgaggtatgctgtgatggtaatgttccaacattt

SEQ ID NO: 36608 - DNA, 201 bp, Homo sapiens
tgattgtcatgcctcagcctccctagtagctgggactacgggcgtgcgccaccacacccggctaattttttgtatttttagtagggacggcgtttcaccaygttggccaggctggtcttgaactcctgacctcaggtgatccacacacctcagcctcccaaagtgctgggattacaggtgtgagccaccacccctggccca

SEQ ID NO: 36609 - DNA, 201 bp, Homo sapiens
aatcatgttgtaggtacttaaatgcattccgcaaatcaaaatatcttgatggataaattatagagcttaatagatcttgttttatttcatccttgttaatyttgtttaatatggctgggcatggtggctcacgcccataatcccagcactatgggaggccaaggcaggaggatcacttgagttcaggagttggagaccagc

SEQ ID NO: 36610 - DNA, 201 bp, Homo sapiens
ttgcagtaacaaatattttgtatttcctgattttcttttcaactattaccttatctataaatgttaccctggggtataatcatgttgtaggtacttaaatrcattccgcaaatcaaaatatcttgatggataaattatagagcttaatagatcttgttttatttcatccttgttaattttgtttaatatggctgggcatgg

SEQ ID NO: 36611 - DNA, 201 bp, Homo sapiens
aaaataatttcagatatatagaaaagttttattctcttatacctttcacccagagtctccaaatgttaccatttttgtgcatttgctttatcattttattmtatatattatacataataacattccttttttatcttgagagtaagttccagacatgaagctcctttattcctaaatacttcagtgtgcatcttcaaaaaa

SEQ ID NO: 36612 - DNA, 201 bp, Homo sapiens
taactattgtattcttactgaggattttttttttttcatttctaggggaaattagtaaaacaaaaggtatttgaagacattttgaaatttttatttggaayataaaactttgattttgggaattatcaaaatatatgacctaggatactttaagagaaatctttgttttcctggacttttaatttgcttttcaactaagca

SEQ ID NO: 36613 - DNA, 201 bp, Homo sapiens
atctttatttttacaagaaatgtccaggaggagtttaagtcaggacagttggtaaaaagtacatattcctattcctccccaaacccccaaacatcttgctrtctgtatactcagtcctctgactaactgaaaaatatcagaaagaacttagtgaggaagagtattattatggggagaaaaaaagcaaatggcttttttttt

SEQ ID NO: 36614 - DNA, 201 bp, Homo sapiens
tgttttagaaataaaacatggactagtggcttgtctgatagtagtgcagtttgcattccagctcctaccaagaaacattggattcttgtgcctcaagacartgttgccttcagtcttggaaagccttagccagggaaacaagggatgcacaagaagtcaatggctatgaatgagctgctgttttgaggttcatttcacttc

SEQ ID NO: 36615 - DNA, 201 bp, Homo sapiens; identical to SEQ ID NO: 7916

SEQ ID NO: 36616 - DNA, 201 bp, Homo sapiens
aggttgtagcgagccgagatcacgccactgcactccagcctgggcaccattgagcactgagtgaacgagactccgtctgcaatcccggcaccttgggaggycgaggctggtggatcacttgcggttaggggctggagactggcctggccaacagagcgaaaccccgtctccaccaaaaccagtcaggcgtggtggcgcgag

SEQ ID NO: 36617 - DNA, 201 bp, Homo sapiens
cttgcctaagccaaaggcaagtgtcatggtgtattttacacattcatctgtatgttacctagccatagctttttttttttttttttttttatttatttttwattgataattcttgggtgtttctcacagagggggatttggcagggtcataggacaatagtggagggaaggtcagcagatacacaagtgaacaaaggtctc

SEQ ID NO: 36618 - DNA, 201 bp, Homo sapiens
tggattcttgcctaagccaaaggcaagtgtcatggtgtattttacacattcatctgtatgttacctagccatagctttttttttttttttttttttatttwtttttaattgataattcttgggtgtttctcacagagggggatttggcagggtcataggacaatagtggagggaaggtcagcagatacacaagtgaacaaa

SEQ ID NO: 36619 - DNA, 201 bp, Homo sapiens
aaaagcaacataatttctaggcaaatttttcatgaaaaggggaaatagattattggagtcttttgagggatctctaatccttaaaaaatgtttttcttggycgagcgcagtggctcacgcctgtaatcccagcactttgggaggccgaggtgggtggatcatgaggtcaggagatcaagaccatcctggctaacatggtga

SEQ ID NO: 36620 - DNA, 201 bp, Homo sapiens
ttcttggattcttgcctaagccaaaggcaagtgtcatggtgtattttacacattcatctgtatgttacctagccatagctttttttttttttttttttttwtttatttttaattgataattcttgggtgtttctcacagagggggatttggcagggtcataggacaatagtggagggaaggtcagcagatacacaagtgaa

SEQ ID NO: 36621 - DNA, 201 bp, Homo sapiens
aaaccttctagcatgggattgggtaatttgattatattaagaatggctaaaggacctaagtgtatgctaattcttggacagagtcagacctggtggctcaygcctgtaattccagcacttgggaggctgatgcaggaggattgcttaacaccaggagtttgagaccagcctgggcaatatagcaagaccccatctctacaa

SEQ ID NO: 36622 - DNA, 201 bp, Homo sapiens
cccaagctagttttatctatctattgaaatggtaagcttttttgagagaactgttttatagacatttctattattcccacggtgcctcgctcatgcctagmcaagtttaaatgctccttacagagcacttataaaatgtggtgaccaaagccaatcactctttcattcgacaaatgtgtatgagcacctaccatgtgtgct

SEQ ID NO: 36623 - DNA, 201 bp, Homo sapiens
ctgaggccacatgattctggatgcacaaacacagaaagtctgatgggcttaggtcttcttttcctccatgggccaattgtccatctatagttcagtaaacygtgggtaaggaggtggttacataaatcacacatgtcttcttagggccacttgtttagtgggtactgcaggtgagcatgattttaacactgcaagatctgg

SEQ ID NO: 36624 - DNA, 201 bp, Homo sapiens
gggactacaggcgcccgccaccgcacccagctaattttttgtatttttagtagagatggggttttatcgtggtctcgatctcctgacctcgtgatccgccygcctcggcctcccaaagtgctgggattacaggcgtgagccaccgtgcctggcctattttgtatttttagtagagatggggtttcaccatgttggccaggc

SEQ ID NO: 36625 - DNA, 201 bp, Homo sapiens
cttttcgtttattgctacgagtgagccatggcggctgtgcctcaaacagtgacgtaaacccctgaggccacatgattctggatgcacaaacacagaaagtytgatgggcttaggtcttcttttcctccatgggccaattgtccatctatagttcagtaaaccgtgggtaaggaggtggttacataaatcacacatgtcttc

SEQ ID NO: 36626 - DNA, 201 bp, Homo sapiens
aggtgtagtggcacacgcctgtagtcctagctacttgggaggctgaagtaggaggctcacttgagcctggagggttgaggctgcagtgagcagtgatggtgcccctgcattctagcctgggtgacatcaataacctatctccaaaaaaaagagaaaacaatccttggacaggctgtcatccatagatcctgcagaaggcaa

SEQ ID NO: 36627 - DNA, 201 bp, Homo sapiens
ggaatctcttttcctttttgtatcaggccaggataataggatagaggagaggccagatctgtagagaatgagcaagtggcttgtttagggtttcctgcccytgtgaggtaagggctcaaggattagattcagtctttccatttgcagtgaaaggaagtaaactcactttcccaccctcatcctggaggttacttatgttat

SEQ ID NO: 36628 - DNA, 201 bp, Homo sapiens
tctttcttgtttatggggccttgtgttctttcattttacttctgtgtgcctcctatattcatttctctgcttttcgtttattgctacgagtgagccatggyggctgtgcctcaaacagtgacgtaaacccctgaggccacatgattctggatgcacaaacacagaaagtctgatgggcttaggtcttcttttcctccatgg

SEQ ID NO: 36629 - DNA, 201 bp, Homo sapiens
ggatccccccgggggctggggatgtctcataacttttagttccagtaataaatgggaagaaaagaaatttactgtaggtcaagtactgagccaagtacttyatggacattatctcattaaccttgtctacaatcccagtaagtaggtggtagtatgcacattttacaagtaaggaaactgaaccatctaataaactagtta

SEQ ID NO: 36630 - DNA, 201 bp, Homo sapiens
cacctgggatgtagaacaagcattgacattgtttggaatggcagtatgttggcttttcctaggggatcaataagaagaaaataactgggcttggggagagracctggctgaagcttgtatgaattactagtgaaccagatttatatacctctgcaactttcttccgaaatgttctctgtcttggaaaagatatggaagagt

SEQ ID NO: 36631 - DNA, 201 bp, Homo sapiens
acctccgcctcctgggttcaagcgattctcctgcctcagcctcccgagtagctgggattgcaggcatgcgccaccatgtccagctaatttttgtatttttrgtagagacggggtttcaccatgttggtcaggctggtcttgaactccccacttcagctgatctgcccacctcagcctcccaaagtgctgggattacaggcg

SEQ ID NO: 36632 - DNA, 201 bp, Homo sapiens
ctgaaacttagatggacagtagggttctctgcttctgtagagatgctggtggtggggagtgggctctctcttgtttgtttatagcctttggtggggctgarattataaagaacattaaaatgaatattgccttttctttgcccgttttcctctcacataagggtactttctgagacttttacctcagttttatctttctgc

SEQ ID NO: 36633 - DNA, 201 bp, Homo sapiens
gtcctcactggctgaccagattctatcacatgggagtggaagagagttcctttccactcaaaccaggcagagatctcaggcttcctgagttaggatctttwccaggttcagctctctgttggaagtagaaaggaagaagccattctagaaatcactaatgagaggattgagcttgttttcagaaagctggaaagaaaagac

SEQ ID NO: 36634 - DNA, 201 bp, Homo sapiens
aaagtcttactctgtcgcccaggctggagtgcagtggtgctatctcagctcactgcaacctctgcctctcgggttcaagtgattgtcatgcctcagcctcyctagtagctgggactacgggcgtgcgccaccacacccggctaattttttgtatttttagtagggacggcgtttcaccatgttggccaggctggtcttgaa

SEQ ID NO: 36635 - DNA, 201 bp, Homo sapiens
acaaagtcttactctgtcgcccaggctggagtgcagtggtgctatctcagctcactgcaacctctgcctctcgggttcaagtgattgtcatgcctcagccyccctagtagctgggactacgggcgtgcgccaccacacccggctaattttttgtatttttagtagggacggcgtttcaccatgttggccaggctggtcttg

SEQ ID NO: 36636 - DNA, 201 bp, Homo sapiens
tggaataggagaaatattgtggcagcactaaagatttgaattggtttctagtatattcatatatttagattcttaaaataaatattggctttttttttttytaatgggccagctctgtatatgcccaaaacagttttgttgttgtttttttctttttcttttttttttcttttagacaaagtcttactctgtcgcccaggc

SEQ ID NO: 36637 - DNA, 201 bp, Homo sapiens
ggggttacgtttctcctcccctgattcttcccttggggtgggctgtctgcatgtgcagtgacctgctagcacttgggaggggtcgcatgtgcagtgtgttkactaaagttgtatacatgctcacttgaggcgtttttcccttaccagtcgagcgtttttagaggaagttcatataccagtttaaactctgccactttgcct

SEQ ID NO: 36638 - DNA, 201 bp, Homo sapiens
gttaaactgcatgccatgttacttttaaactacaagtcgtgtagcatattaagtttcccatccatttacacagctggtggagggcatctaacttgttggtstagtctgttgcatgcaactgtcatctcagatgttgacatactgactctcagcagtttcatagtcttgtcccttttttgttacattagttggaataggaga

SEQ ID NO: 36639 - DNA, 201 bp, Homo sapiens
aaaaattaagcaaaaagtacacatgtactaagagagagaaaagaggggttttgatttaacttcagaggtttacgaactgttgcatctgctttacctcaagyagtcagtgtgcttaccccagggacagtggcaaagcaagacgctagcagcagagtgggctggtcctttatacacagagacttgcttattatacagttaaca

SEQ ID NO: 36640 - DNA, 201 bp, Homo sapiens
tcccccaaagccctggtagtcttataagaggacagagcaaaaatggttctgctgtcatagggctcctctgacaccttttgctggcagcagtcaacctaatsaagtggtatctccattctaggaaggaaactgccttataggtagatgagttggaaggtgagaatgaaggacacctaggtgatatacagacaaggttgtagt

SEQ ID NO: 36641 - DNA, 201 bp, Homo sapiens
gctaatacctaatacctagcactggcaggagtatatcacactgatggtgaaggtggaagtattccccttcctgtatcctgaccagcagacttggactcccwagagacatagcacacaggggaaatttaaaccaattgcacagtctttatttctgtctttatttcacagagcatctagggtgaatccttaccttccttccta

SEQ ID NO: 36642 - DNA, 201 bp, Homo sapiens
tttagtgcataaattcataaaagggcaagagaggagaaaacagcagtaaaattttagaagttagaaagcagctggatgaggcgataactaccttagcaagstagagtaaaccagatcctcaacttaaagtggaggaagctaaggaacaacctgatttatactacagaactccccaaagcctcaaaaattgggagcaccaga

SEQ ID NO: 36643 - DNA, 201 bp, Homo sapiens
ttttttttttttcttgaaatggagttctgctcttgttgcccaggctggagtgcaatggtgcgatcttggctcactgcaacctccacctcccgggttcaagygattctcctgcctcagcctcccaagtagctgagattataggcatctaccaccacacctggctaatttttgtatttttaatagagatggggtttctccttg

SEQ ID NO: 36644 - DNA, 201 bp, Homo sapiens
ttgaacgtttgtttagaggagacaagactgttttgtaattcctagccactctccagtggattgaagttgtcctacatatttatcagattttttaattgggytttttaatacaaaaaataattagctgggcatggtggcaggagactgtaatcccagctgctcgagatgctgaggcaggagaatcgcttgaacccaggaggc

SEQ ID NO: 36645 - DNA, 201 bp, Homo sapiens
aatctgaaacttagatggacagtagggttctctgcttctgtagagatgctggtggtggggagtgggctctctcttgtttgtttatagcctttggtggggckgagattataaagaacattaaaatgaatattgccttttctttgcccgttttcctctcacataagggtactttctgagacttttacctcagttttatctttc

SEQ ID NO: 36646 - DNA, 201 bp, Homo sapiens
ttattattattttgagacagtctcgctctgtcgcccaggctggagtgcagtggcgcgatcttggctcagtgcaatctctgcctcctgggttcaggcaattytcctgcctcagcctcccgagtagctgggactacaggcacacaccaccacacccagctaattttttgtacttttagtagagacggggtttcaccatgttgg

SEQ ID NO: 36647 - DNA, 201 bp, Homo sapiens
ttttgtaattcctagccactctccagtggattgaagttgtcctacatatttatcagattttttaattgggctttttaatacaaaaaataattagctgggcrtggtggcaggagactgtaatcccagctgctcgagatgctgaggcaggagaatcgcttgaacccaggaggcggaagttgcagtgagccaagataccgccat

SEQ ID NO: 36648 - DNA, 201 bp, Homo sapiens
accatgctgcttggacacttatgcaacctgatttaaaacactgattctaccaaaattcctcaaattccttaagggacatatggggtagcacagatgagaargtggacaaaatttcctgccaccttctagatttatggtttctgaccagttaaacatctgttatagaaaagaatgacaaatattttgttcataatgattccc

SEQ ID NO: 36649 - DNA, 201 bp, Homo sapiens
agtctcactctgttgcccaggctggagtgcagtggcgtgatctcggctcactgcaagctctgcctcccgggtttccgccattctcctgcctcagcctcccragtagctgggactacaggcgcctgccgccacgcccagctaattttttgtatatttagtagagacggggtttcaccgtgttagccaagatggtcttgatct

SEQ ID NO: 36650 - DNA, 201 bp, Homo sapiens
tttttctcactttcactttagcctagagtaagattgaagacctctttccccagaaatgtccaaacaagggcaatatattcctgagtttggtacgcttcaaygttatatgcggttgttcagccaaacctgctatggaaaagattatgagaaagaaaggccatgttaggtaactgatgtctggagtcacagaatgaactactc

SEQ ID NO: 36651 - DNA, 201 bp, Homo sapiens
gtgttaaatctgaaacttagatggacagtagggttctctgcttctgtagagatgctggtggtggggagtgggctctctcttgtttgtttatagcctttggkggggctgagattataaagaacattaaaatgaatattgccttttctttgcccgttttcctctcacataagggtactttctgagacttttacctcagtttta

SEQ ID NO: 36652 - DNA, 201 bp, Homo sapiens
agcaattcccctgcctcagcctcccgaatagctgcgactataggcacctgccgccacgcctggctaatttttcttgtttgtttgttttttgtgtttttttktgtgtgtgtgttttttttttgagatggagtctcactctgttgcccaggctggagtgcagtggcgtgatctcggctcactgcaagctctgcctcccgggtt

SEQ ID NO: 36653 - DNA, 201 bp, Homo sapiens
cagagctttcccaacatttttgtttcacagtgcccatggtgttttaagaaatttgtcatggcacctcaaggccaaaaaaaacagaaacaaaaaaaaactcmtaatacttctacttgctaagaagttaggtccaaacaacttagtagttgttcatatggtgttcaacagatgtcactgtattttcctcaaaaatgtaaaata

SEQ ID NO: 36654 - DNA, 201 bp, Homo sapiens
aagattatagtgaactatgatcatgctgctgcattccagcctgggaaacagaatgagaccctgtctcaaaacaacaacaaatagcaaatttttcttttttyttttttttttttttttttgagacggagtctcgctctgtcgcccaggccggactgcggactgcagtggcgcaatctcggctcactgcaagctccgcttccc

SEQ ID NO: 36655 - DNA, 201 bp, Homo sapiens
attagccaggtacagtgacttgcagctatagtctactcgggaggctgagacaggagaatcgcttgagccgaggaagtggaggttgcagtgagccaagatcrcactgtttgcactctagcctgagtgaaactctgtctcaaaaaaaataaaaggcataagtttctttcacttggattattgtgtcagcctccccatttagtg

SEQ ID NO: 36656 - DNA, 201 bp, Homo sapiens
gtggtatttttgtcttagagcaaatgccattgtttcctgacggatttctgtggtagttggatctttgatttcaaacccaatataaagtttccttaataaaygcaaagtatagcctatgattctatgtatttttctgtatctcaatatctagctccttatttatcctctagttaccatttctttttttatctttatatgcat

SEQ ID NO: 36657 - DNA, 201 bp, Homo sapiens
cctttttggccgtaggtttccttggtttcaaaattgtagggtatacagactggtgctagactgagagacatcaattctctgtaaaatgaaaaaagataaagaaaatgtagtgtgtctttcataaagctaaacttaaagaattgtcttttattctgaaattgtctctcctactttctaatgttaaaatatcctttattttat

SEQ ID NO: 36658 - DNA, 201 bp, Homo sapiens
ctttggaactgggtagagctgggttcaagtttgacttcatgacttaccttgtgatcttgggcaagctgcttcatctgtctggactttatttttctggctawcttacagagttgttgagcattagaaagaatagatacaaggtgcttagcacctaagtaggtgctgaataaatgctatttaattttttttttttttttaaga

SEQ ID NO: 36659 - DNA, 201 bp, Homo sapiens
acctgggaggcagaggttgcagtgagccaagatcacaccactgcactccagcctgggcaacagagcaagtgtctaaataaaaagaaagaaagaaagaaagraaggaaggaaggaaggaaggaaaagaaagaaagaaagaaaggaaggaaggaaaagaaagaaaggaaggaaggaaggaaggaaggaaggaaggaaaagaaa

SEQ ID NO: 36660 - DNA, 201 bp, Homo sapiens
ctagaaacttgaaagtgatgtaataagaaattattgtttcaaagttaaatcactaagaatatttaatgagggcttttacacatagaaaacacttaagactracattgaggacaaaaactgtccaactgacttgaagtgttaagaattctattattacacaattctgccacaatgagaactgtgtagatgtacagagagcaa

SEQ ID NO: 36661 - DNA, 201 bp, Homo sapiens
cctcagtgcgtgtttctaacacctgaggggaaatggcttaatgattttaagggtttccttattatttatccatattcatcccatatttattaaatgacagytactgttcctagaccttcatggacaatggatcagctcttacagaacttactcactgagataaaatgaaatgccattatttaggaggcagggaaataattg

SEQ ID NO: 36662 - DNA, 201 bp, Homo sapiens
ttgtaaattaaaaaaaaaaaatttctttttgagacagggtcttgctgtcacccaggctggagggcagtgacacaatcttggctcactgcaacctctgcctyctgggctcaagtgaccctcccacctcagccacccaagtagctgggaccacaggcgcaagccaccatgcctggcttatttttgtattttttgtagagacag

SEQ ID NO: 36663 - DNA, 201 bp, Homo sapiens
gctgttctgttagcctggttgctcatcacactgctaactgcatggtatggtcatgcatgtaatagccatactgttccctaaaacacatcctgtatacttamatgtctccaaatcactacttgtgctttgtaaattaaaaaaaaaaaatttctttttgagacagggtcttgctgtcacccaggctggagggcagtgacacaa

SEQ ID NO: 36664 - DNA, 201 bp, Homo sapiens
ggaaggtctaagggtcatgggggccccctgggctgcggggtggtcaggagcagagtgtgggggactgtggactcccaggcgctgccttcaccctgccccaracacacccaggagtaagaattaggtgatgtctttgcccacctgggctgccccgggaagacagcctggtcctggggagacaggtgagtaaacagaggccgg

SEQ ID NO: 36665 - DNA, 201 bp, Homo sapiens
tatcttcttgaaccaccgaaaacgtagtgaataaaaactgcaattgaattttatagggttgtagagagctttgaattctaaaactaaagtgatcaaatccrtaaaggattttgaatagagagagaggtgatgtgggctaagtggtgattaggaagatttgtcgaaataggctgtttgctctctatttgccacagctatcaa

SEQ ID NO: 36666 - DNA, 201 bp, Homo sapiens
ggctggagtgcagtggcacaatctcagctcgcaacctctgcctcccaggttcaagccattttcctacctcagcctcctgagtagctgggattacaggagcrcaccaccttgcctggctaatttttgtatttttagtagagatggggtttcaccatattggccaggctggtctcgaactcctgacctcaagtgatctgccca

SEQ ID NO: 36667 - DNA, 201 bp, Homo sapiens
ggtagcagccagacttaaactttttcctacctttaacaggaaatgacaaaagttgggaaaaaaagaaggggaatggctcggatgactctactggcccatckcctctggatagttaagagctgactgtcctaatcaaagtcctctcctccattgcagcagaacttgcctctttttgaggctcaggacctcttgggaacttga

SEQ ID NO: 36668 - DNA, 201 bp, Homo sapiens
cagattttaataattcagaagtggcttcttttatccagtggaaagtttattttatttcccatttgcccttagtatgggataggtgaaatcattaccacagmgagagagagagcgtctatgaaattaaagctctgatttgaagaaaggggatcagagactcctcattcctaggtctcttaaatatgagtaattgtgtgctat

SEQ ID NO: 36669 - DNA, 201 bp, Homo sapiens
aaaagccaagcttagttatggatcttatattaaataagagttaagattccaagtgagctataaagtctgtagttttttttgtttggtttttttttgggggrggtgctttttgtgttggcaaattcagccagcgtgaggttttttgtttgtttcttttttgtttttttgccttaaatctggattcaaagttatgttctgggg

SEQ ID NO: 36670 - DNA, 201 bp, Homo sapiens
ggagacacagtattgtaaattgaaggtgagtttctgccgattctcttacattctgctcatagagtctggttccccccaatcaactctcttccgtaattcaraaatctcctggtttggccctgttttggttttctgcttattaggttatatcatttactatgcacttattcatatctattataacattttcccaattttcta

SEQ ID NO: 36671 - DNA, 201 bp, Homo sapiens
gctgagcctataattcctgaaattggcgctttttctttctgtgtgtgtgtgttttacttgaaattcagtcaaagctggaagaggccctcaacttggcaacmgaattccagaattccctacaagaatttatcaactggctcactctagcagagcagagtttaaacatcgcttctccaccaagcctgattctaaatactgtcc

SEQ ID NO: 36672 - DNA, 201 bp, Homo sapiens
cctgtctccactaaaaatgcaaaaaaattagctgggcatggtggcgggcgtctgtagtcccagctgctcagaagactgaggcaggagaatggcatgaaccygagaggcggagcttgcagtgagccgagatcacgccactgcactccagcctgggcgacagagcgagactctgtctccaaaaaaaacaaaaaaaaattaagc

SEQ ID NO: 36673 - DNA, 201 bp, Homo sapiens
cttgcctagcctattttacttttctgtgtcatttaaagtgctgtccagtaggacttgctgccaagatggatttgttctctatcaatagtccagtagagtamccactggccatatgtggctttgactatgtgaaacgtggctagtgggtctgaggaactggattttaaatttaatttaaatgtcaatagctatatgtagctg

SEQ ID NO: 36674 - DNA, 201 bp, Homo sapiens
aagcaattctcctgccccagcctccgaagtagttgggattacaggaatgtgccaccacacccagttaatttttttttttttttttttttttttttttttgkatttttagtagagacagggtttcactgtgttggccaggctggtctcgaactcctgacctcaggtgatccgcctgcctcggcgtcccaaagtgctgggatt

SEQ ID NO: 36675 - DNA, 201 bp, Homo sapiens
gtttttttttttagacagagtctcactctgttgcccaggctggagtacagtggcacaatcttggctcactgcagcctctacctcccgggttcaagcaattytcctgccccagcctccgaagtagttgggattacaggaatgtgccaccacacccagttaatttttttttttttttttttttttttttttttggatttttag

SEQ ID NO: 36676 - DNA, 201 bp, Homo sapiens
tcatggaacaaaaaaaagtttttgtttttttttttagacagagtctcactctgttgcccaggctggagtacagtggcacaatcttggctcactgcagcctytacctcccgggttcaagcaattctcctgccccagcctccgaagtagttgggattacaggaatgtgccaccacacccagttaatttttttttttttttttt

SEQ ID NO: 36677 - DNA, 201 bp, Homo sapiens
ttgtataaaataagggttctataagattacaatttgccaagggagtctttttaagcaaaaattggagagcaccacaattccagttcagtgtttgaacgctytgctgatcggcagaatcttcattggttttttgcattccctaacaccgtttgtgtacaaggattcattcattcatggaacaaaaaaaagtttttgtttttt

SEQ ID NO: 36678 - DNA, 201 bp, Homo sapiens
agaaccaagttagatgatatccatagagataaattatgttgttcaacatgttttaggtcctaaaaaatgatgttttggctcatcaagccacagtggaaacmgtcaacaaagctggcaatgagcttcttgaatccagtgctggagatgatgccagcagcttaaggagccgtttggaagccatgaaccaatgctgggagtcag

SEQ ID NO: 36679 - DNA, 201 bp, Homo sapiens
ttgggggtcgggggacaaagaggacaactcaagtggaagacgtgggttctaggtccacctctactgccactttgcttgacctcagcctctgtgagtacttmagtgtctctgtaacatagggatgctaattacagtcagctgcattattgcacattctgtgaactgtgcagtgcatagggaacatatcaccattatggcatt

SEQ ID NO: 36680 - DNA, 201 bp, Homo sapiens
gagatataaagaaagtgctctgaaagcatagtaaggatcagtatccagcttcacagaagagctatttaaattgagtcctgcagttaatagaatttagagtyagtggaggacattgtaggctgaatagtctaagcaaagccaaccagtcattgatacccatgtcctggtgtgtcatgtactggtgtgggtactgacgtgcag

SEQ ID NO: 36681 - DNA, 201 bp, Homo sapiens
ccgtgttcaagcgattctcctgtctcagcctccctagtagctgagattacaggcgtgcgccaccacgcccagctaattttttgtatttttttttttagtaraaatggggtttcaccatgttagccaggctggtcttgaactcctgacctcaggtgatccgcccaccttggcctcccaaagtgctgggattacaggagtgag

SEQ ID NO: 36682 - DNA, 201 bp, Homo sapiens
tcttactttgctcccttcacttttgttgttcccatgtttagcattttaaggtatacatctgagtatataatgccaaaaccagaaagcagattaatgagaaygcttttgttttgtgtatataaatgggaacttttgtatgatttagcaggaagataatctctaattcactagaaggagtaagagagatgcaagtaatttagg

SEQ ID NO: 36683 - DNA, 201 bp, Homo sapiens
tgttgcccaaactggagtgcaatggcacgatctcggctcactgcaacctctgcctcccgtgttcaagcgattctcctgtctcagcctccctagtagctgarattacaggcgtgcgccaccacgcccagctaattttttgtatttttttttttagtagaaatggggtttcaccatgttagccaggctggtcttgaactcctg

SEQ ID NO: 36684 - DNA, 201 bp, Homo sapiens
aggatccagatagggccagagcatgagcctgaattgggaagaaaattagaaattccactcaaaaagtcagaagtttggctttcttgggcaagtcaaactgrtaatctactgtgatcaagaaccaaagagaggccaggaacagtgcctcacacctgtaatctcagcactttgggaatctgagacaggaggattgcttgaagc

SEQ ID NO: 36685 - DNA, 201 bp, Homo sapiens
tctggtgtgcaagagagccggtcacacagcgagagagtgagccccactggccactgactcctcactttaacacagcttggtgcttctgttcttcatccccrtgaaataatgagcacttctcaatggaagcacttagtgagttcatgaaggttgcgagatccattccttgaaactgttgagagactcttgttttcagaggct

SEQ ID NO: 36686 - DNA, 201 bp, Homo sapiens
cactcattcaccgataccggtaagaacagtggaatttctgtgctcctgcagggctttttctcatctcttgtttgtaattagttataatactgtttccatcycctcaatcaaaaatcaaagctttgattcatttgttcatttgaaaaagaaacatttatttaactacttttctaggaactgggtacaagtagcagtgaagaa

SEQ ID NO: 36687 - DNA, 201 bp, Homo sapiens
ttaaattgctttaatattctatatatagtaggtgttggcagtcacaaatttaactttgtggtttcagtcatgaaaattcatggatttgcatttgtttctgstgtgcaagagagccggtcacacagcgagagagtgagccccactggccactgactcctcactttaacacagcttggtgcttctgttcttcatccccgtgaa

SEQ ID NO: 36688 - DNA, 201 bp, Homo sapiens
cagtgaatgtatcttcaggtctctggtttttgtgtgtttttttttttttttttttttttttggagacagagtcttgctctgtagcccaggttggagtgcartggggcgatctaggctcactgaaacctccacctccggggtccaagtgatcctcctgcctcagcctcccaagtagctggggttacagtcgctcaccaccac

SEQ ID NO: 36689 - DNA, 201 bp, Homo sapiens
tgcttcaactcaattttagtataaatatgacctaatcatttgttcagctgaagaaacttttctgctggtgacactgcaattagcaaatacttcgggttaaytcctgaaaacctgatgcagaaaatcagattttcttctaagcttgtaatgatgctttgcaaaggtttccttaaggcttgaaatagtattcactattttcca

SEQ ID NO: 36690 - DNA, 201 bp, Homo sapiens
tgcatatgaaacatacacatacattatggggatcacaaataaacacagcagaatgaatgaaaaaaaaaaaaccctaatccagtgttatgtaactggactcktgtggtttgaaatgaaatacccagagacaatgtagattcagaaaagtgctgttattaactttaaaatcttagaaaagtagacagtattttctagaaaatt

SEQ ID NO: 36691 - DNA, 201 bp, Homo sapiens
attatttcttccttaaatgaatgtggaatactaaaatacattattcctaggaaaggctttccctcagttgcttctgaatgattagtaggtcctcactggcwgaccagattctatcacatgggagtggaagagagttcctttccactcaaaccaggcagagatctcaggcttcctgagttaggatctttaccaggttcagct

SEQ ID NO: 36692 - DNA, 201 bp, Homo sapiens
gcttatagtcagttcatgaaaaagggtgaataaatctatgtcaccatctgctagttcaatcactatcatttttttgtagagatcaactgacataattgatyaaacaaaaaagaggaatgaaaaatctaagaaagttttagttattgttcctgggaatataatctcctaatttgaagtgttgaaagtaattgtatacaagcc

SEQ ID NO: 36693 - DNA, 201 bp, Homo sapiens
gagtctttgtcttttccattcctttcctttttttaaaaaaaaaaaagagacgaggttttgctatgttgcccatcctgaacttgaatttcaagcctcctccyaccttagcctcccaagtagctgggactataggcaccctctaccatgcctggctctttttctttcctttgcattttttttttcttaaagatttgtatggtg

SEQ ID NO: 36694 - DNA, 201 bp, Homo sapiens
gatgctttatctttagtgggtgatgaggtcagctagaaacttgaggacataataatcaagtacttacttgctcagaacaactcgtctcatccactgagagrcttaccaagtccaaactcctcagctgggataagataagataccaagtcgaaactcctcagctgggataaagataagatagattaccagttcctttgtaat

SEQ ID NO: 36695 - DNA, 201 bp, Homo sapiens
gtaccagaagtttctgttcttttgtctcacttttctatttgtgtttacatattatgaggaatgttcatagttgtttttttctttctttctttctttctttyttttttttttttggagacggagttttgctcttgttatccaggctggagtacaatggagcacaatcctggctcaccgcaagctccgcctcccgggttcaag

SEQ ID NO: 36696 - DNA, 201 bp, Homo sapiens
ccactgcgcctgtaattttttttaaagagatgaggtctcagctatgttgcccaggctagagagcagtggcgattcacaggtaccatcatagcgcacagtakccataaactcctggactcaagcttgtagctgggactgcaagcacaccaccatgcctagctaagataccattttatacccatcagattggcagaaggtaaa

SEQ ID NO: 36697 - DNA, 201 bp, Homo sapiens
tgtatccaaatcatcttgttcaatgcaaggaagttaatccctctcttccctagggaatcaggctttgataattaaaaaaaaatttttttttgtaatggcamcagaaccctcattcttcccatattgctattagttatattctgttgacttctaaacactcagagcagggatcagccctgagtttggctgattctgagtctc

SEQ ID NO: 36698 - DNA, 201 bp, Homo sapiens
tgtaaatggaagataagaatagcatatgcttggtagggttgttgtgagaataatatgaattaatacaagtaatcacaataaatgctagttaatattattamttaaaagaacaagaaaatgaataagaaaaagacaaacacccttgtagaaaaataggggaaagcccaggaataagcaattcacaaaaaaaggaaatccaaa

SEQ ID NO: 36699 - DNA, 201 bp, Homo sapiens
gggaggattgcttgaggtcaggagttcgagaccagcttggccaacatggtgaaaccccatctctactaaaaatataaaaattagctgggtgcggtggcatscacctgtaatcccagctactcaggaggctgaggcaggagaattgcttcaaccctagaggcggaggttgcagtgaactgatatcgtgccttccaaagtgct

SEQ ID NO: 36700 - DNA, 201 bp, Homo sapiens
cttcaggttataatttcattaaaataattttattgttttctgacctgaaaaaattcagaatatgtatatctgcttgatattttcttttgggcatcttggtrcaacacttaaaatctatttcattttgtagtttgggagccataattgcagcttcaccaggcttggttcttcttggcccgggcccttcccttcccttgctgg

SEQ ID NO: 36701 - DNA, 201 bp, Homo sapiens
gtggataccttttgaatggtatgaaggcagctttgctgattcagagtcatgatcactagctttccatgaccaatgtgacttaatttttaacctcaccttakcagccatttgtcttgtgtttctttactggggttccatgatgtgttggtcagtcaaaagcactagaagacacttacaactaaccctttagacctggttcac

SEQ ID NO: 36702 - DNA, 201 bp, Homo sapiens
tcaggaggctgaggcaggagaatcgcttgaagccgggaggcacaggttgcagtgagccaagatcatgccactgcactccagcctgggcaacagagcaagastctgtctcaaaaaaaaaaaaagtaaactttcccccattgacattgacactccatctcctcttcgtctcctttagtattctccatagcatttatgtgacaa

SEQ ID NO: 36703 - DNA, 201 bp, Homo sapiens
ctcaggaggctgaggcaggagaatcgcttgaagccgggaggcacaggttgcagtgagccaagatcatgccactgcactccagcctgggcaacagagcaagrctctgtctcaaaaaaaaaaaaagtaaactttcccccattgacattgacactccatctcctcttcgtctcctttagtattctccatagcatttatgtgaca

SEQ ID NO: 36704 - DNA, 201 bp, Homo sapiens
ggtggatcacctgagatcaggagttcgagaccagcctgcccaacatggcaaaaccgtgtctctactaaaaatacaaaaattagccgggcgtggtggtgggyacctgtaatcccagcttcttgggaggctgaggcaggagaatcacttgaacccggtaggtggaggttgcagtgagccaagatagtgccactgcactgcagc

SEQ ID NO: 36705 - DNA, 201 bp, Homo sapiens
aattttttgtatttttagtagagatggggtttcactgtgttagccaggatggtctcgatctcctgacctcatgatccgcccgcctcggcctcccaaagtgytgggattacaggcgtgagccactgtgcctggcctgttgtgacagaattttttaacaaagggataaaatatatttatttggaatcaggcataataaaagtt

SEQ ID NO: 36706 - DNA, 201 bp, Homo sapiens
caccattctcctgcctcagcctcccaagtagctgggactacaggcgcccaccaccacggctggctaattttttgtatttttagtagagatggggtttcacygtgttagccaggatggtctcgatctcctgacctcatgatccgcccgcctcggcctcccaaagtgctgggattacaggcgtgagccactgtgcctggcctg

SEQ ID NO: 36707 - DNA, 201 bp, Homo sapiens
ctggttatgtaaattccctgcttatttatagacctcttcagtcttaatcccagccactggttcaaaggaagaaaaaaaccttttgtataaaataagggttytataagattacaatttgccaagggagtctttttaagcaaaaattggagagcaccacaattccagttcagtgtttgaacgctctgctgatcggcagaatct

SEQ ID NO: 36708 - DNA, 201 bp, Homo sapiens
tgccaaaaactcgtttgctttttctgtaatgggatctgaggcctactgagaccaatctctggttatgtaaattccctgcttatttatagacctcttcagtyttaatcccagccactggttcaaaggaagaaaaaaaccttttgtataaaataagggttctataagattacaatttgccaagggagtctttttaagcaaaaa

SEQ ID NO: 36709 - DNA, 201 bp, Homo sapiens
aatatttcacaccaggcacagtggctcacacctctaatcccaacatttgggaagccaagggaagaggattgcttgaggccaggagttcgagaacagcctargcaacatagtaagaccccatctctgagaaaataaaaagaaaaaaaaaaaaacagaatatctccagtataaagcttatatagcagtaatcatgaaatataa

SEQ ID NO: 36710 - DNA, 201 bp, Homo sapiens
tcttttcaaataggtatgttggttggttgaaagaatttaccaaagtagattggagagaagcaataaagctaaatgattaagaacttttaaatgcaaatatrtgtttctgaaaaccagagctaggcataatgtttatgaaaaatagagatattttagtcatctttgtcaaactgcctttgtgtccttaagcaagtcattttc

SEQ ID NO: 36711 - DNA, 201 bp, Homo sapiens
ctgcagtgcccaccccagaggagcccacctccccagctgctgcagtgcccaccccagaggagcccgcctccccagctgctgcagtgcccaccccagaggarcccgcctccccagctgctgcagtgcccaccccagaggagcctgccttcccagctcctgcagtgcccaccccagaggaatccgcctccgcagctgttgcag

SEQ ID NO: 36712 - DNA, 201 bp, Homo sapiens
cagctgctgcagtgcccaccccagaggagcccacctccccagctgctgcagtgcccaccccagaggagcccgcctccccagctgctgcagtgcccaccccrgaggagcccgcctccccagctgctgcagtgcccaccccagaggagcctgccttcccagctcctgcagtgcccaccccagaggaatccgcctccgcagctg

SEQ ID NO: 36713 - DNA, 201 bp, Homo sapiens
ccagctgctgcagtgcccaccccagaggagcccacctccccagctgctgcagtgcccaccccagaggagcccgcctccccagctgctgcagtgcccacccyagaggagcccgcctccccagctgctgcagtgcccaccccagaggagcctgccttcccagctcctgcagtgcccaccccagaggaatccgcctccgcagct

SEQ ID NO: 36714 - DNA, 201 bp, Homo sapiens
cagctgctgcagtgcccaccccagaggagcccacctccccagctgctgcagtgcccaccccagaggagcccacctccccagctgctgcagtgcccaccccmgaggagcccacctccccagctgctgcagtgcccaccccagaggagcccgcctccccagctgctgcagtgcccaccccagaggagcccgcctccccagctg

SEQ ID NO: 36715 - DNA, 201 bp, Homo sapiens
gaggagcccacctccccagctgctgcagtgcccaccccagaggagcccacctccccagctgctgcagtgcccaccccagaggagcccacctccccagctgytgcagtgcccaccccagaggagcccacctccccagctgctgcagtgcccaccccagaggagcccgcctccccagctgctgcagtgcccaccccagaggag

SEQ ID NO: 36716 - DNA, 201 bp, Homo sapiens
caccccagaggagcccacctccccagctgctgcagtgcccaccccagaggagcccacctccccagctgctgcagtgcccaccccagaggagcccacctccscagctgctgcagtgcccaccccagaggagcccacctccccagctgctgcagtgcccaccccagaggagcccgcctccccagctgctgcagtgcccacccc

SEQ ID NO: 36717 - DNA, 201 bp, Homo sapiens
agtaaaatctgtctctctgatatgaaattataaacactagttgttgatttcaggccctcaaacatcccaggccttgcaagtcactatagaaatgttctagrcaagtgggaagaacaggggataagagaaaaaaactaaagatgagaacaaactggctttaaaaaaacatcattgcttgagagtgtccaatatgcctatttg

SEQ ID NO: 36718 - DNA, 201 bp, Homo sapiens
ctgaacctctttttggcagcttcttctcttactcccaaatggcaacaagtgttatctctttgattgagctcttggtccatgcagtctaattaccaattcaraacagtgggggaacttcttattttacacaactggcaactgagtacagatttccactactgcagtagttagaagagagtagttggggttgaaattaaaagt

SEQ ID NO: 36719 - DNA, 201 bp, Homo sapiens
ctcatctctatagatgccaagtgtcaggtaccctgttacatctgaaaactagtcccatatctacctagatagtagtagtttgtatttaagttttaagatargagatatttcagagctgtcacttcacatctgacaaagttcctagggggatgaaggtacctttggaaacaattatatctattgactgaccacttgcccaca

SEQ ID NO: 36720 - DNA, 201 bp, Homo sapiens
ggaaagatagttaaggctatgctagtgtaagtctttatggcttgcatggaaccaggcaggctactgctttctgctgtgtggcctggatccttttgttgtaraataaataactgcaataggaaagaaacacatatataattttattctccattcacagccctttgggttatagtcttttcccatatagcagatactatacta

SEQ ID NO: 36721 - DNA, 201 bp, Homo sapiens
cttagaagggattgtgtaaaagccgttgctttagggcttcttgttgctttccttttgtggtcttttccttttttttttttttttttttttttttcaggtcyccaggaaagatagttaaggctatgctagtgtaagtctttatggcttgcatggaaccaggcaggctactgctttctgctgtgtggcctggatccttttgtt

SEQ ID NO: 36722 - DNA, 201 bp, Homo sapiens
tggcctagtctgtcttctgcatgcatattggctgcctgcttttctctgttatttcagcacagccaaatgcctatttatttgtcttcttgtaggtgggagcmccgctcccagaatattttctcagttttaactatggattccttttctttgccgttctgagggcttggtatttgcctatactagctaagtgttctggtgtgt

SEQ ID NO: 36723 - DNA, 201 bp, Homo sapiens
gaaagcttgcctataggtatctgatttaattattttgaatagtcaatgggctaaccaaggagaagatgaggggatcaaatatctgatgtttaaattaaacyagtattcatctctttactttaaatttggtctcttaaaggtctcgcattttgtttcatttgtagtgccacagtttcaggattaatggtattctttcctttc

SEQ ID NO: 36724 - DNA, 201 bp, Homo sapiens
aatacaaaaattagccaggtgtgttggcgcactgtagtcccacctacttgggaggctgcaaagcatgagaatcacttgaacccgggaggtggaggctgcartgagctgaaattgtgccactgcactccagcctgggctacacgagactccatcacaaaaaaaaaaaaaaaaaaaaaaagaatctactacagaagatacaaa

SEQ ID NO: 36725 - DNA, 201 bp, Homo sapiens
attattttgaatagtcaatgggctaaccaaggagaagatgaggggatcaaatatctgatgtttaaattaaactagtattcatctctttactttaaatttgrtctcttaaaggtctcgcattttgtttcatttgtagtgccacagtttcaggattaatggtattctttcctttcaggctttaaatgaagaaattgttaatag

SEQ ID NO: 36726 - DNA, 201 bp, Homo sapiens
aggatcacttgagcatgggagatcaaaggtgtggtaagctgtgatcatgccactacactccagcctgggcaacagagcaagacttgtcttaaaaaataaamacaaatgtttaaaaggggagtaaaatgtaatgtttaaaatggtgtatacccatcatgctttctgccttgttaagaactaccacattgaaactgccaaatt

SEQ ID NO: 36727 - DNA, 201 bp, Homo sapiens
taaccaggaacatgaacttggtaggtgtgctctgtctggcaggatgggaaactttgttgagctttcatggaggactacagttatccctttggaactcttaygaacagaggagcttttagagaaatttgtttgttttttggtcacaaacctgccctcactgtgagtgcccaatgtttgtctcataggtgggaggtaaggaga

SEQ ID NO: 36728 - DNA, 201 bp, Homo sapiens
tatctcacatctggttatagatgatgatttctcctctccttcagtatcttgaatgccaacatgcactgaaaggtgctggaaacatctagaaacacttgacrctgaactcagattttaataattcagaagtggcttcttttatccagtggaaagtttattttatttcccatttgcccttagtatgggataggtgaaatcatt

SEQ ID NO: 36729 - DNA, 201 bp, Homo sapiens
ggcttacatctgtagctctagcactttgggaggccaacacgggaggatcactggagcccaggagttcgagaccagcctgggcaacatagtatgattctgtstgtcccccccgccaaaaaaaaaaaaaaattagccaggtgtggtggcaagtgcttgtagccccagctactcaggagactgaggtggaaggatcacttgagc

SEQ ID NO: 36730 - DNA, 201 bp, Homo sapiens
ttagttcagattctgtatctatagtgtcctaattggtttcctcccttccttttcgttactgccagaatgctctttctaaaattaaaatctgattataaaartagtcactcggaagcccttgcaatgggtttccattgtctttggggtgaatctggtttctttagcatggcatgcaaagctttcatttcctgccattattct

SEQ ID NO: 36731 - DNA, 201 bp, Homo sapiens
gatctcctgacctcgtgatccgcctgtctcagcctcccaaagtgctgggattacaggcgtgagccatcgcgtctggccggcagtttcaaaatcttgcatgytgcatgatcccatttatccaacactctggaaaaagcaaaacaaggaatcaggatcagatcagtggttgtcaggaattaggggtgagagtagggtttgatt

SEQ ID NO: 36732 - DNA, 201 bp, Homo sapiens
taggagtttcagaagactcttggtggcaagcagcctgtgtatgataccacaattagaactggcagagcactgaaagaaaagactttgcttcccgaagatastcagaaacttgacaatttcctaggagaagtcagagacaaatgggatactgtttgtggcaagtctgtggagcggtgagcatgaatgtccccttcaggggtc

SEQ ID NO: 36733 - DNA, 201 bp, Homo sapiens
ccagtttcttattatagataaagaaactgagacctggacaggtaaatgacctgcctcaaatcacaagtcagagcaaagctgagactttaactcaggccttytgacatgcagtttagtgcaccttccactatccatgctgctttctacacagcacccttcctcctttgcttcctaactgaaggaaccaaatccagggattga

SEQ ID NO: 36734 - DNA, 201 bp, Homo sapiens
taatagattttaatggtgttcctgcttctttccttctaccccaaccagtaaaaaatttcacttaccttttcatctgagttcttatggtaggatgtacatcytttgtgatagtatttatcatcttattttacagttttctgtttaattgtcagcctcccctagaccatgagttcagtgactgcaggctgtactttcttcatc

SEQ ID NO: 36735 - DNA, 201 bp, Homo sapiens
catgatcttggctcactgcaacttccacctcctagatttaagctattcttgtgcttcagcctcccagatatctgtgattacaggcatgtgccaccacgccyggctaatttttgaggagccaatgaagggacgggatttcaccatgttggtcagggttgtctctaactcctgggctcaagcaatcctcctgcctcggcctcc

SEQ ID NO: 36736 - DNA, 201 bp, Homo sapiens
tcctttcctttatgcacattaaacctgttctctgctgtttcccagtctgtcagcccctttatggtgtcagtgcttcctgacctatcatgtacaatagggcycgtactggcattctcagatctcttttttttcttccacgccttttctatccccagtgctggacctgtgttcattttctccactgagctactgagtgccact

SEQ ID NO: 36737 - DNA, 201 bp, Homo sapiens
actgcattcactttccaactggtaatagttgagccttggacggggtaccagaggcactgggtagagatggggttctctccagtgggttgtatgacatctgrgattgagtgactggcataactttctcaggagtaattatgttgacagccctacactatcaaagttttgtttgctgtgggtatttcatgctggagtaaaggg

SEQ ID NO: 36738 - DNA, 201 bp, Homo sapiens
acaggcttttagaggtctgcgttaacacatggaggaaaaagaaaacattgaaatttatcccccctcagtgtaaactaacagtgctgctaatgtagactttktacgtttttgttttcaaatcttttttgtttaggaattcatgaagaaagtagaagaaaagcgagtggacgttaactcagcagtagccatgggagaagtcat

SEQ ID NO: 36739 - DNA, 201 bp, Homo sapiens
ctgctaactccttttgccccatcttatttttctccttcactgacaccctcctatcacacacacattattggttagttatcattcccatctctgaggttcasatatgcagtggaccaccctgcctttagctgtccagactttgactgcaacctgtctttctattccactcctcctcccctcccccaaatgatttgaaatgga

SEQ ID NO: 36740 - DNA, 201 bp, Homo sapiens
gaattagcagtgttagtatctaaacttaattccctgtacctgcccaaaatgttctcaaatacaaccctctcttctttaacagtcatccctagagctgggcrtagtcccagtttctaagaaggctgaagtaggaggatcgcttgagtccaggagtttgaggctacagtgagctatcatcaccccactgtactccaacctagg

SEQ ID NO: 36741 - DNA, 201 bp, Homo sapiens
gatggggtttcaccatgttggccaggctggtcttgaactcctgaccttgtggtctgcctgcctcagcctcccaaagtgctgggattacaggcgtgagccaytgcacctggcctattttattttttaactcttttctctccttttttttttttctatctcctaccagaaggaacctttaatgtttagaaaaacgttgattta

SEQ ID NO: 36742 - DNA, 201 bp, Homo sapiens
ctccagccagggagaaaccctcctttgtcccgctcccggcggcgtaggtcagcgctgactggggctcccgctcgccctgtggagccggcccgggtctcccygccgttcggccggcccagcctttcatcctgacgcgcggggcctcccacccagcgggactcccgcgtgggccggcctctcgcgcccctcggctcgggcccc

SEQ ID NO: 36743 - DNA, 201 bp, Homo sapiens
aggcttaacatttttccttgttaacaaggattgtttttatactttttattataaaaataaagtgtggtcattactcgaagtctgaaaaaaagaagagtagsaagaaaaactaaagtcattcatagtcccactccagaggagacaaatataaacttgtttactttacacagtgctttgaattagctaagtaacctgtctaca

SEQ ID NO: 36744 - DNA, 201 bp, Homo sapiens
tcagctctctacttagaaatatttgtctttgccatctctgtatatctgaaatcctaatgagtaaatgtgattccctccataaagccttctctgatacctcytgccttccttcttcccacccttctgtcaggtcttttctaacttgcaaagccccatgattttgtcatcaccatggttttggtgaccattagtctaaaaaga

SEQ ID NO: 36745 - DNA, 201 bp, Homo sapiens
gtagagagcagtggttaaagcatgagatttggagacaggcttggatgagaaccccagctccaacactagtttgctttgtggacttcagcaagtcatttaayctcttgaagtctctgtttccttatttgtaaaatgagaataataaaggtaactactgtacagggtttttgggaagacttaatgagataatatacacaaaac

SEQ ID NO: 36746 - DNA, 201 bp, Homo sapiens
accatgggtagcacagcatctggcatgtaggtgtgtgattgtgtgggtgattgaagttataattcaccaatggctaaagaacttttactgggatgttggcstctgcagcagaagaaataaaaacattaggacttcaaagtgcaaaatttataaaatgaggtagggcactttccttgcctagatgggggccactgatactgt

SEQ ID NO: 36747 - DNA, 201 bp, Homo sapiens
agaggagcccacctccccagctgctgcagtgcccaccccagaggagcccacctccccagctgctgcagtgcccaccccagaggagcccacctccccagctsctgcagtgcccaccccagaggagcccacctccccagctgctgcagtgcccaccccagaggagcccacctccccagctgctgcagtgcccaccccagagga

SEQ ID NO: 36748 - DNA, 201 bp, Homo sapiens
cacctccccagctgctgcagtgccccccccagaggagcccacctccccagctgctgcagtgcccaccccagaggagcccacctccccagctgctgcagtgyccaccccagaggagcccacctccccagctgctgcagtgcccaccccagaggagcccacctccccagctgctgcagtgcccaccccagaggagcccacctc

SEQ ID NO: 36749 - DNA, 201 bp, Homo sapiens
agtgcccaccccagaggagcccacctccccagctgctgcagtgccccccccagaggagcccacctccccagctgctgcagtgcccaccccagaggagcccrcctccccagctgctgcagtgcccaccccagaggagcccacctccccagctgctgcagtgcccaccccagaggagcccacctccccagctgctgcagtgcc

SEQ ID NO: 36750 - DNA, 201 bp, Homo sapiens
ctccccagctgctgcagtgcccaccccagaggagcccacctccccagctgctgcagtgccccccccagaggagcccacctccccagctgctgcagtgcccmccccagaggagcccacctccccagctgctgcagtgcccaccccagaggagcccacctccccagctgctgcagtgcccaccccagaggagcccacctcccc

SEQ ID NO: 36751 - DNA, 201 bp, Homo sapiens
agaaagtttgtgatgaggatggtgaggcaaaagagctggattatcaagccacacttttggaggatcaagctccagcacatttccacagaaacttcccagarcaggtcttccaggatctccagaggaagtccccagagtcagagattctgagtctgcacctgctggttgaagaactgagacttaatccagatggagtggaaa

SEQ ID NO: 36752 - DNA, 201 bp, Homo sapiens
ctgggactggacactgatcggctgggctcttgcagagtgtgttcatcaacagtggactggtgttgacaaggcaagcctggaagaagagtgggagaagggaraagggtggtggagtgtcctgtgtgtagtccattgtcaagtcagtaggtagttaccataaaatgatcagtatccaccctcaagttggggatgcaaatcaaa

SEQ ID NO: 36753 - DNA, 201 bp, Homo sapiens
tggtggcttacatctgtagctctagcactttgggaggccaacacgggaggatcactggagcccaggagttcgagaccagcctgggcaacatagtatgattstgtctgtcccccccgccaaaaaaaaaaaaaaattagccaggtgtggtggcaagtgcttgtagccccagctactcaggagactgaggtggaaggatcactt

SEQ ID NO: 36754 - DNA, 201 bp, Homo sapiens
ttgcccattttaatttggagcaatgttgttctctgcagacacccgcaacagagctaccttatattttatcagcctttaattagtgtcaatttgacacttayaaaagaagtgggtataatctagtgagagtgatatttctctccaaattttagtaaaatataagcaacgttagaaagtaagcagaagaaaatgttctagggg

SEQ ID NO: 36755 - DNA, 201 bp, Homo sapiens
agaagatgcttccatccttatctctccatgtgttagggtactttttgcccattttaatttggagcaatgttgttctctgcagacacccgcaacagagctaycttatattttatcagcctttaattagtgtcaatttgacacttacaaaagaagtgggtataatctagtgagagtgatatttctctccaaattttagtaaaa

SEQ ID NO: 36756 - DNA, 201 bp, Homo sapiens
ggcctttttagaagtctgcctgccacagcctgtttttattgaccatcatttgagccagggtcccactggtccccattatacctggttcagaaagctctctygcatgaacccagtggtcagtgaaggtgcacattagactaaactgaatggaggaaagctcaggtgggccatcttcataatatatccttaagaggcaaatac

SEQ ID NO: 36757 - DNA, 201 bp, Homo sapiens
actccacagtctagactaactggtactctccacctctctggcctctaggttatcatcatacaccccgtcatttgttttcaaaacagcctgtttgcaaactyactgcatggagatactctggctttgctcaataatatctagttgctatagaggacagagatttaacttgcatgttcttagggtatttatttttggtgaggg

SEQ ID NO: 36758 - DNA, 201 bp, Homo sapiens
ccctgggtcctttgttttggtttcgtatctttttttttgccttgcaatagaattaattatatattttttaatggcctaaaattgacagaagcttttattarcatagccggcacatttaatttctagttcttgctctctggctcgtgtttataagtctaataagtaatcagaattttactttcattgtgctggactttattc

SEQ ID NO: 36759 - DNA, 201 bp, Homo sapiens
gggtcaagggatcctcctgccttggcctcctaaagtactgggattgcaggcagaagccactgcacctggcaatgagtatcacttaatgaagtcgtcactasactgggactgaatcagaaatccagttgccacttaacttatagctaagtgaccataacatctcagaacctcagcttccttggtttctttgatggaatggtg

SEQ ID NO: 36760 - DNA, 201 bp, Homo sapiens
atttaagggttgaaatggactgggcatggtggcttacatctgtagctctagcactttgggaggccaacacgggaggatcactggagcccaggagttcgagmccagcctgggcaacatagtatgattctgtctgtcccccccgccaaaaaaaaaaaaaaattagccaggtgtggtggcaagtgcttgtagccccagctactc

SEQ ID NO: 36761 - DNA, 201 bp, Homo sapiens
aagcactggtattacaggtgtgagccattgcacctggcctcctcctctactttcagagctactttgaatattataattggaaaggacttcagttttccacwcaaatgtaaaaatccccaaatccccagcctctactcaaaaaattatagtaactaaaattctactacttctgaaagtagccctttctagcgttgtctggaa

SEQ ID NO: 36762 - DNA, 201 bp, Homo sapiens
ctttgcagggcagcatactcatcctggttcactcgtcctgtgtttgggatggactcatctcactcttgagcatgctgcctggaatctagggaaatggtctmccagtgtagcatttaagggttgaaatggactgggcatggtggcttacatctgtagctctagcactttgggaggccaacacgggaggatcactggagccca

SEQ ID NO: 36763 - DNA, 201 bp, Homo sapiens
atcctcaccagcagtgtatgagggttctagattctctgcttttttgctaacacttatctgtcttttataatatagacatcctagacagcgctaatcactgyggttttgatttatgttttccttatggctaatgatgttgagcatcttttcatgtgtttattagccatttatatatcttctctggacacatttactaatttt

SEQ ID NO: 36764 - DNA, 201 bp, Homo sapiens
agcacagtggcccacacctgtaatcccaacactttgggaggctgaggtgagatgatctcttgaggccaggagtttgagaccagcctgggtaacatactgaracaccatcttgcccccgcaacccctgtctctatgaacattcatttacaagtttttgtctggacgtatgttttcagttctctttaattacatacctagggg

SEQ ID NO: 36765 - DNA, 201 bp, Homo sapiens
ccgagatgagagcaccagaaatgtgggaattttactattgtgagcttaagagcataaggaccaagaagatggaaattacagagagaggaaggaaaataaaagggagaagacaagcctctaaagccccaattaaagtaagccattatttttcacttgagtttagaccttcttaatgaggcctcatggaagcgtgcaggagct

SEQ ID NO: 36766 - DNA, 201 bp, Homo sapiens
cgaggaggtgagtccctggttcagaggaggactgcacacgcccagtaaactatcactatagtatagtatagtatttttcccccaggtaaggaatctttcaytcactgtgaataactcagcaaaaattaagttaacattttagtaaagactgttttcttggtaatgtgtggcaacctggaggagtagtgttggcatagtgct

SEQ ID NO: 36767 - DNA, 201 bp, Homo sapiens
ggatcatagtgatgaacatatgctttttgaatcacacagaaatttgctctgagtccaggtatatccccagtgtgtctttagagttatcccttatcttggcyagatatttcaatatgaaatgtattgtgcttgggagaagcgtatttttaaatgtaagtgtatattggccaagttgaagaggaagagataaaagactggaga

SEQ ID NO: 36768 - DNA, 201 bp, Homo sapiens
gggcgcggcctccgcgcccaggccccgcccccgcgcccccattggtcagtcccgggggtgggcgggcggcacagacggctgagccggggcaaggactcgcrggaatcgcgccgcccgggtcgctgccggagctcgccggtcgcccctgcgctgcgcggaccgcagccacagccggactggtgggaacggcggcgacagacg

SEQ ID NO: 36769 - DNA, 201 bp, Homo sapiens
tggggtattaaattaacactatcctagaaaggagcccggtgaagccctttaggttccctcttagtgcctcagatccctttgcctgtaattcctgtggctgwtactcagggagagtgttaggcccttctcatacagggaagaactggtgagccccctggaccaggaggaaggataaagacacctacatgtgagcccattcac

SEQ ID NO: 36770 - DNA, 201 bp, Homo sapiens
gcggctgcgggccggggactggcggcggcgggcgaggcggcgcccacagcactcgggactcagctgccggagggacaaactaacttcctgagcgcgggacytgaggctggcgcggccgggagccacctgcagcctgcggtgaggcgaccctggccctcggggcgcgcggcatggcgcggggaagcgggccgtgctgagcga

SEQ ID NO: 36771 - DNA, 201 bp, Homo sapiens
tttgctagtaaaattgatctttccttccctgagtttttccagttgtgctgaataattaaaggaaaattaaaacctggattccctaaactgttaagtatcaratctgtaagctgtcagtccttaggattacagtgtatcagagttagaaaggactttaaaattcatctgaacaaactgcagaagatttgtaaatctgttttc

SEQ ID NO: 36772 - DNA, 201 bp, Homo sapiens; identical to SEQ ID NO: 7729

SEQ ID NO: 36773 - DNA, 201 bp, Homo sapiens
accagcctggccaacaaggggtgaaacccatctctactaaaaatacaaaaaattaactgggtgcggtggcgcatgcctgtaatcccagctattggggaggytgaggcaggagaatcgcttgaacccaggaggcaaagattgcagtgagccaagattgcgccactgcactccagtctaggcgacagagtgagacagagtctc

SEQ ID NO: 36774 - DNA, 201 bp, Homo sapiens
ttatacacagcatgtgaaatgaacagatgcttttttttttttgtagctatcagggcaacaagaggtggaaagctgtatcaggtatttatttcagtccctgmgatggctattggcagagtttcacatacctaaactaaggagaaactcatgaacagataaaaattaagacatggaggagaacttgtgcttcctctcttgatt

SEQ ID NO: 36775 - DNA, 201 bp, Homo sapiens
ggacgcagtggctcacgcccgtaatcccagcactttgggaggccaaggcaggcagatcacttgaggtcaggagttcaaaactagcctggccaacatggtawaaccccgtctctactaaaaatacaaaaattagccaggcttggtggtgggtgcctataattccagctacataggaggctgaggcaggagaatcgcttgaac

SEQ ID NO: 36776 - DNA, 201 bp, Homo sapiens
gcttctcggggccagtttatttacagagttgagataagccttcggaaaccgcccccggggcagtcggcgcgctcagagcgccagttacatgatttgccctrttatccggccccagctggaagaaggcgagacaaggcgctggcctggagaccggccgccgtggggagttgctggggaggaggaggaggaggagttgggcgc

SEQ ID NO: 36777 - DNA, 201 bp, Homo sapiens
tggacgcagtggctcacgcccgtaatcccagcactttgggaggccaaggcaggcagatcacttgaggtcaggagttcaaaactagcctggccaacatggtwaaaccccgtctctactaaaaatacaaaaattagccaggcttggtggtgggtgcctataattccagctacataggaggctgaggcaggagaatcgcttgaa

SEQ ID NO: 36778 - DNA, 201 bp, Homo sapiens
cagtccgggccgggcgggggtcggcagcccctgggggacccgtgtgggcagcccgggcccagccggccgcagcctggggccgaggactcgccgggacccgraggcggcggggagagggggcggggaacgggccgggcctggcgctcctgacaggaggagccgccgccgccgcccgccgctgcagccgcgccggggcgggct

SEQ ID NO: 36779 - DNA, 201 bp, Homo sapiens
tatctctgtcatcttgcaattcattcccaaaggataagctctggttttggtctaattctttaaattcatacctaagctgtttgtttctttgtcatcaatgrtaagaattttccttagtaacgaaatgaaagagatggtttttagaaatctcttctctctgtattatttattctgccttcttttctaatattgaggagcagg

SEQ ID NO: 36780 - DNA, 201 bp, Homo sapiens
agaaaaagaaagagagagagagagagagagagaaagagagagagaaagaaaagaaaagaaagacgaaatagttaatgagtgccctatatgtgccagatcakttgctaggtgctaaggatcctgtggtgaattagacgacaaacagtctcagccctcagggagcttacgatttagtaaggatgagagacactgtaccataac

SEQ ID NO: 36781 - DNA, 201 bp, Homo sapiens
atctaaaagtattaggcttatatttggtgctcagctcactagatgataatatgcttttttttaaaaagaagcttatctagacatataaattagaatattgkgaaatctttttttttttcattttttgtttgtttgtttgtttgtttttgagacagggtctcactttgtcaatcaagcctgaagtgcagtggcatgatcatg

SEQ ID NO: 36782 - DNA, 201 bp, Homo sapiens
tgagccgagattgcaccactgcactccagcctgggcgacagagcaagaccttgtctcaaaaaaaaaaaaaaaaaaaaaaaaaaatctataaccgccaaccraacaagtacccctcttaatgtttcaaaatatgattccttttctccagagttccccaccaccaagttagagatgactgctgtggctgacattttcgaccga

SEQ ID NO: 36783 - DNA, 201 bp, Homo sapiens
tcacacctggattccttgcactttgtagaagctgtgatattctagctaaacagtctttctgaagctggccaggagcttggctcacacctgtaattccagcwctttgggaggcaggtggcaaaggcatggtggcacacttgcagtcctagctacttgggaggctgaggtgaatcacctgagcctggggaggtcaaggcctgc

SEQ ID NO: 36784 - DNA, 201 bp, Homo sapiens
agggctcttagagatcggttgacctgatcgcctctggtgagcctgaggaaactgaggccagagcaggaaaaaaatcacagttggcagcagagcttggactrtaactcagaggttttggtatccaagtgagtgcttttaacctgatactttgatatgttctgtcaacatataatatattgagaagaatttggatttgattta

SEQ ID NO: 36785 - DNA, 201 bp, Homo sapiens
ctgacgtcatttgtccattccagatctgccccccctttcctcattcagaggcctgtgatgtctggagttcctccttttcctcacatctagccactcaccakggcttgtcagtcccactttcaaaatacctcttggttccatctttcctgccctggctctggccctcaccatgttttgcctcagttgctgcaatggtttctt

SEQ ID NO: 36786 - DNA, 201 bp, Homo sapiens
ctccccactaccgcccctcccccagccccaggtagatctggagttgattaatagttttagtaaactgactcacactgatcacatttgcttgagattggtckatgtgaatttgttaatttacaaaataaattttaactgccaagtgattcaagaatttgaattggccacttactgcttttgttgctttagaatatctatatg

SEQ ID NO: 36787 - DNA, 201 bp, Homo sapiens
cttcaactgcaatgcaatttcaaagttttcctcttatatcttttttttttttttcctggcagagtttgctcagaagtgaatttttttttttttttttttttgagatggggtctcactctgtcacccaggctggagtgcagtggcacgatctcggctcactgcagcctccgcctcctgggttcaagtgattctcctgcctca

SEQ ID NO: 36788 - DNA, 201 bp, Homo sapiens
acgatgggtttgccaggatgtaacttcatcgtaagtcgaggagcacctgtccttcctgtgggatgtacctcctctctgagagattatcttcttcctattcwgttcttctcctttctgttttcctctctctcctctatgtcttcagtctctccctgtttattcttttctctaaagcttccagacatgtccttccaacccaga

SEQ ID NO: 36789 - DNA, 201 bp, Homo sapiens
accccatctctactaaaaatacaaaaattagctgggcgtggtggcatgcgcctgtaatcccagctacttggaaggctgaggcaggagaatcgctttaaccygggaggcggaggttccagtgagctgagattgcgccactgcactccatcctgggcgacagcgcaagactctgtctcaaacaaaacaaagcaaacgacagca

SEQ ID NO: 36790 - DNA, 201 bp, Homo sapiens
gagattacaggcatgagccaccgcgtccagccgtgatttccttttgtaaatttcttccatggctactagttgcctctagagtttgatgtcacctaactctktcctgatgtagagcactttgcagcgtttccaacccacctgtctagcttcatttctaagcactctgttttttgtagcttgcgctatagccacatgagacaa

SEQ ID NO: 36791 - DNA, 201 bp, Homo sapiens
gaactgattccagatcactaccaaaactatcatcttttacttagagtggtatatgaggtgattaacacagaccttgggttgttagggtgtgcctgtgtgtyactgggctataagatgcctaaagggtatctctacctgtcccctgtgctacccttaatccattctagagggtggtttgatttaaaatgtctcaccatctct

SEQ ID NO: 36792 - DNA, 201 bp, Homo sapiens
aattgcttgaacgccggggtcggaggttgcagtgagccatgatcgcgccactgcactccagcctgggcaacagagcgagactctcaaaaaaaaaaaaaaaattaaaaccacatccctgtggcaggagcttggtaagaatatgttcagtgtgtgtcactttgccagaaaaatgtaatgatatgattttcattctttagtgtt

SEQ ID NO: 36793 - DNA, 201 bp, Homo sapiens
gcttgcctctctatcccctgcccctacacacccccacccaacaaccacagaaagcatattgtctaaagctctgtatactttactgttttttttttttttttacaattttccacattaatatgtgttcataatatgaaaagaaattattcaaaaatataaatcagttggcttccctggtggtctagtggctaggattcggca

SEQ ID NO: 36794 - DNA, 201 bp, Homo sapiens
cttttgatctccccagctcactactcctgatctcttaatcatttacaatgtataactcacttggcttttatcacataccacctaattttgacattttctgrttatatccatttgtcctatcccctcagttaattcacttttgtgtcccttaatgtagttagcatattggtatatacacagttggagatgagacaatatttg

SEQ ID NO: 36795 - DNA, 201 bp, Homo sapiens
tctttgctacacatggtgatggttcatggatggaggttaaaaggaagtgattccatattccttttaacccatccttactgggcagttgctctgtgctagtscttgtggtgggtactggagtctcagatagtctctagttaacagtgtacagatgtgccttgacttacagtgaaattatgtctggaaaaacccatcataact

SEQ ID NO: 36796 - DNA, 201 bp, Homo sapiens
aacatcacataatcaggaccctccctgtccttggcattgatattcaaagatgactgaagatgtggtcccttctgcatggaactcagtctagtggagaggayagaagggagaaaaggccgggtgtagtggctcacacctgtaatctcagcatttcgggaggccgaggcaggagaatcattagagctaaggagttcaagacca

SEQ ID NO: 36797 - DNA, 201 bp, Homo sapiens
acgaggccctcgctactggacttgaccagctcttcttcctgacacgaatccctgcactctttcatctctgtggtgcttgctgtcacagctgattcatctartccagtgttttcaggggtttctaactcggattcaccaaaattggagagaaataagagatgcctgaaactagattaataactttataacaatcttgagaat

SEQ ID NO: 36798 - DNA, 201 bp, Homo sapiens
ctgttgagaactatagccctggaagaaattgccacctatacatgggaaacttagaattcaggtggaataggttactagttaaatatttatgtaacaagcakccttctgataatctgattatgactgtgtgtagtggcaacaaccacttctaagtcagctttcctttaagccaggctctggattctttatttttgctggcct

SEQ ID NO: 36799 - DNA, 201 bp, Homo sapiens
cctgtgcattgtaggctgtttagcagcatttctgacctagtaacttcccagttgtacaactaaaaatgtctccctggaaggcagaattaccctctgttgakaactatagccctggaagaaattgccacctatacatgggaaacttagaattcaggtggaataggttactagttaaatatttatgtaacaagcagccttctg

SEQ ID NO: 36800 - DNA, 201 bp, Homo sapiens
aacaggcactgagctataacggaaagttagagaaaggcttatgtgggctcaggtaatcaggaaaggactttagagggaatgagctccaagtgaggagacarcagtggggcctggaaggcaggagggagagttggagctctttctagtgggcaacgaggagtccttggaggaagtccttctcaaaacctttgggcctgcagc

SEQ ID NO: 36801 - DNA, 201 bp, Homo sapiens
gagaagctgtcctgtgcattgtaggctgtttagcagcatttctgacctagtaacttcccagttgtacaactaaaaatgtctccctggaaggcagaattacsctctgttgagaactatagccctggaagaaattgccacctatacatgggaaacttagaattcaggtggaataggttactagttaaatatttatgtaacaag

SEQ ID NO: 36802 - DNA, 201 bp, Homo sapiens
aactggacccccagagggatgcatcttgcaggatgaaaccaccacactttaattttcttctctgcaagatgctggtaaaccctcctcctcttttaagtgcygcctcctctgtccttaatgcccccagtggtatccaaagcttcctcctccgctctcacagtcatacttttctctcctccatgttcccttgttcaatgtagc

SEQ ID NO: 36803 - DNA, 201 bp, Homo sapiens
aaactgacagttatgttgagcatctgctattgatggggtataaatcacatttgcaaagtttggtaagttctgttctgttttctattttggcttatattctrttcgtttacatgtagactattaaggaagagacagatggtctgcatgaagagctggagtttattcggatccttggagcagatttgatttttgcctgtggag

SEQ ID NO: 36804 - DNA, 201 bp, Homo sapiens
tcctcattttgaaattccctacgtaggttttacttgaactgagatcattctgaatcttaaaccaacccctcctttgccccctgctccccgcaagaaccatrtgacttctcactcagaaagtatttgatggtttgggcatcatactggtgagcattatcaagaaacctggatgcaccttcattcacttgtttttcatatgta

SEQ ID NO: 36805 - DNA, 201 bp, Homo sapiens
aaataatacagccaccccctccactgtgtcatctctcacctggaccttccaatgagcatttaatagctcttcctctcttagtcttgccaccatcctccacrtgactaatagagtatttttttctaaaatacaaacctcaagaacacatattctattttatgaaatgaagtgctgcctgtacaacacttcattaaaaataca

SEQ ID NO: 36806 - DNA, 201 bp, Homo sapiens
aggctaacaagaaaggaaggacgtttttatcactgaaacttgagccaaagaattcccctagagtgaccttcctgggaagggtaaaaaaaaaaaaaaaaaawatatatatatatatatatatatatgttaagtctctgatgataacaagagattttcctcattttgaaattccctacgtaggttttacttgaactgagatca

SEQ ID NO: 36807 - DNA, 201 bp, Homo sapiens
tcatgactttctaaatcctactcttttttcactttttggctatattagacaatgctgctgagaacatggttaagaatgatttgacttctgttatttccttrtaatgaaatccttggagagtacagttttacttgtatcgccttccaaaagtgttctacatgctgacctttcacacgacgtgaaggctggggctacctcctg

SEQ ID NO: 36808 - DNA, 201 bp, Homo sapiens
ttttttttttggttttgaacattatctgttgatattctactacagaaaattagggtttagtttttttattcttacccccttaacgtacacactttctcttmccccttcttcccaaagtcacacgttattgccgttatattcagtgttcagattattgtgattatataaatattgcttaaaggtgagctatgtaatatacta

SEQ ID NO: 36809 - DNA, 201 bp, Homo sapiens
ggaggctaacaagaaaggaaggacgtttttatcactgaaacttgagccaaagaattcccctagagtgaccttcctgggaagggtaaaaaaaaaaaaaaaawatatatatatatatatatatatatatgttaagtctctgatgataacaagagattttcctcattttgaaattccctacgtaggttttacttgaactgagat

SEQ ID NO: 36810 - DNA, 201 bp, Homo sapiens
ggtaagagaggtcccccagcaggctggacgctgtgggtgtgagggaggaatgggccagggcacagcagctgtgtggggagccgaggggtcctcaccagggyctctgacaaagcagccatcatctgatttgttattattattcttggaaagacgttgaaataacattaacgaaaaactcaaaagaggaaaatctgccacccc

SEQ ID NO: 36811 - DNA, 201 bp, Homo sapiens
cgggtcactgaggtttatttttaaatccataacccagggttcagcagttgtccttactgaattcccgtgtggaggctttcagctgcccagacacccccacrtctttactgggcacattccagcagtcctaaagtcctgaccctcaggagtgaaattctggtctggtgtctcactcctggaattccttcatgaggcatggct

SEQ ID NO: 36812 - DNA, 201 bp, Homo sapiens
tccctgggctcccaggccctcctgcagcagcccccgcctgggccatgtcttcctcagatgaagagacgctcagtgagcggtcatgtcggagtgagcggtcwtgtcggagtgagcgatcttacaggagcgagcggtcggggagcctgtctccctgtcccccaggggacaccttgccctggaacctgccactgcatgagcaga

SEQ ID NO: 36813 - DNA, 201 bp, Homo sapiens
gggatttttttttaccaggcccgtcaccaagaattgctgtcccagcagcaaaatttcattctggccacccagtcagctcaggccttcttggatcagcatgsccacaatctcacacctgaggagcaacagatgctgcaacagaagctgggagagctaaaggaacaatactctacttccctggcccaatcagaggcagaactg

SEQ ID NO: 36814 - DNA, 201 bp, Homo sapiens
gacttttgatgttgctggaagatttcaaaaaattactgggcattactttatcttatttctatcctagtatgttgcctaatagtgctcagagttcaatagcrcttagttgcttgtcatagccaaattcgtttcactgatttctaaaaataagccttccacctcagatactctggatgtgaaggctgggactggacactgatc

SEQ ID NO: 36815 - DNA, 201 bp, Homo sapiens
cattccttgaacaaacaaattctcctattttcttttctaggttttccagaaggaactgggaaagcgaacaggaaccgttcaggtcctgaagcggtcaggcmgagagctgattgagaatagtcgagatgacaccacttgggtaaaaggacagctccaggaactgagcactcgctgggacactgtctgtaaactctctgtttc

SEQ ID NO: 36816 - DNA, 201 bp, Homo sapiens
ctaaggtcactcagctaccctgttggcagagctgaggtttaaaccatggcagtttggttctaaaagttgtacttttatctatttgtacccactatgccatrctaaatattacaatattgctaccctatttgtacttttttttgtttgtttgtttgagacagagtctcactctgtcacccaggctggagtgcagtggcgcga

SEQ ID NO: 36817 - DNA, 201 bp, Homo sapiens
gaggtgggtatggtattgagcacaacatattcaagaaccgaaagaaagctagttcgactggactgcaaaaaacaagaggaaaattagggaaagttgaagtwggaggggtaagtgggacctgtatcacactggaccccgcaggccacattaaggataaggagtgatacccaagagagtataagggcccatcaggcctcgact

SEQ ID NO: 36818 - DNA, 201 bp, Homo sapiens
attcggcattagtggtcaaacagtattctgtgtttgcgagatgcgtagtggtacacaagacatttggggacctcagagagcctggtcgaaacacgtacagrcctggtcttagggggtgctttgtgtaatgctcccaggcctggcttctactgtaaggaattcttgtgtggtcctttagtcctggaaataaaagagaaaggg

SEQ ID NO: 36819 - DNA, 201 bp, Homo sapiens
atgctgaaactcttggaaagctggagacacagtattgtaaattgaaggtgagtttctgccgattctcttacattctgctcatagagtctggttccccccartcaactctcttccgtaattcagaaatctcctggtttggccctgttttggttttctgcttattaggttatatcatttactatgcacttattcatatctatt

SEQ ID NO: 36820 - DNA, 201 bp, Homo sapiens
aagacagaaaaagctcaggtgtcagctcatcctctttcttggatgaccttggcaaaataacttgaatttctggagcctcaagtgcttgatttataaaatgrggtaataatatatagttcccagggatattacagggatcaaatgaaataacagatgtaaagatgctttatagtagctgcttaataaattttagtttccctt

SEQ ID NO: 36821 - DNA, 201 bp, Homo sapiens
tcttaaaaaaaaaaaggtcccatcgttgctcactccattttttcccaagcatctacctgttggtcagcttgcctctctatcccctgcccctacacaccccsacccaacaaccacagaaagcatattgtctaaagctctgtatactttactgttttttttttttttttacaattttccacattaatatgtgttcataatatg

SEQ ID NO: 36822 - DNA, 201 bp, Homo sapiens
tttcagtggtccttgtaataaactgtcactaatgcagtagggtgtaatcagctttgctaagctctgcacagtaaaattgttctttcttagttaatattccrgtgttctaatgttttgagcagaaggcatccttactttgtattcccatagttcttcagtgatgcacgagagctggagtcattcttgaggaacctccaagat

SEQ ID NO: 36823 - DNA, 201 bp, Homo sapiens
aagaagggtggggagagttttgtttatgtattgtaacacaggagagacttgagcatgtttattttaagtgctgttttgaaagagccagtagagaaggaagrtataatacaattcaaagacggggagaaaaattgatggagcatgggctctagagtcaaaagttgtgtcttttagaaagatcagagggttaaaaataagaat

SEQ ID NO: 36824 - DNA, 201 bp, Homo sapiens
aattcaaagacggggagaaaaattgatggagcatgggctctagagtcaaaagttgtgtcttttagaaagatcagagggttaaaaataagaatgcaggtgaytaagttggttggttagaggtgtaggaacttgagggaatttctcctgatgctcatactctctctatgaagtaggaggtgaagttatttgctgagagtcagg

SEQ ID NO: 36825 - DNA, 201 bp, Homo sapiens
attcctcccttctaatcttcactgagctagaaaatgagataaacaggcctgttaaaattgcattagatatgagctaaaatgtacaaaagagtccacatgcrggcataaatagtgtttggatttgaggacaagtcatcttttccttttcatttaatccttggtttctagagacattctgacttttgatgttgctggaagatt

SEQ ID NO: 36826 - DNA, 201 bp, Homo sapiens
ttgagtgcttactgggcagtgggcactattaagcactttacatgcaggattaagcactttacatgcagaacccaaccctatagggctaggttctaactgtygtcatccccattttgtagatgagggtgctgaggctcagagagattaaatggcttctccagggtcacacagctagtaaatggagtagaatttaaacccaca

SEQ ID NO: 36827 - DNA, 201 bp, Homo sapiens
tcctcacttgtggtctttaatccccatctcattatctgacatggatagtggaggattcactcactctccatgagtgaactccaggcctagcttcttcattrgtcttaacaggttagctttactactctccccagggcagttgagctttgctttccatgaaggttatgtagttaatttgtactaggcttgtgaagacctggg

SEQ ID NO: 36828 - DNA, 201 bp, Homo sapiens
ccacgcctggttaatttttatatttttagtagagatggggtttcaccatattggccaggctggtctcgatctcctgacctcaagtgatccacccgccctarcctcccaaagtgctgggattacaggcattagtcaccgcactcagccccctgtttttcaaattgaggtatgaaaagccgtaagttaaacatagtctcatct

SEQ ID NO: 36829 - DNA, 201 bp, Homo sapiens
ccatgtgtagcagatggttctgggaagtgagcttgacctggctgagggaaggctgcccagtctggctggtggagcccagctggccttagagcaattgtatkttcactcaactctctccactagctaaactgaccagaaaaaatgggctttctgtcccatccccccaccccatcctcatgctgtgccacgtattcccacaac

SEQ ID NO: 36830 - DNA, 201 bp, Homo sapiens
gggtgtttacaagactggacagagaggctgttgtggaaaatgcagcctccttcttgtttattttggcaggcaggcaatgaaggagatagatttgttctcakgactcagagccctacctgctttaccttaacaggttcaatataaccaccacctttcagatgtgatagtgtccttcagagtttatctgacctttatatctaa

SEQ ID NO: 36831 - DNA, 201 bp, Homo sapiens
cagtttttgttttgacactgctttttcttttttggagacaaggtctcactctgttgcccaggctggagtgcagtggtgctgcctcagctcactgcaacctyggcctcctgggttcaagcaattctcgtgcctcagcctcccgagtagctgggactacaggtgttcaccagcacgccccactaatttttgtatttttagtag

SEQ ID NO: 36832 - DNA, 201 bp, Homo sapiens
aaggctggtagctgaaggcacataccatttgtgctctgatggagcccttggggtggtgggccatgtgtagcagatggttctgggaagtgagcttgacctgsctgagggaaggctgcccagtctggctggtggagcccagctggccttagagcaattgtattttcactcaactctctccactagctaaactgaccagaaaaa

SEQ ID NO: 36833 - DNA, 201 bp, Homo sapiens
gtgcctgaaatcccagctacttgggaggctgaggcaggagaatcatttgaacccaggaggctgaggttgcagtgtcctgtccggacagtagagcgtgactscgtctcaaaaaaaaaaaaaatttttttttacttgtaatcccctgtgatagtgatccacattacttaatatcttatatctgccggctttacataggatttt

SEQ ID NO: 36834 - DNA, 201 bp, Homo sapiens
tcctaaagataaaagctctaataaaatttcagtcagcaagtagagattcatccccatagatgtactgataaatggagttccacatatactctcattgatasccactttttttttttttttaatattatgcataccacacacacacggtctcgctctgtcacccaggctggagtacagtagtgcgatcatggctcactgcac

SEQ ID NO: 36835 - DNA, 201 bp, Homo sapiens
ggctcacacctgtaatcccagcactttgggaggtcgaggtgggcgggtcacaaggtcaggagatcaagaccatcctggctaacacaatgaaaccctgtctytactaaaaatacaaaaaattagccaggcgtggtggcatgtgcctgaaatcccagctacttgggaggctgaggcaggagaatcatttgaacccaggaggct

SEQ ID NO: 36836 - DNA, 201 bp, Homo sapiens
aagtgctgggattacaggcgtgagccaccacgcccagccaatttaagccaaattccttagctcaagggcctttgtaaattgctccaacacatttttttttytcccaatcgttatggtgaaaaagaacagaatgtgaatctgaagacaggggtccagtcctgggaccatccgctttctccctacatgactttgagtatatca

SEQ ID NO: 36837 - DNA, 201 bp, Homo sapiens
tgttgtccaggctagagtgcaatggcatgatctcggctcaccgcaacctccgcctcccaggttcaagcgattctcctgcctcagcctcccgagtagctggsattgcaggcatgcgccaccatgcccggctaattttgtatttttagtagagagggggtttctccatgttggtcaggctggtctcgaactcccgacctcaag

SEQ ID NO: 36838 - DNA, 201 bp, Homo sapiens
agtagagagcagtggttaaagcatgagatttggagacaggcttggatgagaaccccagctccaacactagtttgctttgtggacttcagcaagtcatttarcctcttgaagtctctgtttccttatttgtaaaatgagaataataaaggtaactactgtacagggtttttgggaagacttaatgagataatatacacaaaa

SEQ ID NO: 36839 - DNA, 201 bp, Homo sapiens
tttaatttaattaaattttttttttgagatggagtttgctcttgttgtccaggctagagtgcaatggcatgatctcggctcaccgcaacctccgcctcccrggttcaagcgattctcctgcctcagcctcccgagtagctggcattgcaggcatgcgccaccatgcccggctaattttgtatttttagtagagagggggtt

SEQ ID NO: 36840 - DNA, 201 bp, Homo sapiens
tttttaatttaattaaattttttttttgagatggagtttgctcttgttgtccaggctagagtgcaatggcatgatctcggctcaccgcaacctccgcctcycaggttcaagcgattctcctgcctcagcctcccgagtagctggcattgcaggcatgcgccaccatgcccggctaattttgtatttttagtagagaggggg

SEQ ID NO: 36841 - DNA, 201 bp, Homo sapiens
gaattttttttaatttaattaaattttttttttgagatggagtttgctcttgttgtccaggctagagtgcaatggcatgatctcggctcaccgcaacctcygcctcccaggttcaagcgattctcctgcctcagcctcccgagtagctggcattgcaggcatgcgccaccatgcccggctaattttgtatttttagtagag

SEQ ID NO: 36842 - DNA, 201 bp, Homo sapiens
aatgtagatgaattttttttaatttaattaaattttttttttgagatggagtttgctcttgttgtccaggctagagtgcaatggcatgatctcggctcacygcaacctccgcctcccaggttcaagcgattctcctgcctcagcctcccgagtagctggcattgcaggcatgcgccaccatgcccggctaattttgtattt

SEQ ID NO: 36843 - DNA, 201 bp, Homo sapiens
agatgatgccaggaagcgggcaaaacaagtaagttggggaagaaagatactaattcactgaagagtcttgggctgcatgtattgagtctctgggatgattstcaaacgtgctgtatagtgtgtatattcattcctgttaacttatttcttatgtaattttagttccatgaagcttggaaaaaactgattgactggctagaa

SEQ ID NO: 36844 - DNA, 201 bp, Homo sapiens
actcatcctcaaaaatcaaattctcttctctacaaaataatgaaagatgactagggatcaaggtgtttgcccaaaaagattattttttatgagtacagagwttcactgtattttttgctgctcagatcaagtatgaaatatatacatacacaaacctgttgaccacattcactcaatgaatagttattgagcaagtgtgtg

SEQ ID NO: 36845 - DNA, 201 bp, Homo sapiens
aggaaatttactagaaatcaggagagaagtaaattatatgacctcttcccactcatcctcaaaaatcaaattctcttctctacaaaataatgaaagatgaytagggatcaaggtgtttgcccaaaaagattattttttatgagtacagagtttcactgtattttttgctgctcagatcaagtatgaaatatatacatacac

SEQ ID NO: 36846 - DNA, 201 bp, Homo sapiens
acagggtttcaccatgttagtcaggatggtctcaatctcctgacctcatgatttgcccgcctcggcctcccaaagtgctgggattacaggcgtgagccacygtgcccggccacttcatactcttaatgtggcagaagtaccattctcttctgacccttttttccttttagacatgtctaaatcgtaatggagcttaactgt

SEQ ID NO: 36847 - DNA, 201 bp, Homo sapiens
gcttgtaatcaagatgagcccttcctggactttcccagactctgctacagaatctatatgtaggtgtcttccagagaattcgtagaattgatatctttccygccttttcttgtaggaactctattcccagctgaaagccaaggaagagacttataatcaactacttgacaagggcagactcatgcttctaagccgtgacga

SEQ ID NO: 36848 - DNA, 201 bp, Homo sapiens
tcaccatgttggccaggctggtctcgaactcctgacctcaggtgatccacctgcctcagccccccaaagtgctgggattacaggcgtgagccactgcgccyggcaatcgtaactcttaagtttaagcaaggctactgtattccgcagttccaaggggcactatttacatgtgttcaatgatagtggttcaaatttgatatt

SEQ ID NO: 36849 - DNA, 201 bp, Homo sapiens
acactggggagtggaagtatgtctccactaatttggagaatctttgatcttgtttcactccctggtttggcttgtccagtgcaatttgtctctcaacctgmaagaggtgtgtgtgtgtgtgtgtgtgtgtgtgtgtgtgtacttgggtgtcccttgcctgtggcttcacctgttgccatgaatggttgacttcagggcatg

SEQ ID NO: 36850 - DNA, 201 bp, Homo sapiens
cagagaccagatcatcttcagctccaactaagatggcagagagctgccacctgtggccctttgatgccaggtaatttctctctgatatcctttctagtcaygcaggacctttttgccatattatctatacatatggggcaggatcctaacaggacctttgctctctagtggtaacctgtcactgaaatgggaggctccagt

SEQ ID NO: 36851 - DNA, 201 bp, Homo sapiens
tttctgtttctttaaaatttagtatcttctatttatttttttctgttcccaatgtgcaccctttttgttcctttttcaattgttcctgtccttccctttgratttccgtttcacagacttcacttcagttctctcgctgttatgacaaaccctggttggtaaacagtaaagctggcacccctatcagggacagccattctc

SEQ ID NO: 36852 - DNA, 201 bp, Homo sapiens
gggacagtggcaaagcaagacgctagcagcagagtgggctggtcctttatacacagagacttgcttattatacagttaacatatctgctatgggtaggaaycttgacaaggctgatgtgtcatgaatttatctctatttttgaagaacccacagatggtactaaacccatataacttatataactgttatcatggggtcaa

SEQ ID NO: 36853 - DNA, 201 bp, Homo sapiens
tttacttgttttcacaaaaccctgtcaacatctaaaaatggtgacattgattttggttattatgttttatgaacctctctatagcactccaggtatataamcctggctcctaaaattcatgtgttaatgaaggaatgtgtatttgtccccacaggttaaagacagttgatgttatagtacgtagcatacaggatgctgaac

SEQ ID NO: 36854 - DNA, 201 bp, Homo sapiens
tttgggcctatttccttattataaaaatggagggattatcaaactcaaaagcaattaaacaaaaaaagacaaaaaatgaaaaaagagtaaaacacaaaaayggagggattagatgagatttgtaaagtctgttcagtgattcattcaacatatagtgatttcaagcaaagattggaagaaaattttatctagggaattggt

SEQ ID NO: 36855 - DNA, 201 bp, Homo sapiens
tcattccctggatcaaacagcatacaatactgatgtcagataaaacttttccccaaaaccctgttgaactaaaggtaaagtcaaggacttaaatttttttkgtaaaatctttctagggagtaagtctccaagcttatcactgctggcttctaggtgaggtggtatgaaaaattgggtcctatagtttgtgtccatttattc

SEQ ID NO: 36856 - DNA, 201 bp, Homo sapiens
tcctcgttagtagtggggagaatagttcttaccttgcagggatattgtgaggtttgaataagataatacgtattagcacctagcatatgtgaaacatacartggatactcaatatccgtgagttgtcttttcttccttccattcattcgggagatgcttagggaagcagatataccagattcaaaaggatttagaccctcg

SEQ ID NO: 36857 - DNA, 201 bp, Homo sapiens
taaagctggatttctgcatttgggagattaaggtaaaagcttctgcatagcccagagcacagtactgtgcacacatatcatgtgtgagtatacagaaagarattgatgaaagccaaatttaattactgagatggttgtgatgataatcccatttttctcatccagtttccagtctaggtaatggccctaatccaaacaggt

SEQ ID NO: 36858 - DNA, 201 bp, Homo sapiens
gcccccaccacgcccagctatataccagtgttcttgccacaacccttcgagtctctacaattttaggtgaatagtcagataacactggggcctagaaatgrtaagaaagaggttggttggtgtattatcttctgggctcagccttttcagtttacaagtatccctctcccagttttcctttttaattatagggagagttgt

SEQ ID NO: 36859 - DNA, 201 bp, Homo sapiens
gtagtcacattaaacattgaaatggtactgagactgccttggtggggagttttggcctatgggaatgatgtgggttttggtttctactcctttctctgttwtcagataaatcctcctacatgtcccattctctggctctgggaagtactgacagtagggaaaagttagtacactcatctcattgttcagatcaagtttcct

SEQ ID NO: 36860 - DNA, 201 bp, Homo sapiens
tgcttactgggcagtgggcactattaagcactttacatgcaggattaagcactttacatgcagaacccaaccctatagggctaggttctaactgtcgtcayccccattttgtagatgagggtgctgaggctcagagagattaaatggcttctccagggtcacacagctagtaaatggagtagaatttaaacccacagcatt

SEQ ID NO: 36861 - DNA, 201 bp, Homo sapiens
ttgtgtgttgactttgtctctctgggttttgcttgcaagacctattttgataggagtctgatgaatgatggacctactgaaccctatacagagggtccagrcctggcagaattctaggaaaaaaaaattgcctcctagtctaatttttctcagtgataaactactctgtgtgcttacagtttgtctatcttgcttctctcc

SEQ ID NO: 36862 - DNA, 201 bp, Homo sapiens
tgtaaacaatgtagatgaattttttttaatttaattaaattttttttttgagatggagtttgctcttgttgtccaggctagagtgcaatggcatgatctcrgctcaccgcaacctccgcctcccaggttcaagcgattctcctgcctcagcctcccgagtagctggcattgcaggcatgcgccaccatgcccggctaattt

SEQ ID NO: 36863 - DNA, 201 bp, Homo sapiens
tgtgtactcataatattgaactgtaaacaatgtagatgaattttttttaatttaattaaattttttttttgagatggagtttgctcttgttgtccaggctrgagtgcaatggcatgatctcggctcaccgcaacctccgcctcccaggttcaagcgattctcctgcctcagcctcccgagtagctggcattgcaggcatgc

SEQ ID NO: 36864 - DNA, 201 bp, Homo sapiens
agataaattgtgtactcataatattgaactgtaaacaatgtagatgaattttttttaatttaattaaattttttttttgagatggagtttgctcttgttgyccaggctagagtgcaatggcatgatctcggctcaccgcaacctccgcctcccaggttcaagcgattctcctgcctcagcctcccgagtagctggcattgc

SEQ ID NO: 36865 - DNA, 201 bp, Homo sapiens
ctgggcaacagagtgagactctgtctcaaaaaagaaaaaaaaaaaggctgctttttctgtccttaatggtattttcatttttattatattgaaagatattratataaaaggtgaaactttctggctttattataaaagcttattccaaaatatggcaagtaccattctagactgaataattttaccagtacttgcttcaca

SEQ ID NO: 36866 - DNA, 201 bp, Homo sapiens
catgaggtcaggtgatcgagaccatcctggctaacacagtgaaacctcgtctctactaaaaatacaaaaagttagccaggtgtggtggcgggtgcctgtartcccagctactcgggaggctgaggcaggagaatggcatgaacccgggaggcagagcttgcagtgagctgagatcgcaccactgcactccagcctgggtga

SEQ ID NO: 36867 - DNA, 201 bp, Homo sapiens
gactacaggtgcccgccaccatgcccgtctaattttttgtatttttagtagagacagggtttcaccatgttagtcaggatggtctcaatctcctgacctcrtgatttgcccgcctcggcctcccaaagtgctgggattacaggcgtgagccactgtgcccggccacttcatactcttaatgtggcagaagtaccattctct

SEQ ID NO: 36868 - DNA, 201 bp, Homo sapiens
gagtggttgtgactgtattccagtaaaactttgttgaaacaaagggccagatttgactgatgagctgtagtttactgactcctagactagatcattttttwaaaaaaaaaccagaaatctcatatagaacagaaatctcatatagaaccctactacgtaaaacaaaacattttgttggctgccgggcgcagtggctcacgc

SEQ ID NO: 36869 - DNA, 201 bp, Homo sapiens
atggaagaaaaaggaagggaaataaatccaggctagtgaaatatagctggttctatccctctgataactgagagaaacccaatttttttttttttttttttgagatggagtcttgctctgttgcccaggctggagtgcagtggctcagtctcggctcactgcaagctctacctcccgggttcactccattctcctgcctca

SEQ ID NO: 36870 - DNA, 201 bp, Homo sapiens
tctctgtcacagtcatatacctctgccattgtaacaaaaacagccaaagacaatacattaatagaaatgagtggttgtgactgtattccagtaaaactttsttgaaacaaagggccagatttgactgatgagctgtagtttactgactcctagactagatcatttttttaaaaaaaaaccagaaatctcatatagaacaga

SEQ ID NO: 36871 - DNA, 201 bp, Homo sapiens
agctcacacctgtaatcccagcactttgggaggccaaggcaggcggatcacgaagtcaggagattgagaccatcctggctaacacggtgaaaccccatctytactaaaaatacaaaaaattagccaggcatggtggcgggtgcctgtagtcccagctactcaggaggctgaggcaggagaatggtgcggagcttgcagtga

SEQ ID NO: 36872 - DNA, 201 bp, Homo sapiens
tttggagcgctatcaggaaaaaggctcccagctgcaggagcgttggcaccgagtcattgcccagctcgagattcggtgagtggtggccccacctttttctyctattagagttcagggactaggtcttaaacaaaaacagagttatatctgtacatttatatttaaaggtggaaatggatagggaggggtggaaatttaaaa

SEQ ID NO: 36873 - DNA, 201 bp, Homo sapiens
tgttgggtaaaagacaaactaggcgtgtgtttaaggcaccagcaaatgactatttagattaagaatttgttgtagaaaattttattgaagtgatgacttcmaaatgtgattttgagggcattatacacttgcttcgaggtttaatcttcaatccacatggcggggcaccataatctctggtgcccagggccctcgtctagc

SEQ ID NO: 36874 - DNA, 201 bp, Homo sapiens
cgatgggaaagggccactgaggttactgtggctcggcaaaggcagctagaggaatctgcaagtcatctggcctgcttccaggctgcagaatcccagctccrgccgtggctgatggagaaagaactgatgatgggagtgctggggcccctgtctattgaccccaacatgttgaatgcacaaaagcaacaggtccaggtgagc

SEQ ID NO: 36875 - DNA, 201 bp, Homo sapiens
tcatcagagaccctgttcatctgttgtatttagaagtggtattctttttaccaagcactcatttactgtactcaaaaccaacttccagatttttcctgtckgtgtcattggctggcagaattaacagatctttcttttcttttataggaaaaaggagggaaataaatgctccagaaggctagatctttaaagtctgtgttc

SEQ ID NO: 36876 - DNA, 201 bp, Homo sapiens
atgcctgcattagtatgtaagcttaacaatggcagggatttttgtctcttgttcttttctttgcctggcatagaataggcagtcagtaaatatttattaartgaatggattgtttcatgaatttgatcttctcaaagctttggagtaggtagaccaaataaataggctgtaatgtctgttttcttatgcccatttctcaga

SEQ ID NO: 36877 - DNA, 201 bp, Homo sapiens
gcgatttcagctcactgcaagctccacctcccaggttcatgccattcttctgcctcagcctcccgagtagctggggctacaggcgcccgccaccacaccckgctaattttttgtatttttagtagagatggggtttcaccgtgttagccaggatggtcttgatcttctgacctcatgatccgcccacctcagcctcccaaa

SEQ ID NO: 36878 - DNA, 201 bp, Homo sapiens
gccaggcatggcagtgcgtgcctgtaatcccaactactcgggaggctgaggtgaggcaggagaatcacttgaaccggggaggcggaggtcgctgtgagcckagatcgtgccactgcactgaagcctgggtgatagagtgagactccgtctcaaaaaaataaaaataaaaataaaaataaataaataaaataaaataaaata

SEQ ID NO: 36879 - DNA, 201 bp, Homo sapiens
ttccaggaatctgggtggtagttatttcaatcaagttgagaaatgggatcaccgagagggggatttccgcagaatctgggctgtcagggaaatctttaggytgtcagggaaatctttattccccattgtcttctccttacaaattccaggagaggagtatgaggttatatttgtgtcctcagtaagcccataaaggtcagc

SEQ ID NO: 36880 - DNA, 201 bp, Homo sapiens
gctggagtgcaatggcaccatctcggcttaccaaaacctctgcctcccaggttcaagcgattctcctgcctcagcctcccaagtagctgggattacaggcrtgtgccaccacgctcagctaatttttttattattagtagagacagggttgttggccaggctggtctcgagctcctgacctcaggtgatccacctgcctca

SEQ ID NO: 36881 - DNA, 201 bp, Homo sapiens
ggagagctttgtatgctataaagggatatacaggtcgggcatggtggctcgcactcgtaatcccaacactttgggaggctgagatgggaggatcgcttgarcccaggagttctagaccagcctgggcaacataatgagacccccatctctacagaaatgttaaaaaattagctgggcatggtgatatgcacctgtaccctt

SEQ ID NO: 36882 - DNA, 201 bp, Homo sapiens
tttggattttttcacttgtttcttgagcatatgtaacttctcatttcctatggttaaaaatcagctatctgtatttttttttttttttttttttttgaggkggagtctcactccatctcccaggctggtgtacggtggcatgatcttggctcactgcaacttccacctcctagatttaagctattcttgtgcttcagcctc

SEQ ID NO: 36883 - DNA, 201 bp, Homo sapiens
agcagtttctcttgttgacccaaagaaaggatcagatttaaactcttctttgctcctgcaacctgagtctttttcaggtgggagaagttcctggaaagagsacatgtagtttttttggtttagtccttatcattttttggaatgttgctataggtcttagacaactattcccccaattctgggctgccaggcagagagtta

SEQ ID NO: 36884 - DNA, 201 bp, Homo sapiens
tcctaacctttgaaaacctttaagtgtttgtggagatactgataggatatcatctcttcaccaaaaaccatccagatatctctttgacagttattctcacsatgttttttccccatagttgacttagaaaagcagagagggtaggaggctaaggagaattgaagatgtgtttcatcataagaagtgttcaatgtaaccatc

SEQ ID NO: 36885 - DNA, 201 bp, Homo sapiens
atgttctcatttcttgatgaaatgagaaattagttataatcctttttatatctgcatgtttttgcattactttttctttattttctagatactaatatttyagaaacagtagattcatgtttaaaggtttttttgaattaggtgtatttttcttcctagagctctagtctatatagacgcctctcattttccaatctattg

SEQ ID NO: 36886 - DNA, 201 bp, Homo sapiens
tctttactgcttggtcaagttttctataactttcataggcttcagttttttcatttgtaagaaaggggatgatagaatttactttacaagatgttgtgggkattaaatgagatagtgaatataacatctgatgcagactaggagcctgatagatgttagcgatactgtttctaaaggcgggaactgtgtctcatttatcct

SEQ ID NO: 36887 - DNA, 201 bp, Homo sapiens
gctggcggatcacgaggtcaggagatccaggccatcctggccaacatggtgaaaccccatctttactaaaaatacaaaaattagccgagtgtggtggtgcrtgcctgtagtcccagctcctcaggaggctaaggcaggagaatcgcttgaatccaagaggcggaggctgcagtgagctgagatcataggtgagcctgggtg

SEQ ID NO: 36888 - DNA, 201 bp, Homo sapiens
gctgtttgtctgctttgttgggtctttttcttcttctgactcttaactgtggcagttttctaaggggtaaggcagtgtagtgaagtgggaagaacatgggytttggatccaggcagggctgggttcaaatatatgttttttgtgtgtgtgcgtgtgtgtggagaacggtctcgctatattgcccaggcaggtctcgaactc

SEQ ID NO: 36889 - DNA, 201 bp, Homo sapiens
agttttttcatctgtaaaatggggataataatatcttccatataaaattatgaggattaaacagagtagtataagtaaattttcttattgcctgattgatyggttgatcgtagagatgggggtctctgtgtgttgtacaggctggtctgaaactcctgggctcaagtgatccatccccttggcctcctaaagtgctgggat

SEQ ID NO: 36890 - DNA, 201 bp, Homo sapiens
gcagctcacacctgtaatcccagcactttgggaggccaaggcaggcggatcacgaagtcaggagattgagaccatcctggctaacacggtgaaaccccatytctactaaaaatacaaaaaattagccaggcatggtggcgggtgcctgtagtcccagctactcaggaggctgaggcaggagaatggtgcggagcttgcagt

SEQ ID NO: 36891 - DNA, 201 bp, Homo sapiens
attacaggtgtgagccactgtgcccagcccaaactcagtattttcaaaccaagcttaaatttggcttttctatcctagtccccattttttgacagttgaaytcacattcttccagtctctgagattagaaaccttgcagacatctgttaactcttttctcttcatcaaccccattttcaatctgtcattgagttcttttgt

SEQ ID NO: 36892 - DNA, 201 bp, Homo sapiens
taggccaggtgcggcagctcacacctgtaatcccagcactttgggaggccaaggcaggcggatcacgaagtcaggagattgagaccatcctggctaacacrgtgaaaccccatctctactaaaaatacaaaaaattagccaggcatggtggcgggtgcctgtagtcccagctactcaggaggctgaggcaggagaatggtg

SEQ ID NO: 36893 - DNA, 201 bp, Homo sapiens
ctattccttcaagtttcacttcaggtctttcttctgatgaagacttctctgattatcgtagtccaagttgatgtatcactttcccaagctagttttatctrtctattgaaatggtaagcttttttgagagaactgttttatagacatttctattattcccacggtgcctcgctcatgcctagccaagtttaaatgctcctt

SEQ ID NO: 36894 - DNA, 201 bp, Homo sapiens
gtaaatgggatgggtaagcatcatctttaaacttgggcactggccagccacgaagtcagaagatcaaaaccagcctggccaacatggtgaaaccccatctytactaaaaatacaaaaattaggccaggtgcggcagctcacacctgtaatcccagcactttgggaggccaaggcaggcggatcacgaagtcaggagattga

SEQ ID NO: 36895 - DNA, 201 bp, Homo sapiens
gtgtaaatgggatgggtaagcatcatctttaaacttgggcactggccagccacgaagtcagaagatcaaaaccagcctggccaacatggtgaaaccccatytctactaaaaatacaaaaattaggccaggtgcggcagctcacacctgtaatcccagcactttgggaggccaaggcaggcggatcacgaagtcaggagatt

SEQ ID NO: 36896 - DNA, 201 bp, Homo sapiens
atcacattataatgcaattgataatctgagcttctggttttagaaattgtatcataattctattttgtaccccagtgtttggcatggtgccagtcatatartaaatgttcaatagatatttgataaatgaataaataaatcagaaggatggtctcttaatgcttttcaaaacactagggagtatatacagaacagatgtcc

SEQ ID NO: 36897 - DNA, 201 bp, Homo sapiens
tcctcctcgcaaattcaagtgattcttctgccttagcctcccaagcagctgggactacagagtgcgccaccatgcccagctaatttttgtatttttagtaragacggagtttcaccatgttggccagcctgatcatgaactcctgacctcaagtgatgggcctgccttggccttccaaaatgctaggattacagacgtgag

SEQ ID NO: 36898 - DNA, 201 bp, Homo sapiens
gaggcggagtctcactctgttgcccaggctggagtgcagtggcacaatcttggctcactgcaacctcctcctcgcaaattcaagtgattcttctgccttarcctcccaagcagctgggactacagagtgcgccaccatgcccagctaatttttgtatttttagtagagacggagtttcaccatgttggccagcctgatcat

SEQ ID NO: 36899 - DNA, 201 bp, Homo sapiens
ccatcctatatgacagataagaagtaacttatcaagataagtgtgacattccttcagaatgaaagtccttaaggccaagaggctgcaactctcactggtcyctgaaggaactgtcttcagggagctgctcccctccctaacaggctgttcacaggcttgaggacagtagcagccagagaaacagagagggcaacgcatact

SEQ ID NO: 36900 - DNA, 201 bp, Homo sapiens
attgccctctagatgctaggcttgaaaacgcacactgtttcttacaggctgcctgttctgtaacaaaacaaaacaaaaaagcagaagtcacttcttactgkttatttctactcatttatttattcatttagtaattactgaatagctgccatatgccaggaattagaaataagccagtgagccaaccaagtaaaccatctt

SEQ ID NO: 36901 - DNA, 201 bp, Homo sapiens
agaaggcatccttactttgtattcccatagttcttcagtgatgcacgagagctggagtcattcttgaggaacctccaagattccattaaacgaaaatattsctgtgaccacaacaccagcttatcccgccttgaagacctgctccaggactccatggtgggtgttgcctcagtggggatgattacttctgagaaagagagt

SEQ ID NO: 36902 - DNA, 201 bp, Homo sapiens
tggagatttcatcctgatataagctttcatgattactgcctcagtggtaaaagggcatattatatttatttacattttattagtcaaagcactttccacamaaccacctatacctttcaagagggtgaggaaatgtaatctcaccacttacctagaaggtgcaaagctagaaatatttggtaaaagtattaacagctacca

SEQ ID NO: 36903 - DNA, 201 bp, Homo sapiens
gtccgaggcagagtcttgttctgtcacccaggctgaagtgcagtggcatgatcttggctcactgcaacctctgcctcccgggttcaagcaattctcctgcstcagcctcctgagtagctggggattataggcgcatgctaccatgcctggctaattttttttgtatttttagtggagatggggtttcactgtgttggccag

SEQ ID NO: 36904 - DNA, 201 bp, Homo sapiens
tgtgtgaaggtcaaatgctgagaggttgttgttataaaagtattcaaattagagactttgttccactgaaagacttggaggaagtgtcagggaacatttgycttgggtcttctctcttttcattcctgactgttcctatgtccctcaaaagcctgcaaacatttttgttagtctaaggaaactactaagagaaacaataga

SEQ ID NO: 36905 - DNA, 201 bp, Homo sapiens
tttccatccttgagatataaccttcctgttttacatttcagggagtttcttgtatttgcaaaatgtgaattacgaaatgtctcttgacccctttgcatttwaattagaccctgcagaaacaacaaaatacctgtcaccagcaactggaggatctttgcagttgggtaggacaggcagaaagagcactggcaggccaccaag

SEQ ID NO: 36906 - DNA, 201 bp, Homo sapiens
tctccagtgtgctaaatatttgatagagcatagggaaatttgagtattttagtttccgagtattagtaaagagtggctcacattgccttttactttatacrttcatgcattggaagacttaatattgttaagatggcagcactccccaaactgatctatagattcaatgcaatccctgtcagaatcccagtggggtttttt

SEQ ID NO: 36907 - DNA, 201 bp, Homo sapiens
ggtggagacaggaaccttgattgagctgctggaagatattaaatggtgtggctgcctgggcagtcagaatgattgaccagcataaatcacaggaaacatcrcctgttttttagttcctatttcatgagccctggtgtgggcagtgctgttcatgtgccctcagagcatatggttgagtctatgcatgtcttgggtatactg

SEQ ID NO: 36908 - DNA, 201 bp, Homo sapiens
ttgttctccaccactagattgtaaacttcatgcggtcacaaaacaggactattccaactctacttcccttctgtgtcagctgtggtatatcctttttagawttccaggtggttggtgtttctgggcttcttgaagcacttgtcatttttctgtggcctttggaaacaggagaggctcttctctcacttgttttttgaatgg

SEQ ID NO: 36909 - DNA, 201 bp, Homo sapiens
cattatacatgcttcaaggagattactgttgtggtgaacgagggcagggttggtaagttggagactgagattagacagattaggtaatttaggtgaggtawgttatcagttgccaaggtttcgtacagtctgagcaatattcatagtctttgtggtcagatgtagtttgtttgctgctcctccaaataatgacaattataa

SEQ ID NO: 36910 - DNA, 201 bp, Homo sapiens
tgtcattgtaagggagaaatgaggcctccatttgagaaggtcactagggtcctctggagacacacaagtttcagttcagtagaagagataaagggaggacrgctgaaggacactgtgtcgcaggactctgagggtatgattgaggaggctaacagaggtgaagtagaagtagggtggtttgcccaggacactcccagtttt

SEQ ID NO: 36911 - DNA, 201 bp, Homo sapiens
ccatcccaaattcctgtgggtaatcccaaagagaggcagatctaaaatcttaatgaagttctgagtctgtcttctacaaggcttctttcatggtttggggycctgcccgttggctgttagtaagggatatcctggggggtgctaaatgtgactttaaaaagactgttctttgtatgataaatgatctcttaaaaagaaaac

SEQ ID NO: 36912 - DNA, 201 bp, Homo sapiens
ttagtagagatggggtttcaccatgtggacccagctgttctcaaactcctgacctcaagtgatcctcctgcctcggcctcccaaagtgctgggattacagktgtgagtcaccatgcctggccaaatgacatattttaatatgagtctagactggtgatctaagagtactagggaaaaatatctatgaagtcttagtgagcc

SEQ ID NO: 36913 - DNA, 201 bp, Homo sapiens
catgacatagtgtgagatataaaaacatagagacatagagcatttcatgcattggtgccctcccctagttataacatatgaatcctcttgtagcagagaaygacagtctgagccttgtttttctagtgatagtttcctaaattatcatgttcacagaggaaggaagctttgtcttattgttagcagtggcaaatccatgtg

SEQ ID NO: 36914 - DNA, 201 bp, Homo sapiens
cagaacatgcccaggacttgtcccctcagcagaatcgacagatgctgaggcttctgaatgaactgcagaggtccttccaggacattttggaacagactgcmgctcaggtggatgccttgcagggccatcttcaacaaatggagcaggaagccctggtgaaggtcagactgaaccagcagctgggctcagtttgtctttggg

SEQ ID NO: 36915 - DNA, 201 bp, Homo sapiens
atccagcgcataggaaagcttgcctataggtatctgatttaattattttgaatagtcaatgggctaaccaaggagaagatgaggggatcaaatatctgatrtttaaattaaactagtattcatctctttactttaaatttggtctcttaaaggtctcgcattttgtttcatttgtagtgccacagtttcaggattaatggt

SEQ ID NO: 36916 - DNA, 201 bp, Homo sapiens
aaaaaccatcgttcagctaaaaccacgcagtccagaccatgtgttaaagaacaccatttctgtcaaggctgtctgtgactacaggcagatcgaggtgaggrggtagaaagggtatctctgggccacagggggaaggaagaaagaagggaagccttcagttagggttatgatgataaaagatcaaattacagcgtttttaaa

SEQ ID NO: 36917 - DNA, 201 bp, Homo sapiens
caaattacttattattacccagaaatacagtttaatctctaattattgaattaattttccatggcttttcctagtagggacagtcttcatggacacatgartgacatatttcacagttaagaacttgcattttttttttttttgagatggagtctcaagtctgttgccaggctggagtgcagtggcagggtcttggctcac

SEQ ID NO: 36918 - DNA, 201 bp, Homo sapiens
agaggagcccgcctccccagctgctgcagtgcccaccccagaggagcccgcctccccagctgctgcagtgcccaccccagaggagcctgccttcccagctsctgcagtgcccaccccagaggaatccgcctccgcagctgttgcagtgcccacccccgaggaatctgcctccccagctgctgcagtgcccaccccagcaga

SEQ ID NO: 36919 - DNA, 201 bp, Homo sapiens
tctttatgtgtgtcttgttcctggcagcacacccaggaggatttacagcaattgaggtcagacttggatgcagtttctatgaaatgtgacagctttctccwtcagtctccatctagttcaagtgtcccaactctgcgctcagaactgaatctgctggtggagaagatggaccatgtctatggtctctctactgtatatctg

SEQ ID NO: 36920 - DNA, 201 bp, Homo sapiens
cagctggaagaaatgggaggttggaaagtagagacaattaatatagatccttctttccagaagtcttaggtacaggcaaggaatgaggtgggacactactygaaggagatggattgaaaggaatgttttgaatgggttttggactgaggagaaagaaccaattaaaagggagaacttgaagttagaagagagaggaagtga

SEQ ID NO: 36921 - DNA, 201 bp, Homo sapiens
tactgcttttgttgctttagaatatctatatgggaagcaaataataatctgaaggttgtcaggtgaacatgcagtcagagcagagaggtggtgagtagagraatgatttgtaggatgggcttattagctggcatcatcaaagtagaatagtctgatttcttctgtagaaatgtacctgtcaagggcataagatcctatgtc

SEQ ID NO: 36922 - DNA, 201 bp, Homo sapiens
cgcccctcccccagccccaggtagatctggagttgattaatagttttagtaaactgactcacactgatcacatttgcttgagattggtcgatgtgaatttrttaatttacaaaataaattttaactgccaagtgattcaagaatttgaattggccacttactgcttttgttgctttagaatatctatatgggaagcaaata

SEQ ID NO: 36923 - DNA, 201 bp, Homo sapiens
cataattgcagcttcaccaggcttggttcttcttggcccgggcccttcccttcccttgctggttagtaccagccgagctggtttgctttttccctttttgrtactattctcctcctccttcctccacgttaccttctgccacggcctctcttctttttccctccattttcaatttacacttacattttccctcctcctcct

SEQ ID NO: 36924 - DNA, 201 bp, Homo sapiens
ctcctcacctcccagacggggtcgcggctgggcagaggtgctcctcacatcccagacggggcggcggggcagaggcgctccccacatctcagacgataggyggccgggcagagacgctcctcacttcctagatgtgatggcggcagggaagaggtgctcctcacttcctaggtgggatggcggccgggcggagacgctcct

SEQ ID NO: 36925 - DNA, 201 bp, Homo sapiens
ggctgggcacagtggctcatgtctgtaatcccaacactttgggaggccgagggaggcggatcacttgaggtcaggaggtcaagaccagcctggccaacacrgtgaaactccatttctactaaaaatacaaaaaaaaaaaaaaaaatttgccgggcgtgatggcaggcccctgtaatcccagctactcgggaggctgaggca

SEQ ID NO: 36926 - DNA, 201 bp, Homo sapiens
aaaaaaaaaaagattgggctgggcacagtggctcatgtctgtaatcccaacactttgggaggccgagggaggcggatcacttgaggtcaggaggtcaagaycagcctggccaacacggtgaaactccatttctactaaaaatacaaaaaaaaaaaaaaaaatttgccgggcgtgatggcaggcccctgtaatcccagctac

SEQ ID NO: 36927 - DNA, 201 bp, Homo sapiens
tattttttgtagagatgaggttttactatgttgcctaggctggtcttgaactcctgggctcaagcagcctgcctaccttagccttcagaagtgctgggatyataggtgtgagctgctgtgcctggccaattgtactgtttttatctccagtgtcctagcacatagtagacactcaagaaatatgtattatacaaaagaatg

SEQ ID NO: 36928 - DNA, 201 bp, Homo sapiens
aattttttttttatttctgtgaagaatgtcttgtattttttatagggtaaatctgttttttttttttttattctctcattgacagaggagtttattcttcrtttttcattgttgatgtaacttttttttttttttttttgagatggagtttcactcttgttgcccaaactggagtgcaatggcacgatctcggctcactgc

SEQ ID NO: 36929 - DNA, 201 bp, Homo sapiens
tagaaacattggtgatccatcacattctttttataggggggaaaattgagacccacagaagatgaaaattatgtaaagtcatgtggctagttttttttttycccttttttttttgagatggcatcttgctctgtagcccaggatggagtgcagtgacacgatctcggctcactgcaacttctgcctcctgggtccaagaaa

SEQ ID NO: 36930 - DNA, 201 bp, Homo sapiens
cttatgcccatttctcagataaggaaactgaaacacagagaccgactgacttttttgggttacacacccagataggatttcttttttttttttttttttttgagacggagtctcgctctgtcgcccaggccggactgcggactgcagtggcacaatctcggctcactgcaagctccgcttcccgggttcacgccattctcc

SEQ ID NO: 36931 - DNA, 201 bp, Homo sapiens
tttcttcttgaccttgaagaagtccagaaaaattcttacaaaatagggaattgcatggtaggtaggttatgagaagtttcatttttgggttttgtgaataytacgaacagcttttcctagtttgctagggatttgcgtggccaggtatttgctgcatttaaagttcttagatattatcatcagaagaacagtctttttttt

SEQ ID NO: 36932 - DNA, 201 bp, Homo sapiens
ttacaaaatagggaattgcatggtaggtaggttatgagaagtttcatttttgggttttgtgaatattacgaacagcttttcctagtttgctagggatttgygtggccaggtatttgctgcatttaaagttcttagatattatcatcagaagaacagtcttttttttttttttttttttttttgagatggggtctcgctctg

SEQ ID NO: 36933 - DNA, 201 bp, Homo sapiens
cttatgctggacatgggtggagggtgaggagaggcagtagtccctccaaacccttgtatctccaactgtggattctcctgtttgtttatagggtggaaggsgtggtttatactggtttgtccccagttcctgctctgtgcctgaggggactgcagtggcattaggattttttgcccagttgctcatggacatagagacacg

SEQ ID NO: 36934 - DNA, 201 bp, Homo sapiens
agaagggaccatatggacagtggaagagagtttagcattctgattgttcacctcttgctccttccattctgatggctaattagggacacctcattagctawcagagtggaacaagtatttgccaggctgacatgagcctcagccctgcatcctgcatcttctgctttcccaacctgctgagtcaccacctaggaatggcag

SEQ ID NO: 36935 - DNA, 201 bp, Homo sapiens
tttccatttgcagtgaaaggaagtaaactcactttcccaccctcatcctggaggttacttatgttatttgcagaccccaacttctgcctctctgttaagtwtacttcttatgcaggttgcccttactgttacatcttaccactgggggaaagatccaaggctctgggaaggacagtgacagttgtcctacattggctagtt

SEQ ID NO: 36936 - DNA, 201 bp, Homo sapiens
gagccactgcacccagccctcatttgcttcttgaaagttttcaaggtctgatgctttatctttagtgggtgatgaggtcagctagaaacttgaggacatartaatcaagtacttacttgctcagaacaactcgtctcatccactgagagacttaccaagtccaaactcctcagctgggataagataagataccaagtcgaa

SEQ ID NO: 36937 - DNA, 201 bp, Homo sapiens
tttacattgtattaggaattataagtaatctagagattatttaaagtagctgggaggatgtacacaggttgtatgtgaatactacctcattttgtatctgrgacttgagcatttgtggatttcagtatctgcggattttggtatctgagggaggtcctagaaccaattctccatggatgactactgaaaaggggttactat

SEQ ID NO: 36938 - DNA, 201 bp, Homo sapiens
cccatatagcagatactatactaaaaaaaattggggtggaggaatcttcactgacatcacaaggtgatttttgaatccgacttttacagtctgaaattcasacttcctgccctactgcaatgggagtaaaaaccacctgaacctctttttggcagcttcttctcttactcccaaatggcaacaagtgttatctctttgatt

SEQ ID NO: 36939 - DNA, 201 bp, Homo sapiens
agctgaaatgactgagaaaaggttcttgctaaaaagatttttcctaaacctttgactgaagaagttatcctgtgcccagagaggccttgacatctctgtgwacagattctcctatttgagaagtgttgcttagaagtgttggagagtgcccagaagatgcttccatccttatctctccatgtgttagggtactttttgccc

SEQ ID NO: 36940 - DNA, 201 bp, Homo sapiens
ttgtgaatttcttgttcctctattgtgtctttgccttggttggtggccaaaggagccagcagggctgaagaccctccgtctggtgagcatgccctcctggygccatacaaacaacgaggagcaggcggaggaagatgatgatgatgtagtaggtcctcctggggatgccagcatcccagctggcactgctggcactgcagg

SEQ ID NO: 36941 - DNA, 201 bp, Homo sapiens
ccaggctgggatgccgtggcatgatctcggctcactgcaacctctgcctcccaggttcaagcaactctcccgtctcagcgccctgagtcgctgggattacrggtgcctgccaccacgcccggctaattttttttttgtatttttagtagagacggggtttcaccatgtcggccagtctggtcttgtactcctgacctcaag

SEQ ID NO: 36942 - DNA, 201 bp, Homo sapiens
ctggagtgcagtggcacaatctcggctcactgcaacgtctccctcctgggttcaagcagttctcctttctcagcctcctgagtagctggaatgtaaggcgygccccaccacgccccgctaatttttgtatttttatttatttattttttgaggtggagtcgtgcactgtcacccaggttggagtgcagtgtcgtgatctcg

SEQ ID NO: 36943 - DNA, 201 bp, Homo sapiens
gagtagctgggattgtaggcatgcaccaccacacctggctgacttttaaaattttttgtagagatggagtctcactgtgttgccctgactggtctcaaacycctgggctcaagtaatcttcctgtcttggcctcccaaagtgctgcaataacatgcttgagccaccgcacctggccttctaaattttgatgcttagtccac

SEQ ID NO: 36944 - DNA, 201 bp, Homo sapiens
tccttaatagtgggtgattttggcattttaggaaagacattaagtatataccttcaattttctttgtttctgtaagaaagccagtagctgtcaattctcarataacttctgaccacatgtggaaatactggcctgaacctcttccctccactcacccttttcaagatctgcaggtagcagccagacttaaactttttccta

SEQ ID NO: 36945 - DNA, 201 bp, Homo sapiens
cgtggtggctcacgcctgtaatcccagcactttgggaggctgaggcaggcggatcacctgaggtcgggagttcaaggccagcctgaccaacatgaagaaamcccatctctactaaaaaaatacaaaaaattagctgggcctggtggtgcgtgcctataatcccagccacttggggggctgaggtaggagaattgtttgaac

SEQ ID NO: 36946 - DNA, 201 bp, Homo sapiens
tcagactcctgagtagctgggattgtaggcatgcaccaccacacctggctgacttttaaaattttttgtagagatggagtctcactgtgttgccctgactrgtctcaaactcctgggctcaagtaatcttcctgtcttggcctcccaaagtgctgcaataacatgcttgagccaccgcacctggccttctaaattttgatg

SEQ ID NO: 36947 - DNA, 201 bp, Homo sapiens
gaggatcacctgagcccaggaagtcgaggctatagtgagctgtgatcgcgccactgcactctagcctgggtgatggaagtgagaccctatctccaaaaaaraaaaaaaaaaaaaactttatggccagcacagtggcccacacctgtaatcccaacactttgggaggctgaggtgagatgatctcttgaggccaggagtttg

SEQ ID NO: 36948 - DNA, 201 bp, Homo sapiens
gcctcctaaagtactgggattgcaggcagaagccactgcacctggcaatgagtatcacttaatgaagtcgtcactagactgggactgaatcagaaatccarttgccacttaacttatagctaagtgaccataacatctcagaacctcagcttccttggtttctttgatggaatggtggtaataagtaaacttcacaaggta

SEQ ID NO: 36949 - DNA, 201 bp, Homo sapiens
ttttaggatcatctggttcactcattcatgcatttaatcaaaaatttaggccgggtgcggtggctcatgcctgtaatcccagaactttgggaggctgaggygggcagattacctgaggtcaggagtttgagactagcctggccaacaaggtgaaaccccatctctacgaaaaatacaaaaattagccgggggtggtggcag

SEQ ID NO: 36950 - DNA, 201 bp, Homo sapiens
ttgaagcttgttgtgagggaagtggggaatcagtctgctccctgctctgctcaaattattgtgctaaggagactttgccatggtatgatttttgaggcacrtgatgattctgtctgatttgtaaactgacaacgtgatcagggccaaagaggaagttcagctaggccaaaccttcctaagaagaagtcactgtcccacagt

SEQ ID NO: 36951 - DNA, 201 bp, Homo sapiens
aggctggtctcgaactcccgacctcaagtgatccacccacctcggcctcccaaagtgctgggattacaggtgtgagccaccatgcctggcctttttttttyttttttttttttggggggggggacagggtcttgctctgtcacccaggctggagtacagtggcacaatatagctcactacagcctcgacttccctggctca

SEQ ID NO: 36952 - DNA, 201 bp, Homo sapiens
gctttaccagtccttaccacattccctcctatttcagaggcaggtctctgggcatatacatatatattttgtgttcttagttcctcccttcctagtgactstttgtaaagatattcaggttttctccatcctaagataaaaattcctttaagcttatctcttcttcagactaactctctgtgctttttttttctttaccac

SEQ ID NO: 36953 - DNA, 201 bp, Homo sapiens
gaagtgggggatggttaatggatgcaaaaaaataaaaagactaaataaaacctagtatttgctagcacaacaaggtgactatagtaaaaataatttaattrttcatttaaaaataactaaaagagtttaattggattgtttgaaacacaaattgcttgaggtgatggataccctatttaccctgatgtgattagtatacat

SEQ ID NO: 36954 - DNA, 201 bp, Homo sapiens
cctgcactcaagcaatcctcccaccccagcttcccaagtagctggggttacaggcgcatgtcaccatggctggctaatttttttgtatttttactagagayggggttttgccatgtgctcaggctggtctcaaattcctgagctcaagcgattcgcccaccttggcctcccacagtgctgggattacaggtgtgagccacc

SEQ ID NO: 36955 - DNA, 201 bp, Homo sapiens
tcacggctttggctttttgaagcttgttgtgagggaagtggggaatcagtctgctccctgctctgctcaaattattgtgctaaggagactttgccatggtwtgatttttgaggcacgtgatgattctgtctgatttgtaaactgacaacgtgatcagggccaaagaggaagttcagctaggccaaaccttcctaagaagaa

SEQ ID NO: 36956 - DNA, 201 bp, Homo sapiens
tgtctgtgcctttgtaagggctgttggagacagaagggctttttttccgctttgtcagcagctggccagagaatgcctattagtctgccagatcctaagtmtttcacgtttccctgtctgtgtctggaacttagggcagaatctcttaccacctgaggttacatctcactatttgcctttgtgggacccattggaggataa

SEQ ID NO: 36957 - DNA, 201 bp, Homo sapiens
gcacttagttcaagtggttaagtcagttgttcctgttgttagattgctgttgtgtagtcgactttccttctttaggtgggaagagtctctgaatagacttwaaaaaagcaaaaggaaccagctcttctttagctgattgatcattcctttacatctgactcttttcagcacttaaattcagattgtactatgctgattgct

SEQ ID NO: 36958 - DNA, 201 bp, Homo sapiens
tcacccaatggcatcttgtgagccaggttgtctgaaaaacttcaaatcttggtggcagtgtggtgggtgtatctcccatatgagggattgttccagggatstgactcaattgacagctcctgaatttctaatatgccaaggcttttgtggtaagatgagcaagaatttttcaagctcagatttggggatcatagcttcttg

SEQ ID NO: 36959 - DNA, 201 bp, Homo sapiens
gggtagcttatcctaagaacctgtgactattgggatggtcatctttttgaggccagcagtagaaagaaatttgcagtagtgactgacacattaaagcaacyccgaaacaaatcagagtgaaatagtgtcctggagttggggatatgtgggtgatatctgggctgcattttctctctaggtatccatggagagggtcctgtc

SEQ ID NO: 36960 - DNA, 201 bp, Homo sapiens
gaagttcctggagggactcaacaaccttagaggtattacaaggcttcaggctccctaccctttgtccttgctgatcgtgtgagcacttattatggtgtgtrttgtatagggtctgtaaaaccctcctgctctgagctggccctattttttatgcgtttaggcaattaaacagaagggatagagtttgtaaatgcaatccta

SEQ ID NO: 36961 - DNA, 201 bp, Homo sapiens
ttttctaatctttcattcactattgtttgcttcattcacttatatacactgtataatagtctttatagcataaaacatacaatatatagcagtttctcttrttgacccaaagaaaggatcagatttaaactcttctttgctcctgcaacctgagtctttttcaggtgggagaagttcctggaaagaggacatgtagttttt

SEQ ID NO: 36962 - DNA, 201 bp, Homo sapiens
tcttctttgctcctgcaacctgagtctttttcaggtgggagaagttcctggaaagaggacatgtagtttttttggtttagtccttatcattttttggaatrttgctataggtcttagacaactattcccccaattctgggctgccaggcagagagttagatacaaaccattgcctttgtcaaatcctcctgtgggttgagt

SEQ ID NO: 36963 - DNA, 201 bp, Homo sapiens
ttcaggagttcaagagcagcctggccaacatggtgaaaccccatctctactaaaaaaaatatataaaattagctgggcatagtggcaggcacctgtaatcycagttacttgggaggctgaggcaggagaatcgcttgaacccgggaggtggagattgcaatgagctgagatcgtgccactggactccagcctgggtgacag

SEQ ID NO: 36964 - DNA, 201 bp, Homo sapiens
ttttagaattccaggtggttggtgtttctgggcttcttgaagcacttgtcatttttctgtggcctttggaaacaggagaggctcttctctcacttgttttktgaatggttcgtaatgtactgggactatgtgggtaggctatgttggatcagaacatagaattttgcccctcaaatgcaggctttcatttgacgtcaggcc

SEQ ID NO: 36965 - DNA, 201 bp, Homo sapiens
agaatcgcttgaatccaagaggcggaggctgcagtgagctgagatcataggtgagcctgggtgacagagcaagactgtctcaaaaaaaaaaaaaaaaaaawgaaaagaaaagaaaaaaagaaactccatagtcattttatagtcatacctaatttttggtcaaaagatgatattacccaagacaaaattaaacccaatctc

SEQ ID NO: 36966 - DNA, 201 bp, Homo sapiens
acttctccctgggctcccaggccctcctgcagcagcccccgcctgggccatgtcttcctcagatgaagagacgctcagtgagcggtcatgtcggagtgagyggtcttgtcggagtgagcgatcttacaggagcgagcggtcggggagcctgtctccctgtcccccaggggacaccttgccctggaacctgccactgcatga

SEQ ID NO: 36967 - DNA, 201 bp, Homo sapiens
ggagatggttgttatacgatccctatttctcaaagagtgagcctgtatagctaacaagcatacaataccattttcccctcatccttgattttgttttcttrtcatgtaggcattagtattgaaaggttaaggccttcatcctcactatgctgctgtggtttctattggttgttggagaaaccccaggctgataatactact

SEQ ID NO: 36968 - DNA, 201 bp, Homo sapiens
aaacgactattataggaaaaaggtgtttaatggattcattcagcaggtaatttattgaatatccactgatacaaatgtattcccaggtattagggatataycagtaaataaagcaaagtcctttcccttgtagagcttatattctatcatttagaggcatttttgaaaagcaaagcacctaatattggatgaagcccatct

SEQ ID NO: 36969 - DNA, 201 bp, Homo sapiens
gattcattcagcaggtaatttattgaatatccactgatacaaatgtattcccaggtattagggatataccagtaaataaagcaaagtcctttcccttgtaragcttatattctatcatttagaggcatttttgaaaagcaaagcacctaatattggatgaagcccatctgtgggaggacagcagtgaaggagttaaaatgc

SEQ ID NO: 36970 - DNA, 201 bp, Homo sapiens
actgaacataatcttagtacctcacagacagtgcacatgtactaacacctttcctgaaaccttaaaatataagaaatatagaaatacaggtagtttgtaartctttgctcttggggaagccaattttggatttcctttgtctttttgtcctatcatactccttgaaaggggtagtaaaagcatttttctctttttccctct

SEQ ID NO: 36971 - DNA, 201 bp, Homo sapiens
taagtctttgctcttggggaagccaattttggatttcctttgtctttttgtcctatcatactccttgaaaggggtagtaaaagcatttttctctttttccytctctgtagttcaccccagtggggcacatagttgctggattcagcaacgttctttcccaaatgattcttaaggcatgcgggtcactgaggtttattttta

SEQ ID NO: 36972 - DNA, 201 bp, Homo sapiens
gcctttgctgttcctctcatccctggctatggttggctaagtctctttttcttaggtctcagggtgttcagctgttttgggaacttgttgaaaattgttgytttgcagtacaaaagacactctgttactttttaatcaatatctttttttttgagacagggtctggctctgttgcccaggctcgactacagtagcccatct

SEQ ID NO: 36973 - DNA, 201 bp, Homo sapiens
gattcttgtgccacagcctcctgagcagctgggactacaggcgcgtgctaccatgcccagctaatatttttgtatttttagtagagatgggattttgccaygttgtccaggctggcttcgaactcctggcctcaagcggtacacccgccttggccttccaaagtgctgggattataggcgtgagccactgcgctgggccag

SEQ ID NO: 36974 - DNA, 201 bp, Homo sapiens
aggaagttctggaagggaaggcacttctactcctgcccctccctggcttagagcaatgatagtatttcttctggggctgggaaaagaaataggaattagcyaggacaacctgaagagacagggcacttcccggtggtttgcatctattcttgctctcctttctttggctttcgtaggaaggaaagaaggaaaatgaagaga

SEQ ID NO: 36975 - DNA, 201 bp, Homo sapiens
cagcctggccaacatggtaaaacctcgtctctactaataatacaaaaattagccaggcatggtggcgtgtgcctgtaatcctagctacttgggaggctgargcaggagaatcatttgtacccgggaggcggaggttgcagtgagctgagatcgtgccattgcactccaccctgggcaacaagagcgaaactctgtctcaag

SEQ ID NO: 36976 - DNA, 201 bp, Homo sapiens
tagaactgtacaccaaaaaagaaatcagtttaactgtaaatcaataatgaagtgatgcaaaaatttaatcaaaacaaaaagtcctagagctctgagccgtrcttttatttctttttcaggtgaaactagtgaatattcgcaatgatgacatcacagatggcaaccccaagttgaccctgggtctgatctggaccattattt

SEQ ID NO: 36977 - DNA, 201 bp, Homo sapiens
ggagcttattggacgatctcagggagcagacaaggatctggctgcaaaaggtgcttgatgattgtcattatttttaaaaatcaacagaataaattctaggstgtggttatcttcagcatcccaccagatttatttatttctttgaatgtaaaggcagtccccagtaatgagtattccagaaagtcactggaaaatcatttg

SEQ ID NO: 36978 - DNA, 201 bp, Homo sapiens
ccccaaactgatctatagattcaatgcaatccctgtcagaatcccagtggggttttttcttcttctttcttctcctcctcctcctcttcctcttattcttygtcttcctcttcctcctcctcctcttcttccagaaattggcaagctgctcctgaaattcatgtgaaaatgcaagggacccagaatagtcaaaacaatctt

SEQ ID NO: 36979 - DNA, 201 bp, Homo sapiens
tgaaggacccagggaagaaagttccctagggtgtatttgatttgggagccccctgagggtaatctgtggtgatgctgtttcagaagtcaccacctgactcrttgtcagatgagtctgagcccaagactcgtacctgccacataatatatacaggtcctctctccctttggttatgagctaaaggcctttaatcatgaggta

SEQ ID NO: 36980 - DNA, 201 bp, Homo sapiens
tccacagcaggctcttctctgtgcggagcctgggtggggtgcggctgtcaggggagcggctggggaaggagcagactcagctcgctggggcagggactgtkgccttgtcaccctgggccctgcacttagcatgtggcctggtatagggtgagtgtccggtcctgtggaatggcccagtgggcagctggacccactgtgttc

SEQ ID NO: 36981 - DNA, 201 bp, Homo sapiens
gtggtcacatcatcggagtgaccagagctgagtcgcgtgccctgagtccacagcaggctcttctctgtgcggagcctgggtggggtgcggctgtcaggggrgcggctggggaaggagcagactcagctcgctggggcagggactgtggccttgtcaccctgggccctgcacttagcatgtggcctggtatagggtgagtgt

SEQ ID NO: 36982 - DNA, 201 bp, Homo sapiens
ctctctctcttctttctttcttttttcctcccctccccgcccctctcctctctcttcctttctcttttcttgtcttttctttctttctttctcttcttttstgtgtgtgtgtgtgtgtgtgtttgttttttttttttttttttttttttttgacggaatcttgctttgtcacccaggttgaagtgtagtggcgtgagtagc

SEQ ID NO: 36983 - DNA, 201 bp, Homo sapiens
atagattttgacacaagcttgaacttgtataatgaaagttccatgtgtgagaatttcatcagaataaaagcaacacagttttctttgttgtttaaaaactyagtcttctgtgtctatctatctttgtccagtaggggtcactgagggttaggctctcaataagagaaacactaatctagtgataaatgagctggattcctt

SEQ ID NO: 36984 - DNA, 201 bp, Homo sapiens
ttccttccagctccaaggaaaagcaaaacttacacttgtgttcttggagacacttttttcttttaaattcccaggtagatttggaagttcactgttaaagrtggttcgacacccttgttagtgtatgttacctactaggcctctctagaagagcattttgagttatttctgccataagatgaatggttttccaggcacttg

SEQ ID NO: 36985 - DNA, 201 bp, Homo sapiens
cataatgtcctcaaggttcattcatgttgtagcatgtgccagaatttccttcctttttaaggctaaataatattccatttatgtatctaccacattttatytatccattcatctgttgatggatacttggcttgctaataatatgattatttttgggtttttttgacatcttatttaattaattaatttatttagacagcg

SEQ ID NO: 36986 - DNA, 201 bp, Homo sapiens
ctctttcctttattcccacttcattgtctgaactggacatcatcctagattccattctctctctcactctcctatgtcaaatcagtcatcaaatcttatgrtaattatatttctttcaaagtcagctatacttcttcatctttattgagatattattgtagtttagaaccactgtctgctttcactgttattattatagta

SEQ ID NO: 36987 - DNA, 201 bp, Homo sapiens
catcactcctgttttacagctgaggaaattaaggcttaaggagattaagtaacttgcctgaggttacccataattagaactaaatcttttttttttttttwattttttttagagacaaggtcttggctgttgcacaggctgcagtgcagtggtgtaaacatggctcacagcagcctcaaactcctgggctcaagagattgt

SEQ ID NO: 36988 - DNA, 201 bp, Homo sapiens
cccaccaccacgcccggctaatttttgtatttttagtagagacggagtttcaccatgttggccaggctggtcttgaactcctgacctcaggtgatccaccygcctcagcttcccaaagtgctgggattacaggtgtgagccaccgcgcctggcctcttcatgagggattctaacacccagatgttcaggctccaggggcag

SEQ ID NO: 36989 - DNA, 201 bp, Homo sapiens
tttttctttttctttttctttctttctttttttgttttttgagacggaatttcgctcttgttgcccgggctagagtgcaatggtgcaatctccgttcaccrcaacctctgcctcccgggttcaagagattctcctgcttcagccttccgagtaactgggattactggcatgcaccactacacccggctaattttgtatttt

SEQ ID NO: 36990 - DNA, 201 bp, Homo sapiens
gggcaacagacagagcgagactctgtctcaaaaaaaaaaaaaaatacaaacattagccgggcatggtggcacgcacctatagtcccagctactcgggagtytgaaacaggagaatagcttgaacctggtaggtggaggtttcattgagccacgacagtgcatgcactccagcctgggcaacagacagagtgagactccatc

SEQ ID NO: 36991 - DNA, 201 bp, Homo sapiens
gtactgaggagagggacaaagttcagcgtggaaacctgtggtcacatcatcggagtgaccagagctgagtcgcgtgccctgagtccacagcaggctcttcyctgtgcggagcctgggtggggtgcggctgtcaggggagcggctggggaaggagcagactcagctcgctggggcagggactgtggccttgtcaccctgggc

SEQ ID NO: 36992 - DNA, 201 bp, Homo sapiens
aggtgatgtctttgcccacctgggctgccccgggaagacagcctggtcctggggagacaggtgagtaaacagaggccgggatgctgtcactgtgataaggrcagtactgaggagagggacaaagttcagcgtggaaacctgtggtcacatcatcggagtgaccagagctgagtcgcgtgccctgagtccacagcaggctct

SEQ ID NO: 36993 - DNA, 201 bp, Homo sapiens
tgggtgagtgcggccgcccgcgcggggaccctcggagtaagctggctgcaggggaggggcgcgcatccgcgggcggtgccgggccctggccgaacggggartcacagacggtggacgcgaaccacaggggagtgggaccgccgtggttagggaaggtctaagggtcatgggggccccctgggctgcggggtggtcaggagc

SEQ ID NO: 36994 - DNA, 201 bp, Homo sapiens
acggcgcgcccgcggagcagcgcctgggccgcgccgacctggtcatgagcttcgtcaacatgggtgagtgcggccgcccgcgcggggaccctcggagtaarctggctgcaggggaggggcgcgcatccgcgggcggtgccgggccctggccgaacggggaatcacagacggtggacgcgaaccacaggggagtgggaccgc

SEQ ID NO: 36995 - DNA, 201 bp, Homo sapiens
gcggccccggcctgcgacccccgcccggctgtccccagcgacgtctgggcgcgcgcgagcgccgggacgtgcagcgcgagatcctggcggtgctcgggctrcccgggcggccccggccccgcgcgccacccgccgcctcccggctgcccgcgtccgcgccgctcttcatgctggacctgtaccacgccatggctggcgacg

SEQ ID NO: 36996 - DNA, 201 bp, Homo sapiens
ggggatttgatggcttattatttagctttctattaaaagttcacaaacgcctgacagaattagaattagattcaatcattccccagtgtcctttccagtamgtcccagaaaagcttttgactaaatattcagatcctagtgtgcatctatagcagcggaaacaaagacagacattttagaagtgtgtttgattgtgtggtg

SEQ ID NO: 36997 - DNA, 201 bp, Homo sapiens
cgtcggggcgtccccgggcccaggggcggcggcggagctgatgtgcgcccgctgagcgcccccggcccgccatggccgcgcgccccggaccgctctggctyctgggcctgacgttgtgcgcgctgggcgggggcggccccggcctgcgacccccgcccggctgtccccagcgacgtctgggcgcgcgcgagcgccgggacg

SEQ ID NO: 36998 - DNA, 201 bp, Homo sapiens
caaggtagagtctttgtcttttccattcctttcctttttttaaaaaaaaaaaagagacgaggttttgctatgttgcccatcctgaacttgaatttcaagcstcctcccaccttagcctcccaagtagctgggactataggcaccctctaccatgcctggctctttttctttcctttgcattttttttttcttaaagatttg

SEQ ID NO: 36999 - DNA, 201 bp, Homo sapiens
ctccccgttcgccgtcggggcgtccccgggcccaggggcggcggcggagctgatgtgcgcccgctgagcgcccccggcccgccatggccgcgcgccccggmccgctctggcttctgggcctgacgttgtgcgcgctgggcgggggcggccccggcctgcgacccccgcccggctgtccccagcgacgtctgggcgcgcgcg

SEQ ID NO: 37000 - DNA, 201 bp, Homo sapiens
ccgcaacacctgccgccgcccggggctcctagcgggcgcggcctccgcgcccaggccccgcccccgcgcccccattggtcagtcccgggggtgggcgggcrgcacagacggctgagccggggcaaggactcgcgggaatcgcgccgcccgggtcgctgccggagctcgccggtcgcccctgcgctgcgcggaccgcagcca

SEQ ID NO: 37001 - DNA, 201 bp, Homo sapiens
tgtttctgtaagaaagccagtagctgtcaattctcagataacttctgaccacatgtggaaatactggcctgaacctcttccctccactcacccttttcaaratctgcaggtagcagccagacttaaactttttcctacctttaacaggaaatgacaaaagttgggaaaaaaagaaggggaatggctcggatgactctactg

SEQ ID NO: 37002 - DNA, 201 bp, Homo sapiens
gcccctgtgaggccctttgcggtgcctcccttgccagcccctccagcctccgccatttgccccctgggctctccagtttccactgcccccctgcccgagcscagctccactgctgtgtgacctggcgtaagtcccttaaccgccgtgtgcctcagtttcctcatttattaaaagaggaggttccagtggtatgtaccccct

SEQ ID NO: 37003 - DNA, 201 bp, Homo sapiens
caggacctcttgggaacttgaagggaaggcctgtctcctgtaggtagactgaccttgtccccaagactctaccctacttttctcagtctgcagtgccgttrggagaaataggttctgcttgagtgccagggaatttaggagatggcagattttggttcactttcctccaacttcacccagtaattattattttgattttta

SEQ ID NO: 37004 - DNA, 201 bp, Homo sapiens
cacatggcggggcaccataatctctggtgcccagggccctcgtctagcccctgtgaggccctttgcggtgcctcccttgccagcccctccagcctccgccrtttgccccctgggctctccagtttccactgcccccctgcccgagcccagctccactgctgtgtgacctggcgtaagtcccttaaccgccgtgtgcctcag

SEQ ID NO: 37005 - DNA, 201 bp, Homo sapiens
attagcagtttgtaggtgggagggatacccacttgggagtgaagttgtcaagcaactgaggcaggtcatagggcttgtttaaactgaatggtctgctaggraagcttgcatttactttttttcatttgtagtcgtttgggctaatctctggaaacttgctttcctaggtgctgcccctcctccctccctgccttcaggaac

SEQ ID NO: 37006 - DNA, 201 bp, Homo sapiens
tgttagctgtgacttagatctctcttgataaggcatcattaaataatgattatttaagtaatgtcctgtggccttgaacaagtgacttaacctttttggcmgtaggtttccttggtttcaaaattgtagggtatacagactggtgctagactgagagacatcaattctctgtaaaatgaaaaaagataaagaaaatgtagt

SEQ ID NO: 37007 - DNA, 201 bp, Homo sapiens
tgtctggactttatttttctggctaacttacagagttgttgagcattagaaagaatagatacaaggtgcttagcacctaagtaggtgctgaataaatgctrtttaattttttttttttttttaagacagaatctcactgtcacctaggcaggaggagttcagtggtgccatcttggctcactgtgacctccgcctcctggg

SEQ ID NO: 37008 - DNA, 201 bp, Homo sapiens
gtggcactatctcggctcactacaacttcgcctcccgggttcaagtgattcttgtgcctcagcctgctgagtagctgggactaggcgcgtgccaccactcygggctaactttttatatttttagtagagacggggtttcgccattttggccaggctagtctcaaactcctgacctcaggtagtccgctcgtcttggcctcc

SEQ ID NO: 37009 - DNA, 201 bp, Homo sapiens; identical to SEQ ID NO: 7915

SEQ ID NO: 37010 - DNA, 201 bp, Homo sapiens
ctgtctcagcctctcgagtagctgggattacaggtgcataccaccatgcccggctaatttttttttttttttttttttttgagacggagtttcgctctgtygcccaggctggagtgcagtggcgcgatctcgactcactgcaagctccgcctcccgagttcacgccattctcctgcctcagcctcccgtgtagctgggact

SEQ ID NO: 37011 - DNA, 201 bp, Homo sapiens
tcttaccaagtggagaaactgttgatggggccagcattgcaaagctatcttagcagcaaaagaatataagtataattttttataaaggagatgaaatggasgaaagtgaagctatggtatcagtccattacacttctaagaagagcctggttttgtacttctgtgttagaagtcagattaccaaatagcacagttcttatt

SEQ ID NO: 37012 - DNA, 201 bp, Homo sapiens
ttcaagttggagatttaataaaaagggaatacgaatttcctctagaagggattaagaatcattcctgctaagaaccttgagtgacgttttgttgcctggcrgctaaaataatttgtctctttccatgagtatgttgtcttgtgctgtgttaacttcctgatacctaagcttaaagtgagggccaaaggacaaattcagtgc

SEQ ID NO: 37013 - DNA, 201 bp, Homo sapiens
caaactaggcgtgtgtttaaggcaccagcaaatgactatttagattaagaatttgttgtagaaaattttattgaagtgatgacttcaaaatgtgattttgrgggcattatacacttgcttcgaggtttaatcttcaatccacatggcggggcaccataatctctggtgcccagggccctcgtctagcccctgtgaggccct

SEQ ID NO: 37014 - DNA, 201 bp, Homo sapiens
atcattagcccccttttcttgataagacactgagcctgagagaggttaagatcacagagttgccaggtggctagggaaaacccttgttttgacactactttctccaagaaacctaccccacctcagttcccttccagtcctaatgttctggattccactcacatgtggtctgctcccacttccccgctcctctgcccttcc

SEQ ID NO: 37015 - DNA, 201 bp, Homo sapiens
gatcattagcccccttttcttgataagacactgagcctgagagaggttaagatcacagagttgccaggtggctagggaaaacccttgttttgacactactttctccaagaaacctaccccacctcagttcccttccagtcctaatgttctggattccactcacatgtggtctgctcccacttccccgctcctctgcccttc

SEQ ID NO: 37016 - DNA, 201 bp, Homo sapiens
aaagtgcatttctttttttttctttttttttttttcttttttttttttttttttgagatagggactcattctgttgcccactggagtgcagtggcgcaatmtgggctgaccgcaacctccgcctcccaagctcaaactattctcctgcctcagcctcctgagtagctggagttacaggcacatgctaccatgcctggctaa

SEQ ID NO: 37017 - DNA, 201 bp, Homo sapiens
aatcttgatacctagtattatttgaatttctttttcctttactcattcaccataattgtttgttgtaactattgtattcttactgaggattttttttttttcatttctaggggaaattagtaaaacaaaaggtatttgaagacattttgaaatttttatttggaacataaaactttgattttgggaattatcaaaatatat

SEQ ID NO: 37018 - DNA, 201 bp, Homo sapiens
gcattagaaagaatagatacaaggtgcttagcacctaagtaggtgctgaataaatgctatttaattttttttttttttttaagacagaatctcactgtcayctaggcaggaggagttcagtggtgccatcttggctcactgtgacctccgcctcctgggttcaagtgatcctcgtgccttggccaaccaagtagctggtat

SEQ ID NO: 37019 - DNA, 201 bp, Homo sapiens
aaagaaaaattagaatggcatgctgtagcatgtggcataagtaatgttttgggggtttttttgtttgtttgtttgtttgttttttcattttttaaaaagcraagtagagacaaggtcaaataatggatgtttaaaacatttaaggatcagcctggtcaacatggcaaaaccccatctctactaaaaatacagaattagctg

SEQ ID NO: 37020 - DNA, 201 bp, Homo sapiens
gtagagatgctggtggtggggagtgggctctctcttgtttgtttatagcctttggtggggctgagattataaagaacattaaaatgaatattgccttttckttgcccgttttcctctcacataagggtactttctgagacttttacctcagttttatctttctgcctaaccttcaatgttagtcagaaagatctttgctag

SEQ ID NO: 37021 - DNA, 201 bp, Homo sapiens
ttacataattgatttcaaagaaaaattagaatggcatgctgtagcatgtggcataagtaatgttttgggggtttttttgtttgtttgtttgtttgttttttcattttttaaaaagcaaagtagagacaaggtcaaataatggatgtttaaaacatttaaggatcagcctggtcaacatggcaaaaccccatctctactaaa

SEQ ID NO: 37022 - DNA, 201 bp, Homo sapiens
acatattcaggtctaaatgaaatgaggcagtggactaaaaggaaaccgaatgaattccacctcctttaaatacttactagtttaaaagaaaatctgttaaytttttcctttttcatctgtgtgttgtttgacctattacagcaaacatacatagcttttataaaaaaaagaaattataaaaaaaagaaaaaacacttctat

SEQ ID NO: 37023 - DNA, 201 bp, Homo sapiens
tttacataattgatttcaaagaaaaattagaatggcatgctgtagcatgtggcataagtaatgttttgggggtttttttgtttgtttgtttgtttgttttttcattttttaaaaagcaaagtagagacaaggtcaaataatggatgtttaaaacatttaaggatcagcctggtcaacatggcaaaaccccatctctactaa

SEQ ID NO: 37024 - DNA, 201 bp, Homo sapiens
ctcccaaagtgctaggattacaggcataagccaccttgcctggcatggttttgaggtttttagatattgaactggattcttgtaggtaactcagttctgayttcattttgtgtgtttcttttaccaatcttctaatcatacttggccaattgagaacgctctccggtggttttatgttttagttcttactatgtagaactt

SEQ ID NO: 37025 - DNA, 201 bp, Homo sapiens
atttacataattgatttcaaagaaaaattagaatggcatgctgtagcatgtggcataagtaatgttttgggggtttttttgtttgtttgtttgtttgttttttcattttttaaaaagcaaagtagagacaaggtcaaataatggatgtttaaaacatttaaggatcagcctggtcaacatggcaaaaccccatctctacta

SEQ ID NO: 37026 - DNA, 201 bp, Homo sapiens
aacaatttacataattgatttcaaagaaaaattagaatggcatgctgtagcatgtggcataagtaatgttttgggggtttttttgtttgtttgtttgtttgttttttcattttttaaaaagcaaagtagagacaaggtcaaataatggatgtttaaaacatttaaggatcagcctggtcaacatggcaaaaccccatctct

SEQ ID NO: 37027 - DNA, 201 bp, Homo sapiens
ggcgcctgccactacgcctggctaattttttgtatttttagtagagacggggtttcaccgtgttagccaggatggtctccatctcctgaccttgtgatccrcccaccttggcctcccaaagtgctgggattacaggcatgagccaccgcacctggccaagagagactttaattctaatttggccctagaatcattagtgcc

SEQ ID NO: 37028 - DNA, 201 bp, Homo sapiens
aaggtatggcctgaaaactcttttccctccttaggaattaaagaaggaggtcatggagcacaggctggtgttggacacagtgaatgaggtgagccgtgctstcttagagctggtgccctggagagccagagaagggctggataaacttgtgtccgatgctaacgagcagtacaaactagtcagtgacactattggacaaag

SEQ ID NO: 37029 - DNA, 201 bp, Homo sapiens
tacctagaaaaataaaatataatgataatcattttcatttttggtttgtagtagcagaaccccctccccccgccaccttttgcaagtaacatctttgtgtgtgtgtgtgtgtgtgtgtgtgtgtgtgtgtgtgtgtgtgtgtgtgtgacagagtcttgctctgtcacccaggctggaatgcagtggctcaatctttgctga

SEQ ID NO: 37030 - DNA, 201 bp, Homo sapiens
ctctacagtgccgtcacgggagcaccatagcaaaggctgctgcctgaacattagcatctctgtcacttccttctgaacggcttcaagttcctcaccacacycaagtgcttcaagccggtgggcagaggtgacaacttaagtgtctctcccatctagcagactggcctccccgctgttcccactgtgtcctttaaaccaaca

SEQ ID NO: 37031 - DNA, 201 bp, Homo sapiens
attcagagaaggccactgactcccggtccaccccacgtgggtggccagcacagggtttattcttttcacttgtttttttgagagtcttgctccgtcacccrggctggaggcagtagtgcaatcacagctcactgcagcctcaacctcctgggatcaagtgatcctcccaccttggcctcccaaggagctgggatcacaggc

SEQ ID NO: 37032 - DNA, 201 bp, Homo sapiens
gagtgagcgtcttgacaggacccggcttagccacggggctgctcggggcgcgcttggaggcggggaccttcgccttccccatcctgctgccgtccagcgcmtgggccggcggccacccgagaccccggcctccccgggcccggcgccctggcagcacaagcgcctgcccaggccaggccgaaacacacccaccgcagggac

SEQ ID NO: 37033 - DNA, 201 bp, Homo sapiens
atgcaaatgaggaaggcacacttgcttagttctgattggttaatacttgctgagttcagattggtcgatgcaggtcacagtcgatgggttgattctggcgrcataaacaggaacagatagctgtgaaaccatcccagagttaagtgagagtgggggctttccaggaacgcagaatgtgtgtgtgaccctagtcagcaaatg

SEQ ID NO: 37034 - DNA, 201 bp, Homo sapiens
tgtctggggcttagtggcaacaggggcttagcctctgcagagacctagtgcgccgcctccttgccccagacctgcccgggcagagagccgtgtatgtgtcycagtgcacaggcgctgctgggccctgccaaaaggccacaagcccactgtcaccgttcacattgcttctcgcttcccggcccagccccgcccacacaggca

SEQ ID NO: 37035 - DNA, 201 bp, Homo sapiens
cacacatatttcttatttgcaaaattgggatttagtttggatccctgaaaaaaaggaaaattgtgattatgctgtgcattgctttgttacctgctatttctttttcttttcttttcttttttttttttgagatgaagtttcgctcttgttgcccaggctggagggcaatgacgtgatctcagctcattgcaacctccacct

SEQ ID NO: 37036 - DNA, 201 bp, Homo sapiens
agctgtggccttggcactgctagacgctcggtggcctgtgtgcagctcgaccaaggccaggacgtggaggtggacgaggcggcctgtgcggcgctggtgcrgcccgaggccagtgtcccctgtctcattgccgactgcacctaccgctggcatgttggcacctggatggaggtgagcacagcgggcactcggaatccctat

SEQ ID NO: 37037 - DNA, 201 bp, Homo sapiens
gtttgactggggcaagccgaggacctccccaagatccgggatggggatgagagatgcgaacgccggaagggaactggggggccgctgtgtgtgtagcaccyggtagggcagctgagctgggggcactgggcggtggggctagtgagagccgggctaggtcgctcgcctgcgtcctggactctcgagcctttcccgccttgg

SEQ ID NO: 37038 - DNA, 201 bp, Homo sapiens
atctggcaaggagctgacctgggtacccagggtggaggtggtcttggcaagcagtgggtccttgtagagtttctccagaggagcctgtacccctcaccccracagactcaggtgtgaggacaggggaacctgatactgtttgattaaaagaactttttttccaaaagacgagcaagacacctttagcaggtagaaaataac

SEQ ID NO: 37039 - DNA, 201 bp, Homo sapiens
cagggtggaggtggtcttggcaagcagtgggtccttgtagagtttctccagaggagcctgtacccctcaccccgacagactcaggtgtgaggacaggggawcctgatactgtttgattaaaagaactttttttccaaaagacgagcaagacacctttagcaggtagaaaataacttctgtagaaaattcaggtaaagaaag

SEQ ID NO: 37040 - DNA, 201 bp, Homo sapiens
ctgtcaggcagctgctgcaggaggggtgggcaaaggcatcttcctctgggaaggactggcacaagcacttggtccctgggttgtgtgcctgggaggccggratcagggctggccctctttctccctggcaaagcaaaacctcccttttactactatcaaggggaagtaacttgaaggtaggaacccagcttgtgagccccc

SEQ ID NO: 37041 - DNA, 201 bp, Homo sapiens
gctaccccatagacactgtgcccaaaagagcagctcaaaggcagggctgcagtcctagttaatacccacttctaattatatgcaaattaaggggccagatkatgcagaaatttctagaaaaagggcagtaacttctaggttttcgtcatggaaaaggggcagtaacttctgggttttgccatggcaatggcaaactggtat

SEQ ID NO: 37042 - DNA, 201 bp, Homo sapiens
ccacaaattatgtagctagtcctgggagggcccctgtgcccaaggactcctggctgagtgaggacaccaatcttaaacagttaccaaggacttccccatckattgtggctggagtcagactggagggcttcctggaggaagtggcctctaaactgaacccacagcagaagtggggctggtagggggaggggagatgaagga

SEQ ID NO: 37043 - DNA, 201 bp, Homo sapiens
cagcctggcctctactacagcgccaacgagcagtgccgcgtggccttcggccccaaggctgtcgcctgcaccttcgccagggagcacctggtgagtctgcyggcggtggcctgggattggctgtgaggtccctccgcatcacccagctcacgtccccccaaacgtgcatggtgagaacctgctgggtgccgtgctaggctg

SEQ ID NO: 37044 - DNA, 201 bp, Homo sapiens
tcccaggttcaagcgattctcctgcctcagtctcctgagtagctgggactacaggtgcccgccaccacgcccggctaattttttgtatttttagtagaggmggggtttcaccgtgttagccaggatggccttgatctcctgacctcgtgatccgcctgcctcggcctcccaaagtgctgggattacaggtgtcactgcgcc

SEQ ID NO: 37045 - DNA, 201 bp, Homo sapiens
catattccactgcagggatagaccacattttcatccagtcgtctgctgatggacatctgaggtgttttcaccttttggctcctgtgaacagagccgctgcsaatgtgcttgtacatgtttgaatccctgttttcaattcttttggcagtatgctgaagagcggagttactggatcgtatgggaattgtatgtttgactttt

SEQ ID NO: 37046 - DNA, 201 bp, Homo sapiens
cacaggcgtgagccaccgcgcccagcatgtttggcttttaaagaaactgccaaaccgttttccacagtgcctgaactgtttcacattcccaccagcattgygccagggttccagtttccccacatccgctgcagcacttgctgttttctgttgttgttttttcttttctcttcttttttttttttttttttttaatagaga

SEQ ID NO: 37047 - DNA, 201 bp, Homo sapiens
ctcgatctcctgacctcgtgatccgcccgccctggcctcacaaagtgctgggattacaggcatgagccacagcgccccgccaagtctttttttttaaattmttttgagacagggcctcgttctgttgcccagggtggagtgcagtagcacaatcatagctcactgttgcctcaacttcttgggcacaaacgatcctcccac

SEQ ID NO: 37048 - DNA, 201 bp, Homo sapiens
agccagccctggagaccctcggacagggcagagtcataggggggttggcctactatccctccagcactgggcaaagtggttcaggctctggcatcccacaraccatggatgacatagtggccaggcctcgctggtagatcaggcactgacatcccatctctgagtctcaatttcccatctgtgaaatggagataatagcag

SEQ ID NO: 37049 - DNA, 201 bp, Homo sapiens
tcaccttttggctcctgtgaacagagccgctgcgaatgtgcttgtacatgtttgaatccctgttttcaattcttttggcagtatgctgaagagcggagttrctggatcgtatgggaattgtatgtttgacttttttttttcttttttttttttttgagacagagtcttgctctgtcgccaggctggagtgcagtggtgcaa

SEQ ID NO: 37050 - DNA, 201 bp, Homo sapiens
attacaacattaattttgacctggaagttcattttttcatttttttttttttttgagacagagtctcactctgtcacccaggctggagtgcagtggcacartcttggcttactgcaacctccgcctcccaggttcaagtgattcccgggcctacgcctcccgagtagctgggactacaggcatgtgccaccatgcccagct

SEQ ID NO: 37051 - DNA, 201 bp, Homo sapiens
agtctgtaaggaatagggctacctggcaggctgtgctagttgtgggaggtgaagtttaagcaccatgcaggcagggtgcagtgtggggaggcctgggggamagaggaggcagcatttgagcagaacctaaagctgtgagcaccagcattctgatgtggaagacgggagggatggaggtctccacagggacacacacagcca

SEQ ID NO: 37052 - DNA, 201 bp, Homo sapiens
tgtctttgaacttgtttcccacggtggtggtgtctgaatttgcactttccatctgaagaaccaggggctgccccaggcgggattttcctcgggacgccagraagaaggcaaaggcaagctcccagggccagggtgatggttaggcaagcgtaacctgaacatgggccacagggcatctgccaggataaacttgtttcctgt

SEQ ID NO: 37053 - DNA, 201 bp, Homo sapiens
agaaacagggctatggcaggaggacagtgtgggtcaagggaaggttgttgattgtaatcaagagacaccagagtgtctgggcttggtggctcatgcctgtratcccagcactttgggaggccgaggcagtcagctcacctgaggtcaggagtttgagaccagcttggccaacatggcgaaaccccacctctactaaaaata

SEQ ID NO: 37054 - DNA, 201 bp, Homo sapiens
acacatatttcttatttgcaaaattgggatttagtttggatccctgaaaaaaaggaaaattgtgattatgctgtgcattgctttgttacctgctatttctttttcttttcttttcttttttttttttgagatgaagtttcgctcttgttgcccaggctggagggcaatgacgtgatctcagctcattgcaacctccacctc

SEQ ID NO: 37055 - DNA, 201 bp, Homo sapiens
cacatatttcttatttgcaaaattgggatttagtttggatccctgaaaaaaaggaaaattgtgattatgctgtgcattgctttgttacctgctatttctttttcttttcttttcttttttttttttgagatgaagtttcgctcttgttgcccaggctggagggcaatgacgtgatctcagctcattgcaacctccacctcc

SEQ ID NO: 37056 - DNA, 201 bp, Homo sapiens
acatatttcttatttgcaaaattgggatttagtttggatccctgaaaaaaaggaaaattgtgattatgctgtgcattgctttgttacctgctatttctttttcttttcttttcttttttttttttgagatgaagtttcgctcttgttgcccaggctggagggcaatgacgtgatctcagctcattgcaacctccacctcct

SEQ ID NO: 37057 - DNA, 201 bp, Homo sapiens
ccgaggctggagtgcagtggcatgatcttggctcattgtaaccttcgcctccggggctcaagtgattctcgtgcttcagcctcccgagtagctaggactayaggcgtctgccaccatgcctggctaattttttgtttagtagagatggggtttcaccatgttggccaggctggtcccaaactcttgacctcaggtgatctg

SEQ ID NO: 37058 - DNA, 201 bp, Homo sapiens
atatttcttatttgcaaaattgggatttagtttggatccctgaaaaaaaggaaaattgtgattatgctgtgcattgctttgttacctgctatttctttttcttttcttttcttttttttttttgagatgaagtttcgctcttgttgcccaggctggagggcaatgacgtgatctcagctcattgcaacctccacctcctgg

SEQ ID NO: 37059 - DNA, 201 bp, Homo sapiens
ctataaatacaagtctttttttttcctttttttttttttttgagacagagtctccctctctgctcactgcaggctccgcctgccagattcacaccattctsctgcctcagcctcccgagtagctgggactacaggcgcccgccaccacgcctggctaattttttgtatttttagtagagacggggtttcactgtgttagcc

SEQ ID NO: 37060 - DNA, 201 bp, Homo sapiens
tgagccaagatcgcgccattgccctccagcctgggcaacaagagcgaaactgtctcaaaaaaaaacaagaaagaaaaagaaattaaaacatttgcctcttragcttcaagtcagtgacaagttaagaaggaaaaaaagaaaaaagacacaaaaaacacatttccatgggcccccaaaagtgtgacaggacctggtcatggt

SEQ ID NO: 37061 - DNA, 201 bp, Homo sapiens
gaggccaaggcaggtggatcacctgaggtcaggggttcaagaccagcctggccaacatggtgaaatctcgtctctacagaaaatacaaaaattagccgggygtggtggtgggcgcctgtagtcccagctactcgggaagctgaggcaggagaatcacttgaacccaggaggtagagcttgcagtgagccgagattgggcca

SEQ ID NO: 37062 - DNA, 201 bp, Homo sapiens
ggatggtctggatctcctgacctcaggtgatctgcccgccttggcctcccaaactgttgggattacaggcatgagccaccgctcccggcctatgtttgactttttttttttcttatttttttctttctttctttatttttttttttttagagatggagtctcgctctgtcgcccaagctggagtgcggtggcgcgatctcg

SEQ ID NO: 37063 - DNA, 201 bp, Homo sapiens
ccgccttggcctcccaaactgttgggattacaggcatgagccaccgctcccggcctatgtttgactttttttttttcttatttttttctttctttctttatttttttttttttagagatggagtctcgctctgtcgcccaagctggagtgcggtggcgcgatctcggctcactctaagctccgcctcccaggttcacccca

SEQ ID NO: 37064 - DNA, 201 bp, Homo sapiens
gcggcagtgcaacaaccccaggtaccgcagggagggtgcttttctgtcagggagtgtggccataccatagtccctagttgaaggcagtggtcaccctgctstctcaccctcctgtctgctgggcattttcagacctgcctttggggggcgtgcatgtgttggtgctgacctccaggccgagatgtgcaacactcaggtagg

SEQ ID NO: 37065 - DNA, 201 bp, Homo sapiens
gattcagggagataatcggaaaatgccaagtgtgttccttggttcatgatactttttttgtgagacagagtcttgctctgtcgcccaggctggagtgcagkggcgtaatctcagctcactgtaacctccgcctctgggattcaagggattcttgcccctcagcctctcgaatagctgggactacaggcttgcactaccatg

SEQ ID NO: 37066 - DNA, 201 bp, Homo sapiens
ggctaggctggtttcaaactcctgacgtcaggtgatccgcctgcctcggcttcccaaagttctgggattacaggcatgaaccattgcgcccagccttggtycctaattcaataccattaattattagattagattaggatcgtgattaggattattgccttaggaggtgggatgtggggaagatagaaacccttgccccag

SEQ ID NO: 37067 - DNA, 201 bp, Homo sapiens
gctccgcctgcctccctgctgactcctgcccgtgtctcttgtttcaagcttgcgcgatctctggcctcttcaactgcatcaccatccaccctctgaacatygcggccggcgtgtggatgatgtgagtaatgcatggccgtcccaccccgggggtcttgctggtcgggaatctgctgggcacctcccgggacagaggagtgg

SEQ ID NO: 37068 - DNA, 201 bp, Homo sapiens
cgtgtgtggacattggcgatggccctggggcctacctgtcctatcggaaggctcctgggggcaggttggtgggtgctggccctgatggagctgcagtgccstctgcaggggagtggtgctggggaaaaggatctggacttggagtcagcctgggttaagggctgcagtgtgaccttgggcaagtcactgagccctctaagc

SEQ ID NO: 37069 - DNA, 201 bp, Homo sapiens
gacagaggagtggcaggggccgtgggagtgggcatccttgtggttgccatggctactggctccagcctgggtgcctcgggcatgtgagtttctggccacarcatgcggcttcttccccttcatacccccaccatgtttagtttcctaatgagaggtcaaggcccagggaatgcccaccccggccttcatccggtgcagggg

SEQ ID NO: 37070 - DNA, 201 bp, Homo sapiens
acccatcgccccaaaaggagacaagacgcatcaaaaccagctgcagtgagtggtctcagacagaaaagggaacaaaagggagaaaacgaatccagttactrctttcccttctaagttcctgagctgtggatgacataccctgcttgaggttctcaggccgaatcccactgaccgctgtcctatagtccgtcacgggctcgg

SEQ ID NO: 37071 - DNA, 201 bp, Homo sapiens
ctttgggaggctgaggcgggtggatcacctgtagtcgggagatcacctacagcctggccagtatggtgaaaccccatctctactaaaaatacaaaaattasctgggcatgatggcgggcgcctgtagtcctagctactcaggaggctgaggcaggagaattgcttgaacccaggaggcagaggttgcagtgagccgagatc

SEQ ID NO: 37072 - DNA, 201 bp, Homo sapiens
attgccatccatgccctggccaccaacatgggcgctgggaccgagggagccaatgccagctacatcttggtgaggcccagcatggggacttgtgctgtgaytctggacagctttccctagggcgtgcagggctaggggacccccttcagtttatttcagactaaaaccctcaaaatcattagtgaaagaatgggagaagat

SEQ ID NO: 37073 - DNA, 201 bp, Homo sapiens
attatgcagaaatttctagaaaaagggcagtaacttctaggttttcgtcatggaaaaggggcagtaacttctgggttttgccatggcaatggcaaactggyatggcacactggtgggcgtgtcttatggaaaggggcttcccacccctccctgttttagctagtcctctggtccagtgtccaagcggggcctccagagtgg

SEQ ID NO: 37074 - DNA, 201 bp, Homo sapiens
aaaaaaaaaaaaagtatggacgttgtgcattctgtggcagctaccctcttctctcctgctcaagaaatcccactgagagggacacaagtgaatgagagggwtggtagttacatttggaaaatctttgactttggtgtatatatgaggtcaaaaaccatttgcaaatgccagtgcttctatggagagcagagacttgagccc

SEQ ID NO: 37075 - DNA, 201 bp, Homo sapiens
atttttcccgaccagctaagatcagctccctttgtctgtggtgtggtggctgtgaggtccacgcatctctccttcttttcttctttctagaatatgtcacrtttctgacagttacccccaacctgaccagtgtctacattgccaaccacaggcctctcttcacacacttgggtgagttgactggaggactcccacccagtt

SEQ ID NO: 37076 - DNA, 201 bp, Homo sapiens
tgtgtggtcctggttcttagcaggaccctgggaggtgcttgcctcattcacctcagggagaggaaagcatcctcttccttgaagaagccccgccctccacrgctaagcatccccagcagaccccactccctgagaccagcgtacccgccgaaggcctgctctttcacgaggctgaggctgacgctgccctcgctctgaccc

SEQ ID NO: 37077 - DNA, 201 bp, Homo sapiens
tttctggagtgtgtctgcacctaacctttgaagccttggttgccggcacttgccatggggtccctgagccctgagcctgttgagttctgtgcgtgagtgcrcttggtcatagcactcaccaggttgtggaaagaggcctagagcctccgctgtggggaagcctctagctcagatgcctgtggctccttagaggagggctgg

SEQ ID NO: 37078 - DNA, 201 bp, Homo sapiens
ctgcctcagcctcctgggtagctggaactacaggtgcacgccaccatgcccagctaattttttttttttttttgagacgaagttatgctcttgtcgcccargctggagtgcaatggcgcaatctcggctcaccgcaacctccacctcccgggttcaagtgattcttctgcctcagcctcccgagtagctgggattacaggc

SEQ ID NO: 37079 - DNA, 201 bp, Homo sapiens
tagctcagatgcctgtggctccttagaggagggctggggaccccgggaaggagagtcactgacatgtgcctgtgaggaggatgggtgctcagctccacacrgctaacagggctggttccccgacagcggtgaggatcggagggcgctatgtcgtggctgggaagatgagcatctcccctaacaccacctacccctccctcc

SEQ ID NO: 37080 - DNA, 201 bp, Homo sapiens
gctccacacggctaacagggctggttccccgacagcggtgaggatcggagggcgctatgtcgtggctgggaagatgagcatctcccctaacaccacctacscctccctcctggaggatggtcgtgtcgagtacagagtggccctcaccgaggaccggctgccccgcctggaggagatccgcatctggggacccctccagga

SEQ ID NO: 37081 - DNA, 201 bp, Homo sapiens
cgaccctacgggcctcagctctggctccagaagcactttctgtgctggccctgccctagcccttcttgggctccttagcccagcctaaggtgggcctgcctcctccactgcactttatcctctacccagccagcttagggaaccttctctgtgctgcccaaataccctatcatgtaacccaccaatgacttggtaattacc

SEQ ID NO: 37082 - DNA, 201 bp, Homo sapiens
gctggctagatttctggcaggaagccactgggcggaagtttgctgagggtcaggtggtgtcagggcacaggtggcccctggggccgcggggcagtgagctsagggcccggcctctccctgggtcctctgtccgctctcatatctcccccgttgctgctgccttagccgcctgtcaccggccttcctccccttctccgcacg

SEQ ID NO: 37083 - DNA, 201 bp, Homo sapiens
cccacagagcccctgaagcgtcccgcctccctccctgagtgccactttgccctccagagcgcatctctgcagggagaacctccccactaggaatacagtgygctgctgcatgcctgcaaaggaattttttaaatattatttttatttttttagacagagtctctccctgtcacccagactggagtgcagtggtgctatctc

SEQ ID NO: 37084 - DNA, 201 bp, Homo sapiens
ttaatagagatggggttttgtcatgttggccaggctggtcttgaactccgaccccaggtgatccgcccaccttagcctcccaaagtgctgggattacacgygtgagccatggcgcccggcctgttttctgttttttgattttggccatctcggtggtatgaaatggtagaaagattctttttacattgagttaaattctat

SEQ ID NO: 37085 - DNA, 201 bp, Homo sapiens
cttactcagttctgtgcctctcaaagtgaggtacctctgcctttcctgggagttcctggggctctgttgggtctacagatgaagcttcaggagaaacttgyggcattgccctgagttgtcagttgcatctgcagatttttgggggcatggttatgtgaacatcaaaatgctgtattacagggtagaatgcaaaaatgcagg

SEQ ID NO: 37086 - DNA, 201 bp, Homo sapiens
cggaaaatgccaagtgtgttccttggttcatgatactttttttgtgagacagagtcttgctctgtcgcccaggctggagtgcaggggcgtaatctcagctyactgtaacctccgcctctgggattcaagggattcttgcccctcagcctctcgaatagctgggactacaggcttgcactaccatgccggctaatttttttg

SEQ ID NO: 37087 - DNA, 201 bp, Homo sapiens
aagccgcggaaggcacgggtccaagaggcagcgctgcagggtcatgggggagcacagtattgcgatgaagatcccagctcccttgcaggctgcctgggttygtgtctgggctctgaagaatgcgggccataattagttattgattgattacagatcaacatgggcagccttcccttgcccaagggaagggaactcggcctt

SEQ ID NO: 37088 - DNA, 201 bp, Homo sapiens
gagggatggtagttacatttggaaaatctttgactttggtgtatatatgaggtcaaaaaccatttgcaaatgccagtgcttctatggagagcagagacttsagccctgcctccctctggcttgccccactgtgctggagaaccttggacccggtcccttctcccagccagggcagagccttggcaggtggtcctccagcct

SEQ ID NO: 37089 - DNA, 201 bp, Homo sapiens
tgagtgggagttgagagtttttcctggggtttgagtgcaaagacatgattgactaattggccaggtggatactctcagtctcttggtgacccagcccctaycctaaatcacatagttggtctttctggtacagccagcccctgccctaaaggaggacacttctgcctggtgtgacccgtgtttcctcttggaagccaacag

SEQ ID NO: 37090 - DNA, 201 bp, Homo sapiens
agacctagcctctctctggggtcttctcttcctgcaggtggaaagtcatgtcccttggcccatgttcggccagctgtggccttggcactgctagacgctcrgtggcctgtgtgcagctcgaccaaggccaggacgtggaggtggacgaggcggcctgtgcggcgctggtgcggcccgaggccagtgtcccctgtctcattg

SEQ ID NO: 37091 - DNA, 201 bp, Homo sapiens
gcggtcacttacaggggacccactatgtgttgggccctgtgctaggcaaaatgtagctagctcctccaggggcttagggtcccacaaatatccaaatgtgyctgtgcccagagcccgtgggagaaggccctgcagttctgggatcaggtaaggttggagggcccaatgcaggggtccagggctccctgggaaagagtgatg

SEQ ID NO: 37092 - DNA, 201 bp, Homo sapiens
tgtctctggggagacctagcctctctctggggtcttctcttcctgcaggtggaaagtcatgtcccttggcccatgttcggccagctgtggccttggcactrctagacgctcggtggcctgtgtgcagctcgaccaaggccaggacgtggaggtggacgaggcggcctgtgcggcgctggtgcggcccgaggccagtgtccc

SEQ ID NO: 37093 - DNA, 201 bp, Homo sapiens
tactttcccttctaagttcctgagctgtggatgacataccctgcttgaggttctcaggccgaatcccactgaccgctgtcctatagtccgtcacgggctcrgttggtttgacgtacttgtcataaacgcacttcccatactggttcacgatggacacacgggcggccatgctctcctcccccttagggcccacgcccacca

SEQ ID NO: 37094 - DNA, 201 bp, Homo sapiens
tgagaaaccgcaccgtaaccaacacaggcttgcggcactggccagatgtgggcatcgagggggcaggtgcggaatgtcacctcgccctgggctctggcctycaggctggcctctttcttgggctggtcttgggcacaggacccagttaccctcctgaagagccttaggcccaggaacctgctgaagttcttcctagtgctc

SEQ ID NO: 37095 - DNA, 201 bp, Homo sapiens
ctttcccttctaagttcctgagctgtggatgacataccctgcttgaggttctcaggccgaatcccactgaccgctgtcctatagtccgtcacgggctcggytggtttgacgtacttgtcataaacgcacttcccatactggttcacgatggacacacgggcggccatgctctcctcccccttagggcccacgcccaccatc

SEQ ID NO: 37096 - DNA, 201 bp, Homo sapiens
tccttagcccagcctaaggtgggcctgcctcctccactgcactttatcctctacccagccagcttagggaaccttctctgtgctgcccaaataccctatcrtgtaacccaccaatgacttggtaattacctccccgagccctctatcccaacccactgagagctccttgcagctcagccagtgtcctgtgcactgtgctat

SEQ ID NO: 37097 - DNA, 201 bp, Homo sapiens
gtttgactttttttttttcttatttttttctttctttctttatttttttttttttagagatggagtctcgctctgtcgcccaagctggagtgcggtggcgygatctcggctcactctaagctccgcctcccaggttcaccccattctcctgcctcagcttcccgaatagctgggactacagacgcccgccaccacgcccgg

SEQ ID NO: 37098 - DNA, 201 bp, Homo sapiens
cgccgctggcactccagcctgggctacagagcgagactccgtctcaaaaacaaaacaacaaaacaaaacaagacggggtggggggctcagtggcccaagarccagtctgtaaggaatagggctacctggcaggctgtgctagttgtgggaggtgaagtttaagcaccatgcaggcagggtgcagtgtggggaggcctgggg

SEQ ID NO: 37099 - DNA, 201 bp, Homo sapiens
tcggctcactctaagctccgcctcccaggttcaccccattctcctgcctcagcttcccgaatagctgggactacagacgcccgccaccacgcccggctaatttttttttgtatttttagtagaggcggggtttcaccatgttagccgggatggtcttgatctcctgacctcgtgatctgcctgcctcggcctcccaaaggg

SEQ ID NO: 37100 - DNA, 201 bp, Homo sapiens
ttttctatatcatacagaaacgtccagaaaagaatgtaacagacatgtatgttccagcactccagtttaatagatagcatcctactgccatgtttccttcmtgtccacttacttttatttatttaatttatttattttgagacggagtctcgctttgttgcccaggcagtgatgcaatcttggctcactgcaacctccgcc

SEQ ID NO: 37101 - DNA, 201 bp, Homo sapiens
ctgctgggactgtggtgcctcagtaatggtcactcactgtagccgtgctgcaaaaaaaacacagacattggccgggcgctgtgctcacgcctgtactcccrgcactttgggaggctgaggcgggtggatcacctgtagtcgggagatcacctacagcctggccagtatggtgaaaccccatctctactaaaaatacaaaaa

SEQ ID NO: 37102 - DNA, 201 bp, Homo sapiens
gtctgctcacctcagcctcctaaagtgctgagctaccgtgcctggccagggataggttctgtctctgcaccctgggtgcaggtggggtgcctgactgttgmgcagcgagtgcttgttgaatgggaacctgctggctgatgaatggggaacccggtgcttcagggagagaccctgagcttcacttctctgtggggctcctct

SEQ ID NO: 37103 - DNA, 201 bp, Homo sapiens
gctctttgggccctggggtgaaatcgtgagcccctcgctgagtccagccacgagtaatgcagggggctgccggctcttcattaatgtggctccgcacgcayggattgccatccatgccctggccaccaacatgggcgctgggaccgagggagccaatgccagctacatcttggtgaggcccagcatggggacttgtgctgt

SEQ ID NO: 37104 - DNA, 201 bp, Homo sapiens
ggctgaggcaggagaattgcttgaacccaggaggcagaggttgcagtgagccgagatccctctgcactccagcccgggcaacagagtgagacactgtctcaaaaaaaaaaaaaaaaaaagtatggacgttgtgcattctgtggcagctaccctcttctctcctgctcaagaaatcccactgagagggacacaagtgaatga

SEQ ID NO: 37105 - DNA, 201 bp, Homo sapiens
cgtgctccgtctcctgcgggcgaggtgagggcccccgggatgctcctggggaccagcactcatggtaactctcctgtccacttgcatcttgcctcgttctraaaagcatttgaggtggattgcagaaaatccagactatatgggaacacgtggtaatacacaaggagactaagcatagtagctgacagccacttcaaatgt

SEQ ID NO: 37106 - DNA, 201 bp, Homo sapiens
gaagaccagcctgggcaacaaagtgaaaccccatctgtattagttcattgtgcactgctataaaggaatacctgtgtttggtaatttataaagaaaaaacrtttatgtagctcatggttttgcaggttgtacaagaagcatggtgccagcatctgcttctggtgaggccgaaggaagcttcccatcatggtgtaaggtgaa

SEQ ID NO: 37107 - DNA, 201 bp, Homo sapiens
ggaacacgtggtaatacacaaggagactaagcatagtagctgacagccacttcaaatgtgggtgttgattggctgaaaggtaggaaaagacaataacgccyggcagtgtggcacgagagccattccttatggtcctagcagagcggccggggggtccccaattgatgacccgagcagagaaaccttagctttaagatacac

SEQ ID NO: 37108 - DNA, 201 bp, Homo sapiens
ggccacccgagaccccggcctccccgggcccggcgccctggcagcacaagcgcctgcccaggccaggccgaaacacacccaccgcagggaccccgtccagkaaaagactccggaagagaccccgcacgcgttgcgcatacctcagcacgcacgctccagtccccggaagcgctcgtctctccacaaccggctggaaaccgg

SEQ ID NO: 37109 - DNA, 201 bp, Homo sapiens
tgagaagacacaccatgttcttaaacgaaaaccctgaccacttgctcagtaaaatgtcagcctgtttaaaaccgagaccaaaaagagatttctttttctcycttttcttttttgagacaaaaaagaaaacctctgtcaccaggttggagtgtagtggcacaatcttagctcactacaacctccaccacctgggctgaagcc

SEQ ID NO: 37110 - DNA, 201 bp, Homo sapiens
ctggctaattttttgtattttattttatcagagagggggtttcgccatgatggccacgctggtctcaaactcctgacctcaggtgatccacccgccttggcctcccaaagtgctgggattacaggcatgagccactgagcctatttcttttgaggatattcctaaaagagagacttgagaaaactggccctaataacatct

SEQ ID NO: 37111 - DNA, 201 bp, Homo sapiens
cttgctcagtaaaatgtcagcctgtttaaaaccgagaccaaaaagagatttctttttctctcttttcttttttgagacaaaaaagaaaacctctgtcaccrggttggagtgtagtggcacaatcttagctcactacaacctccaccacctgggctgaagccatcctcccccctcagcctcctgaatagctactataccctg

SEQ ID NO: 37112 - DNA, 201 bp, Homo sapiens
ggatattcctaaaagagagacttgagaaaactggccctaataacatctttatgatagacacaatcagagattttcatattgtgatttttttttcttttttytttttttgagatggagtctcgctctgtcacccaggctggagtccagtggcgcagtcttggctcactgcaacctctgcctcctgggttcaagtgattctcc

SEQ ID NO: 37113 - DNA, 201 bp, Homo sapiens
cccaggcagcagtgagctatgatcctaacaggaggtagctccaagggagctccaagggatgtggtaagaatgtatgagtgacgcacgtggaagagtgtctrggagagagcaggcaacctctacagaagtgcaggtcactagggagacagcaggtacaacacagccttaaaagcatggactccagagtcagccacctggttc

SEQ ID NO: 37114 - DNA, 201 bp, Homo sapiens
cctcccatgttcaaacgattctcatgcctcagcctcctgagcagctgggactccagctatgtgccaccacacctggctaattttttgtattttattttatyagagagggggtttcgccatgatggccacgctggtctcaaactcctgacctcaggtgatccacccgccttggcctcccaaagtgctgggattacaggcatg

SEQ ID NO: 37115 - DNA, 201 bp, Homo sapiens
gcaggagaatcacctgaaccttgggaggtcaaggctgcagtgagcagagatcacaccaccactgcatgccagcctgggcaacagcatgagaccctgtctcaaaaaaaaaaaaaaaaaaaaaaagattttacttaaatttaaaccctgtactaatctgtgatttatttggagtatgttgcaaagtagggaccaaaggatttt

SEQ ID NO: 37116 - DNA, 201 bp, Homo sapiens
tctcctggatgggacagaatgtggcgtggagaaggtcagagccaagagtgaatgagtgggctcctgtgagcacgtgcacgtgggtgcctccagccaggccrccctattcctaggtcaggaggcaggaccagtatggggcagagagtcttggagttggccttggggactgtcctttgggttggtggtctgacctctttcctt

SEQ ID NO: 37117 - DNA, 201 bp, Homo sapiens
agggcccacgcccaccatctcacagtccaaggctaaggctcttgtcaggctgaagggtaaccaaaggctgtagtttaataaacacggcaggccacagggcwccaggtcagagccccagggatccatggactaagtgtcagcagagaaaagctctctgcccctcactcatttgcacccacgtgacaagctctgtgtggtcct

SEQ ID NO: 37118 - DNA, 201 bp, Homo sapiens
ctgggagccggcgggaggtctgccaggctgtcccgtgccctgctcggtgagtgaggggagcaagactgtgtgctggccttctccctgtaagtgggagaccygagccttggctccatgcccggtgacctgcggaggggggcaggtgctgctggctgtgcactgtgtgaggctggaccatggccgccccatccccctgcctca

SEQ ID NO: 37119 - DNA, 201 bp, Homo sapiens
atctggacttggagtcagcctgggttaagggctgcagtgtgaccttgggcaagtcactgagccctctaagcttgcttcctgtgtagatggtggggtgctayagaagtgttgctggttttgtggatcccagaatctcagagctggcagggctgcagagtcattgaggccagcaccctccagtgacacgggccctctgtcctt

SEQ ID NO: 37120 - DNA, 201 bp, Homo sapiens
ctgatcctcctaccccagtctcctgagtagctgggacaacaggcacacgccaccacacctggctaattttaaaattttttatagagatggggtctcccctrtgttactcaggctggtctctaactcccggcctcaagcaatcctccagcctcagcctcccaaaaagctgcgattacaggcataagccactgtgtctggtcc

SEQ ID NO: 37121 - DNA, 201 bp, Homo sapiens
ctcgatgcaacgcgtgtaaagtacattgcacaggatctgggatgctgtgggtgcacatggttgctggtgcgtttcttcatcgcctgctctttatggagcamctaggccccggggccgtcctggagctaggggacacagcagagaacaaggcagacaaatgtccctgacctcctggagcaaatgcagggggaaagggggaca

SEQ ID NO: 37122 - DNA, 201 bp, Homo sapiens
aaggtgaccccagggcaggcacgtgccttggcaccacccaagtgactgttttctctcaccgaggtttgacctggagttgcctgatggtaaccggcaggtgyggggcgtcacccagctgggcggtgcctgctccccaacctggagctgcctcattaccgaggacactggcttcgacctgggagtcaccattgcccatgagat

SEQ ID NO: 37123 - DNA, 201 bp, Homo sapiens
catggactccagagtcagccacctggttcccagccgcaatcttagatgatctatttaaacttttccagcctatttcctcatctgtacaatagcgatgatgraagtgtccacctcacagtcttattgtggggattgcaacacgcatggcatagagcacatggcagagtgcacatttttaggagctcaattagtatttacttc

SEQ ID NO: 37124 - DNA, 201 bp, Homo sapiens
gctgactcgccgacccccgtcccgcccccacccccgcccccgccctgccggccgccttagcgcaactccccgccccccgaccagcttcggcctggagcacsacggcgcgcccggcagcggctgcggccccagcggacacgtgatggcttcggaacggcgccgccccgcgccggcctcgcctggtccccctgcagccgccgg

SEQ ID NO: 37125 - DNA, 201 bp, Homo sapiens
caattcgaactttttccaatcttaggtatctactttagagtcttctccaatgtccaaaaggctagggggttggaggtggggactctggaaaagcagccccyatttcctcgggtaccaataaataaaacatgcaggctgaccggcgtttttttcttataagctgtccagacctggcttgaaaacccatcccatggcaaggca

SEQ ID NO: 37126 - DNA, 201 bp, Homo sapiens; identical to SEQ ID NO: 8208

SEQ ID NO: 37127 - DNA, 201 bp, Homo sapiens
ccccaccgccatccccctcctctgcctcctcctggccaggcctgcgagaagacccagctggagttcatgtcgcaacagtgcgccaggaccgacggccagcygctgcgctcctcccctggcggcgcctccttctaccactggggtgctgctgtaccacacagccaaggtggggcctgcggagtgtggggttgggggaggagc

SEQ ID NO: 37128 - DNA, 201 bp, Homo sapiens
cactcagcatgatgtcctcacagttcatccatgttgtagcatgtgtgagtgtttccttcttaaggctgaaaaagattccattgtgagtgtatcctttacakgtttatccatttattcatcagtggacacttggcttccttccacactttggctattgtgaataatgcttctgtgaacatgggtgtgcaaatatctgtttga

SEQ ID NO: 37129 - DNA, 201 bp, Homo sapiens
cagtgaccctcagggaacccactggacaaggcctgaagctctttgtctgcaggtttacaggcggtatggcgaggagtatggcaacctcacccgcccagacwtcaccttcacctacttccagcctaagccacggcaggcctgggtgtgggccgctgtgcgtgggccctgctcggtgagctgtggggcaggtgagacctgggg

SEQ ID NO: 37130 - DNA, 201 bp, Homo sapiens
cggctgccctgcaagtaacatcttgtagggaatccaagtgtgtcacacacacatggaaacaaggcactgatatgaatttcaactccagaaggaaatttatygcactgacttaagctgatgcccaacagtcagagacaataaaaacaaaatcttgaaatcaaggaagtaggagaaaaacagtcaacagttaaccagcaacca

SEQ ID NO: 37131 - DNA, 201 bp, Homo sapiens
tccctcccagggctgcgctgggtaaactacagctgcctggaccaggccaggaaggagttggtggagactgtccagtgccaagggagccagcagccaccagygtggccagaggcctgcgtgctcgaaccctgccctccctagtgagtgtggtgctgtctgcgcagctccaagggggagagagggttccgctggggctgctgg

SEQ ID NO: 37132 - DNA, 201 bp, Homo sapiens
tctgcaggggagaaggctccctccccatggggcagcatcaggacgggggctcaagctgcacacgtgtggacccctgcggcagggtcgtgctccgtctcctrcgggcgaggtgagggcccccgggatgctcctggggaccagcactcatggtaactctcctgtccacttgcatcttgcctcgttctaaaaagcatttgaggt

SEQ ID NO: 37133 - DNA, 201 bp, Homo sapiens
gtggctgcactttccatcttgcctggccacggaagctgtctaggcaactgtccgagtacacgtgggtggagaggggcctgcgtggggcagtactgtctctrgggagacctagcctctctctggggtcttctcttcctgcaggtggaaagtcatgtcccttggcccatgttcggccagctgtggccttggcactgctagacg

SEQ ID NO: 37134 - DNA, 201 bp, Homo sapiens
tctgaaactcctgggctcaagtgatctgcctgcctcaggctcccaaagttttgggtttacaggcatgagctaccgtgcctggccagtgattgcttgctgarcgaaagattatagggatgcaagaagaagttggaaggcttcccaggggaggtggccatgacagtgaccctcagggaacccactggacaaggcctgaagctc

SEQ ID NO: 37135 - DNA, 201 bp, Homo sapiens
aggggagaaggctccctccccatggggcagcatcaggacgggggctcaagctgcacacgtgtggacccctgcggcagggtcgtgctccgtctcctgcgggygaggtgagggcccccgggatgctcctggggaccagcactcatggtaactctcctgtccacttgcatcttgcctcgttctaaaaagcatttgaggtggatt

SEQ ID NO: 37136 - DNA, 201 bp, Homo sapiens
gggctcagtggctgcactttccatcttgcctggccacggaagctgtctaggcaactgtccgagtacacgtgggtggagaggggcctgcgtggggcagtacygtctctggggagacctagcctctctctggggtcttctcttcctgcaggtggaaagtcatgtcccttggcccatgttcggccagctgtggccttggcactg

SEQ ID NO: 37137 - DNA, 201 bp, Homo sapiens
ggtgcaggtggggtgcctgactgttgagcagcgagtgcttgttgaatgggaacctgctggctgatgaatggggaacccggtgcttcagggagagaccctgwgcttcacttctctgtggggctcctctttgggctcctggatgttggggagcaggtccccttcctccctgcccctagcagctgggctataccttcccctggg

SEQ ID NO: 37138 - DNA, 201 bp, Homo sapiens
agacggagtctcgctttgttgcccaggcagtgatgcaatcttggctcactgcaacctccgcctcccgggttcaagccattctcctgtctcagcctcccaartagctgggaatacaggcacccacaaccacacccagctaacttttgtatttttagtagagacagggtttcaccatattggtcaggccgatcttgaactcct

SEQ ID NO: 37139 - DNA, 201 bp, Homo sapiens
gggttcccaggccctggggctgtttggggtccctgactccagtttgctccaggtggcagtacaagctggcggcctgcagcgtgagctgtgggagaggggtygtgcggaggatcctgtattgtgcccgggcccatggggaggacgatggtgaggagatcctgttggacacccagtgccaggggctgcctcgcccggaacccc

SEQ ID NO: 37140 - DNA, 201 bp, Homo sapiens
tattccccacagctggatgccacctctgcaggggagaaggctccctccccatggggcagcatcaggacgggggctcaagctgcacacgtgtggacccctgyggcagggtcgtgctccgtctcctgcgggcgaggtgagggcccccgggatgctcctggggaccagcactcatggtaactctcctgtccacttgcatcttgc

SEQ ID NO: 37141 - DNA, 201 bp, Homo sapiens
acttgctaaagttcttcctccccagcgtgggcttcccctgggtgtccccgggcctggggccggtggcatcaggtgtgtgggcagctctccgtgactgtttygggactgcgtggctccagctctctgcctccctggtggggcagccttcctggtgctggtgccactgacggcttttggtggccatggcgataatactaacag

SEQ ID NO: 37142 - DNA, 201 bp, Homo sapiens
ccccgccaccttttgcaagtaacatctttgtgtgtgtgtgtgtgtgtgtgtgtgtgtgtgtgtgtgtgtgtgtgtgtgtgacagagtcttgctctgtcacscaggctggaatgcagtggctcaatctttgctgactgcaacctccgaccccaggtttcaagtgattctcctgcctcagcctcccgagtagctgggattaca

SEQ ID NO: 37143 - DNA, 201 bp, Homo sapiens
gaggatggcgcattagccagctccctgcgaagccccacccgtgtgtcctggtgtgaggctctgaccgctaaggtgtctgcgcgcctccaggccccgccccstatgctaataagcgcccgcctcctttgggagcaagtcgccgcaaactgcgagcccccgccccctacgctaatgacgcccgcccccctcgggcacacctct

SEQ ID NO: 37144 - DNA, 201 bp, Homo sapiens
ccctgccctgccccgccccgccccggcggccccaggggaaaggacccgctgggggtcgggggtctgccgggcgcctcccggggcggaggaatggcggggcygccgggagccggcgtcctggggttgccatggttacccgctcgggcctgggcgccttggtaccccgggctgggctgggctggcgcttctgggaacattccc

SEQ ID NO: 37145 - DNA, 201 bp, Homo sapiens
tcggctcaccacaatctccacctcccgggttcaagcgattctcctgcctcagcctcctgggtagctggaactacaggtgcacgccaccatgcccagctaattttttttttttttttgagacgaagttatgctcttgtcgcccaggctggagtgcaatggcgcaatctcggctcaccgcaacctccacctcccgggttcaag

SEQ ID NO: 37146 - DNA, 201 bp, Homo sapiens
cgccgcagcctgaaagccccgccccctatgctaatatgctccctctcccacaaggcagcgcgccggctcggacgcggccggctaccgagccctttgtgagrgctgtgagctgcgcctgacggtggcaccatgagcagctcaggtggggcgcccggggcgtccgccagctctgcgccgcccgcgcaggaagagggcatgacg

SEQ ID NO: 37147 - DNA, 201 bp, Homo sapiens
tgccaaaaccttgtctctactataaatacaaaaattagccgggcatggtggtgcatgccagtatccccagctactcgggaggctgaggcaggagaatcacytgaaccttgggaggtcaaggctgcagtgagcagagatcacaccaccactgcatgccagcctgggcaacagcatgagaccctgtctcaaaaaaaaaaaaaa

SEQ ID NO: 37148 - DNA, 201 bp, Homo sapiens
gggcatggtggtgcatgccagtatccccagctactcgggaggctgaggcaggagaatcacctgaaccttgggaggtcaaggctgcagtgagcagagatcamaccaccactgcatgccagcctgggcaacagcatgagaccctgtctcaaaaaaaaaaaaaaaaaaaaaaagattttacttaaatttaaaccctgtactaat

SEQ ID NO: 37149 - DNA, 201 bp, Homo sapiens; identical to SEQ ID NO: 8139

SEQ ID NO: 37150 - DNA, 201 bp, Homo sapiens
agtgagactctgtctcaaaaaaaaaaaaaaaaaaaaaaaaaaaaagcgaaatggtaaagaatggtaaagacctttctgatgtagactgacagctaacccargactgaagcataattttacagtctgatataacttggacagaatagcaccctgcaccctccccgaggtttcatgtgtcctgggagaactgtgttctgcagg

SEQ ID NO: 37151 - DNA, 201 bp, Homo sapiens
tttctgatgtagactgacagctaacccaggactgaagcataattttacagtctgatataacttggacagaatagcaccctgcaccctccccgaggtttcawgtgtcctgggagaactgtgttctgcagggtatcagcttccccagaggaggcagcctggccccgctctggcaccctgactgtgtgtccttggggaagtgat

SEQ ID NO: 37152 - DNA, 201 bp, Homo sapiens
gtctcccagtgacaacacccgccccccgccccaccgccatccccctcctctgcctcctcctggccaggcctgcgagaagacccagctggagttcatgtcgsaacagtgcgccaggaccgacggccagccgctgcgctcctcccctggcggcgcctccttctaccactggggtgctgctgtaccacacagccaaggtggggc

SEQ ID NO: 37153 - DNA, 201 bp, Homo sapiens
gctaacccaggactgaagcataattttacagtctgatataacttggacagaatagcaccctgcaccctccccgaggtttcatgtgtcctgggagaactgtsttctgcagggtatcagcttccccagaggaggcagcctggccccgctctggcaccctgactgtgtgtccttggggaagtgatgtaacgtccctggacctcg

SEQ ID NO: 37154 - DNA, 201 bp, Homo sapiens
ccccaggccagcctgggacctggccagggtcccgacgctctgtctccttcctcagctgggcggtgggagacttcggcccatgcagcgcctcctgtgggggyggcctgcgggagcggccagtgcgctgcgtggaggcccagggcagcctcctgaagacattgcccccagcccggtgcagagcaggggcccagcagccagctg

SEQ ID NO: 37155 - DNA, 201 bp, Homo sapiens
gggttgccatggttacccgctcgggcctgggcgccttggtaccccgggctgggctgggctggcgcttctgggaacattcccggagggaccagaaaccccakggcgggggggcggcgggggcgggggggcggcgggggcgggggggcggcgggggcgggggcggggggtggggcaccggcctggggcacgtgactgagccct

SEQ ID NO: 37156 - DNA, 201 bp, Homo sapiens
gccaggcatggtggcgtgtgcctgtaatcccagctacttgggaggctgaggcacaagaatcacttgaacccgggaggtggaggttgcactaagcccagatmgcaccactgcactccagcctgggcaacagagtgagactctgtctcaaaaaaaaaaaaaaaaaaaaaaaaaaaaagcgaaatggtaaagaatggtaaagac

SEQ ID NO: 37157 - DNA, 201 bp, Homo sapiens
aaggcaggacagacaagggtaaatggggttcaggctgccccctggaggggctcgctcatggtgtggagggggcataggggcacagcagacagagatgagcygcagccccgcagacctgcttgctctaaggcttggagggacagagaggccgtgagggtgacagggacccagacttgaattatggctcctcccacctatatg

SEQ ID NO: 37158 - DNA, 201 bp, Homo sapiens
gaataaagtgctccacacagtctgcaaagtcggctcatggctggaggagagcatatgttgagtgtaggcactgagaaacttttagagccgcctggcagcgyggttctgcctattcaacctcatgatttacttgacaatttcccaaatggaaataaaaacaaaactgcccccacaaaaatgggtagagatgtgttgccctag

SEQ ID NO: 37159 - DNA, 201 bp, Homo sapiens
tagagccgcctggcagcgtggttctgcctattcaacctcatgatttacttgacaatttcccaaatggaaataaaaacaaaactgcccccacaaaaatgggyagagatgtgttgccctaggccctgggctccagaggcagccttgcctgcttctggggaccaccccaccaccaaccccacttgtaccccccgaacaggggtg

SEQ ID NO: 37160 - DNA, 201 bp, Homo sapiens
ggtagagatgtgttgccctaggccctgggctccagaggcagccttgcctgcttctggggaccaccccaccaccaaccccacttgtaccccccgaacagggstgattagaccaagggtggcccgagccaagtgggaccagctaattttttaaaaatattttttagaaggccaggtgcagtgggtcatgcctgtaattccagc

SEQ ID NO: 37161 - DNA, 201 bp, Homo sapiens
ctgatgactgtctcatgccatcctcaggtgggaggtgtcagagcccagctcatgcacatcagctggtggagcaggcctggccttggagaacgagacctgtrtgccaggggcagatggcctggaggctccagtgactgaggggcctggctccgtagatgagaagctgcctgcccctgagccctgtgtcgggatgtcatgtcc

SEQ ID NO: 37162 - DNA, 201 bp, Homo sapiens
ttgcagtataacacagatattataaaatttaccatccaaactgtttctccctgtgcaggtcagtggcataaaagcacagtcacattgttgtgcggccatcrccaccaacctctccagaacttttccagtttcgcaaactggagctctgtccctgtgaaacacgaactcccatttccccctccgcagcccctggcaacctcc

SEQ ID NO: 37163 - DNA, 201 bp, Homo sapiens
ggtgccgtgctaggctgaggtactaagccagggcggcttagtttaatgctgtctgtgccctctagaaattatttaaaatgtttgaacaaaagctccaacakttttgtttgactgggccccacaaattatgtagctagtcctgggagggcccctgtgcccaaggactcctggctgagtgaggacaccaatcttaaacagtta

SEQ ID NO: 37164 - DNA, 201 bp, Homo sapiens
gtgcacctggtgaagatggtcattctgacagagcctgaggtaggcatggagctggaactcagcacaccatacagagcgggaagcccaagtcatcgcatctycatcctctttaacctcttgtcccggatgccccaagcagcatggatcacagaatgcattcagccagacagaccagctgccctcccagctctacccagcact

SEQ ID NO: 37165 - DNA, 201 bp, Homo sapiens
agtgtcagcagagaaaagctctctgcccctcactcatttgcacccacgtgacaagctctgtgtggtcctggttcttagcaggaccctgggaggtgcttgcytcattcacctcagggagaggaaagcatcctcttccttgaagaagccccgccctccacggctaagcatccccagcagaccccactccctgagaccagcgta

SEQ ID NO: 37166 - DNA, 201 bp, Homo sapiens
ataacccaccacccaagtgtaatgagtgctaacattttaattatgaaggtaacacgttcattattgaacacttaggaaacagacagacagaatgcctgtawgatggaaacacagaaccccttgccctccgtactaggaagctcacacaggcacgtaacacctgcctggggaatctgtctcttgggctaaggttaaatgtca

SEQ ID NO: 37167 - DNA, 201 bp, Homo sapiens
ccctggcttccagaggcagaggcagaggcagaggcgggctgcaggcggcatcctacacctggagctgctggtggccgtgggccccgatgtcttccaggctsaccaggaggacacagagcgctatgtgctcaccaacctcaacatcgtgagtgccccacgctggactgtgcaggtccccacggccagggctggtgaccaatg

SEQ ID NO: 37168 - DNA, 201 bp, Homo sapiens
acgttcattattgaacacttaggaaacagacagacagaatgcctgtaagatggaaacacagaaccccttgccctccgtactaggaagctcacacaggcacrtaacacctgcctggggaatctgtctcttgggctaaggttaaatgtcatttccttagaaaagccattcctggccccactgaatggacacgtccctcttgtt

SEQ ID NO: 37169 - DNA, 201 bp, Homo sapiens
tggagggttgacccctggtctcagtgctttccaattcgaactttttccaatcttaggtatctactttagagtcttctccaatgtccaaaaggctagggggytggaggtggggactctggaaaagcagcccccatttcctcgggtaccaataaataaaacatgcaggctgaccggcgtttttttcttataagctgtccagac

SEQ ID NO: 37170 - DNA, 201 bp, Homo sapiens
cagggcaggcacgtgccttggcaccacccaagtgactgttttctctcaccgaggtttgacctggagttgcctgatggtaaccggcaggtgcggggcgtcayccagctgggcggtgcctgctccccaacctggagctgcctcattaccgaggacactggcttcgacctgggagtcaccattgcccatgagattgggcacagg

SEQ ID NO: 37171 - DNA, 201 bp, Homo sapiens
tctctactataaatacaaaaattagccgggcatggtggtgcatgccagtatccccagctactcgggaggctgaggcaggagaatcacctgaaccttgggargtcaaggctgcagtgagcagagatcacaccaccactgcatgccagcctgggcaacagcatgagaccctgtctcaaaaaaaaaaaaaaaaaaaaaaagatt

SEQ ID NO: 37172 - DNA, 201 bp, Homo sapiens
atggaaacacagaaccccttgccctccgtactaggaagctcacacaggcacgtaacacctgcctggggaatctgtctcttgggctaaggttaaatgtcatktccttagaaaagccattcctggccccactgaatggacacgtccctcttgttccaggcgcccaataccttctcctcactagatttatcctgaccacactta

SEQ ID NO: 37173 - DNA, 201 bp, Homo sapiens
cgacggcgcgcccggcagcggctgcggccccagcggacacgtgatggcttcggaacggcgccgccccgcgccggcctcgcctggtccccctgcagccgccsgcagctgctgagcctgctcaggtagcggccgccccgtgggaggggcgcgcgagcctccagtccagcccgctgggcgcgccagcgccacctctctctacgt

SEQ ID NO: 37174 - DNA, 201 bp, Homo sapiens
tggtgctccaagggtcgctgccgctccctggtggagctgacccccatagcagcagtgcatgggcgctggtctagctggggtccccgaagtccttgctcccrctcctgcggaggaggtgtggtcaccaggaggcggcagtgcaacaaccccaggtaccgcagggagggtgcttttctgtcagggagtgtggccataccatag

SEQ ID NO: 37175 - DNA, 201 bp, Homo sapiens
ccagctggagttcatgtcgcaacagtgcgccaggaccgacggccagccgctgcgctcctcccctggcggcgcctccttctaccactggggtgctgctgtaycacacagccaaggtggggcctgcggagtgtggggttgggggaggagccagccctggagaccctcggacagggcagagtcataggggggttggcctactat

SEQ ID NO: 37176 - DNA, 201 bp, Homo sapiens
tctgccctcccaggggatgctctgtgcagacacatgtgccgggccattggcgagagcttcatcatgaagcgtggagacagcttcctcgatgggacccggtrtatgccaagtggcccccgggaggacgggaccctgagcctgtgtgtgtcgggcagctgcagggtaggcgtgtgtggacattggcgatggccctggggccta

SEQ ID NO: 37177 - DNA, 201 bp, Homo sapiens
catcatgaagcgtggagacagcttcctcgatgggacccggtgtatgccaagtggcccccgggaggacgggaccctgagcctgtgtgtgtcgggcagctgcrgggtaggcgtgtgtggacattggcgatggccctggggcctacctgtcctatcggaaggctcctgggggcaggttggtgggtgctggccctgatggagctg

SEQ ID NO: 37178 - DNA, 201 bp, Homo sapiens
cctgtgcatggactctgccctcagggtgcctgtccaggaagagctgtgtggcctggcaagcaagcctgggagccggcgggaggtctgccaggctgtcccgkgccctgctcggtgagtgaggggagcaagactgtgtgctggccttctccctgtaagtgggagacccgagccttggctccatgcccggtgacctgcggaggg

SEQ ID NO: 37179 - DNA, 201 bp, Homo sapiens
ctccagggcggtggtgctgggatcactgttgaagacagacatgcagggcccttgggtgcccggacccctgcccccactgtctctgggatacgacatctgtsgtttgccctcacctttctcttctgtaaaatgggtttgtccaaatgttctgtccactctgccaagcctcttggtgaggacacaagggggcctccagaaaga

SEQ ID NO: 37180 - DNA, 201 bp, Homo sapiens
ccccgccccgcccggttcccacacatgctggtggagtagcctctccagctcttcacactccgggggcccctgggagtcagcagctgcctggggctggcaaygcccacccgacgggttacctctctcatctgcccttgcacagggggcagaactgcttcgggacccgtccctgggggctcagtttcgggtgcacctggtgaa

SEQ ID NO: 37181 - DNA, 201 bp, Homo sapiens
gccgagctttctgatgggtgctggccagccagcctgggaaggctgctccctcagcctcctgccctctgcaaaggtgaccccagggcaggcacgtgccttgrcaccacccaagtgactgttttctctcaccgaggtttgacctggagttgcctgatggtaaccggcaggtgcggggcgtcacccagctgggcggtgcctgct

SEQ ID NO: 37182 - DNA, 201 bp, Homo sapiens
ctgcctggggaatctgtctcttgggctaaggttaaatgtcatttccttagaaaagccattcctggccccactgaatggacacgtccctcttgttccaggcrcccaataccttctcctcactagatttatcctgaccacacttaatcaacagctgcagtttacagtctgtctactgcacttgacaataagcctcaagaggga

SEQ ID NO: 37183 - DNA, 201 bp, Homo sapiens
agaaattgggcataagacaatatgaggggtggtctcctcccttacttctgcctcctgggttcaagcgattctcctgcctcagcctcctgagtagctgggaytataggtgcacgccaccactctctgccaatttttgtatttttagtagacctggggtttcgccacgttggccaggctgtcttgaactcctgacctccagtg

SEQ ID NO: 37184 - DNA, 201 bp, Homo sapiens
tgtggattttatttctgccttttagtttttacttctttatttggaagcagaaattgggcataagacaatatgaggggtggtctcctcccttacttctgcckcctgggttcaagcgattctcctgcctcagcctcctgagtagctgggattataggtgcacgccaccactctctgccaatttttgtatttttagtagacctg

SEQ ID NO: 37185 - DNA, 201 bp, Homo sapiens
gccaagatgccctcacttctgacatcacccgcaagttcagggggttccccaaaccaccctcaggcttgatagttgactaggaagactcccagagctcactsagagctgtggcacatggctgcggctccttccagaagaacacaggttagaattgtccaagggaagagatgtaggcagagtctgggagggtccaaccaggag

SEQ ID NO: 37186 - DNA, 201 bp, Homo sapiens
gccctccgtactaggaagctcacacaggcacgtaacacctgcctggggaatctgtctcttgggctaaggttaaatgtcatttccttagaaaagccattccyggccccactgaatggacacgtccctcttgttccaggcgcccaataccttctcctcactagatttatcctgaccacacttaatcaacagctgcagtttaca

SEQ ID NO: 37187 - DNA, 201 bp, Homo sapiens
gcacaacacagggaggcccccaaatggctcattcctcagccatcagcgactgtgtcctgaacacccaggcaacatgaagccagctgtaacttatgaacacrtcacctccagctgaaccattcagagaaggccactgactcccggtccaccccacgtgggtggccagcacagggtttattcttttcacttgtttttttgaga

SEQ ID NO: 37188 - DNA, 201 bp, Homo sapiens
ccagctgtaacttatgaacacgtcacctccagctgaaccattcagagaaggccactgactcccggtccaccccacgtgggtggccagcacagggtttattsttttcacttgtttttttgagagtcttgctccgtcacccgggctggaggcagtagtgcaatcacagctcactgcagcctcaacctcctgggatcaagtgat

SEQ ID NO: 37189 - DNA, 201 bp, Homo sapiens
ggaggcagtagtgcaatcacagctcactgcagcctcaacctcctgggatcaagtgatcctcccaccttggcctcccaaggagctgggatcacaggcaacarccaccacacctggctccatcacagggttgaagtaatcaccaggcactgagccaagagtgccaacctcacaatctccttatgatgccaccatgactaccac

SEQ ID NO: 37190 - DNA, 201 bp, Homo sapiens
ggcaacagccaccacacctggctccatcacagggttgaagtaatcaccaggcactgagccaagagtgccaacctcacaatctccttatgatgccaccatgmctaccacaaggcacagaggacgtcagaaacttgccccaaaccacccaactggcgagaagcagggacaggcctcatacttgggtctttctggcttcagcac

SEQ ID NO: 37191 - DNA, 201 bp, Homo sapiens
gatgtcccctcgttctggaacaatatcaccatttgtcctttccttggttcctttcttattgtgctctgttccactggccttggtgcgaggtactggcgccytcctgtccatcttggaacctgaaggaacagagcccctgctggcctcctggtcttttcctgccggcatctcctctcccttcacttgaggcgaggtctcttt

SEQ ID NO: 37192 - DNA, 201 bp, Homo sapiens
ttaatgctgtctgtgccctctagaaattatttaaaatgtttgaacaaaagctccaacatttttgtttgactgggccccacaaattatgtagctagtcctgsgagggcccctgtgcccaaggactcctggctgagtgaggacaccaatcttaaacagttaccaaggacttccccatctattgtggctggagtcagactggag

SEQ ID NO: 37193 - DNA, 201 bp, Homo sapiens
actgcttacctgtctcctgctcccttttcaggtgcctgtggcaggcagcaccttgagccaacaggaaccattgacatgcgaggcccagggcaggcagactrtgcagtggccattgggcggcccctcggggaggtggtgaccctccgcgtccttgagagttctctcaactgcagtgcgggtatgtctagggccatgcaagcg

SEQ ID NO: 37194 - DNA, 201 bp, Homo sapiens
gaaccctggggctgcccacgggaatttgactggtcctgtgtgttaagacaggaatgtctgcactgagatactgtgcagagtattaggaggttcaagaagcrctcggggaggctgaggtgggaggattgcttgaggtcaggagttgaagaccagcctgggcaacaaagtgaaaccccatctgtattagttcattgtgcactg

SEQ ID NO: 37195 - DNA, 201 bp, Homo sapiens
ctgtcgcctgcaccttcgccagggagcacctggtgagtctgccggcggtggcctgggattggctgtgaggtccctccgcatcacccagctcacgtcccccmaaacgtgcatggtgagaacctgctgggtgccgtgctaggctgaggtactaagccagggcggcttagtttaatgctgtctgtgccctctagaaattattta

SEQ ID NO: 37196 - DNA, 201 bp, Homo sapiens
tggcgtggagaaggtcagagccaagagtgaatgagtgggctcctgtgagcacgtgcacgtgggtgcctccagccaggccgccctattcctaggtcaggagrcaggaccagtatggggcagagagtcttggagttggccttggggactgtcctttgggttggtggtctgacctctttcctttagcatttgctcccatgcaga

SEQ ID NO: 37197 - DNA, 201 bp, Homo sapiens
acccaggaggcagaggttgaggtgagccaagatcgcgccattgccctccagcctgggcaacaagagcgaaactgtctcaaaaaaaaacaagaaagaaaaakaaattaaaacatttgcctcttgagcttcaagtcagtgacaagttaagaaggaaaaaaagaaaaaagacacaaaaaacacatttccatgggcccccaaaag

SEQ ID NO: 37198 - DNA, 201 bp, Homo sapiens
ggagagtcactgacatgtgcctgtgaggaggatgggtgctcagctccacacggctaacagggctggttccccgacagcggtgaggatcggagggcgctatrtcgtggctgggaagatgagcatctcccctaacaccacctacccctccctcctggaggatggtcgtgtcgagtacagagtggccctcaccgaggaccggct

SEQ ID NO: 37199 - DNA, 201 bp, Homo sapiens
gtcactagggagacagcaggtacaacacagccttaaaagcatggactccagagtcagccacctggttcccagccgcaatcttagatgatctatttaaactyttccagcctatttcctcatctgtacaatagcgatgatggaagtgtccacctcacagtcttattgtggggattgcaacacgcatggcatagagcacatggc

SEQ ID NO: 37200 - DNA, 201 bp, Homo sapiens
ccctgtgtcgggatgtcatgtcctccaggctggggccatgtgagtgccctgggcatgagggtggctggggctgttgagtcctttacctggctgggagaacraggagcacccattgccaccgtcctccaggccagagcaagaacaccatccttctgtgggaatgctgtctgagggccacccctgctcagaaaagaagcttag

SEQ ID NO: 37201 - DNA, 201 bp, Homo sapiens
agcaaaaaaggtgctaggctctttttaaacaaccagctctcaaatgaaccagcagagtgagaacttactcgttactgaggggagggcaccaagtcattcawgagggatctacccccatgacccaatacctcctatgggccccatctccaccactggggatcacatttcttttttaaaaaaactactttttacttttattta

SEQ ID NO: 37202 - DNA, 201 bp, Homo sapiens
gaaacacctgtgcccagagcagggtccaggaggcagggcaggggctttcccctttgggcagagccaccagggcagtgggaatcttgtcttgatggggtgasccaaagcacacaatagcccaacagctcctcctgggccctgccctttgcgtgcctagtcactaatggggtctggctcttggggtgggggtgacacgcaatg

SEQ ID NO: 37203 - DNA, 201 bp, Homo sapiens
gccaccagggcagtgggaatcttgtcttgatggggtgacccaaagcacacaatagcccaacagctcctcctgggccctgccctttgcgtgcctagtcactratggggtctggctcttggggtgggggtgacacgcaatgtcttgacttcggaaggccatccttccaagacctgccagcccctctcctgttagctttccact

SEQ ID NO: 37204 - DNA, 201 bp, Homo sapiens
gtgactgtatacagcacagcatagccccttttgaagccaggctaccccatagacactgtgcccaaaagagcagctcaaaggcagggctgcagtcctagttaatacccacttctaattatatgcaaattaaggggccagattatgcagaaatttctagaaaaagggcagtaacttctaggttttcgtcatggaaaaggggca

SEQ ID NO: 37205 - DNA, 102 bp, Homo sapiens
caaaaaaaaaaaaaaggatgaagaacggctctgcccttggcaccctctagagcagatacgacagtggtaccaggcccttagtcagtgaccctgtttcagagg

SEQ ID NO: 37206 - DNA, 201 bp, Homo sapiens
aaccaacaagtcagccaccagtgaccagaaacaatgaagtgaccagcaaaacagaaatacagtatcttgagtcacactcattctaagtacctttacttgaytcttgaaaggtttatatttctgtgtgtcccgaatcttcttttttggatgatcaagaaatagtacctagaaaaataaaatataatgataatcattttcatt

SEQ ID NO: 37207 - DNA, 201 bp, Homo sapiens
aggcaacggatacggtagggcaggccctacccccaaatcacaaaaaggccccgagtttgtgtcactgctcttcagggcaagtacgcttttgactttgtagkagagactggtgggtttgaagttaggcattggatccagtcctgtcatgtctggttagctgttttccctgcagattagggtgggcagtgcagtggggtgaca

SEQ ID NO: 37208 - DNA, 201 bp, Homo sapiens
ctgtctgagtgataccctttcctttcctgtctgccctcaatcttgtggattactggagtgggcaaggtcttagagaatgtctgtcgaggatgtctgcaggktttaaacagtgcctgcctggcagagagggctagctctgggcctgggcagggcaggccccatcagcaatcctgccagaaggaccaccttttcagggtcacc

SEQ ID NO: 37209 - DNA, 201 bp, Homo sapiens
gactacaggtgcctgccaccacacccggctaattttttgtatttttagtagagatggggtttcactgtgttagccaggatggtctcgctctcctgacctcrtgatttgcccgcctcggccttccaaattgctgggattacaggcgtgagccacagtgcccggcctttttccttctgattttaaaagaaattaggccaggtg

SEQ ID NO: 37210 - DNA, 201 bp, Homo sapiens; identical to SEQ ID NO: 8061

SEQ ID NO: 37211 - DNA, 201 bp, Homo sapiens
caggaccctgggaggtgcttgcctcattcacctcagggagaggaaagcatcctcttccttgaagaagccccgccctccacggctaagcatccccagcagaycccactccctgagaccagcgtacccgccgaaggcctgctctttcacgaggctgaggctgacgctgccctcgctctgacccaactgtttcctcgctatctt

SEQ ID NO: 37212 - DNA, 201 bp, Homo sapiens
cttaaaagcatggactccagagtcagccacctggttcccagccgcaatcttagatgatctatttaaacttttccagcctatttcctcatctgtacaatagmgatgatggaagtgtccacctcacagtcttattgtggggattgcaacacgcatggcatagagcacatggcagagtgcacatttttaggagctcaattagta

SEQ ID NO: 37213 - DNA, 201 bp, Homo sapiens
ttagatgatctatttaaacttttccagcctatttcctcatctgtacaatagcgatgatggaagtgtccacctcacagtcttattgtggggattgcaacacrcatggcatagagcacatggcagagtgcacatttttaggagctcaattagtatttacttcaagaccgtaagtgtcgctagaaccccatcacatgtctgcta

SEQ ID NO: 37214 - DNA, 201 bp, Homo sapiens
gggacttgggccgccgccttagccagcggcatccggggtcatcgacctcgagtttgactggggcaagccgaggacctccccaagatccgggatggggatgrgagatgcgaacgccggaagggaactggggggccgctgtgtgtgtagcacccggtagggcagctgagctgggggcactgggcggtggggctagtgagagcc

SEQ ID NO: 37215 - DNA, 201 bp, Homo sapiens
ttgggtgtggccatttatcatctcaataaatgtctgcggggagcagggtgaagtatgggggtggagccatgagctccttttcacacttgctgagtttgaaygggccgtcagtcaccaaggagagacgtctaatcagcagcaggatataagattcctaagcttagggaagggtcagtgctggagatgtaatttggaaatcgt

SEQ ID NO: 37216 - DNA, 201 bp, Homo sapiens
ccagatagcaggtgctgggggctctccaggggcgaagcagcagaggaggctgagggggagcagtcagtgcagtgggaggagaagcggatgtgagtggcatyagagaatccagggggagaataaaccacatcagatgctgctgagaggctgagaaggacgaggacagagagatgggaaccagatatggcactgagattgtca

SEQ ID NO: 37217 - DNA, 201 bp, Homo sapiens
ggttccccgacagcggtgaggatcggagggcgctatgtcgtggctgggaagatgagcatctcccctaacaccacctacccctccctcctggaggatggtcrtgtcgagtacagagtggccctcaccgaggaccggctgccccgcctggaggagatccgcatctggggacccctccaggaagatgctgacatccaggtcagc

SEQ ID NO: 37218 - DNA, 201 bp, Homo sapiens
gcagaggggcagaaactaacgatgcaggaggagagagctgggaagggatccagagccagggcctggcaggaagtgtaggtgtgtcctccctgatcgcagargaggagagaggctgcactttgaggggtggaaagacaaggtgaatccccctgctggtcatcagcttgtgcggctctgtgggtgtaaaagagtggtttggag

SEQ ID NO: 37219 - DNA, 201 bp, Homo sapiens
agggcgctatgtcgtggctgggaagatgagcatctcccctaacaccacctacccctccctcctggaggatggtcgtgtcgagtacagagtggccctcaccraggaccggctgccccgcctggaggagatccgcatctggggacccctccaggaagatgctgacatccaggtcagcaggagagcctgggggaggccagtggg

SEQ ID NO: 37220 - DNA, 201 bp, Homo sapiens
caccattgcccatgagattgggcacaggtatgtagccccaccagctgtccccaggatctggcaaggagctgacctgggtacccagggtggaggtggtcttrgcaagcagtgggtccttgtagagtttctccagaggagcctgtacccctcaccccgacagactcaggtgtgaggacaggggaacctgatactgtttgatta

SEQ ID NO: 37221 - DNA, 201 bp, Homo sapiens
agagttgagccagaaccacgatgtctttggcacagcctctcatctgtcagatgggagcggggaccccggagagggagtcagccgaggtcctggcattcctygtgaacccccgtctgtgggtttctggtccagtgtcccttctccagattagatggcttaggcctcctctaagggggtgggcgtgcacatccggagagctgt

SEQ ID NO: 37222 - DNA, 201 bp, Homo sapiens
gccccgcctggaggagatccgcatctggggacccctccaggaagatgctgacatccaggtcagcaggagagcctgggggaggccagtgggggcttcttctygggggctatggctgcttgctcgtttgtctatccatccattccctgattcgttcatttattcattcagcggtcacttacaggggacccactatgtgttggg

SEQ ID NO: 37223 - DNA, 201 bp, Homo sapiens
tgggacaaggcagggctccttctccctcagagggagcatagttcccttctgctcctgtgatgcagaagacgtgagcccccaaactggggcttagcctgggrgggttcttggcttcaccgaggaaagaattcaagagggagcaggtggtgttagacagcaactttgattgatgtggcagtgggcagagtgtacagccctgtg

SEQ ID NO: 37224 - DNA, 201 bp, Homo sapiens
gtcccattccatactgaccagattcccagtcaccaaggccccctctcactccgctccactcctcgggctggctctcctgaggatgcaccagcgtcaccccygggcaagatgccctcccctctgtgtggccggaatccttgcctgtggctttctcctgggctgctggggaccctcccatttccagcaggtgggctcatttgc

SEQ ID NO: 37225 - DNA, 201 bp, Homo sapiens
ctctggggagacctagcctctctctggggtcttctcttcctgcaggtggaaagtcatgtcccttggcccatgttcggccagctgtggccttggcactgctwgacgctcggtggcctgtgtgcagctcgaccaaggccaggacgtggaggtggacgaggcggcctgtgcggcgctggtgcggcccgaggccagtgtcccctg

SEQ ID NO: 37226 - DNA, 201 bp, Homo sapiens
cacaatgcccagctaatttttaaattttttgtagagatggggtctccctttgttacccaggcttgtctaggactcctggcttcaagccatcctcccacctyggcgtcccaaagcactgggattacagacatgagccaccacccacgcctgatcagcaaatctattaatattatatattacaacattaattttgacctggaa

SEQ ID NO: 37227 - DNA, 201 bp, Homo sapiens
tggagtcagagtcaggagggaaggacgagtccccacggcagcagtctctgagggggtacagcaggagcacacagaagacctttctgtgaggacactgcccrgggggttctcacctcagtttcaccctctgtaaacaagcatgaacacctccagcatcttcaatggattcaagggatctctacagtgccgtcacgggagcac

SEQ ID NO: 37228 - DNA, 201 bp, Homo sapiens
gtcagagtcaggagggaaggacgagtccccacggcagcagtctctgagggggtacagcaggagcacacagaagacctttctgtgaggacactgcccggggrgttctcacctcagtttcaccctctgtaaacaagcatgaacacctccagcatcttcaatggattcaagggatctctacagtgccgtcacgggagcaccata

SEQ ID NO: 37229 - DNA, 201 bp, Homo sapiens
gggggtacagcaggagcacacagaagacctttctgtgaggacactgcccggggggttctcacctcagtttcaccctctgtaaacaagcatgaacacctccrgcatcttcaatggattcaagggatctctacagtgccgtcacgggagcaccatagcaaaggctgctgcctgaacattagcatctctgtcacttccttctga

SEQ ID NO: 37230 - DNA, 201 bp, Homo sapiens
tctgaacggcttcaagttcctcaccacacccaagtgcttcaagccggtgggcagaggtgacaacttaagtgtctctcccatctagcagactggcctccccrctgttcccactgtgtcctttaaaccaacatccaggcatttgcccataaactcaaagtgacccccaccctgttctcctgtaaatacacacgtactcgctct

SEQ ID NO: 37231 - DNA, 201 bp, Homo sapiens
tccccctccaggccgccctccttcccctggcttccagaggcagaggcagaggcagaggcgggctgcaggcggcatcctacacctggagctgctggtggccrtgggccccgatgtcttccaggctcaccaggaggacacagagcgctatgtgctcaccaacctcaacatcgtgagtgccccacgctggactgtgcaggtccc

SEQ ID NO: 37232 - DNA, 201 bp, Homo sapiens
ggcctgtccccattgcccacaggcccatgtctgtgaccttctccggtgcgagcccccttcccagtagggccattggcaacttgactaatggctgatggggrccagaggcaggtgggctagtggtcaggggcaacaggagggcaaggcccactttgtgacctggttctttgtggtctaggccagaggcacactgaccagtgc

SEQ ID NO: 37233 - DNA, 201 bp, Homo sapiens
tttgcgtgcctagtcactaatggggtctggctcttggggtgggggtgacacgcaatgtcttgacttcggaaggccatccttccaagacctgccagcccctytcctgttagctttccactgcttgctctctagaaccatcgccctctgctctccctctccccctccaggccgccctccttcccctggcttccagaggcagag

SEQ ID NO: 37234 - DNA, 201 bp, Homo sapiens
atggggtctggctcttggggtgggggtgacacgcaatgtcttgacttcggaaggccatccttccaagacctgccagcccctctcctgttagctttccactrcttgctctctagaaccatcgccctctgctctccctctccccctccaggccgccctccttcccctggcttccagaggcagaggcagaggcagaggcgggct

SEQ ID NO: 37235 - DNA, 201 bp, Homo sapiens
acgcaatgtcttgacttcggaaggccatccttccaagacctgccagcccctctcctgttagctttccactgcttgctctctagaaccatcgccctctgctytccctctccccctccaggccgccctccttcccctggcttccagaggcagaggcagaggcagaggcgggctgcaggcggcatcctacacctggagctgctg

SEQ ID NO: 37236 - DNA, 201 bp, Homo sapiens
attccagcactttgggaggcggaggcaggcggatcacctgagttcgggagttcaagaccagcctgaccaatgtggagaaaccctgtctctacttaaaatamaaaattagtcgggtgtggtggcatatgcctgtaatcccagctactcgggaggctgaggcaggagaatcgcttgaacccaggaggcggaggttgcagtgag

SEQ ID NO: 37237 - DNA, 201 bp, Homo sapiens
ggtgaccaatgtctgtgggctggtgtatctggtagtctgaatacagtgggttaaactcaggtagaatggctcggggttcttcctcttctccctccctcccmtgggtggaggtgggtgaggtcccacaccctctctaggctccatggcacatgcacaccctgcagcctctcactactcaagtcccttcacctggggccaccc

SEQ ID NO: 37238 - DNA, 201 bp, Homo sapiens
cccacaaagctcagctaaagcaaccctggcaaatgggatacgggctgctcacactgccctctgcaccccgaccctgccctctctccattctcttgtccccygctcagagtggcgaggacaggtcacccgtctgaagtctaaacagagactgctggcaaaggagatgcccaccttcatttcttgctagcacctgaatccctg

SEQ ID NO: 37239 - DNA, 201 bp, Homo sapiens
tccttagaggagggctggggaccccgggaaggagagtcactgacatgtgcctgtgaggaggatgggtgctcagctccacacggctaacagggctggttccycgacagcggtgaggatcggagggcgctatgtcgtggctgggaagatgagcatctcccctaacaccacctacccctccctcctggaggatggtcgtgtcga

SEQ ID NO: 37240 - DNA, 201 bp, Homo sapiens
cctggagctaggggacacagcagagaacaaggcagacaaatgtccctgacctcctggagcaaatgcagggggaaagggggacagataataataggacaggyggggaatgcagtttgatggatggtgttcagtgcgatgcagccaaacacagcgggaggggaggaggggagggctggcggggtgggctccagggcggtggtg

SEQ ID NO: 37241 - DNA, 201 bp, Homo sapiens
gcccctgggagtcagcagctgcctggggctggcaatgcccacccgacgggttacctctctcatctgcccttgcacagggggcagaactgcttcgggacccrtccctgggggctcagtttcgggtgcacctggtgaagatggtcattctgacagagcctgaggtaggcatggagctggaactcagcacaccatacagagcgg

SEQ ID NO: 37242 - DNA, 201 bp, Homo sapiens
gttgttaggaggactaactgggaaacaaaccgaccgcagtcagcaccgtgcctggttggggtgtcctaaatgcaggctttgctgtgggtccgcagggtgcyccaaatatcacagccaacctcacctcgtccctgctgagcgtctgtgggtggagccagaccatcaaccctgaggacgacacggatcctggccatgctgacc

SEQ ID NO: 37243 - DNA, 201 bp, Homo sapiens
gaccccagggcaggcacgtgccttggcaccacccaagtgactgttttctctcaccgaggtttgacctggagttgcctgatggtaaccggcaggtgcggggygtcacccagctgggcggtgcctgctccccaacctggagctgcctcattaccgaggacactggcttcgacctgggagtcaccattgcccatgagattgggc

SEQ ID NO: 37244 - DNA, 201 bp, Homo sapiens
agctgggcggtgcctgctccccaacctggagctgcctcattaccgaggacactggcttcgacctgggagtcaccattgcccatgagattgggcacaggtakgtagccccaccagctgtccccaggatctggcaaggagctgacctgggtacccagggtggaggtggtcttggcaagcagtgggtccttgtagagtttctcc

SEQ ID NO: 37245 - DNA, 201 bp, Homo sapiens
agtacctagaaaaataaaatataatgataatcattttcatttttggtttgtagtagcagaaccccctccccccgccaccttttgcaagtaacatctttgtktgtgtgtgtgtgtgtgtgtgtgtgtgtgtgtgtgtgtgtgtgtgtgtgacagagtcttgctctgtcacccaggctggaatgcagtggctcaatctttgct

SEQ ID NO: 37246 - DNA, 201 bp, Homo sapiens
atttttaggagctcaattagtatttacttcaagaccgtaagtgtcgctagaaccccatcacatgtctgctatctgcttttcacttctacacaggaatcttytttctccctgtcttgctacacagaccagtgtgttctttcgttgttgttgtttgagatggagtctcgctctgtcgcccaggctggagtgcagtggcgcgat

SEQ ID NO: 37247 - DNA, 201 bp, Homo sapiens
tctgcccgccttggcctcccaaagtgctgggattataagcgtgagccaccatgcctggcctactttttgactttttttttctttgagacgcagtcttgctmttgtcccccatgctggagtacaatggcgcgatgtcagctcattgcaacctccgcctcctgggttcaagtgattctcctgtcttagcctccttagtagctg

SEQ ID NO: 37248 - DNA, 201 bp, Homo sapiens
gtcggtgagtcacgtgatgcatgtcatggccgcctccatggcccggggaggcgtgagtgccagggttctgctgcaggctgccaggggcacctggtggaacrgacctgggggcacttccgggtcgggggagggggtggcgctggggacaaccagaaagtttcaagcgacaggtacctggggcgcccggggcgggcagcgtta

SEQ ID NO: 37249 - DNA, 201 bp, Homo sapiens
gatttcaccatgttgcccaggctggtctcaaactcctggcctcaaatgatctgcccgccttggcctcccaaagtgctgggattataagcgtgagccaccakgcctggcctactttttgactttttttttctttgagacgcagtcttgctattgtcccccatgctggagtacaatggcgcgatgtcagctcattgcaacctc

SEQ ID NO: 37250 - DNA, 201 bp, Homo sapiens
ctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctca

SEQ ID NO: 37251 - DNA, 201 bp, Homo sapiens
agagacaggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgca

SEQ ID NO: 37252 - DNA, 201 bp, Homo sapiens
caaaggagctggtggccagtggcatgggctgggcagccttcaatctcagcaacgtgactggcaacagtcggatcctctgctcagtgtactgcaatggctcycagataacaggctcctctaacatcaccgtgtacagtgagtcgacgtgtccggaggtgggactggtcttgggtagtggtgtgggcaagtggccaatggctc

SEQ ID NO: 37253 - DNA, 201 bp, Homo sapiens
caggctgccaggggcacctggtggaacagacctgggggcacttccgggtcgggggagggggtggcgctggggacaaccagaaagtttcaagcgacaggtayctggggcgcccggggcgggcagcgttaatccgtcagatgccggcggggcggggctcggcgcagccgctcaccgaaccgtgttttccaggctcgcgcccgg

SEQ ID NO: 37254 - DNA, 201 bp, Homo sapiens
gccaccatgccctgcctgccattactttcaatggcaaaaacagcaattacttttgcaccaacctactaaaataaatatctcatctgaaggctctgaaagasaccttgaggtcagtaggagcggagagagatcattaagtagggagggcacaggcagaaaaggtgaggtgctgttagtggcagggactgcacctggctggtg

SEQ ID NO: 37255 - DNA, 201 bp, Homo sapiens
gatcaagaccatcctggctaacatggtgaaaccctgtctctactaaaaatacaaaaacaaaattagccaggcatggtggcaggcgcctgtagtcccagctrctctgggaggcggaggcaggagaatggcgtgaatccgggaagcggagcttgtagtgagccgagatcacgccactgcagtccagcctgggcaacagagcgg

SEQ ID NO: 37256 - DNA, 201 bp, Homo sapiens
ctcgatctcttgatcttgtgacccgcctgcctcagcctccaaagtgctggaattacaggcgtgagcccggcctctttttttttttttttttttgttgttgktatttttttttttttttttttttttttttgagacggagtctcgctctgtcgcccaggctggactgcggactgcagtggcgcaatctcggctcactgcaag

SEQ ID NO: 37257 - DNA, 201 bp, Homo sapiens
tgtgcgggctcaggacagaagatgagttagcacaatggcctcacctttcttttattttattttatatttttttaagacagagtcttgctctgtcacccagkctggagtgcaggggcgcgatcttggctcactgcatcctccgcctcctgggttcaagtgattctccagcttcagcctcccgagtagctgggatgacagcgc

SEQ ID NO: 37258 - DNA, 201 bp, Homo sapiens; identical to SEQ ID NO: 8215

SEQ ID NO: 37259 - DNA, 201 bp, Homo sapiens
ccaatagcagttgcaacgtgggttgggcctgagtgcccgaagctggacacagcgcggaaagagggcgaggcttgaacggccgaaagcgtggcccggatatyccgagaggaaaggggagggcggagggagcggcttgacccacaggaaggtcctgttcattaagctcctgggcaatgccccgcctttaggcttcctaggacc

SEQ ID NO: 37260 - DNA, 201 bp, Homo sapiens
aatcttaaccgctgtgcttccgtcgcagtgggaggccccgccttttcccctgcctgcccttcgggcacctcaggaaggcaccttcctctgtcagaatggcyaccatggtaccatccgtgttgtggcccagggcctgctggactctgctggtctgctgtctgctgaccccaggtgagaccagtcaagccggggagggctgga

SEQ ID NO: 37261 - DNA, 201 bp, Homo sapiens
gccaggcacagtggtgtgtacctgtggtctcagctcctagggaggctgaggtgggaggatcacttgaacccaggaggctgagattgcagttagctgagatygtgcccctgcactccagcctaggcgacacggtgagactctgtttcaaaaaacaaaaaagaaatatgacttatttacaaatatttctttcttttttatttt

SEQ ID NO: 37262 - DNA, 201 bp, Homo sapiens; identical to SEQ ID NO: 8225

SEQ ID NO: 37263 - DNA, 201 bp, Homo sapiens
aatcgcttgaacgtgggaggcagagcttgcagtgagctgagattacaccactgcactccagcctgggcgacagagagactccgtctcaaaaataaaaaaaagaaaaagaaaaagacagcttagattgtgcctgatgcatagtaggtgttcaaaaaaagtttttggattttttcgttgtttgtttttagagacagggtctgg

SEQ ID NO: 37264 - DNA, 201 bp, Homo sapiens
ggcaggaaaatcgcttgaacgtgggaggcagagcttgcagtgagctgagattacaccactgcactccagcctgggcgacagagagactccgtctcaaaaawaaaaaaaagaaaaagaaaaagacagcttagattgtgcctgatgcatagtaggtgttcaaaaaaagtttttggattttttcgttgtttgtttttagagaca

SEQ ID NO: 37265 - DNA, 201 bp, Homo sapiens; identical to SEQ ID NO: 8234

SEQ ID NO: 37266 - DNA, 201 bp, Homo sapiens
gggagaatcgctttaacccaggaggcagaggctgcagtgagatcttgcctttgcactccagcctgggtgacaaagtgagactctgtctcaaaaaaaaaaaraaaaaaaaaaaaaaatgtcgggcaccatggctcatgcctgcctgtaatcccagcactttgggaagctgaggtgggtggatcaggagttcgagaccagcct

SEQ ID NO: 37267 - DNA, 201 bp, Homo sapiens
aggctgaggtgggcgaatcccttgaggtcaggagttcgagaccagcgtggacaaaatggtgaaaccccctctctattaaaaatacaaaaattaggcaggtktggtggcatgtgcctgtaatctcacctactcagggggctaaggtgggagaatcgctttaacccaggaggcagaggctgcagtgagatcttgcctttgcac

SEQ ID NO: 37268 - DNA, 201 bp, Homo sapiens
ttatgaaaggcctacctaaagttctgttctggaatccagcagccaatagtctaggacagggattggaatgtgagatagatttatttgttcatttatttatytgagacagagtctcgctctatcacccaggctggactgcaatggcatgatcttggcttactgcaacctctacctccagggttcaagtgattctcctgcctt

SEQ ID NO: 37269 - DNA, 201 bp, Homo sapiens
cacctggcccagcgccacggggtggacctggaaggtaggaaccgggcagagggaattaaggaggtccttatacatttgtccaaaaaaaaaaaaaaaaaaamccacaaatcaggtgtgtctcttcacgtctttttcccaccaaatatggactaaaatccaaacccctcaccatggcctcatctgttgccaagctcttatttg

SEQ ID NO: 37270 - DNA, 201 bp, Homo sapiens
tgggggaccagatgctgaatgcgacagtcatgaaccacggggacacgctaacggccacagccacagccacggcgcgcgcggatcaggagggtgcccgggaratcgtctgcaacgtgaccctagggggcgagagacgggaggcccgggagaacttgacggtctttagtaagaggaggcgtgggaagggggcgcggcctcagc

SEQ ID NO: 37271 - DNA, 201 bp, Homo sapiens
gctgtctttacccacttattcaacatttattgagcaactgtgtgtgctaggacccaatgaggaccctcagtggtgaacagaacaaagatccctgctctacyggggctgatgttctaggagacagtaaaaaaaaaaaaaaaaaaaactcagaggcaggacgcggtgcctcatgcctgtaatcccagcattttggaaggctaa

SEQ ID NO: 37272 - DNA, 201 bp, Homo sapiens
aggctgaggcaggagaatcacttgaacctgggaggcagaggttgcattgagccgagatcataccattgcactccagcctgggcaaagagagcgaaactccmcctcaaaaaaaaaaaaaaaaaaaaattagccaggtgtggtggtgcgcacatgtagtcccagctactcgggaggctggggtgggaggatcgcttgagccgg

SEQ ID NO: 37273 - DNA, 201 bp, Homo sapiens; identical to SEQ ID NO: 8209

SEQ ID NO: 37274 - DNA, 201 bp, Homo sapiens
gtctgtactaaaaatacaaaaattagctgggcgtggtgtcgcgcgcctgtagtcccagctgcttgggaggctgaggctcaagaattgcttgaacccgggargtggaggttgtagtgagctgagatgacaccactacactccagcctgggcaacagagcgagactccatctgcaaaaataataataataataataataatat

SEQ ID NO: 37275 - DNA, 201 bp, Homo sapiens
ctggagctcaggagaccctcggtcaccatggctgatgggacagtgatagagttggagtgtggcgggcactggggaaccctgtgcctgtctgcccaggatcsgccgtgccctggagttggggtgtgtctgccaagactctgggccacacctgtctgcttccctgggcccccctgcccccatctgcaactgtctgtgctctgt

SEQ ID NO: 37276 - DNA, 201 bp, Homo sapiens
ggaccctgggttcgagggggtgactctgaagtttcagataaagccggactccagcctgcagatcatccccacgtacaggtaggggccggctggggccaggycgccctttctcccagttacaacgcaaacaccagtgtgggaggtaggggtgctctctggcgtcggtgtggaccctcacctgtgctctacgttacacgtggc

SEQ ID NO: 37277 - DNA, 201 bp, Homo sapiens
gacggggtgttccgcccacatcagcctctcaaagtgctgggattacaagtgtgagccactgcgcctggccccaacaataatcccaacactttgggaggccraggcaggaggattgcttgagtccggaaatttaagaccaggcagagcaatatagggacaccccgtctctacaaaaataaataaaaaatattagctgggcat

SEQ ID NO: 37278 - DNA, 201 bp, Homo sapiens; identical to SEQ ID NO: 8212

SEQ ID NO: 37279 - DNA, 201 bp, Homo sapiens
acttattcaacatttattgagcaactgtgtgtgctaggacccaatgaggaccctcagtggtgaacagaacaaagatccctgctctactggggctgatgttytaggagacagtaaaaaaaaaaaaaaaaaaaactcagaggcaggacgcggtgcctcatgcctgtaatcccagcattttggaaggctaaggcaggcggactg

SEQ ID NO: 37280 - DNA, 201 bp, Homo sapiens; identical to SEQ ID NO: 8216

SEQ ID NO: 37281 - DNA, 201 bp, Homo sapiens
cctgcagatcatccccacgtacaggtaggggccggctggggccaggccgccctttctcccagttacaacgcaaacaccagtgtgggaggtaggggtgctcyctggcgtcggtgtggaccctcacctgtgctctacgttacacgtggcccagtctctggttgacaacttgagctggtgccagatacagtcctgccgctcctg

SEQ ID NO: 37282 - DNA, 201 bp, Homo sapiens
aggatcacttgagccctggaggtcaagactgcagtgaaccgtgatcgtaccactgtactccagcctgggtaatagagggagacttggggaaaaaaaaaaaagtagggtgggcatggtccttgctgtgggcgtgagtgagccacaaagccacacacccttatgagatcctctttgtctctcctgggcagccctgaatgggag

SEQ ID NO: 37283 - DNA, 201 bp, Homo sapiens
ccaggtccctctggcctgcatgccaggagtcggtcaccgccctgtgcttcctccaagagacagtggagaggctgggtcagtcccctgcccaggacaccccrgtcctggggccttgctgggacccgatggctctggggactcagggccgcctgctgctggacagggattccaaggacacacagaccaggatcagccaaaagg

SEQ ID NO: 37284 - DNA, 201 bp, Homo sapiens
gaggcgggcggatcacctgaggtcaggagtttgagactagcctggtcaacatggtgaaaccccgtctctactaaaaatgcaaaaaattagctgggtgtggkggtgcatgcctgtaatcccagctacttgggaagttgaggcgggagaatcacttgaacctgggaggcagaggttgcagtgagcccagactatgccactgca

SEQ ID NO: 37285 - DNA, 201 bp, Homo sapiens
ctgctacctgcacctttgctgcccgggcattcagcaagtgccggtgcccagcccaaccacttcccttagcactgctacctggcttggccactgtctggaaygagagcccttccttccccacccgttgctgattatctcttttttttttttttttttgagatggagttttgctcttgttgcccaggctggagtgcagtggcg

SEQ ID NO: 37286 - DNA, 201 bp, Homo sapiens
cattcagcagcccccaccatcctccccacttccagttcctggaatgggagctgcctcccccaccactaccccctgcgctcagtcagcttcctccctccccsacctctggccccccacccacccagctagcttgccctcggctaacactgcccgtgtcaccaccctagggaagacgacatgctagacatggcccccctcctc

SEQ ID NO: 37287 - DNA, 201 bp, Homo sapiens
aggtggaggttgtagtgagctgagatgacaccactacactccagcctgggcaacagagcgagactccatctgcaaaaataataataataataataataatwttactaatgagaggcaaagccaggccattcagatattagttgcctcctcgggggatggctgataccttgatactaaatcttcatttcggagggctgttgg

SEQ ID NO: 37288 - DNA, 201 bp, Homo sapiens
gtgtcgcgcgcctgtagtcccagctgcttgggaggctgaggctcaagaattgcttgaacccgggaggtggaggttgtagtgagctgagatgacaccactayactccagcctgggcaacagagcgagactccatctgcaaaaataataataataataataataatattactaatgagaggcaaagccaggccattcagatat

SEQ ID NO: 37289 - DNA, 201 bp, Homo sapiens
tggggcgcccggggcgggcagcgttaatccgtcagatgccggcggggcggggctcggcgcagccgctcaccgaaccgtgttttccaggctcgcgcccggckggagaggaggacgcgggcggcccggagcggcccggggacgtgtgagtgcagggggccaagtcccccattcctcatcccacggaattcctctggtccccat

SEQ ID NO: 37290 - DNA, 201 bp, Homo sapiens
gcttgaactcaggaggtgaagtcttcagtaagcagagatagcgccacctcactccagcctgagccacagagtgggactcagtctcaaaaaaaaaaaaaaaactagctgggaatggtaatgggcacctgtaatcccagctacttgggaggctgaggcaggagaatcgcttgaacccaggaggtggaggttgcactgagcaga

SEQ ID NO: 37291 - DNA, 201 bp, Homo sapiens; identical to SEQ ID NO: 8226

SEQ ID NO: 37292 - DNA, 201 bp, Homo sapiens
aggcgggcggatcacgaggtcaggagatagagaccatcctggctaaaatggtgaaaccccgtctctaataaaaatacaaaaaattaggtgggcgtggtggygggcgcctgtagtcccagctactcgggaggctgaggcaggagaatggcatgaacccgggaggtggagcttgcagtgagccaagatcacgccactgcactc

SEQ ID NO: 37293 - DNA, 201 bp, Homo sapiens
agctctactaaaaaaatataaaaaaattagccaggcgtggtggcaggcacctgtagtcccagctacttgggaggctgaggcaggagaatggcgtgaacccrggaggcagagcttgcagtgagccgagatcgtgccactgcactccagcctgggcaacagaacaagactccatctcaaaaaaaaaaaaaacaaaatcctaat

SEQ ID NO: 37294 - DNA, 201 bp, Homo sapiens
ggaagccaccacccctgctgccatccgtgcttggccctgctgggggtgaccgggaggccctgggcttgggtcccccagcggcccagctcactcctcccccmgcccctgtggggctccgaggctctggcctcagaggcctccagaaagacagtgggcctctgccgacgccccctggggtaaggccctgccctgcgcgcggca

SEQ ID NO: 37295 - DNA, 201 bp, Homo sapiens
acctggcccagcgccacggggtggacctggaaggtaggaaccgggcagagggaattaaggaggtccttatacatttgtccaaaaaaaaaaaaaaaaaaaamcacaaatcaggtgtgtctcttcacgtctttttcccaccaaatatggactaaaatccaaacccctcaccatggcctcatctgttgccaagctcttatttgt

SEQ ID NO: 37296 - DNA, 201 bp, Homo sapiens
ggcaacagagtgagaccctgtctcaaaaaaaaaaaaaaaaaaaatcctggccgggtgcagtggcttacgcctgtaatcccagcactttgggaagctgaggygggcagatcatgaggtcaggagatcaagaccatcctggctaacatggtgaaaccccagctctactaaaaaaatataaaaaaattagccaggcgtggtggc

SEQ ID NO: 37297 - DNA, 201 bp, Homo sapiens
aatatatatttcatatataatataaaatataatttatgttttatactaaaaatacaaaattagccaggtgtggtagacatgcctgtaatcccagttactarggaggctgaggcaggagaatcacttgaacctgggaggcggaggttgtggtgagccaagattgtgccattacactccagcctgggcaacaagagcaaaact

SEQ ID NO: 37298 - DNA, 201 bp, Homo sapiens
ccatggcactccaggctgggcaacagagtgagaccctgtctcaaaaaaaaaaaaaaaaaaaatcctggccgggtgcagtggcttacgcctgtaatcccagsactttgggaagctgaggcgggcagatcatgaggtcaggagatcaagaccatcctggctaacatggtgaaaccccagctctactaaaaaaatataaaaaaa

SEQ ID NO: 37299 - DNA, 201 bp, Homo sapiens
gggttcacgccattctcctgcctcagcctcccgagtagctgggaatacaggcgcctgccaccgcgcccggctaatttttttgtatttttagtagagacggrgtttcaccttgttagccaggatggtctcgatctcctgacctcgtgatccacccgcctcggcctcccaaagtgctgggattacaggcgtgagccaccgcgc

SEQ ID NO: 37300 - DNA, 201 bp, Homo sapiens
ccagcctgaccaacatggagaaattatatattataaaatatataataaaatatatatttcatatataatataaaatataatttatgttttatactaaaaawacaaaattagccaggtgtggtagacatgcctgtaatcccagttactagggaggctgaggcaggagaatcacttgaacctgggaggcggaggttgtggtga

SEQ ID NO: 37301 - DNA, 201 bp, Homo sapiens
gcttgagccgggaggttgaggcagtaagctatgactgagccatggcactccaggctgggcaacagagtgagaccctgtctcaaaaaaaaaaaaaaaaaaaatcctggccgggtgcagtggcttacgcctgtaatcccagcactttgggaagctgaggcgggcagatcatgaggtcaggagatcaagaccatcctggctaac

SEQ ID NO: 37302 - DNA, 201 bp, Homo sapiens
gcctataatcccagcactttgggaggccgaggcgggcagatcacctgaggtcaagagttcaagaccagcctgaccaacatggagaaattatatattataawatatataataaaatatatatttcatatataatataaaatataatttatgttttatactaaaaatacaaaattagccaggtgtggtagacatgcctgtaat

SEQ ID NO: 37303 - DNA, 201 bp, Homo sapiens
cgcttgagccgggaggttgaggcagtaagctatgactgagccatggcactccaggctgggcaacagagtgagaccctgtctcaaaaaaaaaaaaaaaaaaaatcctggccgggtgcagtggcttacgcctgtaatcccagcactttgggaagctgaggcgggcagatcatgaggtcaggagatcaagaccatcctggctaa

SEQ ID NO: 37304 - DNA, 201 bp, Homo sapiens
ctggagtgcagtggtgcgatcatagctcactgcagcctcaacctcttgggctcaagcgatcctcacacctcagtctcctgaggagctgggaccacaggcaygcacctccatgcccagctaatttttaaatttgtggtagagacggagtctcattgtgttgtccaggctggtctcaaactcctgacctcaagtgagccaccc

SEQ ID NO: 37305 - DNA, 201 bp, Homo sapiens
ttacaggcgtgagccaccacgtctggccataaacaggaatttttaatattcatatcatagtcataaacgttcatcccttccatcctcatttttttttattktgccatctttgagaacagaaagttttgtttagcgccttgcaaggtatctgacaacacaggaaatgataatcactgcgctaatgataatagcaaacgcttc

SEQ ID NO: 37306 - DNA, 201 bp, Homo sapiens
acctgggaggcagaggttgcattgagccgagatcataccattgcactccagcctgggcaaagagagcgaaactccacctcaaaaaaaaaaaaaaaaaaaaattagccaggtgtggtggtgcgcacatgtagtcccagctactcgggaggctggggtgggaggatcgcttgagccgggaggttgaggcagtaagctatgact

SEQ ID NO: 37307 - DNA, 201 bp, Homo sapiens
tcacccctgggcgccctccagcctggggcccagccagccaaccccctcctcggggagctgcctgcaggtaacgcagaccctgcccacacggtgtcccccarccacttccccttccttccctgctacgtggcctcgggtgagtgacccaacctctgggtcccagcgcccttgtccatcagttgggtgccctccactcagggc

SEQ ID NO: 37308 - DNA, 201 bp, Homo sapiens
tgcccagatgctcatgactgcctgccttcctccggcagctggcgtgcggccaggatgggcagctgaagggcttcgcggtgctggagtatgagacggctgakatggcggaggaggcacagcagcaggcggacggcctgtccctggggggcagccacctgcgagtctccttctgcgcccctgggccccccggccgcagtatgc

SEQ ID NO: 37309 - DNA, 201 bp, Homo sapiens
cgcactgccctcctcccaccgcagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggccct

SEQ ID NO: 37310 - DNA, 201 bp, Homo sapiens
gatctcttgatcttgtgacccgcctgcctcagcctccaaagtgctggaattacaggcgtgagcccggcctctttttttttttttttttttgttgttgttawttttttttttttttttttttttttttgagacggagtctcgctctgtcgcccaggctggactgcggactgcagtggcgcaatctcggctcactgcaagctc

SEQ ID NO: 37311 - DNA, 201 bp, Homo sapiens
ggaaagcccccggccactgggcaaggtggccccggaagggaggcccgagccgtgggatctttgaagaaggccgttttcatggccctgtgtgtgtgtcctgygaagaagggtgacccagtcagcaagatatcctgactgggggggatgagggtgtcctggggaaggcacagtcctgggggttgtactatgcccacctttctc

SEQ ID NO: 37312 - DNA, 201 bp, Homo sapiens
cctgctaggagtgcccttctcatggggccagcatggggcagcgcttcccaatgctctttggacccagggaaatggcatctatactgccctgccctatggckgtgaaataggttctcgcttcctgctgctgagattccctgctctccggcccaccagcacaccgggtgggcacgtggctagtggaaccccagggatgttggg

SEQ ID NO: 37313 - DNA, 201 bp, Homo sapiens
atgcctgtaatcccagctactcgggaggctgaggcaggaaaatcgtttgaacccgggaggcagaggctgcagtgagccgagatcccgccactgcactccarcctgggtgacagagtgagactctgtctcaaaacaaacaaacaaaaaccaagtagaatcctggatagacagtggctcagggactcagctgtccccaaatca

SEQ ID NO: 37314 - DNA, 201 bp, Homo sapiens; identical to SEQ ID NO: 8210

SEQ ID NO: 37315 - DNA, 201 bp, Homo sapiens
ctcccgagtggctgagattacacatgcacgccaccacacccagcaaattttgtatttttagttgagatggcatttcaccatgttggccagtctggtcttgwactcctgacctcaggcgatccgcccacctcagcctcccaaagtgctgggattacaggcatgggccactgcgcccggccccaacaagcttttttttttttt

SEQ ID NO: 37316 - DNA, 201 bp, Homo sapiens
ctgatgcatagtaggtgttcaaaaaaagtttttggattttttcgttgtttgtttttagagacagggtctggttctgtcacctgggctggagcacaatgacratatcatagctggaagtggctttgacctcctaggctcaaaggatcctcctgcctcagcctcccaagtagctgggactacaggcatgcaccaccatgtctg

SEQ ID NO: 37317 - DNA, 201 bp, Homo sapiens
cactgggcctggtctcaccaaacatttgttgagcatctgatgagtagcaggcgttgaagtgatgtcctccgaggagcccacctttaatgttaggtgacccrgctgaatggagggtgggcttgacagtgaagcagcttgaggttcacacatcagtccctcgacttaggaattgtgtggccttgatcactctgtgacccctct

SEQ ID NO: 37318 - DNA, 201 bp, Homo sapiens
aatcacccaggctggaggagtacactccggcctcgacctcctgggttcaagaaatcctcctaccttggcctcccatgtagctggggaactacaggaatgcrtcaccatgcccagctgatttttaaaattttatgtagaggccgggcacagtggctcatgcctgtaatcccagcactttgggaggctgcggcgggcagatca

SEQ ID NO: 37319 - DNA, 201 bp, Homo sapiens
atgataatcactgcgctaatgataatagcaaacgcttcgactggcccagctctaagccctctaagtttattaactcaaagctcacagttctcggcaggacyaccctgtctcctccccagtccctggggtgagtgggtgggtttgcaggacccgctaagtgccatcctcccctcctctctcagggctcccggagcgtgtgga

SEQ ID NO: 37320 - DNA, 201 bp, Homo sapiens
tcccgccactgcactccagcctgggtgacagagtgagactctgtctcaaaacaaacaaacaaaaaccaagtagaatcctggatagacagtggctcagggamtcagctgtccccaaatcacctaccttagctctttgtgcaggggatgggggatccccaagatcttcaaagatagggaggtatcctcaagatcttcaaaggt

SEQ ID NO: 37321 - DNA, 201 bp, Homo sapiens
agctcaggagaccctcggtcaccatggctgatgggacagtgatagagttggagtgtggcgggcactggggaaccctgtgcctgtctgcccaggatcggccrtgccctggagttggggtgtgtctgccaagactctgggccacacctgtctgcttccctgggcccccctgcccccatctgcaactgtctgtgctctgtccct

SEQ ID NO: 37322 - DNA, 201 bp, Homo sapiens
aacctgggaggcagaggttgcattgagccgagatcataccattgcactccagcctgggcaaagagagcgaaactccacctcaaaaaaaaaaaaaaaaaaaaattagccaggtgtggtggtgcgcacatgtagtcccagctactcgggaggctggggtgggaggatcgcttgagccgggaggttgaggcagtaagctatgac

SEQ ID NO: 37323 - DNA, 201 bp, Homo sapiens
ttcttttcttttctttttttttttttttgagacagagtctcactctgtcccccaggctagagtgcagtggcgcaatcttggctcactgcaacctctgcctyccgggttcaagcgattctcctgcctcagcctcctgagtagctgggattacaggcgcatgccaacacgcccagctaatttttgtatttttagtagggacag

SEQ ID NO: 37324 - DNA, 201 bp, Homo sapiens
gggatgaatatatcagggatcctgattttatcattaaaggggaagatatgttgggaggggttatgaaaggcctacctaaagttctgttctggaatccagcrgccaatagtctaggacagggattggaatgtgagatagatttatttgttcatttatttatctgagacagagtctcgctctatcacccaggctggactgcaa

SEQ ID NO: 37325 - DNA, 201 bp, Homo sapiens
agctctttggaggccgagacggacggatcacctgaggtcaggagtttgagaccagcctgacaaacatggagaaatcccgtctctactaaaaatacaacaamaaaaaaaaggtagccaggcatggcgccacgcgcctgtaatctcagctactcaggaggctgagacaggagaattgcttgaacccagaagactgcggttgcg

SEQ ID NO: 37326 - DNA, 201 bp, Homo sapiens
ggtgcaggcctgtaatcccagctactcaggaggctgaggcaggagaatcgcttgtacctgggaggtggaggttgcagtgagctgagatcacgccactgtaytccagcctgggtgacaaagcaacactgcatctcaaaaacagaaaaaaaaaaaaaaaaaaaaaacaggccaggcgcagtggctcacgcttgtaatgccagc

SEQ ID NO: 37327 - DNA, 201 bp, Homo sapiens
ttacaggcatgagtcaccttgcccagcctttttttttttttttttttttttgacatagagtctctctctgtcgccaggctggagtgcagtggcactatctmagctcactgcaaattttgcctcctgggttcaagcgattcttgtgcctcagcctcctgagtagctgggattacaggcacgtgctaccatgcctggctaatt

SEQ ID NO: 37328 - DNA, 201 bp, Homo sapiens
agagacaaggtttcaccatgttggccaggctggtctcgaactcctgacctcaggtgattcacccgcctcggcctcccaaaatgctgggattataagcgtgrgccaccccgcccagccagctaaaggtataccctctaagagcatgttgcctgggtaatagcacagtctgcagctaggttctgaatcccatctctgccaggt

SEQ ID NO: 37329 - DNA, 201 bp, Homo sapiens
tcttgtgacccgcctgcctcagcctccaaagtgctggaattacaggcgtgagcccggcctctttttttttttttttttttgttgttgttattttttttttwttttttttttttttttgagacggagtctcgctctgtcgcccaggctggactgcggactgcagtggcgcaatctcggctcactgcaagctctgcttcccgg

SEQ ID NO: 37330 - DNA, 201 bp, Homo sapiens
acctcgtgatctgcccgcctcagcctcccaaagtgctaggattacaggcgtgagctaccacacctggcccagaaatacttctttatcagaaatattactgrcgggtgtagcagggcacgcctataatcccagcactttgggaggtcgaggcaggcagatcccttaagcttaggagttcaagaccaacctgggcaatatggt

SEQ ID NO: 37331 - DNA, 201 bp, Homo sapiens
cgatctcttgatcttgtgacccgcctgcctcagcctccaaagtgctggaattacaggcgtgagcccggcctctttttttttttttttttttgttgttgttrtttttttttttttttttttttttttttgagacggagtctcgctctgtcgcccaggctggactgcggactgcagtggcgcaatctcggctcactgcaagct

SEQ ID NO: 37332 - DNA, 201 bp, Homo sapiens
tctcggctcactgcaagctccgccttctgggttcacgccattctcctgcctcagcctcccgagtagctgggactacaggcacctgccaccatttttttttktatttttagtagagacggggctaatttttttttgtatttttagtagagatggggtttcaccgtgttaaccaggatggtctcgatctccttacctcgtgat

SEQ ID NO: 37333 - DNA, 201 bp, Homo sapiens
tactaaaaatgcaaaaaattagctgggtgtggtggtgcatgcctgtaatcccagctacttgggaagttgaggcgggagaatcacttgaacctgggaggcaraggttgcagtgagcccagactatgccactgcactccagcctgggtgacagactgagaccctgtctcaaaaaaaaaaaaaaaatcagctggagcttaaatt

SEQ ID NO: 37334 - DNA, 201 bp, Homo sapiens
gggcgttgtagtgggtgcctgtaatcccagctgctcaggaggctgaggcaggagaatcgcttgaactcaggaggtgaagtcttcagtaagcagagatagcrccacctcactccagcctgagccacagagtgggactcagtctcaaaaaaaaaaaaaaaactagctgggaatggtaatgggcacctgtaatcccagctactt

SEQ ID NO: 37335 - DNA, 201 bp, Homo sapiens
aagactccatctcaaaaaaaaaaaaaacaaaatcctaatgcctgattccttcccccaccacactgactgctgagtcagccggtccatcctccaagagcagyggagaggtggggacacattagcccagcacagtgatagggtcacagcaagggctcacagactgcggggagcctgcctggcctttcccctctcagctacctg

SEQ ID NO: 37336 - DNA, 201 bp, Homo sapiens
tgaacccgggaggcagagcttgcagtgagccgagatcgtgccactgcactccagcctgggcaacagaacaagactccatctcaaaaaaaaaaaaaacaaaatcctaatgcctgattccttcccccaccacactgactgctgagtcagccggtccatcctccaagagcagtggagaggtggggacacattagcccagcacag

SEQ ID NO: 37337 - DNA, 201 bp, Homo sapiens
ggcgtgaacccgggaggcagagcttgcagtgagccgagatcgtgccactgcactccagcctgggcaacagaacaagactccatctcaaaaaaaaaaaaaamaaaatcctaatgcctgattccttcccccaccacactgactgctgagtcagccggtccatcctccaagagcagtggagaggtggggacacattagcccagc

SEQ ID NO: 37338 - DNA, 201 bp, Homo sapiens
gaccccaggatgctgcagaatcagtgagaggtgcgtaaggccaaaccccattccccggaccccgctagcacttcaccacctggctcagtgatcaaggggtyatgacctctctttgctggggttatcgagaagtggcaattttataatagttactgaaacttacaaagaggttctggtgcccagagacacttggggtcatct

SEQ ID NO: 37339 - DNA, 201 bp, Homo sapiens; identical to SEQ ID NO: 8217

SEQ ID NO: 37340 - DNA, 201 bp, Homo sapiens
gtaacagatgtttgataatttgttgagagaaaaataataatagaaatttcttgtccaggcacagtggctcatgcctgtaatcccaacactttgggaggccraggcaggcgactcacttgaggacaggagtttgagactagtctggccaacatggcgaaaccctgtctctacaagaaacacaaaaattagctgggcgtggtg

SEQ ID NO: 37341 - DNA, 201 bp, Homo sapiens
cccatgtccttattcatgcttatctgttgcctgtcaagatgtaacagatgtttgataatttgttgagagaaaaataataatagaaatttcttgtccaggcrcagtggctcatgcctgtaatcccaacactttgggaggccgaggcaggcgactcacttgaggacaggagtttgagactagtctggccaacatggcgaaacc

SEQ ID NO: 37342 - DNA, 201 bp, Homo sapiens; identical to SEQ ID NO: 8221

SEQ ID NO: 37343 - DNA, 201 bp, Homo sapiens
tttttagtagagacggggtgttccgcccacatcagcctctcaaagtgctgggattacaagtgtgagccactgcgcctggccccaacaataatcccaacacyttgggaggccaaggcaggaggattgcttgagtccggaaatttaagaccaggcagagcaatatagggacaccccgtctctacaaaaataaataaaaaatat

SEQ ID NO: 37344 - DNA, 201 bp, Homo sapiens
taagatctccctaatccagccaaaatgtgtctcccgggcctgaagtcaaaagccccaagtcagaggcatctttcagcaggcgggacacacaggccaccagyactcacagggagggagggaggatggagagtcaagactggtggcgggctgggcatggtggctcacacctgtaatcccaacacttcagaaggcagaggtggg

SEQ ID NO: 37345 - DNA, 201 bp, Homo sapiens
gtctcaaactcctggcctcaaatgatctgcccgccttggcctcccaaagtgctgggattataagcgtgagccaccatgcctggcctactttttgacttttyttttctttgagacgcagtcttgctattgtcccccatgctggagtacaatggcgcgatgtcagctcattgcaacctccgcctcctgggttcaagtgattct

SEQ ID NO: 37346 - DNA, 201 bp, Homo sapiens
gttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaacctctgcctcc

SEQ ID NO: 37347 - DNA, 201 bp, Homo sapiens
ggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaacctctgcctc

SEQ ID NO: 37348 - DNA, 201 bp, Homo sapiens
tgttgcctaggttggtctcaaactcctgggctcaggcaatcctcccacttcagtctctccagtagctgggattgcaggcctgagccactgtacctggctayttttttttttcttttcttttctttttttttttttttgagacagagtctcactctgtcccccaggctagagtgcagtggcgcaatcttggctcactgcaac

SEQ ID NO: 37349 - DNA, 201 bp, Homo sapiens
atgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaa

SEQ ID NO: 37350 - DNA, 201 bp, Homo sapiens
tgctgctttctcttggacacctgctacgtaccaggcctgctatgtaccaggccgcctgtgcgggctcaggacagaagatgagttagcacaatggcctcacytttcttttattttattttatatttttttaagacagagtcttgctctgtcacccagtctggagtgcaggggcgcgatcttggctcactgcatcctccgcct

SEQ ID NO: 37351 - DNA, 201 bp, Homo sapiens
ctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgc

SEQ ID NO: 37352 - DNA, 201 bp, Homo sapiens
cctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactg

SEQ ID NO: 37353 - DNA, 201 bp, Homo sapiens
cagtggtgcaatctcggctcactgcgacctctgcctcccaggtccagctaatgcccagctaagttttgtatttttagtagagacggggtgttccgcccacmtcagcctctcaaagtgctgggattacaagtgtgagccactgcgcctggccccaacaataatcccaacactttgggaggccaaggcaggaggattgcttga

SEQ ID NO: 37354 - DNA, 201 bp, Homo sapiens
gaggctgaggcaggagaatcgcttgaacctgggaggcggagggaagattgtatacaaagggctgggtactacaattgtctgcttcactccaccggcccttyttctacagatgtcccccccgcccagtggcttcggcgaacggagcagcggtgggagtggcgggggccccctgtctcacttctattcaggctcgcccacttc

SEQ ID NO: 37355 - DNA, 201 bp, Homo sapiens
ccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcact

SEQ ID NO: 37356 - DNA, 201 bp, Homo sapiens
gatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggc

SEQ ID NO: 37357 - DNA, 201 bp, Homo sapiens
ggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttgg

SEQ ID NO: 37358 - DNA, 201 bp, Homo sapiens
attctacctttcccactggaccatgaaggcaggaacccttctgtctcggcacaaggagagaggtgttaaatggtggggcctgttgatgcgtgggttggggracaaggaaacaaacaccaggacttcttcatgttcctgaaggtgtccaggggcaggagttccttttgcgggtggagccccagaaccctgtgctctctgctg

SEQ ID NO: 37359 - DNA, 201 bp, Homo sapiens
caagccacaatgccaggctgttttgtttcctactttgtcatctgtcccccagtgagattggtgacccatgtccttattcatgcttatctgttgcctgtcargatgtaacagatgtttgataatttgttgagagaaaaataataatagaaatttcttgtccaggcacagtggctcatgcctgtaatcccaacactttgggag

SEQ ID NO: 37360 - DNA, 201 bp, Homo sapiens
cagcgccacggggtggacctggaaggtaggaaccgggcagagggaattaaggaggtccttatacatttgtccaaaaaaaaaaaaaaaaaaaaccacaaatyaggtgtgtctcttcacgtctttttcccaccaaatatggactaaaatccaaacccctcaccatggcctcatctgttgccaagctcttatttgttaagcatt

SEQ ID NO: 37361 - DNA, 201 bp, Homo sapiens
gactgtgccggagtatcttgagaggctgccacagggctggtgaaccaggaaagccctgagtgtctgaacctgattggagagaactgaataatcctgacctyttgatccacccaccccggcctcccaaagctctgggattacaggcgtgagccaccacgtctggccataaacaggaatttttaatattcatatcatagtcat

SEQ ID NO: 37362 - DNA, 201 bp, Homo sapiens
caggaagccttccctgactcacctcctcctatgctggatcagagcctcttctggcctccttctgagttctccccggtctctgatggattctacctttcccmctggaccatgaaggcaggaacccttctgtctcggcacaaggagagaggtgttaaatggtggggcctgttgatgcgtgggttgggggacaaggaaacaaac

SEQ ID NO: 37363 - DNA, 201 bp, Homo sapiens; identical to SEQ ID NO: 8213

SEQ ID NO: 37364 - DNA, 201 bp, Homo sapiens
tggccaagcacaggccccctgggacagctaggatttgggggtgcctgccaccggggctctgtaaccctcggtgcccaggccaaagctggggtggtggcagrggttggtcttgctcagggtggagtagcaacagcctattgtcctccatccactctgcatcaagcacctagcactgccagcattccgggctttctgtcactt

SEQ ID NO: 37365 - DNA, 201 bp, Homo sapiens
ctactaaaaatacaaaaaattagctgggcatggtggcgcatgcctgtaatcccagctactcgggaggctgaggcaggagaatcgcttgaacctgggaggcrgagggaagattgtatacaaagggctgggtactacaattgtctgcttcactccaccggcccttcttctacagatgtcccccccgcccagtggcttcggcga

SEQ ID NO: 37366 - DNA, 201 bp, Homo sapiens
tgccactctatggggcagtgggcggtccccggcactcacctgggtctcagtgagctatgtggcctcacatatttggcgtccacaggctggaacagtttctstgtgcccattcgtgcggtgatgatccctgggttcctggaggaggaagaggaggcgggtacccacgtgccagctctcctcagtcctattagccaaagctag

SEQ ID NO: 37367 - DNA, 201 bp, Homo sapiens
gtgcccgggagatcgtctgcaacgtgaccctagggggcgagagacgggaggcccgggagaacttgacggtctttagtaagaggaggcgtgggaagggggcrcggcctcagcagtctgggggcgtggcagagggggcggagactagccgaaaaggtggggcctggcttgccccaatagcagttgcaacgtgggttgggcctg

SEQ ID NO: 37368 - DNA, 201 bp, Homo sapiens
gtacttatcagtgccaagcgtccagctcacgaggcaaatacaccctggtcgtggtgatggacattgagggtgagctaatacggggctgcgggtctggaccsgtaagccggggggcgggggggttggagacagaagggacgcatattgacttagcgctttctctgcacagctgggagctcccactttgtccccgtcttcgtg

SEQ ID NO: 37369 - DNA, 201 bp, Homo sapiens
tgccctattcagtacctgtgcgtcaagcctcaattcctacttcctaaccctagattctacccgggccctgagcccatcatccagttcggcattcgcacttycatctgtccccagggtgaacgtggtgttcgtagaccgctcaggccagcggatcccagtgagtggcagagtcggggacaatgttcttcacctggcccagcg

SEQ ID NO: 37370 - DNA, 201 bp, Homo sapiens
ggcacctggtggaacagacctgggggcacttccgggtcgggggagggggtggcgctggggacaaccagaaagtttcaagcgacaggtacctggggcgcccrgggcgggcagcgttaatccgtcagatgccggcggggcggggctcggcgcagccgctcaccgaaccgtgttttccaggctcgcgcccggctggagaggagg

SEQ ID NO: 37371 - DNA, 201 bp, Homo sapiens
gctcaaatactgttttgtggacaaatacaaagggacaggtttgtggggccatggggcgggccagggcagggagtgaccatccctgaagatgggagggcctrgctcactgtctgctgctctgagcttcaggcccagtattgccccccaggccaacatggcaggttgccccaatctgcctgtcatcctgtcatcttgggacag

SEQ ID NO: 37372 - DNA, 201 bp, Homo sapiens
caggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatctt

SEQ ID NO: 37373 - DNA, 201 bp, Homo sapiens
acaggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatct

SEQ ID NO: 37374 - DNA, 201 bp, Homo sapiens
ttcgtcaacgtaacacataatggtacttatcagtgccaagcgtccagctcacgaggcaaatacaccctggtcgtggtgatggacattgagggtgagctaayacggggctgcgggtctggaccggtaagccggggggcgggggggttggagacagaagggacgcatattgacttagcgctttctctgcacagctgggagctc

SEQ ID NO: 37375 - DNA, 201 bp, Homo sapiens
gacaggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatc

SEQ ID NO: 37376 - DNA, 201 bp, Homo sapiens
gatcacctgagcctgggaggtcaaggttgcagtgagccatgattatgtcactgcattccagcctgggagacagagccagaccctgtctcaggaagaagaaraaaaaaaaaaaagccaaatctttttatcccaggatgtctgaaaaggacagagtctatggagcatggatgcagaaaagtagttattcctaccagaaaaaaa

SEQ ID NO: 37377 - DNA, 201 bp, Homo sapiens
gccagtcacccctgcttgtgtggtctttttttttttttttttgagatggagtcttgctctgtcgccaggctggagtgcagtggcgcgagctcggctcgctrcaacctccgcctcctgggttcagcccattcccctgcttcagcctcccgagtagctgggattacaggcatgtgccaccatgcccggctaatttttgtattt

SEQ ID NO: 37378 - DNA, 201 bp, Homo sapiens
tactctgtagcccaggctggagtgcagtggtgcaatctcggctcactgcgacctctgcctcccaggtccagctaatgcccagctaagttttgtatttttaktagagacggggtgttccgcccacatcagcctctcaaagtgctgggattacaagtgtgagccactgcgcctggccccaacaataatcccaacactttggga

SEQ ID NO: 37379 - DNA, 201 bp, Homo sapiens
gtttcgggctgcaatggtccccgcttccaggaagccttccctgactcacctcctcctatgctggatcagagcctcttctggcctccttctgagttctcccyggtctctgatggattctacctttcccactggaccatgaaggcaggaacccttctgtctcggcacaaggagagaggtgttaaatggtggggcctgttgatg

SEQ ID NO: 37380 - DNA, 201 bp, Homo sapiens
ctctggagctcagatgtgaagcccagaaggcaggtcagaggcctgaggtcagaggcaggtcaaaggtgggggtcccacctggtccccttggcgccttcccytggaatgcagtgaccagctgcctggaagggtgggcaaggggacaacaggatggggtaaaggccagttacaagtagaatcctggaaggccgggcgcagtgg

SEQ ID NO: 37381 - DNA, 201 bp, Homo sapiens
gtcctgttggggaattgtgaatgggctggtacattggaccaccagttgccccctgcttggatgatgcttttctccacccactctaccacagggtggcgggrcctcacatccagaagtttcaggactgcggagagtacgcccctccatatcacgcgtttattcactgctctcagagataaatccggaagttaacagcagccc

SEQ ID NO: 37382 - DNA, 201 bp, Homo sapiens
cttgtatctccacaggaagtacatgacctgctcagtgactatgagctcaaatactgttttgtggacaaatacaaagggacaggtttgtggggccatggggygggccagggcagggagtgaccatccctgaagatgggagggcctggctcactgtctgctgctctgagcttcaggcccagtattgccccccaggccaacatg

SEQ ID NO: 37383 - DNA, 201 bp, Homo sapiens
actggggaaccctgtgcctgtctgcccaggatcggccgtgccctggagttggggtgtgtctgccaagactctgggccacacctgtctgcttccctgggccmccctgcccccatctgcaactgtctgtgctctgtccctagaagcccggcatcctgggagactcacccctgggcgccctccagcctggggcccagccagcca

SEQ ID NO: 37384 - DNA, 201 bp, Homo sapiens
ggagcgccgctgctgggcaccagtttgtgaatagactctgctcggaagctctatagacatgcctgggaaaaaactccaggtctatcccctcagtgtgtgcrcacacacacacgcacacctagaaacacaggtatacatatagactcacacatacaaagatgcaaatatacacacagagacatagacacacaaagacataag

SEQ ID NO: 37385 - DNA, 201 bp, Homo sapiens
cactctcgaggtggacggcgagttcttgcacaggaacagtagcgtccagctgcgagtcctgtgtgagtcggtcaccctgacctttaatccctccacccctkccctggaaagattagacgctcctctgcaccactgtgcctcgggtgtgttgggtgtctgatcacacatggtggttccacagatggtcccaaaattgaccga

SEQ ID NO: 37386 - DNA, 201 bp, Homo sapiens
ggccccaacaagcattttttttttttttttgagacagagtttcgctctttttgcctaggctggagtgcagtggcacgatgtcggctcactgcaaccttcgmctcctgggttcaagtgattctcctgcctcagcctcccgagtggctgagattacacatgcacgccaccacacccagcaaattttgtatttttagttgagat

SEQ ID NO: 37387 - DNA, 201 bp, Homo sapiens
gatggtctcgatctcttgatcttgtgacccgcctgcctcagcctccaaagtgctggaattacaggcgtgagcccggcctctttttttttttttttttttgktgttgttatttttttttttttttttttttttttttgagacggagtctcgctctgtcgcccaggctggactgcggactgcagtggcgcaatctcggctcac

SEQ ID NO: 37388 - DNA, 201 bp, Homo sapiens
tgagtggcagagtcggggacaatgttcttcacctggcccagcgccacggggtggacctggaaggtaggaaccgggcagagggaattaaggaggtccttatmcatttgtccaaaaaaaaaaaaaaaaaaaaccacaaatcaggtgtgtctcttcacgtctttttcccaccaaatatggactaaaatccaaacccctcaccat

SEQ ID NO: 37389 - DNA, 201 bp, Homo sapiens
tcactgtggcctcaaactcctgggctcaagcaatcctcccactttggcctcccaaagtgctaggatcacaggcatgagccaccataccatgccaggcattktattacttcttgccactctatggggcagtgggcggtccccggcactcacctgggtctcagtgagctatgtggcctcacatatttggcgtccacaggctgg

SEQ ID NO: 37390 - DNA, 201 bp, Homo sapiens; identical to SEQ ID NO: 8214

SEQ ID NO: 37391 - DNA, 201 bp, Homo sapiens
ggctgggagcgccgctgctgggcaccagtttgtgaatagactctgctcggaagctctatagacatgcctgggaaaaaactccaggtctatcccctcagtgygtgcgcacacacacacgcacacctagaaacacaggtatacatatagactcacacatacaaagatgcaaatatacacacagagacatagacacacaaagac

SEQ ID NO: 37392 - DNA, 201 bp, Homo sapiens
agccttcaatctcagcaacgtgactggcaacagtcggatcctctgctcagtgtactgcaatggctcccagataacaggctcctctaacatcaccgtgtacrgtgagtcgacgtgtccggaggtgggactggtcttgggtagtggtgtgggcaagtggccaatggctcaggagagtggggaccctcagtttgcaaagaatgg

SEQ ID NO: 37393 - DNA, 201 bp, Homo sapiens
actgcgctggcctggccttaccttcttatgtggagatcaaaggtcacagggtcatgaccagctacaggtactctcctagcctgtttccacatctcaaaatrgggctggcagtgcttcatgatcaggttgttgtgaacagctgcccattcattcctccactcgaacattcactaaacttaattttttttttttttgagacag

SEQ ID NO: 37394 - DNA, 201 bp, Homo sapiens
tcgacgtgtccggaggtgggactggtcttgggtagtggtgtgggcaagtggccaatggctcaggagagtggggaccctcagtttgcaaagaatggaccacrgttctgacccagagctcagacctggacatttgtgtgtgagatacaaagatagacagagacagagacacagagacagagacagagatatagagacgcatct

SEQ ID NO: 37395 - DNA, 201 bp, Homo sapiens
ggtgggaggattgcctgattctgggagtccgaggctgcagtgagccatgatcgcaccacagcaccatgacactacagcctgagcaacagagctagaccctyatctcaaaaacagagagacagtcctgggctcggacccccagctctgtgggcttgagtgggtccctctcgtgtaagtggggtattggtgccccatttaaac

SEQ ID NO: 37396 - DNA, 201 bp, Homo sapiens
gaacaggccagactcactctctaagagcccccagaaggtcttgatccccagagatcccaaaggggacattcccccagcactcgctgtggactctgagtacrtaaccttcagttgcttcatcctgtagcaaccctgagaggcaggtatcactcccattttcaggtgaggataccaaggcacagaggggtcaagtaacttgcc

SEQ ID NO: 37397 - DNA, 201 bp, Homo sapiens
tcccctcctctctcagggctcccggagcgtgtggagctggcacccctgcctccttggcagccggtgggccagaacttcaccctgcgctgccaagtggaggrtgggtcgccccggaccagcctcacggtggtgctgcttcgctgggaggaggagctgagccggcagcccgcagtggaggagccagcggaggtcactgccact

SEQ ID NO: 37398 - DNA, 201 bp, Homo sapiens
gccaatggctcaggagagtggggaccctcagtttgcaaagaatggaccacagttctgacccagagctcagacctggacatttgtgtgtgagatacaaagayagacagagacagagacacagagacagagacagagatatagagacgcatctcaatctcatgccaaggcagcagttgtgaaatcaattaacttgggccccaa

SEQ ID NO: 37399 - DNA, 201 bp, Homo sapiens
atctcagcaacgtgactggcaacagtcggatcctctgctcagtgtactgcaatggctcccagataacaggctcctctaacatcaccgtgtacagtgagtcracgtgtccggaggtgggactggtcttgggtagtggtgtgggcaagtggccaatggctcaggagagtggggaccctcagtttgcaaagaatggaccacagt

SEQ ID NO: 37400 - DNA, 201 bp, Homo sapiens; identical to SEQ ID NO: 8231

SEQ ID NO: 37401 - DNA, 201 bp, Homo sapiens; identical to SEQ ID NO: 8230

SEQ ID NO: 37402 - DNA, 201 bp, Homo sapiens
tcctccataagcagggactcaatacttgcacaatgggttggcaaaacagtcccttgttcattcaagccacacatgccaggcacttctgtgtgtgtgcctcrccctgtaacaggtgcagtggggcgagaacaggccagactcactctctaagagcccccagaaggtcttgatccccagagatcccaaaggggacattccccc

SEQ ID NO: 37403 - DNA, 201 bp, Homo sapiens
tcaaggagaggtaatagtaaaagagatactattcaaaatcctgtcctccaaaattgttaaattctaattgccaaagaagtagagtaagtagaattctaccraagtaaaatgttcataatctattctcaaaaggagaaaaagcacaagccacaaaataatcttatcttggatgtttgtttctacacatacaaaactaaaaag

SEQ ID NO: 37404 - DNA, 201 bp, Homo sapiens; identical to SEQ ID NO: 33261

SEQ ID NO: 37405 - DNA, 201 bp, Homo sapiens
tcaaggggaaaaaaatgtcttggtctagaaaagttaattttgcacccaaatctagtgcctccatattaattcttacatagagaaatgtgactctgctgcakaaaacaaaaggtagtaaaacattaggaacatgatttcttgcatcataccacattaaaatttaaaggaaacaatgaggacttacagcgttctgccaagtca

SEQ ID NO: 37406 - DNA, 201 bp, Homo sapiens; identical to SEQ ID NO: 33266

SEQ ID NO: 37407 - DNA, 201 bp, Homo sapiens
atttctgaatttccagacaagatatttttctcagaacctagagacaggtccaaagtgacaactcctcccatttacccaggactgagtagcttcctgaaacrcaagacttttagttctaaattcagaaaagtcctgaggaagaaagaccaaagataggttttgagtacatagtgttgtgtggaagcccaaggccctgaccca

SEQ ID NO: 37408 - DNA, 201 bp, Homo sapiens
caaatcaatattgaatgtctacatgtatcaagttccaataaggacagatatgacctcacatcctttaggggaaaacagactttaaataaggaattgcagtrgtatttaacagatggaaagaagagtaaagtgctggagttcagaagaatagagcaagtctaggggtcagggagggctgtcctaggaaatgattcttcagct

SEQ ID NO: 37409 - DNA, 201 bp, Homo sapiens; identical to SEQ ID NO: 33269

SEQ ID NO: 37410 - DNA, 201 bp, Homo sapiens
cttcagaattatcccacctgagaggtgaaggagttggagtaattcatcattcgcttttcaggattcttggttgaaccacaaagaataatttccttggtacygcctgtctacctggagctgataacttggcttttcccagttctacaggaaagagccctcaggtacagagaggcagatcttagcaaggggagtacactgagc

SEQ ID NO: 37411 - DNA, 201 bp, Homo sapiens; identical to SEQ ID NO: 33271

SEQ ID NO: 37412 - DNA, 201 bp, Homo sapiens
gaaagaaaaccatttataagcaattaagctgttctgaagtggcactagatatacacaaggttctgctagaaccaccaccaagaacatcatgcaagcatttratgctttgagtggaaagctagcatcttaatacaggctcttccaaagcagaccctgagacaaagattcaagggaaagaattttatctgggaagtgcaggga

SEQ ID NO: 37413 - DNA, 201 bp, Homo sapiens
atttccagccatgtttctcctaggaagtatcagagactaactccagtatagtgggtctgtgtcacacatgcaacactccagagtgttgtatgtatgttgayaggtttgctaactggttttctccatgtcaaactgaaatttttaagcaacctcaggttagttctgtaagtttctgtcaaacatatttatgagatttatttg

SEQ ID NO: 37414 - DNA, 201 bp, Homo sapiens
gaaggattctttagttgttaggcagccggctgattaaattgatattcttataatgctatcatttaaagatatctcttgatcatccaataagtgttctatayggttctttgtcacatttataattttataacttcagttttctaacttcataatgtatagtttaattccctacatctacatcctatatttcactccatgttt

SEQ ID NO: 37415 - DNA, 201 bp, Homo sapiens
ttaaaatgaatgagacagtttgatatctcaaggagcttgtaatctcagggaaaggagaaggcttcacaaatattcaactagaatacaaaaataaataaacratatgaagaaataaaagcaaaacactatgagactatatagaaaaggaaataattaacacccacaaaagaagcagacttgtcaaagtcaatgaattgccta

SEQ ID NO: 37416 - DNA, 201 bp, Homo sapiens; identical to SEQ ID NO: 6270

SEQ ID NO: 37417 - DNA, 201 bp, Homo sapiens
attttgatttccctcacacctaaaaaaaaaaatttaattactaactgaaaatcttaattgccctccacttggaaccacagtgtatggattgagataaactytccagtgtgtttacagttccaattacagcacaccacaagccatccacaaataattatgtcctcctttagtggatattggtcactctttttagctgtccag

SEQ ID NO: 37418 - DNA, 201 bp, Homo sapiens
gaattgatccctttaccattatgtaatcgccttcttagtctcctttgatctttgttggttgaaagtctgttttatcagagagtaggattgcaacccctgcytttttttgttttccatttgcttggtagatcttcctccatccctttattttgagcctatgtgtgtctctgcacatgagatgcgtctcctgaatacagcaca

SEQ ID NO: 37419 - DNA, 201 bp, Homo sapiens
cctatgagtcagaactaaactgcacaaaacaaggagacacaaaagggtctgcattctaatctgcaggctctgcttgctatcctggaaaagctgcaaggaarctagccacgcgcgtacagaaggtgaaaacaagtcacctgtaaagcagaatgctaagcctgtgccactcgtccttctaagggtcatattccctgggtgtgg

SEQ ID NO: 37420 - DNA, 201 bp, Homo sapiens
tggagtttgcatatgtattttcaagatgaaacaaagtcattccaagaaacaaagaccttctctatgactttttccctttatcaaatcaaatctattattgkttcttataaactattatattttccttcagagaaaaatgcccccatagatctaggaatttacaaaatgcttatgaagagacaaaaacttcaattagtcatt

SEQ ID NO: 37421 - DNA, 201 bp, Homo sapiens
tgatcttcaatgtccatctccagaactgtgagaaataaatttctgttatttaaaagctacccagtgtaaagtattttgttatagcagcccaaatggactawgacaacacttaaaaacataaaaagcctcagcaaataaatagcatttcagcaaagaaacagaagatataaagaagaaccaaataaaaatattagaactaaa

SEQ ID NO: 37422 - DNA, 201 bp, Homo sapiens
gaataatgttagatatataaattgcctgatgtaaaagtttgaagaggaccagctttctaaaatgtacttgaaagcagcaaatgttcaaataatgtactttwctaagaggaatgcattagaagtgctctaccttttaaacaagatgcaacagacagtatcattatcacctgttagtctagattttgtaatggaagaactaat

SEQ ID NO: 37423 - DNA, 201 bp, Homo sapiens
ggccgaggcaggcggatcacaaagtcaggagctcgagaccatcctggctaacacagtgaaaccccatctctactaaaactacaaaaaaaaaaaaaaaaaaagtagccgggtgtggtggcaggcgcctgtagtccccgctactcgggaggctgaggcaagaaaatggcatgaacccaggaggtggagcttgcagtaagcaga

SEQ ID NO: 37424 - DNA, 201 bp, Homo sapiens
caaaagcaatggcaacaaaagccaaaatagataagtgggatctaattaaactacagagcttctgcacagctaaagaaactgtcatcagagtgaacaggcarcctacagaatgggagaaaattttgcaatctatccatctgaaaaagggctaatatccagaatctacaaagaacttaaacaaatttacaagaaaaaacagac

SEQ ID NO: 37425 - DNA, 201 bp, Homo sapiens
tctgtttactccttactcatcagttctaggtagcactcaggttgagagaatggtttttccagaatcatcgtttggcccagttgttaaactcacacctcaaragaaaaaaaaagcgtcaagagaactactcctttagtttttgtgcctgttcgcctgcctggcactataggtctcaaagaacacaattaagcccttttcatc

SEQ ID NO: 37426 - DNA, 201 bp, Homo sapiens
gcatgggcaaggacttcatgactaaaacaccaaaagcaatggcaacaaaagccaaaatagataagtgggatctaattaaactacagagcttctgcacagcwaaagaaactgtcatcagagtgaacaggcaacctacagaatgggagaaaattttgcaatctatccatctgaaaaagggctaatatccagaatctacaaaga

SEQ ID NO: 37427 - DNA, 201 bp, Homo sapiens
agcatttaccctatttgaacatggtttgaacagttagccccctttgattggccaaaactcagttattggcacaagtgtaggttacatctgtatacaactctgtttagtttgtacttcagtatgtacagggaaacctgtaggccaaacttaaaatatgtaagtagtcagctttaggcttaacttgatttagcatactcaata

SEQ ID NO: 37428 - DNA, 201 bp, Homo sapiens
cttgcacaagaattacttggatcatatcactaggttaagtagaaaaatgaaaatgggtcctgaataagcatataatacgatccaaattgttacttacatgytttgaatgccttaaaaataatgtacagggcatttgtttggcagtgtgcttttatttatttccttacttattcctgtttcttttgcagaatgccctggcta

SEQ ID NO: 37429 - DNA, 201 bp, Homo sapiens
taccattcaggacataggcatgggcaaggacttcatgactaaaacaccaaaagcaatggcaacaaaagccaaaatagataagtgggatctaattaaactamagagcttctgcacagctaaagaaactgtcatcagagtgaacaggcaacctacagaatgggagaaaattttgcaatctatccatctgaaaaagggctaata

SEQ ID NO: 37430 - DNA, 201 bp, Homo sapiens
cagcatttaccctatttgaacatggtttgaacagttagccccctttgattggccaaaactcagttattggcacaagtgtaggttacatctgtatacaactctgtttagtttgtacttcagtatgtacagggaaacctgtaggccaaacttaaaatatgtaagtagtcagctttaggcttaacttgatttagcatactcaat

SEQ ID NO: 37431 - DNA, 201 bp, Homo sapiens
aaatatcaagaatatacatctaagaaggtagagtaaataccatcatccactgaaacagagagaggtttactatgcaggtttcagtcaatattctctattaataatacttcctagtgatttagagtcatccttctcttcctggaacaaagcggagatactcatacaaaaggaacattttttaaaagatgtaacttttttaca

SEQ ID NO: 37432 - DNA, 201 bp, Homo sapiens
aggagtgagcaagtggagaaggaagaagactgggagcacaaagagagggagaggcatttttttaatcctttttttaatgcttgtgcaagagatgttgggggtaattgcttcagctgtgttcttcacactgcctctgaagccctgccatggccaacaatttgtgacttggtccgtatttctcttgatcaacctgtcactctg

SEQ ID NO: 37433 - DNA, 201 bp, Homo sapiens
ttctaatgctcctgccctaactcacacaaccctattgtaacttaatctggctttataaactgccacattgccaagtgtttttttgtttttttgtttttttkttttttgctttgttttctttgcgtttttgcatgcgtgtgttttggtttgtttgcctgcaaacaggtaaacaacttctttgcacaaccataaagacttcct

SEQ ID NO: 37434 - DNA, 201 bp, Homo sapiens
gcaatctcggctcactgcaacctctgcctcccaggttcaagcgattctcctgcctcagcctcctgagtagctgggattatgggcgcccaccaccatgcccrgctaattttcatatttttagtagatatggggtatcaccatgttggctaggctggtctcaaactcctgacctcaggtgatccacccacctcggcctcccaa

SEQ ID NO: 37435 - DNA, 201 bp, Homo sapiens
cctttgcagggacatggatgaagctggaaaccatcattctcagcaaactaacaaaagaacagaaaatcaagcaccacaagttctcactcataagtgggagstgaacaatgagaacacatgaacacagggaggagaacatcccacactggggcctgtcagagggtagggggagggatagcattaggagaaatacctaatgta

SEQ ID NO: 37436 - DNA, 201 bp, Homo sapiens
taaatttttagagaagtgacatgacaaaggaaaaggactgggactctctagggacagcaacttgggaaagacaaccaacaaaaaaatggttaagtaagtaaagcttgttaactgtagattcctccagcattgcccccaggactatacgtgtttaaagctgccgtcagtggttgttgttcttggtagagcaggggcaagata

SEQ ID NO: 37437 - DNA, 201 bp, Homo sapiens
tcttttctgaaataactccccatttaggagcttgcctcttctataatataaaatcctattgcctttttaacatcagaattgaagcaacaaagttctatttkcatagtaagtggtctaggaattgatgacagaatatgatgatgaaaagaaggaggaggaggaaataatgacaataataatatgagaggaaaaataattttt

SEQ ID NO: 37438 - DNA, 201 bp, Homo sapiens
tatctcctattgttcactgagaaaactgatgctttgtttaattgttgtgatcacttttccttgtgagttctcttgaacgttatgctactgtctgattgtcygttggcatgtatacatcacaccaatattctggaacaccacatactaaaatgaaaactttttgagtctgtgttactgcgctggcagctgtcaaaataattc

SEQ ID NO: 37439 - DNA, 201 bp, Homo sapiens
ccaaaatgtgaaagcgactttggaactgggtaacaggcagagaggttggaacagtttggagggctcagaagaagataggaaaatgtggaagagtttggaamctcctagagacttgttgaatggctttgacaaacatgctgatagtgatatgaacaataaggttcaggctgaggtggtctcagatggagatgaggaacttgt

SEQ ID NO: 37440 - DNA, 201 bp, Homo sapiens; identical to SEQ ID NO: 6259

SEQ ID NO: 37441 - DNA, 201 bp, Homo sapiens
cctctttttgttcctagtttcaggtatgtctttattggcagcatgaaaatgaactaatatggtaaattggtaccagtagggtggggcattgccgaaaagawaccccaaaatgtgaaagcgactttggaactgggtaacaggcagagaggttggaacagtttggagggctcagaagaagataggaaaatgtggaagagtttg

SEQ ID NO: 37442 - DNA, 201 bp, Homo sapiens; identical to SEQ ID NO: 6262

SEQ ID NO: 37443 - DNA, 201 bp, Homo sapiens
caattaaacctctttttgttcctagtttcaggtatgtctttattggcagcatgaaaatgaactaatatggtaaattggtaccagtagggtggggcattgcygaaaagataccccaaaatgtgaaagcgactttggaactgggtaacaggcagagaggttggaacagtttggagggctcagaagaagataggaaaatgtgga

SEQ ID NO: 37444 - DNA, 201 bp, Homo sapiens; identical to SEQ ID NO: 6265

SEQ ID NO: 37445 - DNA, 201 bp, Homo sapiens; identical to SEQ ID NO: 6271

SEQ ID NO: 37446 - DNA, 201 bp, Homo sapiens; identical to SEQ ID NO: 6272

SEQ ID NO: 37447 - DNA, 201 bp, Homo sapiens; identical to SEQ ID NO: 6274

SEQ ID NO: 37448 - DNA, 201 bp, Homo sapiens
ctaactcacacaaccctattgtaacttaatctggctttataaactgccacattgccaagtgtttttttgtttttttgttttttttttttttgctttgtttkctttgcgtttttgcatgcgtgtgttttggtttgtttgcctgcaaacaggtaaacaacttctttgcacaaccataaagacttccttgtctcctgcttttct

SEQ ID NO: 37449 - DNA, 201 bp, Homo sapiens; identical to SEQ ID NO: 33331

SEQ ID NO: 37450 - DNA, 201 bp, Homo sapiens; identical to SEQ ID NO: 6264

SEQ ID NO: 37451 - DNA, 201 bp, Homo sapiens; identical to SEQ ID NO: 6268

SEQ ID NO: 37452 - DNA, 201 bp, Homo sapiens; identical to SEQ ID NO: 6273

SEQ ID NO: 37453 - DNA, 201 bp, Homo sapiens; identical to SEQ ID NO: 33342

SEQ ID NO: 37454 - DNA, 201 bp, Homo sapiens
tctgctgcaggaattgtctccaactttatactctcatttaaaagacaaaaattttaaatgacaaactcagaattcatttaataaactagtcatttattcamcattatgctctttaagtgacttcttggcctgataaaattctcctaccaggcttgctcagtacatggcttatcaatcatcgaaaatttcatggccaagcct

SEQ ID NO: 37455 - DNA, 201 bp, Homo sapiens
atatatatatatatatatatatatgttagcaccgccaagcatttcagtttttcacttaagcttggtctgtatgtgttcccaatgggtgctcacagtattgytctcccagagatgggtgtggttggctctcatttctgtccaaaatttctggccaccagaaaagaggaggtgggggtatgtagtttgtataactcatgtaaa

SEQ ID NO: 37456 - DNA, 201 bp, Homo sapiens
tcaaaaagcttttcatttttccccatccatggccaaaaatatatatatatatatatacatatatatatatatacacatatatatgtgtgtgtgcgtgtgtrtatatatatatatatatatatatatatatatatatatatatatgttagcaccgccaagcatttcagtttttcacttaagcttggtctgtatgtgttccca

SEQ ID NO: 37457 - DNA, 201 bp, Homo sapiens
tcactgtactgtgatcaaggatactaatgatcataaacttttctctcttccaagcatacttttcactcaaagtagaaagggaagtgaagtcacacacacayacacacacacacacacaccttcagactggcctcataatagaaactatcacctggacaattcatttctctaaatagtaggcctcaaagatttctgttacca

SEQ ID NO: 37458 - DNA, 201 bp, Homo sapiens
attcactgtactgtgatcaaggatactaatgatcataaacttttctctcttccaagcatacttttcactcaaagtagaaagggaagtgaagtcacacacayatacacacacacacacacaccttcagactggcctcataatagaaactatcacctggacaattcatttctctaaatagtaggcctcaaagatttctgttac

SEQ ID NO: 37459 - DNA, 201 bp, Homo sapiens
taatttaaaatcttagatcgcactgtgattccgacaatggaaaaaaaaacatgaaatattaactatagcattttggtagcaagaaataaaaacttggaaarcatttagtgccataatgtcttctttttctgcctaaattagattgccataagccctgtagtattataaatccatggtaacttttaaaagagctgacagtgt

SEQ ID NO: 37460 - DNA, 201 bp, Homo sapiens
ctttcaaacaatatttctttaatttatgaaacatctggctgccagaaattggcaccaataaactaaaagagcaaatataagatttaaagcatttgagttaygccaaaaaaaaaaatgtattccatttagacaatgacatggatatttggcttacctaaatgcataaatttgaagacctagtaactttaaaactgaaaattg

SEQ ID NO: 37461 - DNA, 201 bp, Homo sapiens
agtgtgattggccaaatccccaggggacatttggccatgtctggaatcacttttggttgtcgcaacttgaaagaggagagtgccactggcacttagtaggkagaggccagggatgctgccaaacatcctgcaatgcacagaacagtcccacacaacaaagaactatctggtacaaaatatcaattgtgccaaggctgaggt

SEQ ID NO: 37462 - DNA, 201 bp, Homo sapiens
cggtcaaaccccgtctctactaaaaatacaaaaaattagccgggcgtggtggcgggcacctatagtcccagctactcgggaggctgaggcaggagaatggmgtgaactcaggaggcggagcttgcagtgagccgagatcgcaccactgcactccagcctgggcgacagagcgagactctgtctcaaaaataaacaaattaa

SEQ ID NO: 37463 - DNA, 201 bp, Homo sapiens
tgcagtatttttttagttatctaaaattcagcatttcatagtggtcaagagcagagagtctggacttagactgcctgggttcaattcctagcctttctacytgttagtcaaacttggacacctctctgggtctcaacttcctcatttgtaaaatgaagatgataatactatttacataggagattgttgtgagaggtaaat

SEQ ID NO: 37464 - DNA, 201 bp, Homo sapiens
aacacataagaaatacaaatgtgtctgcaactatcattgagaaaagaacttcatgaagatgaaagctgagagccaggaaggttgttttcatttgttataayaaatatcttaaggagctgtcttaagatatcttcaatagttacagttcttgaagtaaaattacaaaatatagttgctaaagagcccaaaggaaaattatat

SEQ ID NO: 37465 - DNA, 201 bp, Homo sapiens
actgaagagattcattaacctattctgcttgcataagtttactcaactacccaagctaggggggtgttacctaggggtaactctgcctggtgctttctggkttataaagaaagatatcaatgcagagacttcatcaaatgctttactaagatcaagattcaacattctaccaggttagtgctctcatccaaaactaaggtg

SEQ ID NO: 37466 - DNA, 201 bp, Homo sapiens
ctttacagggaagctctcttattatgtaaaataaaggtagaaacacataagaaatacaaatgtgtctgcaactatcattgagaaaagaacttcatgaagaygaaagctgagagccaggaaggttgttttcatttgttataacaaatatcttaaggagctgtcttaagatatcttcaatagttacagttcttgaagtaaaat

SEQ ID NO: 37467 - DNA, 201 bp, Homo sapiens
gcacagaatctaccatggcctgcaaggaggaagtctaaggtaattctaccatccatgacaaccctggccagtgagttggggccgcccttaatgcctcccarggctaacgtggtgtttagtgcattttgtgtgtgtgtatgacttaggatccaatctaggatgtctctttagtcttctttaatctggactagttcttcagcc

SEQ ID NO: 37468 - DNA, 201 bp, Homo sapiens
aaattaactcaataataatcccataacccaaagagagctactcttaatattatagtatattcttatagacacttttctatatacatgctattttcattttyttacataattaacattctataattttgtatcatgctttctaacctaatatgtcacaagcatatactatctactttattatatttcaactacatttttata

SEQ ID NO: 37469 - DNA, 201 bp, Homo sapiens
tagacacttttctatatacatgctattttcatttttttacataattaacattctataattttgtatcatgctttctaacctaatatgtcacaagcatataytatctactttattatatttcaactacatttttataataattacatattatttcaccctacaactacgttataatttatttcagcagtcaactattgttaa

SEQ ID NO: 37470 - DNA, 201 bp, Homo sapiens
gtcaggagctcgagaccatcctggctaacacagtgaaaccccatctctactaaaactacaaaaaaaaaaaaaaaaaaagtagccgggtgtggtggcaggcrcctgtagtccccgctactcgggaggctgaggcaagaaaatggcatgaacccaggaggtggagcttgcagtaagcagagattgtgccactgcactccagcc

SEQ ID NO: 37471 - DNA, 201 bp, Homo sapiens
tggttatcccaaccctctactgtgagacatgcttgggaaatagctgtatggcagagtccccttttgatgatttgtaatgcatattaaagactccaagaaaycttacactaaaggagcttgtttgttttagtttaaagcaaacatatttgacctcagaacccttttctacttaatattatggaatgcttggggaaatccttt

SEQ ID NO: 37472 - DNA, 201 bp, Homo sapiens
tacttcaagaaaagagatctgtaattttttttttttttttttacctgaacccagcaccatgatctggtgactatattgggaaggattctggaatattgctstaagcaaattcaggagtaagtataggatatactacctacacgcatttggggctcattccaaaggttgcctggagaaaaacaccaggttagaattatgtaa

SEQ ID NO: 37473 - DNA, 201 bp, Homo sapiens
ttgtgatcacttttccttgtgagttctcttgaacgttatgctactgtctgattgtccgttggcatgtatacatcacaccaatattctggaacaccacatastaaaatgaaaactttttgagtctgtgttactgcgctggcagctgtcaaaataattcttgctgacatcatgttgaacagacttgcctccgagtcagatcaa

SEQ ID NO: 37474 - DNA, 201 bp, Homo sapiens
tatttggtgcattggtaaacagctgtgaggctatagcattgctcctgatttccagccatgtttctcctaggaagtatcagagactaactccagtatagtgsgtctgtgtcacacatgcaacactccagagtgttgtatgtatgttgacaggtttgctaactggttttctccatgtcaaactgaaatttttaagcaacctca

SEQ ID NO: 37475 - DNA, 201 bp, Homo sapiens; identical to SEQ ID NO: 33377

SEQ ID NO: 37476 - DNA, 201 bp, Homo sapiens; identical to SEQ ID NO: 33380

SEQ ID NO: 37477 - DNA, 201 bp, Homo sapiens; identical to SEQ ID NO: 33383

SEQ ID NO: 37478 - DNA, 201 bp, Homo sapiens
taatactttatcacactctgatatacactacacacagagagagataaaataaatgagtgtttcactgatgggatactgggcgattttctctgacaaacacrtaagtttctatgaatagattcaccaatgtgaagggattcacactatagctcaagaaaattgagaaataaatgctttgatcctttcataaacttttcattc

SEQ ID NO: 37479 - DNA, 201 bp, Homo sapiens
aattgtctgcaaggtaagatgagcaaaatctaagcagacattctgactgagagagggcataagacaacttggagattctgccaaatccataggagaggacyttttgtttggttagttggtgggctgattttcagctttttaatttttttcatagagtggagatgttgtaaccctgtcttataagctaatagaattaggaaa

SEQ ID NO: 37480 - DNA, 201 bp, Homo sapiens
agaacagcaaatattgcagaacagcaaatgctgctgcctgatccttcctctggaagcttcgtctcagaggggcacccggctgtatgaggtgtcagtcggcscctactgggaggtgtctcccacttaggctactcgggggtcagggacccacttgaggaggcagtctgtccatactcagatctcaatctctgtgctgagaga

SEQ ID NO: 37481 - DNA, 201 bp, Homo sapiens
acaagtaaacaaaggttttacttaacaaactataacttttctattcaaaaaaatgtaactacatttactgtgctccaccctatcaatgaggctccaccacrctatccatctacctactctcacaacaggccaacctttttcttgccctagggcctttgtaaatgctgttccttgtgcctggattggtctcccattttcccc

SEQ ID NO: 37482 - DNA, 201 bp, Homo sapiens
tcagaaaatccacagttttcttataaacaagcatctaatgctggtgaaaattgttgccatttccagcaggaagtgacctaggactcctagaaagcaactgmttttaagggtctggtgatgaccactgggcatgagctggtgagtgattaacattgttagatttgtccgtagtatttaagatgttcagagtgttttacaatc

SEQ ID NO: 37483 - DNA, 201 bp, Homo sapiens
ccagtggattttggaatctgcaaggatccctagaacaaatcacccaccagatactgagggatgcctctacttctaaataatccatgagtcaaagaggaagkctcaaggaaaagcaaaaatatatattgaactgcatgataacagaaatacaatatatcaaaatctatgggactcaactagagcagtgttgagatgaaaatt

SEQ ID NO: 37484 - DNA, 201 bp, Homo sapiens
gtctttatcacatcacctttaaggagaggaactcatcattgctcagtagtcaccaatctcagtttacttcttatcctaaaaacatggacaaaggggagatkggaaacccagattggccctggaggccggccagctgtgaatcccattctaggctcttagtccttataatcatttgtttaatcagactgccttctgcacatg

SEQ ID NO: 37485 - DNA, 201 bp, Homo sapiens
atcatctgccctcatctctttttacagaaacatgaagggaaaagagttaccactctaaattgtagcaaatgcaagaattacctttctctctaccattcttrgcaggggtcagtcatctgggttgattggaacattcccactgagcttgctgccccaggtggaattccattctgctagaaatttctgtgttggtgaaatatg

SEQ ID NO: 37486 - DNA, 201 bp, Homo sapiens
atccacgtataaaaatagtgccattttctatgtgtaaaaaaaagataggaaagcactaaaagaggctataaaataatattagtaaagatggacaaagaacrttattgatttcaaacagataagtggaaaagtcttgaaaaaccatttcaaattattatggagatgtagtcaattcaaaataacataatattaaaaatatga

SEQ ID NO: 37487 - DNA, 201 bp, Homo sapiens
cgcaaattgtttaaaaggaaatacatcataattaggctaacaaatctgctgtgatgctgcctctcctgatgaataaattttgtgtagatagaggggtagayacataggggtactttgcatttttctcttcattgattttcatacatcataatacgatggattaaccaacattggctcacaattgctctttgtccgaagttt

SEQ ID NO: 37488 - DNA, 201 bp, Homo sapiens
caaaatacatgtaagctgttgatatgcataaatcattaacaattcatttcataaatgcataaaagagtaaagtcactaacagttgctatccatctgtctcsagagtggtttctcagcctcactaaaacctttccttcattgaacatcatatccctcactgtaactagggagaatgtatgaagtccctctttcacatcagga

SEQ ID NO: 37489 - DNA, 201 bp, Homo sapiens
aagaagatttggagctggtgcgggtgactgtcaagcgcagatggccagttaccgacgtaatctgtgtatctgggaggcatgtgctataagaaggcagctgytaaaacaaatgaatcaagccacagtttttaagaaggaaaagtgtagattggaaaaggataaaagttttgaatgcatgcagctgtgcagggctatgatcaa

SEQ ID NO: 37490 - DNA, 201 bp, Homo sapiens
ggggtatcaccatgttggctaggctggtctcaaactcctgacctcaggtgatccacccacctcggcctcccaaagtgctgggattacaggcgtgagccacmacgcctggcctgactcatattttgtttaatttccaaaatacatgtaagctgttgatatgcataaatcattaacaattcatttcataaatgcataaaagag

SEQ ID NO: 37491 - DNA, 201 bp, Homo sapiens
cctgggaggcggaggttgcagtgatctgagatcctgccactgcactctagcctgggcgacgagagcaaaactccatctcaaaaaaaaaaagacagagtgtytttttggctaaacagacgacaaacaagtaccagggctacctgaggcacaagtcaccttcaagaggtagacaccagtccctctaattagacactcagtgta

SEQ ID NO: 37492 - DNA, 201 bp, Homo sapiens
cagtaattatgatctcatttctcatgtcatacattcttggtgaatagaattgcagcacctaacttcaaagatttatcaatgaaaagaaccagaatatgagsctgttctgcatacctgccatgaatacatttaaagcatatacagagttcagcagtatcagagaaacaaaatgtcaaaaacattgtctaatcatttttttgt

SEQ ID NO: 37493 - DNA, 201 bp, Homo sapiens
gctttaaaatttgactgcccaactggattttggacttgcatgggccctgtaacccctttgttttggccaatttctcccatttggaacaggagtatttaccmaatacctgtacccacattgtatctaggaagtaactaacttgcttttgattttacaggctcataggtggaaggaacttgccttgtctcaggtgagactttg

SEQ ID NO: 37494 - DNA, 201 bp, Homo sapiens
ttggaaagacagacattacacaaataattaactcattaattaacaatttattaattagtaatctaatttacattaatcaaataagtgctggatgaactacrcaaaaagaacatacaaaaagtctacctgcttgatgtacgggagaagcctccctcagaaactgctgtaacctgagaaataagtcacagttagctagacaaa

SEQ ID NO: 37495 - DNA, 201 bp, Homo sapiens
gtctctctctctttgacccctcttctcttcccccacataactttctatatcctttcagttttctccttcattttccttttttattctaaaataaccattcytttcactttagtacagaattaattactctttttcctttaacaaaacagatcctcataccttataactttccttaccaaaagcacatcttattttccttgt

SEQ ID NO: 37496 - DNA, 201 bp, Homo sapiens
agatgttaaaaattgggatctaattaaactaaagagcttctgcacagcaaaaaaaaaaaactaccatcagagtgaacaggcaacctacagaatgggaaaamatttttgcaatctactcatctgacaaagggctaatagaatctacaaagaactcaaacaaatttacaagaaaaaaacaaccccatcaaaaagtgagtgaag

SEQ ID NO: 37497 - DNA, 201 bp, Homo sapiens
gcatagaacaaaaaagtatgagataggcaaatttcctctctctctgattctctttctctctgattctctctctctctctctctctctctctctctctctcwctctctctctgtttctcttttctggagctgagatacgcatcttctcctgtccttggacatcagaactccaagtcctctggcctttggacttcaggacttg

SEQ ID NO: 37498 - DNA, 201 bp, Homo sapiens
gatatttacatagtttcttttttattattattattatactttaagttctagggtacatgtgcacaactgtgcaggtttgttacatatgtatacatgtgtcwtgttggtgtgctgcacacattaactcgtcattcacattaggtatatctcctaatgctatcgctccccactcccccaaccccatgacaggcccctgtgtgt

SEQ ID NO: 37499 - DNA, 201 bp, Homo sapiens
ctcttggggctgccactgagtaatccagaagaccattaaattccccagtaagggccaggcacagtggctcacacctgtaatcccagcactttgggaggccraggcgggcggattgcctgaggtcgggagttcaagaccagtctggccaacatggtgaaaccccgccactactaaaaatacaaaaaaaattagccaggcatg

SEQ ID NO: 37500 - DNA, 201 bp, Homo sapiens
ggggctgccactgagtaatccagaagaccattaaattccccagtaagggccaggcacagtggctcacacctgtaatcccagcactttgggaggccgaggcrggcggattgcctgaggtcgggagttcaagaccagtctggccaacatggtgaaaccccgccactactaaaaatacaaaaaaaattagccaggcatggtggc

SEQ ID NO: 37501 - DNA, 201 bp, Homo sapiens
aaaatgaggaaatgtatttcagctgtcactgccatgtcattatagcccccccttaactgcatttatgttgccaagaggaatcctcaccagatcaaactgaytggaatgaggcccaagacagctgtggcccagataaagaaaaccaaatgattttcagtctcctgaataccaagaaacaggatatgtcattgatgtccagtt

SEQ ID NO: 37502 - DNA, 201 bp, Homo sapiens
ccagaagaccattaaattccccagtaagggccaggcacagtggctcacacctgtaatcccagcactttgggaggccgaggcgggcggattgcctgaggtcrggagttcaagaccagtctggccaacatggtgaaaccccgccactactaaaaatacaaaaaaaattagccaggcatggtggcgtgcacctgtaatcccagc

SEQ ID NO: 37503 - DNA, 201 bp, Homo sapiens
ttacctactcagatggccaaacctttctaccactatttttggaaaagacttagatttttttatttgcccaacttccaaatagcttttttttccttctgatwatcatctccctgaagttcgcatttcaaaagggatggttctcaggtaagacagggtagaacatttatatctcaaaggtacagaaaaagaatgtaagtttca

SEQ ID NO: 37504 - DNA, 201 bp, Homo sapiens
tatttttctctaagcctcagtttcttcaaatgtaatatggggtaattcatagagcaatcatgaaaaccaagttagacaacacatgttaagttgctagtacygagcctgacacagagtaagttctcaatcaataatatggtgatgtcctttagctgatccaagcaactggccagataatacttagaactctaagaagaaaat

SEQ ID NO: 37505 - DNA, 201 bp, Homo sapiens
tttttttcactgtcataattttcttgctggtataatttttgcaaaggcagtttcaatatcaccaactaaacctgtgatgtcaacactattgctaaacgttktagttatattaataacaagttctgtcatttagctagtttacttttagttttggttgcaaacaaggggaaattagggataggaagtgaagaaagaacccaa

SEQ ID NO: 37506 - DNA, 201 bp, Homo sapiens
tagcattaggagatatacctaatgtaaatgacgagttaatgtgtgcagcacaccaacatggcacatgtacacatatgtaacaaacctgcacgttgtgcacrtgtaccctagaacttaaagtataataaatttaaaaaaattggcggggggtagggggagacagggaccaatgaagtgaaggaaggattcagtgaagtgaag

SEQ ID NO: 37507 - DNA, 201 bp, Homo sapiens
tgagaaaaagctctagaacattattgaaatccatctattgtatttttcttcagaggctaaatagattggagaggcagtgggagtctcaaacacatcacatrtttatatcatattccagaaagaagaaattgccaatatgtaatctattaagaagccaaagatgtacttttatttattaacaaagtcttatcctgagaaata

SEQ ID NO: 37508 - DNA, 201 bp, Homo sapiens
tgttatcattgtaaaatctaaatggtgaacatttcaatgttcgccatagtacttacagcatttttagtacatttatattttgtaatttaaatttttggggktttttttgcctcccaagtagctgggattaaggcacctgccgccacgcccggctaatttttgtattttttagtagagacagggtttcaccacgttggccag

SEQ ID NO: 37509 - DNA, 201 bp, Homo sapiens; identical to SEQ ID NO: 33421

SEQ ID NO: 37510 - DNA, 201 bp, Homo sapiens
agctgttgatatgcataaatcattaacaattcatttcataaatgcataaaagagtaaagtcactaacagttgctatccatctgtctcgagagtggtttctyagcctcactaaaacctttccttcattgaacatcatatccctcactgtaactagggagaatgtatgaagtccctctttcacatcaggagatctgagctaca

SEQ ID NO: 37511 - DNA, 201 bp, Homo sapiens
attttcatatttttagtagatatggggtatcaccatgttggctaggctggtctcaaactcctgacctcaggtgatccacccacctcggcctcccaaagtgytgggattacaggcgtgagccacaacgcctggcctgactcatattttgtttaatttccaaaatacatgtaagctgttgatatgcataaatcattaacaatt

SEQ ID NO: 37512 - DNA, 201 bp, Homo sapiens
ttttctatcatcagagctcaatcctgtggaggctgttgactaaattttaagtgccagtatatttccaattaacctttgtagtctcggatatatgctttggsggaatcctgagatccatgagagcaggactccaaagctcaagtgactgagaggctagagtgggagggaaaaggtccgtcaaagaaggacagagggacggag

SEQ ID NO: 37513 - DNA, 201 bp, Homo sapiens; identical to SEQ ID NO: 6275

SEQ ID NO: 37514 - DNA, 201 bp, Homo sapiens
ttaaaagaaatatttaaatgccactagtaagtggcatgctacttaaggtgactgttatttgattatctgattcatttggtgtctgaatttagtttagcacrccaaagcaactttaatattttgagtagctggagatccttccaactttttcttatattgtagaattctagtttacttacttccagagcacattttgctaaa

SEQ ID NO: 37515 - DNA, 201 bp, Homo sapiens
atcagaggttctgcctttcagataaataactaactggagatttcctttgataaatggcaagataaagaaattgtagaatggtagaaaatatcatgtttacstacaaaaagaactattgcctcaccatgtttcacatctctagaagatggttttaaatctattatgagcattatgtaatgtttaactggttctggtttcaat

SEQ ID NO: 37516 - DNA, 201 bp, Homo sapiens
ataatcttatcttggatgtttgtttctacacatacaaaactaaaaagttcaaataaaaatacatgccacttttatctttaccagagtacaagacaggtgaytaaaatgcaaaaatttaatttgatgtatcatactcattgatttaaaagttatttttaatttccaataattttctctattgattaagcttttctctagtat

SEQ ID NO: 37517 - DNA, 201 bp, Homo sapiens; identical to SEQ ID NO: 33444

SEQ ID NO: 37518 - DNA, 201 bp, Homo sapiens
acattgtcccataccttattgaatcagtcacttagtactaagaataagtcagttcagttaaactgaactgaactgaactgaactgaactaagtcagttcasttcagcgtctcatttcaggaggtggtattacaagtgggctcccaccaaagttaggcctatatggtgcaagcatacagttatttaataagaggtatttata

SEQ ID NO: 37519 - DNA, 201 bp, Homo sapiens; identical to SEQ ID NO: 8289

SEQ ID NO: 37520 - DNA, 201 bp, Homo sapiens
tctctcccatgcatgctttcatctgagcctttgaataactctgggaaggaagaaatgagaccaagaccaatgccttccccaggaccccacaaataggtaayggcagagctggccctggattccaagtcttaagacttcagttctgatggattttgtgtttagttattgctctaattaaaatggtttttattcttgacccca

SEQ ID NO: 37521 - DNA, 201 bp, Homo sapiens
tctaatataattgtgtgtacgaccatgtgagctaattttgccacaaaaaaacagccacctgggtaataaactgtctgaaaaaataatgataatttataaamatgccaattggggaaaagcacttaatattatgctgtctagccaaagaaaatgagatccactccaattatttcaatactctgacatgaagcattttgtgtt

SEQ ID NO: 37522 - DNA, 201 bp, Homo sapiens
tcatgccactgcactccagcctgggtgacagagcaagactccgtctcaaaaacataaaaataaaaataaatttcccagtaagtagatgaagaaaaacactraataaatatggaaacaataggaaaacaagagactcataaatgaaatttatttttaaattgtgctggattaggcttaccaataaggaaagggaattcatta

SEQ ID NO: 37523 - DNA, 201 bp, Homo sapiens
actgcactccagcctgggcgaaagagtgagactccgtctcaaaaaacaaacaaacaaacaaacaaacaaacaaaaaaacttgtatgattatgctcttagargccatgaattatctgcttgatctcttggggctgccactgagtaatccagaagaccattaaattccccagtaagggccaggcacagtggctcacacctgta

SEQ ID NO: 37524 - DNA, 201 bp, Homo sapiens; identical to SEQ ID NO: 33467

SEQ ID NO: 37525 - DNA, 201 bp, Homo sapiens; identical to SEQ ID NO: 33471

SEQ ID NO: 37526 - DNA, 201 bp, Homo sapiens
aaaaaataaaagttggcaacactataataaacatccttggatataaacctctctctctctctgtctctctgtctctctctccttctctctctctctctatmtatatatatatttaatgtacttaaaattatataatatttgatattaatatagtttcaaagtactttcctaaaaaatctgtattaattacaaagggataaa

SEQ ID NO: 37527 - DNA, 201 bp, Homo sapiens
agccgagcacagtggctcatgcctgtaatcccagcactctgggaggccaaggcaggcagatcgcttgatgccaggagttcaaggccagcctggccaacacrgcgaaactgcacctctactaaaaatacaaaaattagccaagcatgatggtgcatttcagtaatcccagctactcaggagtctgaggcacaagaatcactt

SEQ ID NO: 37528 - DNA, 201 bp, Homo sapiens; identical to SEQ ID NO: 33476

SEQ ID NO: 37529 - DNA, 201 bp, Homo sapiens; identical to SEQ ID NO: 33262

SEQ ID NO: 37530 - DNA, 201 bp, Homo sapiens
tgagatatcttggggtgtctaaagtcaaaacacaaaattcatttatgtatcatatacaccttatatacatatcctgaaggtaattttacacagtatttttrataattttatgcatgaaacaaagttttgactgcattttggctgatatccgtcacatgaggtcaggtgtggaaatttccacttgtgacatcatgtcaatgc

SEQ ID NO: 37531 - DNA, 201 bp, Homo sapiens
gaaagcaactgattttaagggtctggtgatgaccactgggcatgagctggtgagtgattaacattgttagatttgtccgtagtatttaagatgttcagagygttttacaatcccttttcttagtcacaactcataggcttgtgaaggaggcagctcctgtcattattgctttgctatttggatgctgatccacagaaaggt

SEQ ID NO: 37532 - DNA, 201 bp, Homo sapiens; identical to SEQ ID NO: 6255

SEQ ID NO: 37533 - DNA, 201 bp, Homo sapiens
gaacagaaactgttttaaaacaaatggagttaaaatattggacaaagacaaagaaagtgagtggaggacttcggagttaaggattccaaagggccttacaytgtttcagagcaagatagatgtgatatttaacttcacaatttaagaagtcacataaaaatttaaaggtaatatagagcagaaaaagaatgaaaaactttc

SEQ ID NO: 37534 - DNA, 201 bp, Homo sapiens; identical to SEQ ID NO: 6257

SEQ ID NO: 37535 - DNA, 201 bp, Homo sapiens
agaatttccttgtctgtaagaattacacactgaaatagttggaagtgacagggatttacatcagctacttattcttaagtgtgtcaagggaaaaaaaaagytttttatgctactctgcagtctttctcctggtttgaaattatttcatattaaaaaataaaactcatgtaccaaacagtagtgcagacacagttgagtgaa

SEQ ID NO: 37536 - DNA, 201 bp, Homo sapiens; identical to SEQ ID NO: 6260

SEQ ID NO: 37537 - DNA, 201 bp, Homo sapiens
cagtgttgacttcctagtttagatgttggagaatttccttgtctgtaagaattacacactgaaatagttggaagtgacagggatttacatcagctacttaytcttaagtgtgtcaagggaaaaaaaaagctttttatgctactctgcagtctttctcctggtttgaaattatttcatattaaaaaataaaactcatgtacc

SEQ ID NO: 37538 - DNA, 201 bp, Homo sapiens
tttttgtatttttagtagagatggggtttcaccgtgttagccagggtggtctcgatctcctgaccttgtgatccgcctgcctcagcctcccgaagtgctgrgagccaccgcgcccgtcttaattgaagttttaattaaggcattactaagatagaagtccactgctctcctcaagaatttgagtataatgcaagattataa

SEQ ID NO: 37539 - DNA, 201 bp, Homo sapiens; identical to SEQ ID NO: 6266

SEQ ID NO: 37540 - DNA, 201 bp, Homo sapiens
aaaatcttagatcgcactgtgattccgacaatggaaaaaaaaacatgaaatattaactatagcattttggtagcaagaaataaaaacttggaaaacatttrgtgccataatgtcttctttttctgcctaaattagattgccataagccctgtagtattataaatccatggtaacttttaaaagagctgacagtgtgacaac

SEQ ID NO: 37541 - DNA, 201 bp, Homo sapiens; identical to SEQ ID NO: 6267

SEQ ID NO: 37542 - DNA, 201 bp, Homo sapiens
atatgctttctcttataatgtgcttatcttcaattgcccttctctccacaatgttggctaactagaagttgtcaccagccccttgctttctctgtccttaycttagcatgtctttatacttcctcacttcatttaacctctcatccttgactcactaggtcaccttctacagccaatccttatccaaacattgatactcta

SEQ ID NO: 37543 - DNA, 201 bp, Homo sapiens; identical to SEQ ID NO: 6269

SEQ ID NO: 37544 - DNA, 201 bp, Homo sapiens
attgtcctcttagcagtttctgtcggttgatttttttgtttgtttccaggtttttgtcttacttggcttgctttgttttggtttggttagtctgtttttakttttttgttatccttgaatatcattttcctgaactattttttagttttcctccacgttttcctgagttatgacagtggtaactgggaaatttttattttt

SEQ ID NO: 37545 - DNA, 201 bp, Homo sapiens
agacgtgacaaataaaggcaatgtaggatcctagattgtaacctagaatggaaaaaggacattagtggataaacttgtgaaatctgaataaagtctacagyttagtttatagtattgtatccatgctaatttattcactttaataattataccatggttgtgtaagatggtaacattcaggaagctggatgacgggtatgt

SEQ ID NO: 37546 - DNA, 201 bp, Homo sapiens; identical to SEQ ID NO: 33282

SEQ ID NO: 37547 - DNA, 201 bp, Homo sapiens
aaaatgttagggatagtgagaagtttgggatagctcaccaaagtctctgatttcggcagcccaagaaagagaggccaagaagggttagatggtttcacaargccacacccttatctggtggcagatcctgagctagaattcagagctctagagtcttattcccatgctcttcctgtgccttacaggaagatttttcttttt

SEQ ID NO: 37548 - DNA, 201 bp, Homo sapiens; identical to SEQ ID NO: 33285

SEQ ID NO: 37549 - DNA, 201 bp, Homo sapiens; identical to SEQ ID NO: 33286

SEQ ID NO: 37550 - DNA, 201 bp, Homo sapiens
atttgcaaaactctgcacactgccgaaaaaacaatgccatttgtggtattaccataaagccatattctgaaattgcaccagtcttgagtatgacagtcacrtctgatatacatgaaaatgtcagtatgcccctgttatgcaaattgaacaaagaagcactcaattactcaatacacactcacaaaatgcagattttacatg

SEQ ID NO: 37551 - DNA, 201 bp, Homo sapiens; identical to SEQ ID NO: 33287

SEQ ID NO: 37552 - DNA, 201 bp, Homo sapiens
aataagtcctaatgagaagtgaagcatgtttttgtatactgtgttagaaagcaatagaaacactaaattcttgaatgatcattaaattaattagatggatkatgagtactttatgttttgttcaaactaattcattctataaaaaggctacaaaacatggattcaataccctactgaaaagaagagaagcttgagagtaat

SEQ ID NO: 37553 - DNA, 201 bp, Homo sapiens; identical to SEQ ID NO: 33288

SEQ ID NO: 37554 - DNA, 201 bp, Homo sapiens; identical to SEQ ID NO: 33289

SEQ ID NO: 37555 - DNA, 201 bp, Homo sapiens; identical to SEQ ID NO: 33297

SEQ ID NO: 37556 - DNA, 201 bp, Homo sapiens; identical to SEQ ID NO: 33296

SEQ ID NO: 37557 - DNA, 201 bp, Homo sapiens
tagggggagggatagcattaggagaaatacctaatgtagatgatgggttgatgggtgcagcaaaccaccatggcatgtgtatacctatgtaacaaacctgcactttctgtacatgtaccccagaacttaaagtataattaaaaaatatagattctctgaagtaattttctaaaatgtattacttgaaatttccaaaaactt

SEQ ID NO: 37558 - DNA, 201 bp, Homo sapiens; identical to SEQ ID NO: 33305

SEQ ID NO: 37559 - DNA, 201 bp, Homo sapiens
caagaaaactgaaagatgaagagaagaaggaaaactagctacagatctcaggacccttggaaacacatggtgatgagttcgtgagttttctttctgcctcrtatataccagacttggagtcaaataatatgaccacccagaaacaccaatggacacagacaaaaataagcccaatacaaacctcttctgtccagccaaagg

SEQ ID NO: 37560 - DNA, 201 bp, Homo sapiens; identical to SEQ ID NO: 33307

SEQ ID NO: 37561 - DNA, 201 bp, Homo sapiens
aacagcatcataattccatttttccatgaaattcctcttcataattcacatacaggctgttcgtacctatggacgtgagatccaagtgacagagcttctcracaagttagacttttatgtcctgcctgtgctcaatattgatggctacatctacacctggaccaaggtatatgcaccaatactgagagaggctgatgaaat

SEQ ID NO: 37562 - DNA, 201 bp, Homo sapiens; identical to SEQ ID NO: 33319

SEQ ID NO: 37563 - DNA, 201 bp, Homo sapiens; identical to SEQ ID NO: 33320

SEQ ID NO: 37564 - DNA, 201 bp, Homo sapiens; identical to SEQ ID NO: 33323

SEQ ID NO: 37565 - DNA, 201 bp, Homo sapiens
ttgcaaatacagtatttaagaaaaagaacggattaaaagagcactcacatgagctggaaaatagccacatggattataatatttttataaattccatttcyttttcaaagcaccacttaacattatatattgctatattatctacctacacagaaataatatactcatcaggccaaaattcataaagtaaatccaagtgta

SEQ ID NO: 37566 - DNA, 201 bp, Homo sapiens
aaaaaaaaaaaaaccatcaacccataatcttatgcccagtgaaaatatcctttagaaaggaaggggaaattaaggcattctttgatgaaggaaaagagaawtttttacctgcagacctactcgaaaagaatggctacaggaagctctctaaaaaggaaggcaaaggcaaatagaatccttctcacatcacatcaccctggc

SEQ ID NO: 37567 - DNA, 201 bp, Homo sapiens
ccataatcttatgcccagtgaaaatatcctttagaaaggaaggggaaattaaggcattctttgatgaaggaaaagagaattttttacctgcagacctactygaaaagaatggctacaggaagctctctaaaaaggaaggcaaaggcaaatagaatccttctcacatcacatcaccctggcctcctcctctgcccttgcttt

SEQ ID NO: 37568 - DNA, 201 bp, Homo sapiens
ccttgctttcccattttaaggacacttgtgattacactatgcctactgagataatctaggtatccccatctgatgattacctaattaacaacttcagttcyatatgctaccttaatttctgtttgctgtattaggtaacatattcataggttctggggattaggaggcagggatctttgaggggccattatactgtctacc

SEQ ID NO: 37569 - DNA, 201 bp, Homo sapiens
tgacagaactaaaagagaaaaataggcaaatctacagtaataatgacagactacaacacctctctctcaacaattgatagaacaaataggcagaaaagcakcaaggatatagaagaactcaatactcaagaatatatgtattctgtttttgttgggtgggtgatttgttgggttgggtgattctataaatatcaaactaaa

SEQ ID NO: 37570 - DNA, 201 bp, Homo sapiens
gggtgggtgatttgttgggttgggtgattctataaatatcaaactaaagtaatcaactgaaagaatttgatattcatagaatacccctcccaacaatgacrgaatatccatattcttttcagatgcctgtggaacatatagtaagatagagcatattcctgggccataaaataaatctcaacaattttaaaagaattgaaa

SEQ ID NO: 37571 - DNA, 201 bp, Homo sapiens
tcaaactaaagtaatcaactgaaagaatttgatattcatagaatacccctcccaacaatgacagaatatccatattcttttcagatgcctgtggaacatawagtaagatagagcatattcctgggccataaaataaatctcaacaattttaaaagaattgaaatcataaacattgtgtattatggacttaattatgtcccc

SEQ ID NO: 37572 - DNA, 201 bp, Homo sapiens
taagatagagcatattcctgggccataaaataaatctcaacaattttaaaagaattgaaatcataaacattgtgtattatggacttaattatgtccccccycccccgtgccaaaattcatatgttgaagccctaaccccttagtgtgattttttgaagacggagcctataaaaaggtaattacggttaaatgaggtgaata

SEQ ID NO: 37573 - DNA, 201 bp, Homo sapiens
tcccccctcccccgtgccaaaattcatatgttgaagccctaaccccttagtgtgattttttgaagacggagcctataaaaaggtaattacggttaaatgargtgaatatggtgaggtgaataaggttacatgaggtgaatatggtggagccctaattcaaaatggcttatgtcttgatgagaagagtaagagacaccaggg

SEQ ID NO: 37574 - DNA, 201 bp, Homo sapiens
aaataatcttatcttggatgtttgtttctacacatacaaaactaaaaagttcaaataaaaatacatgccacttttatctttaccagagtacaagacaggtractaaaatgcaaaaatttaatttgatgtatcatactcattgatttaaaagttatttttaatttccaataattttctctattgattaagcttttctctagt

SEQ ID NO: 37575 - DNA, 201 bp, Homo sapiens
ataaacatcctacaatgcacagaacagccctcccatccccaacaaattatccagcccaaaacgtcaagagtgccaaggttgagaaacttgctttaaataamtataagaacaaagtcacattcctggacaaaggctctcgcctttcacaggatcttatactttcttcacaaaactttacaatgttctgcaaattacaagtgc

SEQ ID NO: 37576 - DNA, 201 bp, Homo sapiens
ttcagaactgtgcaaagaaccatgtgcctaaaaagccaacgaaaggttcctggggcctttcttttctgatagtttaaagcatgtggcttttgcctcacagyaaatttttctaaaatatgtaatcagttttctgttcaaaaaaaaaaaaaaaggagggaaagcctggacaacatagcaaacttttctctaaaaaaaattaaa

SEQ ID NO: 37577 - DNA, 201 bp, Homo sapiens
tcaaagatgggcaaaagacagaaaaacataaattgaaacaagcagaaaaaaaaaatacattggagtacattgtcccataccttattgaatcagtcacttartactaagaataagtcagttcagttaaactgaactgaactgaactgaactgaactaagtcagttcacttcagcgtctcatttcaggaggtggtattacaag

SEQ ID NO: 37578 - DNA, 201 bp, Homo sapiens; identical to SEQ ID NO: 33347

SEQ ID NO: 37579 - DNA, 201 bp, Homo sapiens
tgtgcagtttctaatgctcctgccctaactcacacaaccctattgtaacttaatctggctttataaactgccacattgccaagtgtttttttgtttttttkttttttttttttttgctttgttttctttgcgtttttgcatgcgtgtgttttggtttgtttgcctgcaaacaggtaaacaacttctttgcacaaccataaa

SEQ ID NO: 37580 - DNA, 201 bp, Homo sapiens
tggaatagtttcagaaggaatgctaccagctcctcgttgtacctctggtagaattcagctgtgaatctatctggtcctggactttttttggttggtaggcyattaattattgcctcaatttcagaacctgttattggtctatccagcgattcaacttcttcctggtttagtcttgggagggtgtatgtgtcgaggaattta

SEQ ID NO: 37581 - DNA, 201 bp, Homo sapiens
ctctttgagatagtgaccttgagaaaaggtttgaagacaatgagagagtgagccatgcagtgtctgggagaagagcattccaggcagggaaaatggcaaayacaaagagggaaaggtgtatgaattgtacaggcatttgggggtattccaaaacttttattctaagtaatatcattgtagataactttatggattcattca

SEQ ID NO: 37582 - DNA, 201 bp, Homo sapiens
aatcagagtgcagtagattgagctgtttaagtctttgctcagttgctcatgagtcatatgaccttgatcaagtcacttaacctctttgagcctcagtttaytcatctataaatagggtcctattcaacctcaggcttataagaaggatagagtaaattaatgtatggcaaagtgattgatagatatcagacccttagcaaa

SEQ ID NO: 37583 - DNA, 201 bp, Homo sapiens
caacctacagaatgggagaaaattttgcaatctatccatctgaaaaagggctaatatccagaatctacaaagaacttaaacaaatttacaagaaaaaacavacaaccccatcaaaaagtaggtgaaggatatgaacagacacttctcaaaagaagacatctatgcagccaacaaacacatgaaaaaatgctcatcatcact

SEQ ID NO: 37584 - DNA, 201 bp, Homo sapiens
tacctgaggcacaagtcaccttcaagaggtagacaccagtccctctaattagacactcagtgtatgcaagcaagtggctagagtggtaggggctagacccragagctgtgggtgctgcagcttagatttatctggaaggcacattccacaggcctcattttcaatttctacgtatatcttcctttgccttcaaatggtttc

SEQ ID NO: 37585 - DNA, 201 bp, Homo sapiens
ttaatcaaataagtgctggatgaactacacaaaaagaacatacaaaaagtctacctgcttgatgtacgggagaagcctccctcagaaactgctgtaacctragaaataagtcacagttagctagacaaagggagcaccgcttccaggcctgtggctatcccaaaagtataagaagaaagccagtgagggtgaaatttggag

SEQ ID NO: 37586 - DNA, 201 bp, Homo sapiens
cctgagaaataagtcacagttagctagacaaagggagcaccgcttccaggcctgtggctatcccaaaagtataagaagaaagccagtgagggtgaaatttrgagagctgaggaaagaggagcatgtgtacaggctggggagggtggtaggaaccatgtcaggcagagcttagaggtcacgttaaggactggggacactggt

SEQ ID NO: 37587 - DNA, 201 bp, Homo sapiens; identical to SEQ ID NO: 33374

SEQ ID NO: 37588 - DNA, 201 bp, Homo sapiens; identical to SEQ ID NO: 33375

SEQ ID NO: 37589 - DNA, 201 bp, Homo sapiens
caacatgagaatttatggagagtgcaatgtgccatctactaaagcagtggctctggggttttatgtgtgttcactggagaaaaatacacttatgttcatargaacacccactttggttcgttgcagggtactgataagcaacctgagaaatgtggtggaggctcagtttgatagccgggttcgtgcaacaggacacagtta

SEQ ID NO: 37590 - DNA, 201 bp, Homo sapiens; identical to SEQ ID NO: 33394

SEQ ID NO: 37591 - DNA, 201 bp, Homo sapiens
tatcaaaatgcataatctgaatcaaaccataagaaaatatcaaagatacaaaaagtaaggaacattcaagaaaataactggtctgtcatctttaaaagtcrcaacatgaaagtcaaggaagactgaggaacattccaagctgagggagacggcagagacatgacagctacaggtgatgtatgatcctttgctagatccttt

SEQ ID NO: 37592 - DNA, 201 bp, Homo sapiens
cgaggaatttatccatttcttccagattttctagtttatttgcatagaggtgtttatagtattctctgatggtaattagtatttctgtgggatcggtggtratatccccattatcattttttatggaatctatttgattcttctgtcttttcttctttattagtcttgctagtggtctatcaattttgttgatcttttcaa

SEQ ID NO: 37593 - DNA, 201 bp, Homo sapiens
tatcatattccagaaagaagaaattgccaatatgtaatctattaagaagccaaagatgtacttttatttattaacaaagtcttatcctgagaaataccaargtcctcaaagcactcacctagattccccaaataaaataaaagtgttcttcctacttgacctgaaaaacagacatagaagctttctccacacaattttaaa

SEQ ID NO: 37594 - DNA, 201 bp, Homo sapiens
ctttcctgtattttccagaatcattttcaatgggcatttataatttttagaatcagaaaataaaactctaaaaagcaaagctataacattaaaaaaaattmttgaagtagtccacatgaaaacaaatacagagacatattttatccctaaaggtcacggccaccactttaatctaccacatgatctattttgataccggtt

SEQ ID NO: 37595 - DNA, 201 bp, Homo sapiens
ctaaaactccagttctttttatcaaaacaagtgcagaacaggtccccatatggagcagtcttttcgacattgaattcctaaggaaatttctcacgttggaytgtggatagagacatagagtcacagagggatcgtttttaagcatcattttttatttcagcctgattcttagttggttgttctcggaatgttcttcttaaa

SEQ ID NO: 37596 - DNA, 201 bp, Homo sapiens; identical to SEQ ID NO: 33402

SEQ ID NO: 37597 - DNA, 201 bp, Homo sapiens
caatttttcaaaaagcttttcatttttccccatccatggccaaaaatatatatatatatatatacatatatatatatatacacatatatatgtgtgtgtgygtgtgtatatatatatatatatatatatatatatatatatatatatatatgttagcaccgccaagcatttcagtttttcacttaagcttggtctgtatgt

SEQ ID NO: 37598 - DNA, 201 bp, Homo sapiens; identical to SEQ ID NO: 8285

SEQ ID NO: 37599 - DNA, 201 bp, Homo sapiens
actttaaagtttattcaagcaagcctagggaagggttgaatttaagtttaatatgatgctggagcagagggactgtgactacgagaacatattaaatgggyatgatgtccctcattcatagataagtatctacattatttaacagggacaacaggattgtcccttcttgagaaagacaacaaaggaaactcccatcactat

SEQ ID NO: 37600 - DNA, 201 bp, Homo sapiens
accatcctggctaacacatctctaccacaaaaaattagccgggcgtggcggcgggcgcctacagtcccagctactcgggaggctgaggcaggagaacggcrtgaacccaggaggcggagcttgcagtgagccaagatcacgccactgcactccagcctgggcgacagagcgagactcctactcaaaaaaaaaaagacttca

SEQ ID NO: 37601 - DNA, 201 bp, Homo sapiens
ttgcataagagggaaggaggaaataaagtctctagtacaaagcagaggtcctcctccagggggtagattagggaggaacaaagacaaagtcttgggctccrgtcctgaacattcaaatgtttatccggcaatcccccatcacaagctcaagtcttcattatgttttggaagaatgtagcctatataattttaacagaaatt

SEQ ID NO: 37602 - DNA, 201 bp, Homo sapiens
aagacaaagtcttgggctccggtcctgaacattcaaatgtttatccggcaatcccccatcacaagctcaagtcttcattatgttttggaagaatgtagcckatataattttaacagaaatttctcttgtttttcacgtcttaaaaatgtaaaagaatagtatctgtgccagtgaagatgtcagaattgtcacctataaaat

SEQ ID NO: 37603 - DNA, 201 bp, Homo sapiens
ggtgagaacaatgctgagttggtaagtagcaaagtagtaggtatgacattttactattgagattttttaaattctaatcctgaaaaaaaaatcattataaraacactttctggaagtccctttattgatttttttggtagtagaattgaaaaacttattacagatttataaggaatctggagttggctaaaagaaatacaa

SEQ ID NO: 37604 - DNA, 201 bp, Homo sapiens
ggtcagacacaatgttggcactcttggttctggtgactgtggccctggcatctgctcatcatggtggtgagcactttgaagggtaagtaagccatctttarggagcaagtccttcttccttgctagcccccaaatttggacacattactcatttccaattctctgtgcttctattatctcattattcagcgagaaggtgtt

SEQ ID NO: 37605 - DNA, 201 bp, Homo sapiens
ttgttaggaaggcatggttggttttgaaatgtgaggacatgagatttggaggggccggggtggaatgatagggtttggctgtgtccccacccaaacctcartttgaatcgtatctcccagaattcccacatgttgtgggagggacccaggggtaggtaattgaatcatggggaccgatctttcccaggctattcccatgat

SEQ ID NO: 37606 - DNA, 201 bp, Homo sapiens; identical to SEQ ID NO: 33430

SEQ ID NO: 37607 - DNA, 201 bp, Homo sapiens
atagttcctgtttgcaatcaggagaagaaagcaaagaacactcaggattataaaagcagatgagacctacccactagacctggtcagacacaatgttggcrctcttggttctggtgactgtggccctggcatctgctcatcatggtggtgagcactttgaagggtaagtaagccatctttaaggagcaagtccttcttcct

SEQ ID NO: 37608 - DNA, 201 bp, Homo sapiens
ggtagcaagaaataaaaacttggaaaacatttagtgccataatgtcttctttttctgcctaaattagattgccataagccctgtagtattataaatccatrgtaacttttaaaagagctgacagtgtgacaactggatgagttgcaactgtcacgaaggtcacagaacatctaatgtacagtcactttccttctaaggcaa

SEQ ID NO: 37609 - DNA, 201 bp, Homo sapiens
tgattccgacaatggaaaaaaaaacatgaaatattaactatagcattttggtagcaagaaataaaaacttggaaaacatttagtgccataatgtcttcttyttctgcctaaattagattgccataagccctgtagtattataaatccatggtaacttttaaaagagctgacagtgtgacaactggatgagttgcaactgtc

SEQ ID NO: 37610 - DNA, 201 bp, Homo sapiens
tatatatttgttaacacttttatcaacatctaactgcttggttccaacccttgttcactcaaaggaaatattttcaacagatttcatggatgatttgattytgaaaataactcaattcagtagagcaataatgtgctcgcagattatccttcatccattgaattataggtatccaatatatcttgtcctttattcagattg

SEQ ID NO: 37611 - DNA, 201 bp, Homo sapiens
ggagcaaccattttccaagtttaaggttcacagatagtcaaatacctgaggtttgggctgtggaagatcctaccttgcttgcattctccagtatccttctyagtgacttactcactctttatggtcagtaacagaatctctctggagcagctgaaggtcatcaggaagaaccagaggacaacatgagaatttatggagagt

SEQ ID NO: 37612 - DNA, 201 bp, Homo sapiens; identical to SEQ ID NO: 33260

SEQ ID NO: 37613 - DNA, 201 bp, Homo sapiens
atgatctacccttactcatatgcttacaaactcggtgagaacaatgctgagttggtaagtagcaaagtagtaggtatgacattttactattgagatttttwaaattctaatcctgaaaaaaaaatcattataagaacactttctggaagtccctttattgatttttttggtagtagaattgaaaaacttattacagattta

SEQ ID NO: 37614 - DNA, 201 bp, Homo sapiens
gttagcttaaaaacataccatcctaatcctgtgattaaatggatattttactatataatatatacataatagggacaactttaaggactccttgataaggrctcctatgaaaacaactccctaatttgaaagtttaaaacatccccacaagaacttcactaggtgatccttgccattaacatcatatgtttttccagaaat

SEQ ID NO: 37615 - DNA, 201 bp, Homo sapiens
caatgaattctaacacatgaacatctgtttcacagacacgcttatcccaaacattgttataactctttcctgcctacatccccgagggaaccagattcccyagcttcttttatcatatgtggatttttaaatcattattttgatttattcaaaaggaaaaatgcaataaaataagagaagacctataaatttaaccacatt

SEQ ID NO: 37616 - DNA, 201 bp, Homo sapiens
tataatatatacataatagggacaactttaaggactccttgataaggactcctatgaaaacaactccctaatttgaaagtttaaaacatccccacaagaayttcactaggtgatccttgccattaacatcatatgtttttccagaaattggagcctctcgaaacccctgtgatgaaacttactgtggacctgccgcagagt

SEQ ID NO: 37617 - DNA, 201 bp, Homo sapiens
aaaatatgagtttgtggaaataatactttatcacactctgatatacactacacacagagagagataaaataaatgagtgtttcactgatgggatactgggygattttctctgacaaacacataagtttctatgaatagattcaccaatgtgaagggattcacactatagctcaagaaaattgagaaataaatgctttgatc

SEQ ID NO: 37618 - DNA, 201 bp, Homo sapiens
gattttctagtttatttgcatagaggtgtttatagtattctctgatggtaattagtatttctgtgggatcggtggtgatatccccattatcattttttatrgaatctatttgattcttctgtcttttcttctttattagtcttgctagtggtctatcaattttgttgatcttttcaaaaaccacctccaggattcattgat

SEQ ID NO: 37619 - DNA, 201 bp, Homo sapiens; identical to SEQ ID NO: 33290

SEQ ID NO: 37620 - DNA, 201 bp, Homo sapiens
tttaccacctggctgataaagtattaatgctataggaattggaatccttgaagtcttacggccacgccctcatcagtttgacataagattctactaaactrgtttcaacattagaataaggaaaggaaaattcctactttgtaaaaatcatattattctgatttcatcaccaacctcacagttttccaggcatatgtagaa

SEQ ID NO: 37621 - DNA, 201 bp, Homo sapiens
attcaaaacactaaaagtgttcaagcaagaaagcacttccaaaccacaaaccaagctactatgcctatttcaacactggtgctagggtttctgtaagatcrctctgagtcatcaaacatctccaaagcatctttagctctgtccttgccatttaacttgatattgctttgaggaacaaggtgcaatttcttgtctgtaaat

SEQ ID NO: 37622 - DNA, 201 bp, Homo sapiens; identical to SEQ ID NO: 6253

SEQ ID NO: 37623 - DNA, 201 bp, Homo sapiens
taagcacacaatcagtattgtttcatgaccaaacttgtcatgaagttatcctgacctaaatacatactcagatcattcattttaactttctatgtacaaayctgaacaaaaggaagatccatctatctgtcttctgtattgacacaactggctctcttaaaactctctcctccctagccttcatggatactacactattcc

SEQ ID NO: 37624 - DNA, 201 bp, Homo sapiens
ccagggatgctgccaaacatcctgcaatgcacagaacagtcccacacaacaaagaactatctggtacaaaatatcaattgtgccaaggctgaggtccctgrggtagatgaggaagggaagagcaccatgtgaatgctgcagtaaattgtgctaaataatgaagtgccagtctcccagttcttataacctctaaagtgtctc

SEQ ID NO: 37625 - DNA, 201 bp, Homo sapiens; identical to SEQ ID NO: 6256

SEQ ID NO: 37626 - DNA, 201 bp, Homo sapiens; identical to SEQ ID NO: 33295

SEQ ID NO: 37627 - DNA, 201 bp, Homo sapiens; identical to SEQ ID NO: 33294

SEQ ID NO: 37628 - DNA, 201 bp, Homo sapiens; identical to SEQ ID NO: 33300

SEQ ID NO: 37629 - DNA, 201 bp, Homo sapiens; identical to SEQ ID NO: 33299

SEQ ID NO: 37630 - DNA, 201 bp, Homo sapiens; identical to SEQ ID NO: 33303

SEQ ID NO: 37631 - DNA, 201 bp, Homo sapiens; identical to SEQ ID NO: 33302

SEQ ID NO: 37632 - DNA, 201 bp, Homo sapiens; identical to SEQ ID NO: 33304

SEQ ID NO: 37633 - DNA, 201 bp, Homo sapiens; identical to SEQ ID NO: 33306

SEQ ID NO: 37634 - DNA, 201 bp, Homo sapiens; identical to SEQ ID NO: 33308

SEQ ID NO: 37635 - DNA, 201 bp, Homo sapiens
cactcctgccatcaatggttgactcaagtgccacccagactgttggcactcgacactgagttcttccctcatcccctgccctcactgacactgctggaccragagacctgagggtaggtttatggtgacagccccagaattttccccaaaacctgctggcttttttgcagcaccaattccatgttcagctgctgggcaacc

SEQ ID NO: 37636 - DNA, 201 bp, Homo sapiens
gaaaaggtatgtagcttaaaccctccctgactaaacagcctggtgaagacactcctgccatcaatggttgactcaagtgccacccagactgttggcactcracactgagttcttccctcatcccctgccctcactgacactgctggaccgagagacctgagggtaggtttatggtgacagccccagaattttccccaaaac

SEQ ID NO: 37637 - DNA, 201 bp, Homo sapiens; identical to SEQ ID NO: 33327

SEQ ID NO: 37638 - DNA, 201 bp, Homo sapiens; identical to SEQ ID NO: 33328

SEQ ID NO: 37639 - DNA, 201 bp, Homo sapiens
gcatcacaaatacgactgcttaagtgccaaaaacctggcccgcttaatgaccaatcagagaactacatgatcgttcaatctattcagaacctttttttttyccctgaggtaaatatagttaagctgtaaatattcttactgttttccatcaagtgtgctttttcttaaaatactgcttccttttcagcatcaaaaattcaa

SEQ ID NO: 37640 - DNA, 201 bp, Homo sapiens
aatccataggagaggactttttgtttggttagttggtgggctgattttcagctttttaatttttttcatagagtggagatgttgtaaccctgtcttataarctaatagaattaggaaagctgcctccatccacagcagtttgtttttcatcccaatggtttgtcaacataatgaactagataaacaatctgcacaagaaat

SEQ ID NO: 37641 - DNA, 201 bp, Homo sapiens
tcaggcctcacttgttactgaaaactcagcagaaacttacaaagacacaagaacaattgggaggatgccaaacacacaagccaaataaactgaagattctycttcaggcttcagtttctttgcttttcctacatacatctcacccagcatttggctaggcactcctaactaagaatgttgaggttatcagaaaaattggcc

SEQ ID NO: 37642 - DNA, 201 bp, Homo sapiens
tacacctatttaattcacttattcttcacaattgtgcttggattacccgtgaaattttcagggacctcagacaaagctaagcatcatttcaagttatttcyccattaagtattttcactgcacatgcatgttaggcagacgtcaccaaaacaacaacttaaaagttaaatacatcggatttttgttattattaaactaaca

SEQ ID NO: 37643 - DNA, 201 bp, Homo sapiens
tgaataagtatctattttttaacttaacttagcaaaacttaagggtgtaagttaccaaagagatttacaaaactgtttttaagtagatatattataaaacrtaattattgtttgaaagcatattcataaattcttaccccacttacacctatttaattcacttattcttcacaattgtgcttggattacccgtgaaatttt

SEQ ID NO: 37644 - DNA, 201 bp, Homo sapiens
ttaaagcatccaggaggatgtgcataagttatataaaaataactacagcattttataaagggagttaagcaccagtggattttggaatctgcaaggatccstagaacaaatcacccaccagatactgagggatgcctctacttctaaataatccatgagtcaaagaggaaggctcaaggaaaagcaaaaatatatattgaa

SEQ ID NO: 37645 - DNA, 201 bp, Homo sapiens
cagagcgataatccatttcatttcactggcagagttgggagagggcatttaacaaggtcagctttaacactgttttcctgggatgctgaatgtggtttgtwactgttgatgctctgtgttttggaataaggttgtaagactaggtttaaaagaaggtattgacctgtcattttcctataaaagtggagcagagatggcttt

SEQ ID NO: 37646 - DNA, 201 bp, Homo sapiens
aaaatgaagaaatgacaaaacaggattgttgttattgtgagattaatatattttaaagttttacattagtatatagacccttatatgaataaaaatgaagkaactatattattcacaagataacataatttataaacatatacagttaacgagtacatcaaagagcccagtgatggggcataaggcaaacctgtataatga

SEQ ID NO: 37647 - DNA, 201 bp, Homo sapiens
gatttggagctggtgcgggtgactgtcaagcgcagatggccagttaccgacgtaatctgtgtatctgggaggcatgtgctataagaaggcagctgctaaamcaaatgaatcaagccacagtttttaagaaggaaaagtgtagattggaaaaggataaaagttttgaatgcatgcagctgtgcagggctatgatcaatgctt

SEQ ID NO: 37648 - DNA, 201 bp, Homo sapiens
attatatctttagtctcatctagaaataatgtcacaaatctgcactcaagaatctgtagatcataaaacataaaatgaaccgtgggtttattctattttartatttctgtagaagacatctcaactaataaagccatgtcacatttttttcctttgctgctaatggagtatttgcaaaactctgcacactgccgaaaaaac

SEQ ID NO: 37649 - DNA, 201 bp, Homo sapiens
gaaatgtatattctctacttccactctcccatcggccatcgattactttggaggcatgcagctctcatagagaccacctttgacattggtttggtctattscagaatggcatggccacaggtcaaatggatcacagtaaaaagtgctattggatcaggggtctgcctctgcaaatctgctgtcttagctaaatgccctctt

SEQ ID NO: 37650 - DNA, 201 bp, Homo sapiens; identical to SEQ ID NO: 33336

SEQ ID NO: 37651 - DNA, 201 bp, Homo sapiens
ctgtccgacaagccccagtgggatgaacctggtacctcagttggaaatgcagaaattatccatcttctgcatcgctcatgctgggggatatagactggagytgttcctattcagccatcctggaacttccccccaccaaatatttatataatttcaatacataaggattttatccctacaaaatccttattaattacaaag

SEQ ID NO: 37652 - DNA, 201 bp, Homo sapiens; identical to SEQ ID NO: 33338

SEQ ID NO: 37653 - DNA, 201 bp, Homo sapiens; identical to SEQ ID NO: 33339

SEQ ID NO: 37654 - DNA, 201 bp, Homo sapiens; identical to SEQ ID NO: 33341

SEQ ID NO: 37655 - DNA, 201 bp, Homo sapiens
agtggtaggggctagacccgagagctgtgggtgctgcagcttagatttatctggaaggcacattccacaggcctcattttcaatttctacgtatatcttcytttgccttcaaatggtttctttctgcctgaggttggaaagaaattgaaacacacacatgacaaaagacccagtctcatcatcaagtggcctccagtgcag

SEQ ID NO: 37656 - DNA, 201 bp, Homo sapiens
ggggtgttacctaggggtaactctgcctggtgctttctggtttataaagaaagatatcaatgcagagacttcatcaaatgctttactaagatcaagattcracattctaccaggttagtgctctcatccaaaactaaggtgaatttaattgggcctgacttattcttgctttaaaccatactggctcccagagaccacagc

SEQ ID NO: 37657 - DNA, 201 bp, Homo sapiens
ggtttgaacagttagccccctttgattggccaaaactcagttattggcacaagtgtaggttacatctgtatacaactctgtttagtttgtacttcagtatrtacagggaaacctgtaggccaaacttaaaatatgtaagtagtcagctttaggcttaacttgatttagcatactcaatatctaacagacacaaatacatgt

SEQ ID NO: 37658 - DNA, 201 bp, Homo sapiens
ataacagaattctaaaattaagaggatttctatttttcctctttcacctttcctgtattttccagaatcattttcaatgggcatttataatttttagaatsagaaaataaaactctaaaaagcaaagctataacattaaaaaaaattattgaagtagtccacatgaaaacaaatacagagacatattttatccctaaaggt

SEQ ID NO: 37659 - DNA, 201 bp, Homo sapiens
tacctagaatcatatgccatttgttcatcttattctgcaagctgacctatatgaattggtcaaagagagaatttctagaaggaaaagaaggcagaccatarcaagttaacatgttaatttgggggcaaaaagggttctgctgagtgataatgattaaaaatatatagagaaaagcatagctaaactatatggtgatatttt

SEQ ID NO: 37660 - DNA, 201 bp, Homo sapiens
cccaaagtatggaaatcttggcaaaccacaaagaactctcctaattccctaaattgaatgctttaaaatagaaattaggaataatatatgtggactgcttktttaaaattccaaggaatttttaagggtaagaacaaagaataggaaagcaaatatgcaaatattcttatttgaaatcccatgtatctgagatgtcctgca

SEQ ID NO: 37661 - DNA, 201 bp, Homo sapiens
acctctttgagcctcagtttactcatctataaatagggtcctattcaacctcaggcttataagaaggatagagtaaattaatgtatggcaaagtgattgayagatatcagacccttagcaaatattagtgatattgatgatagctctgtgtttcaaaaaagaaagccagaggggaaaatcaaaaggggttttcttcctggt

SEQ ID NO: 37662 - DNA, 201 bp, Homo sapiens; identical to SEQ ID NO: 33358

SEQ ID NO: 37663 - DNA, 201 bp, Homo sapiens; identical to SEQ ID NO: 33360

SEQ ID NO: 37664 - DNA, 201 bp, Homo sapiens
gaggttgcagtgagccaagatcgtgccactgcactccagcctgggcgaaagagtgagactccgtctcaaaaaacaaacaaacaaacaaacaaacaaacaaaaaaacttgtatgattatgctcttagaggccatgaattatctgcttgatctcttggggctgccactgagtaatccagaagaccattaaattccccagtaag

SEQ ID NO: 37665 - DNA, 201 bp, Homo sapiens; identical to SEQ ID NO: 33364

SEQ ID NO: 37666 - DNA, 201 bp, Homo sapiens
ctgtcaatgcccatgggactacaaaagactattgaacataaggggaaagcaggagctatctggataattcagccaatggccaatacttcacctgttctggktttggtcttggtttccaagactaccacttctgtttttcctcccaaaagcttttcaaacaccagctttttcaaggtaaaactatgaaatcaggagctgttc

SEQ ID NO: 37667 - DNA, 201 bp, Homo sapiens
ggaggttgcagtgagccaagatcgtgccactgcactccagcctgggcgaaagagtgagactccgtctcaaaaaacaaacaaacaaacaaacaaacaaacaaaaaaacttgtatgattatgctcttagaggccatgaattatctgcttgatctcttggggctgccactgagtaatccagaagaccattaaattccccagtaa

SEQ ID NO: 37668 - DNA, 201 bp, Homo sapiens; identical to SEQ ID NO: 33366

SEQ ID NO: 37669 - DNA, 201 bp, Homo sapiens
ctttgacaggtaaatcttacttcctgtgttccagtctctgtgtagaagagaattaaaggttgtttccttacagttcactttttttttttcatttgcctccrcaaagggagaaggtgttccgcgtgaagccccaggatgaaaaacaagcagacatcataaaggacttggccaaaaccaatgaggtaagcatttagagggata

SEQ ID NO: 37670 - DNA, 201 bp, Homo sapiens; identical to SEQ ID NO: 33368

SEQ ID NO: 37671 - DNA, 201 bp, Homo sapiens; identical to SEQ ID NO: 33371

SEQ ID NO: 37672 - DNA, 201 bp, Homo sapiens
cagagcttctcgacaagttagacttttatgtcctgcctgtgctcaatattgatggctacatctacacctggaccaaggtatatgcaccaatactgagagargctgatgaaattaaaaccaacgcctctctattatatttgtcctaactatgtagtccactttcagagccgattttggagaaagactcgctccacccatact

SEQ ID NO: 37673 - DNA, 201 bp, Homo sapiens; identical to SEQ ID NO: 33372

SEQ ID NO: 37674 - DNA, 201 bp, Homo sapiens; identical to SEQ ID NO: 33373

SEQ ID NO: 37675 - DNA, 201 bp, Homo sapiens
aacacaagaccatgcttcaagcaagtttatcatggaatctgatgctagaccatcagtcctgagaatgaaaactgtagcccatccacagaggcactctcctytgactaagtaggacctgtcaacagccaatactccatggatcagggaaagcatttcatgtggtttagaatcactcttctggctgtaatgcaataccggaga

SEQ ID NO: 37676 - DNA, 201 bp, Homo sapiens
gtggagaaggaagaagactgggagcacaaagagagggagaggcatttttttaatcctttttttaatgcttgtgcaagagatgttgggggtaattgcttcarctgtgttcttcacactgcctctgaagccctgccatggccaacaatttgtgacttggtccgtatttctcttgatcaacctgtcactctgtcagttaaaatt

SEQ ID NO: 37677 - DNA, 201 bp, Homo sapiens
aaaaatgctaagaggaaatacgagcaaacaaatagtttcaaaaatgggtataatgcaggagtgagcaagtggagaaggaagaagactgggagcacaaagaragggagaggcatttttttaatcctttttttaatgcttgtgcaagagatgttgggggtaattgcttcagctgtgttcttcacactgcctctgaagccctgc

SEQ ID NO: 37678 - DNA, 201 bp, Homo sapiens
gatgacaaattttgagagaaagtaaggatgcaattttttcaaatgccaactcatggacccctaagatttttttcccctaagaaaaccctgctttagaagasgaaagctacaggaaaatgtttctattgcactctcttcttccctgtccccagacttttcctgaatcactcataatccctttacctatattcttttttcctt

SEQ ID NO: 37679 - DNA, 201 bp, Homo sapiens
ggtacttctttttgaagtatcaattaagatcagtggcaacttcaaagtaattgtaagtataagtaattttcaaggtatttgcaaccattacattgtaataygaaaatattttttgtttctattagagacctagtcatggatgttgctaataatacagaagtttgtagcctatatttatagttgagggagatgacaaatttt

SEQ ID NO: 37680 - DNA, 201 bp, Homo sapiens
tattattccctaaacaatacagcataacagctatttacatagcatttgtaatgtattctatattattagtaatctagaaatgatgatttaaagcatccagraggatgtgcataagttatataaaaataactacagcattttataaagggagttaagcaccagtggattttggaatctgcaaggatccctagaacaaatcac

SEQ ID NO: 37681 - DNA, 201 bp, Homo sapiens
cggaggttgcagtgagccaagatcgtgccactgcactccagcctgggcgaaagagtgagactccgtctcaaaaaacaaacaaacaaacaaacaaacaaacaaaaaaacttgtatgattatgctcttagaggccatgaattatctgcttgatctcttggggctgccactgagtaatccagaagaccattaaattccccagta

SEQ ID NO: 37682 - DNA, 201 bp, Homo sapiens
gcggaggttgcagtgagccaagatcgtgccactgcactccagcctgggcgaaagagtgagactccgtctcaaaaaacaaacaaacaaacaaacaaacaaacaaaaaaacttgtatgattatgctcttagaggccatgaattatctgcttgatctcttggggctgccactgagtaatccagaagaccattaaattccccagt

SEQ ID NO: 37683 - DNA, 201 bp, Homo sapiens; identical to SEQ ID NO: 33381

SEQ ID NO: 37684 - DNA, 201 bp, Homo sapiens
acacagtagaagtttgagcaaagagggaaatgcaccaagaaatgcagccaaggtataggagggattcaccttgctccaagccaggccctttgtcattagaagcagtttttacagctcaggataaaagtgggcaattgtctgtttaccttagtcaatataatacagtcagtaaaattacctaatcatcaaagtagaatattt

SEQ ID NO: 37685 - DNA, 201 bp, Homo sapiens
gcacagacaagtcggctagaggtcagggcctcagggcctcccccactgaggaccgagagcataaatacctcagacacactgtaagccattcatgtgggaarggttgctgtccagtagaggttgctaacttttttgtcatgctatctgttgacatctattaaccccttctcagaatatttttaaatgcatgaaataaaattt

SEQ ID NO: 37686 - DNA, 201 bp, Homo sapiens; identical to SEQ ID NO: 33386

SEQ ID NO: 37687 - DNA, 201 bp, Homo sapiens
gtaacctaacagtttgcctaaacttcctttgtcatagaacacatgaagtttatgtttgcacagacaagtcggctagaggtcagggcctcagggcctccccmactgaggaccgagagcataaatacctcagacacactgtaagccattcatgtgggaagggttgctgtccagtagaggttgctaacttttttgtcatgctat

SEQ ID NO: 37688 - DNA, 201 bp, Homo sapiens; identical to SEQ ID NO: 33388

SEQ ID NO: 37689 - DNA, 201 bp, Homo sapiens
ttcattgttcaaaaactaaagataaattggcatggaaacacataccagactagagactaccaaataatatagagagtatgtatggatggatatatatatakagagagagagagacagagagtatggatttattaaaatttgaccttatataagagggggaaaatgactacatgaagataaaggttttagtcaagcctctca

SEQ ID NO: 37690 - DNA, 201 bp, Homo sapiens; identical to SEQ ID NO: 33390

SEQ ID NO: 37691 - DNA, 201 bp, Homo sapiens
aactcataggcttgtgaaggaggcagctcctgtcattattgctttgctatttggatgctgatccacagaaaggttaaataccgtttccaaggtcacggagmgttttcctgacagagcctacttaagcattcattgccgctgacacagggctctagggaaaaggaaacagaggaggcgaggaaaagccctaggctacaatga

SEQ ID NO: 37692 - DNA, 201 bp, Homo sapiens; identical to SEQ ID NO: 33392

SEQ ID NO: 37693 - DNA, 201 bp, Homo sapiens; identical to SEQ ID NO: 33395

SEQ ID NO: 37694 - DNA, 201 bp, Homo sapiens
ctaggagtggggtgcagggaactggagggcaatggttcttatgagaaggtgatgatgcttctaagaaaaaagattacacgtaagttaatacctaacaattktttttaattctgaaattcaaatgttctgcattttgaaatagaatgaatattctctaactttttagtctaaaaaatttccaagctggagctaccactcatc

SEQ ID NO: 37695 - DNA, 201 bp, Homo sapiens
atgattaccagtagtgggacaaatcaacactgagtcccacctgataggattcaatgagaatacggtatcacttctataatactcctatcaaaatgcataayctgaatcaaaccataagaaaatatcaaagatacaaaaagtaaggaacattcaagaaaataactggtctgtcatctttaaaagtcgcaacatgaaagtcaa

SEQ ID NO: 37696 - DNA, 201 bp, Homo sapiens
agaccccaacagaaattttgatgctggttggtgtggtaagtatctggctagccattttgcatgtatccattgaaaaacataagaggaaaaatatgaaaacrcaacagtatctaaaataaaaaaagcaagttttatattttaaagttctaaccttctaaaagcaccaaaaaaaaaaaaaccagtttaattcatttgaccaaa

SEQ ID NO: 37697 - DNA, 201 bp, Homo sapiens; identical to SEQ ID NO: 33397

SEQ ID NO: 37698 - DNA, 201 bp, Homo sapiens
caattgcgggcacccctcccccagcctcgctgccaccttgcagttcgatctcagactgctatgctagcaatgagcaaggctccatgggcgtgggaccctcygagccatgcacgggatataatctcctggtgtgccatttgctaagactgttggaaaagcgcagtattagggtgagagtgtcccgattttccaggtaccatc

SEQ ID NO: 37699 - DNA, 201 bp, Homo sapiens
gaatagctttccaaatcagtaaaactcacaaatacttggctgaggcaaatacaaaattattctataggagtgactccacagggaccagtctacaacccaasacactgggatttctctggtaaacaatccctcttgaaaaattacccacagtaaaaaaattataagccctacatagaaatgagccacgttgaagcacagtga

SEQ ID NO: 37700 - DNA, 201 bp, Homo sapiens
tatgtcctgcctgtgctcaatattgatggctacatctacacctggaccaaggtatatgcaccaatactgagagaggctgatgaaattaaaaccaacgcctstctattatatttgtcctaactatgtagtccactttcagagccgattttggagaaagactcgctccacccatactggatctagctgcattggcacagaccc

SEQ ID NO: 37701 - DNA, 201 bp, Homo sapiens; identical to SEQ ID NO: 33399

SEQ ID NO: 37702 - DNA, 201 bp, Homo sapiens
aatcctgaaaaaaaaatcattataagaacactttctggaagtccctttattgatttttttggtagtagaattgaaaaacttattacagatttataaggaawctggagttggctaaaagaaatacaattttcacgcaggaaattgttccccacatgcgatttattgactaatcttcaaaatgacaatagttccatttcctct

SEQ ID NO: 37703 - DNA, 201 bp, Homo sapiens
cttttgcctgcttctgccatttccccaggatcccatctgtgggctctgaagcaagtgaatgtcccagaaaaatcccacatcctcgtcaccagaaattcagsgaaaggaataagaacctccctaggttcttagttggaacagacccattacaaaagacaggttaacaagagagaaacaaacagaagtttgttaacaggttta

SEQ ID NO: 37704 - DNA, 201 bp, Homo sapiens; identical to SEQ ID NO: 33401

SEQ ID NO: 37705 - DNA, 201 bp, Homo sapiens
cattttgcatgtatccattgaaaaacataagaggaaaaatatgaaaacacaacagtatctaaaataaaaaaagcaagttttatattttaaagttctaaccytctaaaagcaccaaaaaaaaaaaaaccagtttaattcatttgaccaaaacatattgagaactctgttgcgttcccagctgtgctagatgctgaaaatata

SEQ ID NO: 37706 - DNA, 201 bp, Homo sapiens
ttttcttaaggggtttctagcagagatagcccacctatttatatatggtgaacttggtgcatgttttattcagttcaactaggcttctttttccattacaytgtaagactttggagggcagagccaacatctctcctttgttctggcatcttcagagttgagcccatagcctgctgttcagtgggggctatacaattgttg

SEQ ID NO: 37707 - DNA, 201 bp, Homo sapiens
aaaaagttgctcctatcaggctatgaatatcagaaaccaaacttttttaaccgaaggtattatctactaagcaactcaggatcaaaaccaataaacctttyatggcttaaccacagatacactagtcatctccagaggtgcaaagatactgcctccatgatttcaaagttcactttcagagatagccaaaaaaaatcaaag

SEQ ID NO: 37708 - DNA, 201 bp, Homo sapiens
tgtttgtatataacaagagccatccactgcacacaagttctaccaaaataacttttcagattttttcagtgtttccaaccctcttcaccaagacctgtatyatttggcagctttaatcagatcctgaattatcataggaaaaaaatcaaaatgtgtgcaaaaagaaagataactgtaattttcaatgacaaagtttcactc

SEQ ID NO: 37709 - DNA, 201 bp, Homo sapiens
gacagagcttctcgacaagttagacttttatgtcctgcctgtgctcaatattgatggctacatctacacctggaccaaggtatatgcaccaatactgagasaggctgatgaaattaaaaccaacgcctctctattatatttgtcctaactatgtagtccactttcagagccgattttggagaaagactcgctccacccata

SEQ ID NO: 37710 - DNA, 201 bp, Homo sapiens
agaaggaagaagccaacttggggagatcttaagttcttaaagaagctaatgaagttccatattacccttaacaaaatttatgccaatgagaaagaaacctkaaagtggcggcagaacctacagttagcaagggtttgagaagggcttcccatggaggaattcctatgggaggagcaggatcaaatggagagaacagagtgg

SEQ ID NO: 37711 - DNA, 201 bp, Homo sapiens
gaaacagaagcaatgagaaggaagaagccaacttggggagatcttaagttcttaaagaagctaatgaagttccatattacccttaacaaaatttatgccartgagaaagaaaccttaaagtggcggcagaacctacagttagcaagggtttgagaagggcttcccatggaggaattcctatgggaggagcaggatcaaatg

SEQ ID NO: 37712 - DNA, 201 bp, Homo sapiens
tgatcacttagatgtgtgacttaatctgtatggctggataaattctggattttctgtctatccatggtttaacccataatgttactggaaaatgagccaayattactttgttctggctgtgtgcacagcagtgaattctaattgtgtttctcaatctaagccccagaatgaaaactgccaagatcaattcattttgataaa

SEQ ID NO: 37713 - DNA, 201 bp, Homo sapiens
cgctcatgctgggggatatagactggagctgttcctattcagccatcctggaacttccccccaccaaatatttatataatttcaatacataaggattttayccctacaaaatccttattaattacaaagggataaagagaatcttcacagtggaaaaacctgactgtaccactttaataatggtcatgattaccagtagtg

SEQ ID NO: 37714 - DNA, 201 bp, Homo sapiens
caaagtccaggtactgatcaaatattctattttccagaaatctgaaagggggataaaactgagtcatgtctttctttacttctcagacattgtgttccttrcttttttgggagtcccagttatctaatttgcttgtgtgttagaaaaaaaaaaaaaaaaaggagaagttggatggcactataaaacgagcatataaaagta

SEQ ID NO: 37715 - DNA, 201 bp, Homo sapiens
tggggttgcaagcagtccctgtgcatcccattattacctcatatggtaactagtatttagacgatttcctgctggcaaaaatttgcagtagtgtttgtatrtaacaagagccatccactgcacacaagttctaccaaaataacttttcagattttttcagtgtttccaaccctcttcaccaagacctgtattatttggcag

SEQ ID NO: 37716 - DNA, 201 bp, Homo sapiens
gggggtcagggacccacttgaggaggcagtctgtccatactcagatctcaatctctgtgctgagagaaccactactctcttcaaagctgtcagagagggaygtttaagtctacagaagtttctgctgccttttgttcagctatgccctgcccccagaggtggagtctacagaggcaggcaggcctccttgagctatggtgg

SEQ ID NO: 37717 - DNA, 201 bp, Homo sapiens
ctcgggggtcagggacccacttgaggaggcagtctgtccatactcagatctcaatctctgtgctgagagaaccactactctcttcaaagctgtcagagagrgatgtttaagtctacagaagtttctgctgccttttgttcagctatgccctgcccccagaggtggagtctacagaggcaggcaggcctccttgagctatgg

SEQ ID NO: 37718 - DNA, 201 bp, Homo sapiens
actctgatttttagaattttcagcttttctgctctggtttctccccatctttgtggttttatctacctttggtctttgatgattgtgacgtacagaggggkttttgatgtggatgtcctttctgtttgttagttttccttctaacagtcaggaccctcagctgcaggtctgttggagtttgctggaggtccactccagacg

SEQ ID NO: 37719 - DNA, 201 bp, Homo sapiens
tgccgtttattctagttagccattcatctaatcttttttcaaggtttttagcttctttgcaatgggttcaaacatcctcctttagcttggagaagtttgtkattaccaatcgtctgaagccttcttctctcaactcgtcaaagtcattctctgtccagctttgttccgttgctggcaaggagctgctttcctttggaggag

SEQ ID NO: 37720 - DNA, 201 bp, Homo sapiens
tgaagcttgtgcatgtgtcacgtagttcttgtgccatggttttcagctccatcaggtcatttaaggtcttctctatgccgtttattctagttagccattcrtctaatcttttttcaaggtttttagcttctttgcaatgggttcaaacatcctcctttagcttggagaagtttgttattaccaatcgtctgaagccttctt

SEQ ID NO: 37721 - DNA, 201 bp, Homo sapiens
ttttgcaacttggtttcattctccccgtcactttcagttacgccaatcagacgtagatttggtcttttcacatagttccatatttcttggaggctttgttygtttctttttactcttttttctccaaatttctcttctcgcttcatttcattcatttgatcttcaatcactaataccctttcttccacttgattgaattgg

SEQ ID NO: 37722 - DNA, 201 bp, Homo sapiens
agaatttctgccaagagatcagctgttagtctaatgggcttccctttgtgggtaaccgacctttgtctctggctgcccttaacattttttccttcatttcractttggtgaatctgacaattatgtatcttggagttgctcttctcaaggagtatctttgtggctttctctgtatttcctgaatttcaatgttggcctgcc

SEQ ID NO: 37723 - DNA, 201 bp, Homo sapiens
agcaggactccaaagctcaagtgactgagaggctagagtgggagggaaaaggtccgtcaaagaaggacagagggacggaggaggcagaggctggaaggagrcatatcaacaatgtaagggaactgatggaagatttaaggcaacaaaagaaaaaaggagaaacagaagcaatgagaaggaagaagccaacttggggagatc

SEQ ID NO: 37724 - DNA, 201 bp, Homo sapiens; identical to SEQ ID NO: 33415

SEQ ID NO: 37725 - DNA, 201 bp, Homo sapiens
ttttttttgttttccatttgcttggtagatcttcctccatccctttattttgagcctatgtgtgtctctgcacatgagatgcgtctcctgaatacagcacrctgatgggtcttcactctttatccaatttgccagtctgtgtcttttaattggaacattaggcccatttacatttaaggttaatattgttatgtgtgaatt

SEQ ID NO: 37726 - DNA, 201 bp, Homo sapiens
agtgccagtatatttccaattaacctttgtagtctcggatatatgctttgggggaatcctgagatccatgagagcaggactccaaagctcaagtgactgaraggctagagtgggagggaaaaggtccgtcaaagaaggacagagggacggaggaggcagaggctggaaggaggcatatcaacaatgtaagggaactgatgg

SEQ ID NO: 37727 - DNA, 201 bp, Homo sapiens; identical to SEQ ID NO: 33417

SEQ ID NO: 37728 - DNA, 201 bp, Homo sapiens
ttgggtgcatatatatttaggatagttagctcttcttgttgaattgatccctttaccattatgtaatcgccttcttagtctcctttgatctttgttggttkaaagtctgttttatcagagagtaggattgcaacccctgcttttttttgttttccatttgcttggtagatcttcctccatccctttattttgagcctatgt

SEQ ID NO: 37729 - DNA, 201 bp, Homo sapiens
tgaagttcgcatttcaaaagggatggttctcaggtaagacagggtagaacatttatatctcaaaggtacagaaaaagaatgtaagtttcaatccaagaagsagccttggggcacatttttctatcatcagagctcaatcctgtggaggctgttgactaaattttaagtgccagtatatttccaattaacctttgtagtctc

SEQ ID NO: 37730 - DNA, 201 bp, Homo sapiens; identical to SEQ ID NO: 33418

SEQ ID NO: 37731 - DNA, 201 bp, Homo sapiens
atgttaggacatcaattttagatctttcctgctttctcttgtgggcattcagtgctataaatttccctctacacactgctttaaatgtgtcccagagattmtgttatgttgtgtctttgttctcattggtttcaaagaacatctttatttctgccttcatttcattatgtgcccagtagtcattcagaagcaggttgttca

SEQ ID NO: 37732 - DNA, 201 bp, Homo sapiens
aagaaaatcacagtaaggctaatttattttcaaaataagtctagtgttattaaacttcaattgattatttatataagtgcagcaaaaacagtgattgatcrcataggctctttttaagtctgctttgctggaacttttgataagaaatttcagattagatttttaaaaggctttgactcaaggccaaggatttgctagaag

SEQ ID NO: 37733 - DNA, 201 bp, Homo sapiens
ggctgtcatataacttatgccaaatctgttttcttctccttaaaaaaatatgttttcaaaaactttttctaaatattttcatgaagttagtgctggtcaayggagccacactaaagcactcataacctcagcttaaccacgggaaaagcactttgttatagcattgatcgacctcacatttatttcagaaaatccacagtt

SEQ ID NO: 37734 - DNA, 201 bp, Homo sapiens
acaggtccccatatggagcagtcttttcgacattgaattcctaaggaaatttctcacgttggactgtggatagagacatagagtcacagagggatcgtttktaagcatcattttttatttcagcctgattcttagttggttgttctcggaatgttcttcttaaaacccaagagcatgacaccaattcaatgaagcttggtg

SEQ ID NO: 37735 - DNA, 201 bp, Homo sapiens
ctcttgtaaggcaggcctggtggtgacaaaatctctcagcatttgcttgtctgtaaaggattttatttctccttcacttatgaagcttagtttggctggawatgaaattctgggttgaaaattcttgtctttaaaaatgttgaatattggccccctctctcttctggcttgtagaatttctgccaagagatcagctgttag

SEQ ID NO: 37736 - DNA, 201 bp, Homo sapiens
catgtcatacattcttggtgaatagaattgcagcacctaacttcaaagatttatcaatgaaaagaaccagaatatgagcctgttctgcatacctgccatgmatacatttaaagcatatacagagttcagcagtatcagagaaacaaaatgtcaaaaacattgtctaatcatttttttgtttgtttgtttgttttgagacag

SEQ ID NO: 37737 - DNA, 201 bp, Homo sapiens; identical to SEQ ID NO: 33422

SEQ ID NO: 37738 - DNA, 201 bp, Homo sapiens; identical to SEQ ID NO: 33423

SEQ ID NO: 37739 - DNA, 201 bp, Homo sapiens; identical to SEQ ID NO: 33424

SEQ ID NO: 37740 - DNA, 201 bp, Homo sapiens
tttgcttcgctgttcactgcttagcacatttgtagcatataattttctaaatattaaataataataagtccctggaaatcctggagaagcataccagcaayatccttgctggggttgcaagcagtccctgtgcatcccattattacctcatatggtaactagtatttagacgatttcctgctggcaaaaatttgcagtagt

SEQ ID NO: 37741 - DNA, 201 bp, Homo sapiens; identical to SEQ ID NO: 33425

SEQ ID NO: 37742 - DNA, 201 bp, Homo sapiens
aacaaagatcagcgaccatagattaaccctagctacctgaatgatgtcttaattctacccttatcacaaaacagtaaaatggtttctgatagaatttcaayctctatttataatcagatagaaagttcactttcttttttagtggtgaactttttgggaattgtgtatgaatgttgtctcatctagaacataggacatccc

SEQ ID NO: 37743 - DNA, 201 bp, Homo sapiens; identical to SEQ ID NO: 33426

SEQ ID NO: 37744 - DNA, 201 bp, Homo sapiens
ataataaagacatatctctctctcccaccacaccatagaatgacaggtgtttattaggaacacaaattcagagctaagtttcaaaaatatgctttctcttrtaatgtgcttatcttcaattgcccttctctccacaatgttggctaactagaagttgtcaccagccccttgctttctctgtccttatcttagcatgtcttt

SEQ ID NO: 37745 - DNA, 201 bp, Homo sapiens
gaaaaattcctttgaaaaaatgtaaagacactaattataaaagaaaaatgttggtaaacaaactttatcaaaattaaaaacatctgttcatcaaaacatamcattaagaaaataaaaatgcaagccacatactgggaaaaatatttggaacatatatttctaacacaggtcttgtatccatgctatataaagaacggctac

SEQ ID NO: 37746 - DNA, 201 bp, Homo sapiens
cactgtttcctcatcaatatttagttgacttgctgtttcggtagtatgcttttgggccttagagttgattctggaaaggatcgagactttggagaatgctrgaacagagtgaatatattttataccttcacctctccaaagacccagatcatcatttccaactgcttattgtacatttccacttggataacacattgactg

SEQ ID NO: 37747 - DNA, 201 bp, Homo sapiens
tgagggatgagtgtctcagcactgaaaaaaggatctgggcagagccctgtggtgtccaccccacagcctggaggagcgcttagctcctccgccacctcctctttttccccttctcctttcttctcctgctcccccatgggctcctcctttagcacaaactgcttccattctacaccacatcgccctggggcaaaacacagc

SEQ ID NO: 37748 - DNA, 201 bp, Homo sapiens; identical to SEQ ID NO: 33427

SEQ ID NO: 37749 - DNA, 201 bp, Homo sapiens
ggaagattagaagaggcagccccctgtcatgatgctggctgtgtacaagagattggaacaagggctatgtgcacagtcacgaaaggggagtttctttatcrtatattcgatgggaatgcaggtcagtggaaaagaatatcctctccttattcatctcaccaggtccttggaactcaatgcctggagaaacattacactaag

SEQ ID NO: 37750 - DNA, 201 bp, Homo sapiens
atccatttttaaagaggttcataaacttcatgtctatcagacaacattacaaagcacatcaacaatttgtttctgtcattttctaacaccatttttgtcaygtaattctaatgaaggaaataaaaagacagggaataagtgagagagtagtaaaaattcttacaagattagcgacaatcatgattacttctaattactcat

SEQ ID NO: 37751 - DNA, 201 bp, Homo sapiens
aggagtgaccaggaggaaggttcagaggatgtccctgacatacttcatcagaatgtccttggggcagccagaggagaagcagacttttgatgtgtgtctgmaattctctgtatgtcagataaaatcatttcaaggtttaactgtggataatagaaatttctgcaaagtggcctctgtctgtaatattcactgtactgtgat

SEQ ID NO: 37752 - DNA, 201 bp, Homo sapiens
tagaggtgtttatagtattctctgatggtaattagtatttctgtgggatcggtggtgatatccccattatcattttttatggaatctatttgattcttctstcttttcttctttattagtcttgctagtggtctatcaattttgttgatcttttcaaaaaccacctccaggattcattgattttttgaagggatttttgtg

SEQ ID NO: 37753 - DNA, 201 bp, Homo sapiens
tacccttatcacaaaacagtaaaatggtttctgatagaatttcaatctctatttataatcagatagaaagttcactttcttttttagtggtgaactttttrggaattgtgtatgaatgttgtctcatctagaacataggacatcccctgagggctaagagcttgttaatttttgcttcgctgttcactgcttagcacattt

SEQ ID NO: 37754 - DNA, 201 bp, Homo sapiens
catatacacatacacaaaaattagccagagttgggggtgcatgcctgtaatcccagctactcaggaggctgaggcacaaaactgcttgaacctgggaggcraaagttgcaatgagccaagatcacaccactgcactccagcttgggcgacagagcaagactctgtctccaaaaaaaacaaacaaaaacaaacaaacaaaca

SEQ ID NO: 37755 - DNA, 201 bp, Homo sapiens; identical to SEQ ID NO: 33433

SEQ ID NO: 37756 - DNA, 201 bp, Homo sapiens
cttgcaccccagggatgaagccaacttgatcgtggtggataagctttttgatgtgctgctggattcggtttgccagtattttattgaggatttttgtgtcsatgttcatcagggatattagtctaaaattctcttttattgttgtgtctctgccaggctttggtatcaggatgatgctggcctcataaaatgagttaggga

SEQ ID NO: 37757 - DNA, 201 bp, Homo sapiens; identical to SEQ ID NO: 33434

SEQ ID NO: 37758 - DNA, 201 bp, Homo sapiens
gcatatattgaaccagtcttgcaccccagggatgaagccaacttgatcgtggtggataagctttttgatgtgctgctggattcggtttgccagtattttaytgaggatttttgtgtccatgttcatcagggatattagtctaaaattctcttttattgttgtgtctctgccaggctttggtatcaggatgatgctggcctc

SEQ ID NO: 37759 - DNA, 201 bp, Homo sapiens
tcttgtgccagttttcaaagggaatgcttccagtttttgcccattcagtatgatattggctgtaggtttgtcataaatagctcttattattttgagacacrtaccatcagtacctagtttattgagagtttttagcatgaagggctgttgcattttgtcaaaggccttttctgcatctattgagataatcatgtgattttt

SEQ ID NO: 37760 - DNA, 201 bp, Homo sapiens
attaatttttgtataaggtgtaaggaagggatccagtttcagctttatacatatggctagccagttttcccggcaccatttattaaatagggaatcctttycccatttcttgtctttgtcaggtttgtcaaagatcagatggctgtagatgtgtggtattatttctgagggctctgttctattccattggtctacttctct

SEQ ID NO: 37761 - DNA, 201 bp, Homo sapiens
tgccattgcttttggtgttttagtcatgaagtccttgcccatgcctatgtcctgagtggtattgcctaggttttcttctagggtttttatggttttaggtcttacatttaagtctttaatccatcttgaattaatttttgtataaggtgtaaggaagggatccagtttcagctttatacatatggctagccagttttcccg

SEQ ID NO: 37762 - DNA, 201 bp, Homo sapiens
tgtcaattttggcttttgttgccattgcttttggtgttttagtcatgaagtccttgcccatgcctatgtcctgagtggtattgcctaggttttcttctagrgtttttatggttttaggtcttacatttaagtctttaatccatcttgaattaatttttgtataaggtgtaaggaagggatccagtttcagctttatacata

SEQ ID NO: 37763 - DNA, 201 bp, Homo sapiens
tgtgatagttggctgagaatgatggtttccagcttcatccatgtccctacaaaggacatgaactcatcattttttatggctgcatagtattccatggtgttatatgtgccacattttcttaatccagtctattattgatggatgtttgggttgattccaagtctttgctattgtgaatagtgccacaataaacatatgtgt

SEQ ID NO: 37764 - DNA, 201 bp, Homo sapiens
atgtgtaaaaaaaagataggaaagcactaaaagaggctataaaataatattagtaaagatggacaaagaacgttattgatttcaaacagataagtggaaaagtcttgaaaaaccatttcaaattattatggagatgtagtcaattcaaaataacataatattaaaaatatgagttatagttgtgtgcatttctggacaaga

SEQ ID NO: 37765 - DNA, 201 bp, Homo sapiens
aaaaagtatgagataggcaaatttcctctctctctgattctctttctctctgattctctctctctctctctctctctctctctctctctcactctctctctgtttctcttttctggagctgagatacgcatcttctcctgtccttggacatcagaactccaagtcctctggcctttggacttcaggacttgcaccagcagt

SEQ ID NO: 37766 - DNA, 201 bp, Homo sapiens; identical to SEQ ID NO: 33437

SEQ ID NO: 37767 - DNA, 201 bp, Homo sapiens
gagccaggccttgcttctcaagtgttttatttaaataggcagtatgtcagtggagttttaccacagagtttctgagcgcagagagcctttccctaggagtrgggtgcagggaactggagggcaatggttcttatgagaaggtgatgatgcttctaagaaaaaagattacacgtaagttaatacctaacaattttttttaat

SEQ ID NO: 37768 - DNA, 201 bp, Homo sapiens; identical to SEQ ID NO: 33438

SEQ ID NO: 37769 - DNA, 201 bp, Homo sapiens; identical to SEQ ID NO: 33439

SEQ ID NO: 37770 - DNA, 201 bp, Homo sapiens; identical to SEQ ID NO: 33440

SEQ ID NO: 37771 - DNA, 201 bp, Homo sapiens; identical to SEQ ID NO: 33441

SEQ ID NO: 37772 - DNA, 201 bp, Homo sapiens; identical to SEQ ID NO: 33442

SEQ ID NO: 37773 - DNA, 201 bp, Homo sapiens; identical to SEQ ID NO: 33443

SEQ ID NO: 37774 - DNA, 201 bp, Homo sapiens; identical to SEQ ID NO: 33445

SEQ ID NO: 37775 - DNA, 201 bp, Homo sapiens; identical to SEQ ID NO: 33446

SEQ ID NO: 37776 - DNA, 201 bp, Homo sapiens; identical to SEQ ID NO: 33447

SEQ ID NO: 37777 - DNA, 201 bp, Homo sapiens; identical to SEQ ID NO: 33448

SEQ ID NO: 37778 - DNA, 201 bp, Homo sapiens; identical to SEQ ID NO: 33449

SEQ ID NO: 37779 - DNA, 201 bp, Homo sapiens; identical to SEQ ID NO: 33450

SEQ ID NO: 37780 - DNA, 201 bp, Homo sapiens
aatgctatcgctccccactcccccaaccccatgacaggcccctgtgtgtgatgttccccttcctgtgtccaagtgttctcattgttcaattcccacctgtragtgagaacatgcggtgtttggttttctgtccttgtgatagttggctgagaatgatggtttccagcttcatccatgtccctacaaaggacatgaactcat

SEQ ID NO: 37781 - DNA, 201 bp, Homo sapiens; identical to SEQ ID NO: 33451

SEQ ID NO: 37782 - DNA, 201 bp, Homo sapiens
cccgagtagctgggactacaggcacctgccaccacacccggctaatttttttgtatttttagtagagatggggtttcaccgtgttagccagggtggtctcratctcctgaccttgtgatccgcctgcctcagcctcccgaagtgctgggagccaccgcgcccgtcttaattgaagttttaattaaggcattactaagatag

SEQ ID NO: 37783 - DNA, 201 bp, Homo sapiens; identical to SEQ ID NO: 33456

SEQ ID NO: 37784 - DNA, 201 bp, Homo sapiens; identical to SEQ ID NO: 33457

SEQ ID NO: 37785 - DNA, 201 bp, Homo sapiens; identical to SEQ ID NO: 33460

SEQ ID NO: 37786 - DNA, 201 bp, Homo sapiens; identical to SEQ ID NO: 33463

SEQ ID NO: 37787 - DNA, 201 bp, Homo sapiens; identical to SEQ ID NO: 33464

SEQ ID NO: 37788 - DNA, 201 bp, Homo sapiens
taggcttagactccctgaaacagtgcaagatctccagaaatttccacagaagcctgaggagcttatgtgttcgtggtctcctttagtttttgccatctgcytttccagttcagtttagagattatgatctcactactccacactgtaagatgccatattattccatggctgtaagatgccgtattccatgtgaaacagctc

SEQ ID NO: 37789 - DNA, 201 bp, Homo sapiens; identical to SEQ ID NO: 33466

SEQ ID NO: 37790 - DNA, 201 bp, Homo sapiens
ttgttgtagccatttgtcactccaaaggagaggtggtgtttccagaagttgtcacagtgtgtacttataccataagtatggagccaacatagtgaaagacyggacaaagaatggaaatgaatcaagtccttatgacatcattggagagttgactttttgtgctagaaatttgcactgtcctccagatctccctatcttaag

SEQ ID NO: 37791 - DNA, 201 bp, Homo sapiens
aaaaaagtatgagataggcaaatttcctctctctctgattctctttctctctgattctctctctctctctctctctctctctctctctctcactctctctctgtttctcttttctggagctgagatacgcatcttctcctgtccttggacatcagaactccaagtcctctggcctttggacttcaggacttgcaccagcag

SEQ ID NO: 37792 - DNA, 201 bp, Homo sapiens
atagaacaaaaaagtatgagataggcaaatttcctctctctctgattctctttctctctgattctctctctctctctctctctctctctctctctctcacwctctctctgtttctcttttctggagctgagatacgcatcttctcctgtccttggacatcagaactccaagtcctctggcctttggacttcaggacttgca

SEQ ID NO: 37793 - DNA, 201 bp, Homo sapiens
agcatagaacaaaaaagtatgagataggcaaatttcctctctctctgattctctttctctctgattctctctctctctctctctctctctctctctctctyactctctctctgtttctcttttctggagctgagatacgcatcttctcctgtccttggacatcagaactccaagtcctctggcctttggacttcaggactt

SEQ ID NO: 37794 - DNA, 201 bp, Homo sapiens
tagaacaaagtaagttgctcaataagtgtctcttcctgcttctccttaaagagcctttttttttttttttttacgcaaattccagcttaggggtaatatcmctttctaaagcagaaattattttctgctgggagttgttcctagacacaatttgctccttattgaataaataaataattcctattttgtaaagtaaaattc

SEQ ID NO: 37795 - DNA, 201 bp, Homo sapiens
aattttgaatatctggtaatttttaatgttctcactataaaataatagactattcctggttcaaagttacatttgagatcatatatccccactctcatttyatttatttaggtttatttcatcagaaaaaagatttgaggaaacgtaataaaattacaaatgaactgatacatttaaagacaaaaagataagtaagagcca

SEQ ID NO: 37796 - DNA, 201 bp, Homo sapiens
ataagttcttgatttgctcttcaaaatttgttttccacgatgttatttcacaactggagtttgcatatgtattttcaagatgaaacaaagtcattccaagraacaaagaccttctctatgactttttccctttatcaaatcaaatctattattgtttcttataaactattatattttccttcagagaaaaatgcccccata

SEQ ID NO: 37797 - DNA, 201 bp, Homo sapiens
ctattttaatatttctgtagaagacatctcaactaataaagccatgtcacatttttttcctttgctgctaatggagtatttgcaaaactctgcacactgcygaaaaaacaatgccatttgtggtattaccataaagccatattctgaaattgcaccagtcttgagtatgacagtcacatctgatatacatgaaaatgtcag

SEQ ID NO: 37798 - DNA, 201 bp, Homo sapiens
ttgaacttaaaataaaagtggaagaagaaaaaaaaaagagaaatcatagagggcagaggtaagtggcaaaatattttgaaattgctggaaaaaaaaaaaaaccatcaacccataatcttatgcccagtgaaaatatcctttagaaaggaaggggaaattaaggcattctttgatgaaggaaaagagaattttttacctgca

SEQ ID NO: 37799 - DNA, 201 bp, Homo sapiens
attctgggttgaaaattcttgtctttaagaatgttgaatattggcccccactctcttctggcttgtagagtttctgctgagagatccactgttagtctgaygggcgtccctttgtgggtaacccaacctttctctctggctgcccttaacattttttccttcatttcaactttggtgaatctgacaattatgtgtcttgtg

SEQ ID NO: 37800 - DNA, 201 bp, Homo sapiens; identical to SEQ ID NO: 33477

SEQ ID NO: 37801 - DNA, 201 bp, Homo sapiens
tttatacatatggctagccagttttcccggcaccatttattaaatagggaatccttttcccatttcttgtctttgtcaggtttgtcaaagatcagatggcygtagatgtgtggtattatttctgagggctctgttctattccattggtctacttctctgttttggtaccagtactatgctgttttggttactatagccttg

SEQ ID NO: 37802 - DNA, 201 bp, Homo sapiens; identical to SEQ ID NO: 33258

SEQ ID NO: 37803 - DNA, 201 bp, Homo sapiens; identical to SEQ ID NO: 33259

SEQ ID NO: 37804 - DNA, 201 bp, Homo sapiens
ctttcctctgctcctcacctctcccctgaccccccaaaaatggcattacaaaatatgagtcatgtaggtactttccaatatattatccaagcctatttatycaaaatcaatacagtaatattttactttgtctgaaaccgatctcactggatttcaagatagaattttaatagtctttgtccttgaaaattgggctcacta

SEQ ID NO: 37805 - DNA, 201 bp, Homo sapiens; identical to SEQ ID NO: 33263

SEQ ID NO: 37806 - DNA, 201 bp, Homo sapiens; identical to SEQ ID NO: 33264

SEQ ID NO: 37807 - DNA, 201 bp, Homo sapiens
tttccttttcacaacaggccctgtctgccgttgccatgtattgaaattttcctttctctttagcagagagggtcttccacttctctgagtgcttcttagamaactctgagaaatcgactgaagcatctgtgtgctcctcctggcaaatttgcacaaagaatgcatatgatgacattttgtctcttggcttctgaggttttc

SEQ ID NO: 37808 - DNA, 201 bp, Homo sapiens; identical to SEQ ID NO: 33265

SEQ ID NO: 37809 - DNA, 201 bp, Homo sapiens
cctaaggacagttgtagcagcatcattgaaaactacctcaacatggatgctatttaagaccttgagaggtaaggagagagttgcaacagaaaagataaaawatgcttactgcttcaccttttgcttctggctgcagaacaagtagaaaggagcaattacacccaaaacgttaaaaaaaaaaaaaaagcaattaggctaaag

SEQ ID NO: 37810 - DNA, 201 bp, Homo sapiens
gccttccttcctgtggcctctttccccacatctcttcactaaccaaagaggtaactcttggctaatctcttacttaccacaaaacttaatttcataaatcytcccccccgtctcttacttaccataaaacttaatttcataaatcttccccccgtctcttatcaagtcagatttcagttacgtcaaaaggctcaaataaac

SEQ ID NO: 37811 - DNA, 201 bp, Homo sapiens
gatgagtgtctcagcactgaaaaaaggatctgggcagagccctgtggtgtccaccccacagcctggaggagcgcttagctcctccgccacctcctctttttccccttctcctttcttctcctgctcccccatgggctcctcctttagcacaaactgcttccattctacaccacatcgccctggggcaaaacacagctcttt

SEQ ID NO: 37812 - DNA, 201 bp, Homo sapiens
atcctttttccaaaaagtccttgttattttcttattcaagatataaacccaaggtgttctacttcaagaaaagagatctgtaattttttttttttttttttacctgaacccagcaccatgatctggtgactatattgggaaggattctggaatattgctctaagcaaattcaggagtaagtataggatatactacctacac

SEQ ID NO: 37813 - DNA, 201 bp, Homo sapiens; identical to SEQ ID NO: 33276

SEQ ID NO: 37814 - DNA, 201 bp, Homo sapiens
gagacagctttgttgccactagttgtatacaataacaaccagaacctgggctactctaaaagtctccaaatcattcttaaaaaaaaaaaaaaaaaaaaaaagacaagtaagtcctgcctttagaatattatgaataatttttgctacttcctaaggaaattttctccagtaaaagaaccaagcctcagagttagcaagttt

SEQ ID NO: 37815 - DNA, 201 bp, Homo sapiens
aatgaatcagggtggagtaggtaatagaaaaaggttactttacgaggaagttaagtttaaaagtagaaggcaaagaattgaacatactgacatattaattmtttgaagagaaattcagaattcatatttaacgtatatgttatttttataacttctaatagtaacagccatatccagatgttgttagaagcaataatgtaa

SEQ ID NO: 37816 - DNA, 201 bp, Homo sapiens
catggggaaattgtgttaaaaaaaattgggggggcaggcagtgtcatttctggggctaagtagacaagtctattaagcttctgcaaaaaaaaaaaaaaaaagtttattcactcattaacgttaggaacaaaggcagctggtagcatgggataaacctaaagggttataacccacttccatgggagacaaaatgaaggtgtg

SEQ ID NO: 37817 - DNA, 201 bp, Homo sapiens
taaaagtatgacttatttcaactgtgcacagagacccagaggataaagatgttatgatcataccatgagtcctaaggacagttgtagcagcatcattgaamactacctcaacatggatgctatttaagaccttgagaggtaaggagagagttgcaacagaaaagataaaaaatgcttactgcttcaccttttgcttctggc

SEQ ID NO: 37818 - DNA, 201 bp, Homo sapiens
gacaggcatagaattctctgcttatatgcattatattatttaatcctcacaacacccagtcatgctatttctgttattatcctatgagacaaaaaaaaaaacacagattttacataatcagtccaatgtaacatgactggtaaatgttggtgttgacatttgaaatcaggcattctgactccagaatctgtgctcttattt

SEQ ID NO: 37819 - DNA, 201 bp, Homo sapiens; identical to SEQ ID NO: 33277

SEQ ID NO: 37820 - DNA, 201 bp, Homo sapiens; identical to SEQ ID NO: 33278

SEQ ID NO: 37821 - DNA, 201 bp, Homo sapiens; identical to SEQ ID NO: 33279

SEQ ID NO: 37822 - DNA, 201 bp, Homo sapiens; identical to SEQ ID NO: 33280

SEQ ID NO: 37823 - DNA, 201 bp, Homo sapiens; identical to SEQ ID NO: 33283

SEQ ID NO: 37824 - DNA, 201 bp, Homo sapiens; identical to SEQ ID NO: 33281

SEQ ID NO: 37825 - DNA, 201 bp, Homo sapiens; identical to SEQ ID NO: 33284

SEQ ID NO: 37826 - DNA, 201 bp, Homo sapiens
caactttggtgaatctgacaattatgtgtcttgtggttgcccttctcgaggagtatctttgtggcattctctgtatttcttgaatttgaatgttggcctgycttcctagattggggaagttctcctagataatatcctgcagagtgttttccaacttggttccattctccccatcactttcaggtacaccaatcagacgta

SEQ ID NO: 37827 - DNA, 201 bp, Homo sapiens
aggagcaattacacccaaaacgttaaaaaaaaaaaaaaagcaattaggctaaaggctgaggaaatgatcataacatgatggaagttccagcagccaagatsaatcagaaagtagctatgtagcctatcatgataggaaagctgggcatagacatagatcagtgttttccaaccaagtgtgggccaggagtggtggctcacg

SEQ ID NO: 37828 - DNA, 201 bp, Homo sapiens; identical to SEQ ID NO: 33310

SEQ ID NO: 37829 - DNA, 201 bp, Homo sapiens; identical to SEQ ID NO: 33312

SEQ ID NO: 37830 - DNA, 201 bp, Homo sapiens; identical to SEQ ID NO: 33314

SEQ ID NO: 37831 - DNA, 201 bp, Homo sapiens; identical to SEQ ID NO: 33315

SEQ ID NO: 37832 - DNA, 201 bp, Homo sapiens; identical to SEQ ID NO: 33316

SEQ ID NO: 37833 - DNA, 201 bp, Homo sapiens; identical to SEQ ID NO: 33317

SEQ ID NO: 37834 - DNA, 201 bp, Homo sapiens; identical to SEQ ID NO: 33318

SEQ ID NO: 37835 - DNA, 201 bp, Homo sapiens; identical to SEQ ID NO: 33321

SEQ ID NO: 37836 - DNA, 201 bp, Homo sapiens; identical to SEQ ID NO: 33322

SEQ ID NO: 37837 - DNA, 201 bp, Homo sapiens
attgaatgtctacatgtatcaagttccaataaggacagatatgacctcacatcctttaggggaaaacagactttaaataaggaattgcagtagtatttaayagatggaaagaagagtaaagtgctggagttcagaagaatagagcaagtctaggggtcagggagggctgtcctaggaaatgattcttcagctgagaactga

SEQ ID NO: 37838 - DNA, 201 bp, Homo sapiens; identical to SEQ ID NO: 33324

SEQ ID NO: 37839 - DNA, 201 bp, Homo sapiens
atttacacatttttaagaattctgtaacttagaaatcagctaatgatatttgctcttaagaatgagaaagaaacaattttctttgaaatgtgtgttaaacrtgaaagaaaagaaaatgtaagtaaggaagaatgtttagtgcttgcccagatttttcctacttttattaggtagtccaaagtccacaatgtgttaaggtgt

SEQ ID NO: 37840 - DNA, 201 bp, Homo sapiens; identical to SEQ ID NO: 33325

SEQ ID NO: 37841 - DNA, 201 bp, Homo sapiens; identical to SEQ ID NO: 33326

SEQ ID NO: 37842 - DNA, 201 bp, Homo sapiens
tagaagaaaacctacacaataccattcaggacataggcatgggcaaggacttcatgactaaaacaccaaaagcaatggcaacaaaagccaaaatagataartgggatctaattaaactacagagcttctgcacagctaaagaaactgtcatcagagtgaacaggcaacctacagaatgggagaaaattttgcaatctatcc

SEQ ID NO: 37843 - DNA, 201 bp, Homo sapiens
aaaccctagaagaaaacctacacaataccattcaggacataggcatgggcaaggacttcatgactaaaacaccaaaagcaatggcaacaaaagccaaaatwgataagtgggatctaattaaactacagagcttctgcacagctaaagaaactgtcatcagagtgaacaggcaacctacagaatgggagaaaattttgcaat

SEQ ID NO: 37844 - DNA, 201 bp, Homo sapiens
taaatcttccccccgtctcttatcaagtcagatttcagttacgtcaaaaggctcaaataaaccttcatatgttataaattttaggaaaagaaaagtcctgrgtaaggtcttctccaacccccttattttacagatgaagtaaaataagtccaataagacaccaagtccccagtaggtgagcccaggcatagaggaaggttt

SEQ ID NO: 37845 - DNA, 201 bp, Homo sapiens
aaactgcttccattctacaccacatcgccctggggcaaaacacagctctttcttcactgtgcctaagaaacccactcacatcaagtgcttttgtgtttcaytcaatctcctcaaaaggggaggaaggtgtgccgcatcctggagtgtggagccctctctcgtttccctagcatcatactcttcccctcctcctttctattc

SEQ ID NO: 37846 - DNA, 201 bp, Homo sapiens
gtaaatttttagagaagtgacatgacaaaggaaaaggactgggactctctagggacagcaacttgggaaagacaaccaacaaaaaaatggttaagtaagtaaagcttgttaactgtagattcctccagcattgcccccaggactatacgtgtttaaagctgccgtcagtggttgttgttcttggtagagcaggggcaagat

SEQ ID NO: 37847 - DNA, 201 bp, Homo sapiens
ggagaataatgagtcagggtggagcaggtgattggaatgagtctgggtggagcaggtgattggaatgagtcagggtggagtaggtaatcggaatgaatcarggtggagtaggtaatagaaaaaggttactttacgaggaagttaagtttaaaagtagaaggcaaagaattgaacatactgacatattaattctttgaagag

SEQ ID NO: 37848 - DNA, 201 bp, Homo sapiens
agtaaatttttagagaagtgacatgacaaaggaaaaggactgggactctctagggacagcaacttgggaaagacaaccaacaaaaaaatggttaagtaagtaaagcttgttaactgtagattcctccagcattgcccccaggactatacgtgtttaaagctgccgtcagtggttgttgttcttggtagagcaggggcaaga

SEQ ID NO: 37849 - DNA, 201 bp, Homo sapiens; identical to SEQ ID NO: 33329

SEQ ID NO: 37850 - DNA, 201 bp, Homo sapiens
aagtaaatttttagagaagtgacatgacaaaggaaaaggactgggactctctagggacagcaacttgggaaagacaaccaacaaaaaaatggttaagtaagtaaagcttgttaactgtagattcctccagcattgcccccaggactatacgtgtttaaagctgccgtcagtggttgttgttcttggtagagcaggggcaag

SEQ ID NO: 37851 - DNA, 201 bp, Homo sapiens; identical to SEQ ID NO: 6261

SEQ ID NO: 37852 - DNA, 201 bp, Homo sapiens; identical to SEQ ID NO: 33333

SEQ ID NO: 37853 - DNA, 201 bp, Homo sapiens; identical to SEQ ID NO: 6263

SEQ ID NO: 37854 - DNA, 201 bp, Homo sapiens
cctccaatcacagccctgctaatttgaaataccatgcatgcattttactgggatagattttccctgcactaaccaaaagcaaagaaggttgagacgatgaragccccctgtggactgggatctattattaagacaaactcccctgagagttggcacaaagaacacttagtttctcagattcccaacccgactagcttccag

SEQ ID NO: 37855 - DNA, 201 bp, Homo sapiens
caagccagggttacctactcagatggccaaacctttctaccactatttttggaaaagacttagatttttttatttgcccaacttccaaatagcttttttttccttctgataatcatctccctgaagttcgcatttcaaaagggatggttctcaggtaagacagggtagaacatttatatctcaaaggtacagaaaaagaat

SEQ ID NO: 37856 - DNA, 201 bp, Homo sapiens
cagaatccaaattgtttctgacaaatgggacaagccagggttacctactcagatggccaaacctttctaccactatttttggaaaagacttagatttttttatttgcccaacttccaaatagcttttttttccttctgataatcatctccctgaagttcgcatttcaaaagggatggttctcaggtaagacagggtagaac

SEQ ID NO: 37857 - DNA, 201 bp, Homo sapiens
tattatttctagtagttttaattatatatgttaatccaaatttttaactcgaagtaactttaatttctagaaacatgtgcttcctcatagtataattttttaatgtgacacatgtttaacagacccaaatatcttcagcttctctatactatatgaaaacaaaatgccaaaagtatacaaacttaaacttatgcttagtaa

SEQ ID NO: 37858 - DNA, 201 bp, Homo sapiens; identical to SEQ ID NO: 33337

SEQ ID NO: 37859 - DNA, 201 bp, Homo sapiens
aggttcctgattctgccaggaagtgacattccgtactcacctataaggtttgcaacacttttaattaggtactaggccaggttttttgaagggggggggggctttattggttccataaagccaaccttagtttcttaaaactacagacagcttgtcacccaggctggtgtacagtggcccaataacagctcactacagcct

SEQ ID NO: 37860 - DNA, 201 bp, Homo sapiens
attaattgcattaattgtccactaggtggtagcagtgcagctgctacaatgtgtcacacactcatcttcaaactcatttagtaatacatcatttaaatagrcagagaaccatatgtgaaaaaaaaaaatcccattaatttgtcagcaacattggtggtaatttaaaaatagatgtaatttagctaaatattcttcctccta

SEQ ID NO: 37861 - DNA, 201 bp, Homo sapiens
tgtttattgtggcactattcacaatagcaaagacttggaaccaacccaaatgtccaccagtgatagactggattaagaaaatgtggcattatatacatcayggaatactatgcagccataaaaaagaatgagttcacgtcctttgtgaggacatggatgaaactggaaaccatcaatctcagcaaactatcgcaaggacaa

SEQ ID NO: 37862 - DNA, 201 bp, Homo sapiens
tgatgctatgctattcattgtgagaatcatagcaaattgagagatgttaaaaattgggatctaattaaactaaagagcttctgcacagcaaaaaaaaaaaactaccatcagagtgaacaggcaacctacagaatgggaaaaaatttttgcaatctactcatctgacaaagggctaatagaatctacaaagaactcaaacaa

SEQ ID NO: 37863 - DNA, 201 bp, Homo sapiens; identical to SEQ ID NO: 33343

SEQ ID NO: 37864 - DNA, 201 bp, Homo sapiens; identical to SEQ ID NO: 33344

SEQ ID NO: 37865 - DNA, 201 bp, Homo sapiens
tcccagcccctgagggatgagtgtctcagcactgaaaaaaggatctgggcagagccctgtggtgtccaccccacagcctggaggagcgcttagctcctccrccacctcctctttttccccttctcctttcttctcctgctcccccatgggctcctcctttagcacaaactgcttccattctacaccacatcgccctggggc

SEQ ID NO: 37866 - DNA, 201 bp, Homo sapiens; identical to SEQ ID NO: 33345

SEQ ID NO: 37867 - DNA, 201 bp, Homo sapiens
taaagtgatcctcctgccttggcctccccaagttctgggattatagacatgagctgcacccagcccatttcttatttgacaatgcttcctatgcagatttrgcatatcaaataagcttaattaatttaatatgtctcgttataaagagagagagtaaattttttgagatagtcaaggggcttatctgaaaaatcccgaagt

SEQ ID NO: 37868 - DNA, 201 bp, Homo sapiens; identical to SEQ ID NO: 33346

SEQ ID NO: 37869 - DNA, 201 bp, Homo sapiens; identical to SEQ ID NO: 33348

SEQ ID NO: 37870 - DNA, 201 bp, Homo sapiens; identical to SEQ ID NO: 33349

SEQ ID NO: 37871 - DNA, 201 bp, Homo sapiens; identical to SEQ ID NO: 33350

SEQ ID NO: 37872 - DNA, 201 bp, Homo sapiens; identical to SEQ ID NO: 33351

SEQ ID NO: 37873 - DNA, 201 bp, Homo sapiens; identical to SEQ ID NO: 33352

SEQ ID NO: 37874 - DNA, 201 bp, Homo sapiens; identical to SEQ ID NO: 33353

SEQ ID NO: 37875 - DNA, 201 bp, Homo sapiens
actttcggtcaagcctcataatgtcaaacttctggtttgatttctcagaatccctcacccctaacacagctacagcaagatacttggaaagatccagatgycaccagaggaaatggaacaagattacacagaaagcagaagtggatgtctaaaaatagaataaaaacggataagggaatccacctaatccccaaatcccac

SEQ ID NO: 37876 - DNA, 201 bp, Homo sapiens
acacaacacttagaatgcctggaaatggtcccaaaatatcatgagcccacaatttagtgatggtcaggccatgaaaaagttgattagcctccctgagtctsagtttcctcctccatacaattgggagattggatttgatgagttctaaaatttctaacagctccaaggtgttataactaaatccttccactgctctataag

SEQ ID NO: 37877 - DNA, 201 bp, Homo sapiens
acttagaatgcctggaaatggtcccaaaatatcatgagcccacaatttagtgatggtcaggccatgaaaaagttgattagcctccctgagtctgagtttcytcctccatacaattgggagattggatttgatgagttctaaaatttctaacagctccaaggtgttataactaaatccttccactgctctataagaaagtct

SEQ ID NO: 37878 - DNA, 201 bp, Homo sapiens; identical to SEQ ID NO: 6249

SEQ ID NO: 37879 - DNA, 201 bp, Homo sapiens; identical to SEQ ID NO: 6250

SEQ ID NO: 37880 - DNA, 201 bp, Homo sapiens
attattaaatgtgaacaaaagatagaaagctacttccaaattctaacaccttccagtccagtggcaactcagtcactgcctcttaattgaagttttttttktttgtttgtttgtttgtctgtttgtttttgagacggagtctcgctctatcacccaggctggagtgcagtggtgcaatctcggctcactgcaagctccacc

SEQ ID NO: 37881 - DNA, 201 bp, Homo sapiens; identical to SEQ ID NO: 6251

SEQ ID NO: 37882 - DNA, 201 bp, Homo sapiens; identical to SEQ ID NO: 6252

SEQ ID NO: 37883 - DNA, 201 bp, Homo sapiens; identical to SEQ ID NO: 6254

SEQ ID NO: 37884 - DNA, 201 bp, Homo sapiens; identical to SEQ ID NO: 33361

SEQ ID NO: 37885 - DNA, 201 bp, Homo sapiens
ttgatgctatgctattcattgtgagaatcatagcaaattgagagatgttaaaaattgggatctaattaaactaaagagcttctgcacagcaaaaaaaaaaaactaccatcagagtgaacaggcaacctacagaatgggaaaaaatttttgcaatctactcatctgacaaagggctaatagaatctacaaagaactcaaaca

SEQ ID NO: 37886 - DNA, 201 bp, Homo sapiens; identical to SEQ ID NO: 33362

SEQ ID NO: 37887 - DNA, 201 bp, Homo sapiens; identical to SEQ ID NO: 33363

SEQ ID NO: 37888 - DNA, 201 bp, Homo sapiens; identical to SEQ ID NO: 33365

SEQ ID NO: 37889 - DNA, 201 bp, Homo sapiens; identical to SEQ ID NO: 33367

SEQ ID NO: 37890 - DNA, 201 bp, Homo sapiens
aagaggagcatgtgtacaggctggggagggtggtaggaaccatgtcaggcagagcttagaggtcacgttaaggactggggacactggtctaagaacaatgmaaatccattgaagatattaagtcatcaatgacatggttacagtgtttttggaacaccaactaggctagggtgtggaaagcagatcagaagtgagacaaga

SEQ ID NO: 37891 - DNA, 201 bp, Homo sapiens; identical to SEQ ID NO: 33370

SEQ ID NO: 37892 - DNA, 201 bp, Homo sapiens; identical to SEQ ID NO: 33369

SEQ ID NO: 37893 - DNA, 201 bp, Homo sapiens
cagcatagaacaaaaaagtatgagataggcaaatttcctctctctctgattctctttctctctgattctctctctctctctctctctctctctctctctctcactctctctctgtttctcttttctggagctgagatacgcatcttctcctgtccttggacatcagaactccaagtcctctggcctttggacttcaggact

SEQ ID NO: 37894 - DNA, 201 bp, Homo sapiens
agaatcgtttgaacctgggaggcggaggttgcagtgatctgagatcctgccactgcactctagcctgggcgacgagagcaaaactccatctcaaaaaaaamaagacagagtgtttttttggctaaacagacgacaaacaagtaccagggctacctgaggcacaagtcaccttcaagaggtagacaccagtccctctaatta

SEQ ID NO: 37895 - DNA, 201 bp, Homo sapiens; identical to SEQ ID NO: 33376

SEQ ID NO: 37896 - DNA, 201 bp, Homo sapiens; identical to SEQ ID NO: 33378

SEQ ID NO: 37897 - DNA, 201 bp, Homo sapiens
ggtgttgggaaaactgtctagccataggcagaaagctgaaactggatcccttccttacaccttatataaaagttaactcaagatggattaaagacttaaawgtaaaacctaaaaccataaaaaccctagaagaaaacctacacaataccattcaggacataggcatgggcaaggacttcatgactaaaacaccaaaagcaa

SEQ ID NO: 37898 - DNA, 201 bp, Homo sapiens; identical to SEQ ID NO: 33382

SEQ ID NO: 37899 - DNA, 201 bp, Homo sapiens; identical to SEQ ID NO: 33384

SEQ ID NO: 37900 - DNA, 201 bp, Homo sapiens; identical to SEQ ID NO: 33385

SEQ ID NO: 37901 - DNA, 201 bp, Homo sapiens; identical to SEQ ID NO: 33387

SEQ ID NO: 37902 - DNA, 201 bp, Homo sapiens; identical to SEQ ID NO: 33389

SEQ ID NO: 37903 - DNA, 201 bp, Homo sapiens; identical to SEQ ID NO: 33391

SEQ ID NO: 37904 - DNA, 201 bp, Homo sapiens; identical to SEQ ID NO: 33393

SEQ ID NO: 37905 - DNA, 201 bp, Homo sapiens; identical to SEQ ID NO: 33396

SEQ ID NO: 37906 - DNA, 201 bp, Homo sapiens; identical to SEQ ID NO: 33398

SEQ ID NO: 37907 - DNA, 201 bp, Homo sapiens; identical to SEQ ID NO: 33400

SEQ ID NO: 37908 - DNA, 201 bp, Homo sapiens
tcactgcacggcaccaagtacacatatggcccgggagctacaacaatctgtgagtcttggcttcagaactgtgcaaagaaccatgtgcctaaaaagccaaygaaaggttcctggggcctttcttttctgatagtttaaagcatgtggcttttgcctcacagtaaatttttctaaaatatgtaatcagttttctgttcaaaa

SEQ ID NO: 37909 - DNA, 201 bp, Homo sapiens
tgctcctgccctaactcacacaaccctattgtaacttaatctggctttataaactgccacattgccaagtgtttttttgtttttttgttttttttttttttgctttgttttctttgcgtttttgcatgcgtgtgttttggtttgtttgcctgcaaacaggtaaacaacttctttgcacaaccataaagacttccttgtctc

SEQ ID NO: 37910 - DNA, 201 bp, Homo sapiens; identical to SEQ ID NO: 33403

SEQ ID NO: 37911 - DNA, 201 bp, Homo sapiens
cagagggtctcaaggcaggcaaagaagaaccatgaggctcatcctgcctgtgggtttgattgctaccactcttgcaattgctcctgtccgctttgacaggkaaatcttacttcctgtgttccagtctctgtgtagaagagaattaaaggttgtttccttacagttcactttttttttttcatttgcctccacaaagggaga

SEQ ID NO: 37912 - DNA, 201 bp, Homo sapiens; identical to SEQ ID NO: 33404

SEQ ID NO: 37913 - DNA, 201 bp, Homo sapiens; identical to SEQ ID NO: 33405

SEQ ID NO: 37914 - DNA, 201 bp, Homo sapiens
taaaactaatttcttccatcattcaattcaagcagaatggtagagtagtattttagaacagatagaactagtaaatcccagctctgtgaacatactttctytgttaccttggccaagttatttgctaaaggcatttgcttcccatcctgtatctgtaaaatgggtatttcctattgcaaaaggtagataagtagcatgtgc

SEQ ID NO: 37915 - DNA, 201 bp, Homo sapiens; identical to SEQ ID NO: 33406

SEQ ID NO: 37916 - DNA, 201 bp, Homo sapiens; identical to SEQ ID NO: 33407

SEQ ID NO: 37917 - DNA, 201 bp, Homo sapiens; identical to SEQ ID NO: 33408

SEQ ID NO: 37918 - DNA, 201 bp, Homo sapiens; identical to SEQ ID NO: 33409

SEQ ID NO: 37919 - DNA, 201 bp, Homo sapiens; identical to SEQ ID NO: 33410

SEQ ID NO: 37920 - DNA, 201 bp, Homo sapiens; identical to SEQ ID NO: 33411

SEQ ID NO: 37921 - DNA, 201 bp, Homo sapiens; identical to SEQ ID NO: 33412

SEQ ID NO: 37922 - DNA, 201 bp, Homo sapiens; identical to SEQ ID NO: 33413

SEQ ID NO: 37923 - DNA, 201 bp, Homo sapiens; identical to SEQ ID NO: 33414

SEQ ID NO: 37924 - DNA, 201 bp, Homo sapiens; identical to SEQ ID NO: 33416

SEQ ID NO: 37925 - DNA, 201 bp, Homo sapiens; identical to SEQ ID NO: 33419

SEQ ID NO: 37926 - DNA, 201 bp, Homo sapiens; identical to SEQ ID NO: 33420

SEQ ID NO: 37927 - DNA, 201 bp, Homo sapiens
tcatagaacacatgaagtttatgtttgcacagacaagtcggctagaggtcagggcctcagggcctcccccactgaggaccgagagcataaatacctcagasacactgtaagccattcatgtgggaagggttgctgtccagtagaggttgctaacttttttgtcatgctatctgttgacatctattaaccccttctcagaat

SEQ ID NO: 37928 - DNA, 201 bp, Homo sapiens; identical to SEQ ID NO: 33428

SEQ ID NO: 37929 - DNA, 201 bp, Homo sapiens
gtggtgtctttagaagagcaatattttaaaagtcaaaccactagtaacctaacagtttgcctaaacttcctttgtcatagaacacatgaagtttatgtttrcacagacaagtcggctagaggtcagggcctcagggcctcccccactgaggaccgagagcataaatacctcagacacactgtaagccattcatgtgggaag

SEQ ID NO: 37930 - DNA, 201 bp, Homo sapiens; identical to SEQ ID NO: 33429

SEQ ID NO: 37931 - DNA, 201 bp, Homo sapiens
gttactggaaaatgagccaacattactttgttctggctgtgtgcacagcagtgaattctaattgtgtttctcaatctaagccccagaatgaaaactgccargatcaattcattttgataaattaactgtttctgatggctatctacactgaactgcagctgctgtgtttttttcttccttaacaaaatgattatgaagtaa

SEQ ID NO: 37932 - DNA, 201 bp, Homo sapiens; identical to SEQ ID NO: 33431

SEQ ID NO: 37933 - DNA, 201 bp, Homo sapiens
atcacacagttactcagtgcacctttccaccagctcagcactcctctgtcccaagtggtgtgtctccctgtggccatcccctgctgggcagtactgatacrtgtacatatatgaaaaacaacatccataaggaaaggttaatttggagaaaagcctaagtggaggaatcgatcagcaacaagagttaataatcaattgcag

SEQ ID NO: 37934 - DNA, 201 bp, Homo sapiens
taaagaatgtagcatcattctatcaatctaatgtatctttgtaacggcagtggcagcatgtggcagtgcttaaattgcaaatacagtatttaagaaaaagmacggattaaaagagcactcacatgagctggaaaatagccacatggattataatatttttataaattccatttctttttcaaagcaccacttaacattata

SEQ ID NO: 37935 - DNA, 201 bp, Homo sapiens
tatgctagcaatgagcaaggctccatgggcgtgggaccctccgagccatgcacgggatataatctcctggtgtgccatttgctaagactgttggaaaagcrcagtattagggtgagagtgtcccgattttccaggtaccatctgtcatggcttcccttggctaggaaagggaattccctgaccccttgcattcccaggtga

SEQ ID NO: 37936 - DNA, 201 bp, Homo sapiens; identical to SEQ ID NO: 33432

SEQ ID NO: 37937 - DNA, 201 bp, Homo sapiens
atgccgtttattctagttagccattcatctaatcttttttcaaggtttttagcttctttgcaatgggttcaaacatcctcctttagcttggagaagtttgytattaccaatcgtctgaagccttcttctctcaactcgtcaaagtcattctctgtccagctttgttccgttgctggcaaggagctgctttcctttggagga

SEQ ID NO: 37938 - DNA, 201 bp, Homo sapiens
tcaactaataaagccatgtcacatttttttcctttgctgctaatggagtatttgcaaaactctgcacactgccgaaaaaacaatgccatttgtggtattaycataaagccatattctgaaattgcaccagtcttgagtatgacagtcacatctgatatacatgaaaatgtcagtatgcccctgttatgcaaattgaacaaa

SEQ ID NO: 37939 - DNA, 201 bp, Homo sapiens
agcctgtcttggtacatgtgattatatctttagtctcatctagaaataatgtcacaaatctgcactcaagaatctgtagatcataaaacataaaatgaacygtgggtttattctattttaatatttctgtagaagacatctcaactaataaagccatgtcacatttttttcctttgctgctaatggagtatttgcaaaact

SEQ ID NO: 37940 - DNA, 201 bp, Homo sapiens
acatcaaagagcccagtgatggggcataaggcaaacctgtataatgaacgtattcttcatcgagcctgtcttggtacatgtgattatatctttagtctcayctagaaataatgtcacaaatctgcactcaagaatctgtagatcataaaacataaaatgaaccgtgggtttattctattttaatatttctgtagaagacat

SEQ ID NO: 37941 - DNA, 201 bp, Homo sapiens
gagaacccaactttttattactcgttaaatgaaatgtgcagtctttttccccttttaaggtcaagtatacagtattttggaaaacaaaccataaaaacatrattagagagaacagaggaagtcattattttctccagtcataaagaatgtagcatcattctatcaatctaatgtatctttgtaacggcagtggcagcatgt

SEQ ID NO: 37942 - DNA, 201 bp, Homo sapiens; identical to SEQ ID NO: 33436

SEQ ID NO: 37943 - DNA, 201 bp, Homo sapiens
tgcactccagcctgggtgacagagcaagaccctgtctcaaaaaaaaaaaaaaaaaaaaaagaaagagaaagagagaaaaaaagaaagaaagaaagaaagaraaagagaaagaaagaaatttcattgagcacctattaagtgttcattataaagtatgtttcctgccactgagaatttacaatcctactgaaatgataagac

SEQ ID NO: 37944 - DNA, 201 bp, Homo sapiens
tcaacactattgctaaacgttttagttatattaataacaagttctgtcatttagctagtttacttttagttttggttgcaaacaaggggaaattagggatrggaagtgaagaaagaacccaaattggggttgatggatttcaaaagttgaagctagaaagacattaacaaaagccaaatccaaaaggcaaggtcagtgggg

SEQ ID NO: 37945 - DNA, 201 bp, Homo sapiens; identical to SEQ ID NO: 33452

SEQ ID NO: 37946 - DNA, 201 bp, Homo sapiens; identical to SEQ ID NO: 33453

SEQ ID NO: 37947 - DNA, 201 bp, Homo sapiens
ttaacctgtgttcagtcaaaaccattaggtaattttttttcctcacatgaatcaccctcaaacaggatgtccctccttttgtgcttacctaattgactttyttcacctaaatgtaggattttagatttacacttttaagatttatcttgacagcctgttttcagcatgttgagatcttttagaaaactaattcagtcatcc

SEQ ID NO: 37948 - DNA, 201 bp, Homo sapiens; identical to SEQ ID NO: 33454

SEQ ID NO: 37949 - DNA, 201 bp, Homo sapiens
tgtaggattttagatttacacttttaagatttatcttgacagcctgttttcagcatgttgagatcttttagaaaactaattcagtcatccagggcaataaytcttcccctaactttgtctctccaacaagtttgataatcatgtctttttgacttttatccttgtcactgataaaagaaaacattaaataggtcaggagtc

SEQ ID NO: 37950 - DNA, 201 bp, Homo sapiens; identical to SEQ ID NO: 33455

SEQ ID NO: 37951 - DNA, 201 bp, Homo sapiens
ctgcagctttgccagaatccatgccaggccccagcagctcctgcttctgggcttcacctgttttcgtgtttataaaatctaaaacttgccccctctactcrccagtgagcccttcgagctctgattcttccaagattgctgagaaagttctgcaatcacatctgcagtatttttttagttatctaaaattcagcatttcat

SEQ ID NO: 37952 - DNA, 201 bp, Homo sapiens
catcagacatatctctagccccaaagcagtgcgcaaacatccgaacagagattggctgagacacagggagaaagaaagacccaatgtcaggctgacctcaracttctaggcttccactcggcacaagcaaggaagagaataacagacacctacaagacacagtatgttttagttaatatttttccactgaaaggtgttact

SEQ ID NO: 37953 - DNA, 201 bp, Homo sapiens; identical to SEQ ID NO: 33458

SEQ ID NO: 37954 - DNA, 201 bp, Homo sapiens
acagagcctagcatatcgtaggttctcacaatagttgatgagtaactgaataaatgaaaatgtcagtacatgactggatccccaagagcaatttgtctccrgccacagtgtcaatatacccattgtgaaaagatgccatttttcttcctgatgtatccaccacaggtcagggatcctcctggttccacatattactgtgac

SEQ ID NO: 37955 - DNA, 201 bp, Homo sapiens; identical to SEQ ID NO: 33459

SEQ ID NO: 37956 - DNA, 201 bp, Homo sapiens; identical to SEQ ID NO: 33461

SEQ ID NO: 37957 - DNA, 201 bp, Homo sapiens; identical to SEQ ID NO: 33462

SEQ ID NO: 37958 - DNA, 201 bp, Homo sapiens
attattctgatttcatcaccaacctcacagttttccaggcatatgtagaagaagtaattataatgccaaagtatgaaatatagccggtttcataaccggartgaattatggctaattctcctgcagtaaataatttgtttttcaaatctgtattccccagacagctgagccaggccttgcttctcaagtgttttatttaaa

SEQ ID NO: 37959 - DNA, 201 bp, Homo sapiens
gcagccaacaaacacatgaaaaaatgctcatcatcactggtcattagagaaatgcaaatcaaaaccacaatgagataccatctcacaccagttagaatggygatcattaaaaagtcaggaaacaacagatgctgggaaggatgtggagaaataggaatgtttttacactgttggtgggagtgtaaattagttcaaccattg

SEQ ID NO: 37960 - DNA, 201 bp, Homo sapiens
tggttcctgcttatagaccgtaagggcttcttcttttgcaccaaaattataaaagttaagtttcttattggtcccttggtgtaatttacccattatcgcasgacagaaggaaggaaactgcagttaaggattattttgatgtttctcttatcacaaatattcacccatagggatggctaaactcagaactttcagttagaa

SEQ ID NO: 37961 - DNA, 201 bp, Homo sapiens
tagaccaatggaacagaacaggggcctcagaaataacaccacacatctacaaccatctgatctttgacaaacctgacaaaaacaagaaatggggaaaggaktccctatttaataaatggtgttgggaaaactgtctagccataggcagaaagctgaaactggatcccttccttacaccttatataaaagttaactcaagat

SEQ ID NO: 37962 - DNA, 201 bp, Homo sapiens; identical to SEQ ID NO: 33465

SEQ ID NO: 37963 - DNA, 201 bp, Homo sapiens
ttatcttggatgtttgtttctacacatacaaaactaaaaagttcaaataaaaatacatgccacttttatctttaccagagtacaagacaggtgactaaaaygcaaaaatttaatttgatgtatcatactcattgatttaaaagttatttttaatttccaataattttctctattgattaagcttttctctagtatcttaaa

SEQ ID NO: 37964 - DNA, 201 bp, Homo sapiens
tgtgattttggatgagcttatattgggtctagcaaataaacaggctacaactgttaactgtcatagtaattagttaaatgctctggtcctttctgcagccrggaatttagatagcacttactaaatgggaggggaaaggaaattcctaaatttattttcatatcaaagttttaacttcttacagcctaacagaatgatgtt

SEQ ID NO: 37965 - DNA, 201 bp, Homo sapiens
gaagcagacttttgatgtgtgtctgaaattctctgtatgtcagataaaatcatttcaaggtttaactgtggataatagaaatttctgcaaagtggcctctrtctgtaatattcactgtactgtgatcaaggatactaatgatcataaacttttctctcttccaagcatacttttcactcaaagtagaaagggaagtgaagt

SEQ ID NO: 37966 - DNA, 201 bp, Homo sapiens; identical to SEQ ID NO: 33468

SEQ ID NO: 37967 - DNA, 201 bp, Homo sapiens; identical to SEQ ID NO: 33469

SEQ ID NO: 37968 - DNA, 201 bp, Homo sapiens
ttgcctcaggtgaagtggaacagtcaatactgaaacttaaggaaaaagttgcctgtctgtctaaggcagacattgatggttaactattgttaacaatattractattgcacagaatctaccatggcctgcaaggaggaagtctaaggtaattctaccatccatgacaaccctggccagtgagttggggccgcccttaatgc

SEQ ID NO: 37969 - DNA, 201 bp, Homo sapiens; identical to SEQ ID NO: 33470

SEQ ID NO: 37970 - DNA, 201 bp, Homo sapiens; identical to SEQ ID NO: 33472

SEQ ID NO: 37971 - DNA, 201 bp, Homo sapiens; identical to SEQ ID NO: 33473

SEQ ID NO: 37972 - DNA, 201 bp, Homo sapiens; identical to SEQ ID NO: 33474

SEQ ID NO: 37973 - DNA, 201 bp, Homo sapiens; identical to SEQ ID NO: 33475

SEQ ID NO: 37974 - DNA, 201 bp, Homo sapiens
ttacctatattcttttttccttcagttttatctatatttgttctctttgaattagtcttttttcattattatcttgcaaattctttcccttcttttccttyacttcatttcctttcctccctttccataattcatttctcaatacacttagcacatgagcagctccatcagggcaagcccttgaatgagtctgtccatagc

SEQ ID NO: 37975 - DNA, 201 bp, Homo sapiens
tgggactctatgtccaaacaaataaaagggagtctctgagacctggggatagtatgtttcttaggaaaaatctgtgtaacatcatctcctgtccccccccmaaaaaaagggggggtgctgggcacggtggttcacacctgtaatcccaacattttaggcggccaagatggaaggattgcttgaggccaggagttcaagagc

SEQ ID NO: 37976 - DNA, 201 bp, Homo sapiens
ttgggactctatgtccaaacaaataaaagggagtctctgagacctggggatagtatgtttcttaggaaaaatctgtgtaacatcatctcctgtcccccccsaaaaaaaagggggggtgctgggcacggtggttcacacctgtaatcccaacattttaggcggccaagatggaaggattgcttgaggccaggagttcaagag

SEQ ID NO: 37977 - DNA, 201 bp, Homo sapiens
aacaaaagatagaaagctacttccaaattctaacaccttccagtccagtggcaactcagtcactgcctcttaattgaagttttttttgtttgtttgtttgyttgtctgtttgtttttgagacggagtctcgctctatcacccaggctggagtgcagtggtgcaatctcggctcactgcaagctccacctcccgggttcatg

SEQ ID NO: 37978 - DNA, 201 bp, Homo sapiens
atttcattgttcaaaaactaaagataaattggcatggaaacacataccagactagagactaccaaataatatagagagtatgtatggatggatatatatakatagagagagagagacagagagtatggatttattaaaatttgaccttatataagagggggaaaatgactacatgaagataaaggttttagtcaagcctct

SEQ ID NO: 37979 - DNA, 201 bp, Homo sapiens
aattattaaatgtgaacaaaagatagaaagctacttccaaattctaacaccttccagtccagtggcaactcagtcactgcctcttaattgaagttttttttgtttgtttgtttgtttgtctgtttgtttttgagacggagtctcgctctatcacccaggctggagtgcagtggtgcaatctcggctcactgcaagctccac

SEQ ID NO: 37980 - DNA, 201 bp, Homo sapiens
ttgatcttcaatcactgataccctttcttccagttgatcaaattggctcctgaagcttatgcatgtgtcaggtagttctcgtgccatggttttcagctccwtcaggtcatttaaggacttctctacactggttattctaatataagtgataagtgctagggaaaaaataaaacagaaaaaatagatagtaattgccatgtt

SEQ ID NO: 37981 - DNA, 201 bp, Homo sapiens
aaattattccattttctttaaagacttctactgcaaagtttgggactcagacaccaagtaatacagtcagagaagacttcaggagtctatacaaagcatcyttaattcaatcaatgacaatgcccattgttctaataatttcattgttcaaaaactaaagataaattggcatggaaacacataccagactagagactacca

SEQ ID NO: 37982 - DNA, 201 bp, Homo sapiens
agttgccactaccgtcaaaggaagttttgagacttaaaagaaaaacaatgaatttagatttccaaaattctaaaggacaatgaaatattgaattctgtgamcttgttattgtcagagaaattaaaactgggagaaaaggctctcaaacctagccatatggctgcacttattgggcaggaagaagctcccaatctttggtgc

SEQ ID NO: 37983 - DNA, 201 bp, Homo sapiens
acagaaggcttaaataagtgtcagagtctcataatatgagattcataatatgactttcaaagtgttcagtttgcaattaaaaagcactcatcataccaagragcaggaaatgtaaacttgaataaaaaaagaatcaatcatcaatagatgccaacactgagacaacaaagatgttagaattatctgataatgattttaaag

SEQ ID NO: 37984 - DNA, 201 bp, Homo sapiens
gacagctttgttgccactagttgtatacaataacaaccagaacctgggctactctaaaagtctccaaatcattcttaaaaaaaaaaaaaaaaaaaaaaagrcaagtaagtcctgcctttagaatattatgaataatttttgctacttcctaaggaaattttctccagtaaaagaaccaagcctcagagttagcaagtttaa

SEQ ID NO: 37985 - DNA, 201 bp, Homo sapiens
tcaaaacaacaacaaagtaagtgccattgtcttcttttcatatataataaaattgaaatcaattcttaagtcaattatttgaggcaatatagccagtaaastgccacttcaggatttgagcctatatatttctatcttcaaagtccatactttttccaaacaccccagattactcccttgagtctcagtctattgtccact

SEQ ID NO: 37986 - DNA, 201 bp, Homo sapiens
taaaaaaataaaagttggcaacactataataaacatccttggatataaacctctctctctctctgtctctctgtctctctctccttctctctctctctctmtatatatatatatttaatgtacttaaaattatataatatttgatattaatatagtttcaaagtactttcctaaaaaatctgtattaattacaaagggata

SEQ ID NO: 37987 - DNA, 201 bp, Homo sapiens
aattatttgaggcaatatagccagtaaagtgccacttcaggatttgagcctatatatttctatcttcaaagtccatactttttccaaacaccccagattaytcccttgagtctcagtctattgtccacttaactattatataagttcttgatttgctcttcaaaatttgttttccacgatgttatttcacaactggagttt

SEQ ID NO: 37988 - DNA, 201 bp, Homo sapiens
aaccagggagcaaatcaaagcaagggaagtctttcaatcttttagcatctctggtaaattagtaaggtatcctcctgcacgttgctctgggtttgaaaagrttttaaaacaaattacttttttctcttggcctgtctcaggagcaacctaaattctacttttcaaatgctgaaatgcccttaaaagggaggggttgaaatg

SEQ ID NO: 37989 - DNA, 201 bp, Homo sapiens
cctagcactttgggaggccaaaacaggtgaattgcttgggcccaggaattggagaccagcctgggcaacacggtggaacctcatctctttaaaaaaaaaaattgtatttatttgaatttcactcatctgaactttctcacccacatttggtagagagtccaacaactagcatagtgattggtcatgtaaaagctaatggtt

SEQ ID NO: 37990 - DNA, 201 bp, Homo sapiens
cacacttgtagatttatcgttccgaatccaacatcggctgagccatctatgtgaatcagtgtatgccctaaccccttccccagatttcgctttcctcacaytcccttccagccacatcgctccattgtctgcaaataaccttgccttttacttcaaagagaaaattgaagccaccctgcagaaaatgcctctttccactca

SEQ ID NO: 37991 - DNA, 201 bp, Homo sapiens
ttcttaattgccttcagctcaacaattctttatattttggagtggcatattctggtcccccacacaataatagtctataattccttgcctctgaaatttayttcagccccatattcaaactctcagagaagttctgtctcattttaaataaagatgcatcattcacttcagtcttgaaactaccctcttttaaatcacaca

SEQ ID NO: 37992 - DNA, 201 bp, Homo sapiens
cctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaagaa

SEQ ID NO: 37993 - DNA, 201 bp, Homo sapiens
acataatatttggatccaaaccatatcaggttgtttccatctctttactattgtgaatagtgcttccatgagcatgggtgtgcagatgtcttttcagacaytgcctcaattcttttggatccatacccagaagtgggatgctcttcagcaccttttattcgtgtacagtcagcaacactttcatttccccacattgtctgt

SEQ ID NO: 37994 - DNA, 201 bp, Homo sapiens
attctctttttgtattaatttcctattgctgctgtaacaaatttccacaaacttagtggcttaagacaacagaaatgtattctcttccagttctggaggcygacgtctaaaatagatccatagggctgtgttccttgtggaggctccaggggagcaggggttttcttgctctttccagcttccaggggctgcttccgtcct

SEQ ID NO: 37995 - DNA, 201 bp, Homo sapiens
tcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaaga

SEQ ID NO: 37996 - DNA, 201 bp, Homo sapiens
atcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaag

SEQ ID NO: 37997 - DNA, 201 bp, Homo sapiens
gcaatgacccactcctgggtaccaattttctgtattagtttcttcccacattgctataaagaaatacctgagactggataatgtataaacaaaagaggttyaattggcttatggttccagggtctgtacaggaagcatgctgctgacttcttcctgccttctggggaggccttgggaaactcacaaccatggaggaaggca

SEQ ID NO: 37998 - DNA, 201 bp, Homo sapiens
aatcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaa

SEQ ID NO: 37999 - DNA, 201 bp, Homo sapiens
catgaaggatccaccctcatgatccaatcacctcctaccaggtcccacctccaacaactgaggattacaattcgacatgagatttggatgggaacacagcrtttttctgagccctccatatttttccaacctctgcctgttacccaattccaaagttgctgccgcattttcaggtatctttatagcaatgacccactcctg

SEQ ID NO: 38000 - DNA, 201 bp, Homo sapiens
ataacttccaaatgtgaaacagcctaaactaaactacctagaaattttgttgctgacataatttaaattttaaaatgctgatggatgcttccagtgtgcayggtcctttggaattttaaagaagtataagagctctgcacccaaagtgtatgcatatagaagtaggtggtggagttttatgaaatctacttattaggaagc

SEQ ID NO: 38001 - DNA, 201 bp, Homo sapiens
agttacaaccacagtgcatgctaagtgcttagctaagaggggaaaggcattaaatttgtgggcggaagaggtgaacagaaatgtgttctaattgacagctrtcaggtttggtactatctgaggttttgggtatcggctaatgtcttggaacatgtcccccaaagataagtgggtgactactgtatattcaaaataagcatt

SEQ ID NO: 38002 - DNA, 201 bp, Homo sapiens
ttagagctttcatgttttttctagaaatcttttgtccaagtcctccagttattcctaatgggagacacacaggaaaacctctggaagtctttccctttggraaaacagtaaattacacatgcgacccccacccagacagagggacgagcttcgacctcattggagagagcaccatccgctgcacaagtgaccctcaaggga

SEQ ID NO: 38003 - DNA, 201 bp, Homo sapiens
tgtctttgcaaccatctgatctgtctctgtccttctgcattctctgttctagtgcgataaatcctttggtcttgtgctcctaggtcaggagagattagatratgtgaagctttaacaattttctttctttctctagttttttctttcttttttctcttccttccatccttcagttctttcttcccttcttctctccttctc

SEQ ID NO: 38004 - DNA, 201 bp, Homo sapiens
tgacttaaagtttgtccacttgtcatcttgcctccaggctgtcttaatctttgtacttgaactgttccactcagggggtaagaagcaaggaaagagtagcscaaagaaaagagtaggaaaaggaagaggctatttcttcctaaggaggggaagaagttgcctggtccttcagggcaaacattaggccttttccagagcaga

SEQ ID NO: 38005 - DNA, 201 bp, Homo sapiens
gtgggaaaaagggactgagggaggggtggagggaaggcagtaaggcacagttatgtaaatcaggaagaaaaatgtattcactggagacgacatgaaaacawctgcctctgaacactaaccagtatctgtataattgacagtctccataagttcatgaggggtacatgggcatgcaaagttcaaaattggaaatgtggatat

SEQ ID NO: 38006 - DNA, 201 bp, Homo sapiens
gggagagcaccatccgctgcacaagtgaccctcatgggaatggggtttggagcagccctgcccctcgctgtgaactttctgttcgtgctggtcagtatccrcttccacatatcctaaatgggttcagaatatgtggacccaatccctcatgtttctgtaataagactatggtatttgtttgtgagcttaactttgtcataa

SEQ ID NO: 38007 - DNA, 201 bp, Homo sapiens
tgaagaagaaatcaaaattccaaatggtgttgtatcaaagaaatattaatgaggcacaaaactagttaaatggggtcactaaaactgttttatttaatatrgaaataaaatatcaaagcaggactaattcttgaaagataattcatgtaatatgaaaagaagaagaaacttgatataaaaaatagattttatcacttcagc

SEQ ID NO: 38008 - DNA, 201 bp, Homo sapiens
ggaatgggggaaatcaaaagttaagcttgggacataactttagtgttcctcttagatatccagatggatatgttggagagtcccaggctgcccatagatakgtagaagccatcattgtatctgctatgcttgaaatcaggactgaaagagatcttcacctagggagtgagtgctgctagagaacagatgcatggactgagc

SEQ ID NO: 38009 - DNA, 201 bp, Homo sapiens
attactttttccattttataacagttttatgtaatttatttgagatccaaatgtgttttgatttcccaagatcagatcaactacattaagagagagcctgmgatgccgttacaatatgttgtgtgaaattacactctcattatggtgacagtaggtctttcagattttgttcgacagtttcccaccttctcactgaagtga

SEQ ID NO: 38010 - DNA, 201 bp, Homo sapiens
cttgacataaaaaataaggagaaaatggtacttcacaccagtataaaatctatatatctatatctatatatatctatatctatatctatatatatatatawaatcaaattttaaaagataatcagaagggcgaaaccacttggtccataaaacaaaagaggggtgagagaaacaagagctagcaagctttctgtctctctt

SEQ ID NO: 38011 - DNA, 201 bp, Homo sapiens
aaaagggaactgatctgctcaaagacaaactgaaattactttttccattttataacagttttatgtaatttatttgagatccaaatgtgttttgatttccyaagatcagatcaactacattaagagagagcctgagatgccgttacaatatgttgtgtgaaattacactctcattatggtgacagtaggtctttcagattt

SEQ ID NO: 38012 - DNA, 201 bp, Homo sapiens
tcaaactcatcagttataatagtaaatgtgaatgattccaatccccccttttgaaagacaaaggcttctaaatatggtcagaatcctatttacagtagcaycaaaaagaataaaatacttaggaatcaatttaatcaaggaggcacaagacctgtgcactgaaaactcagtaactgaaaatgagcaaatgatgtgatagac

SEQ ID NO: 38013 - DNA, 201 bp, Homo sapiens
taaaaattcaaagttttagaaaacggagtaccttagatcttgatcaaagagaaatttaaaaacagccattgcagattacctggagaataacaatcgctaaygatcctcaagtgcatgtgcctcaagcattcttctaagtcctttacttgaattgatttacttagtctttaaaagaccctttgaaatggatatcatgcatat

SEQ ID NO: 38014 - DNA, 201 bp, Homo sapiens
tacaaggggtacctgctatgaaaggccagagaggcagcttatgatgggcaccctgagaatggagtatggagagagatgataaaatatgtcttgctactcakgagtgaattagcacaaacacatgaagatttgagtggttaactgaggatataggcactccgataggaggtcagaatgtgaaactacaagctgaagttcttg

SEQ ID NO: 38015 - DNA, 201 bp, Homo sapiens
ttgttgtcccttaacttcatgagaaaatcaaaagtctgttcagcctctcagttgccccgtcctgattcagctgcccattcccaaacaataagcagcccagktgccaagcccaaatacccagctctcaactggattctcatcttctcctagatcatggcccaggaatgcttcactagtttgttagctttctgatgctttaac

SEQ ID NO: 38016 - DNA, 201 bp, Homo sapiens
gcctcagaatagacaaagaccttagagtttgtctataatggtctgcctcctacattttattttgattttattttatttaaaaactatttattagagttgaygtcccactctgttgcccaggctgaagtacagtgatacaatcatggctcactgcagcctcagattcctaggctcaagccatccacgtcctacattttatcc

SEQ ID NO: 38017 - DNA, 201 bp, Homo sapiens
cgcagatgctgagcgggtgccgcacgaaattccttgcctttgtgtattcacagcctcggctggctatagccaagacgtggcgttgatcctagtgaaagggracttggggatccgacaaacctgagttctggtcctagaaacttaactgtgaggcaacttagcacacctgagtctgtttgctcttctgtaaaatggggacac

SEQ ID NO: 38018 - DNA, 201 bp, Homo sapiens
tataaagaaaagagttttaattggctcatggttccgcagactgtatgagaagcatgatactggcatctgctcagcttctggggaggcccccaggaaactgwcaattatggcagaagatgaagagggaagccaggcatgttttacatggcagaagcaggatcaagggagagaatggggaggtgccacacactagaacaacac

SEQ ID NO: 38019 - DNA, 201 bp, Homo sapiens
gacattaggttgtgtattagtctgttcttacattgcaatatagaaatacctgagactgagtactttataaagaaaagagttttaattggctcatggttcckcagactgtatgagaagcatgatactggcatctgctcagcttctggggaggcccccaggaaactgacaattatggcagaagatgaagagggaagccaggca

SEQ ID NO: 38020 - DNA, 201 bp, Homo sapiens; identical to SEQ ID NO: 8293

SEQ ID NO: 38021 - DNA, 201 bp, Homo sapiens
cggctggctttcggtttctctgctcacctccggataaatcacggggtctcccgcgccgctcatggcgcctcccgtccgtctcgagcgtccctttccttccyggcgctttcctgggttgcttctggcggccctggtgttgctgctgtcctccttctccggtaggaccccggggtggattcgcgcgtccgcggcgaggctaga

SEQ ID NO: 38022 - DNA, 201 bp, Homo sapiens
acacgaattaagctttaccaggcagtgtttaatatagggtggactctggcgccctcacgtggtcctcatataggatctggtttggttatccctgctaggtwaaggtgcaagatagaagggaagttccaatttgctttctgtgctttgtggtgtattttggtttacatatgctcagatgagtggatgtgtgatttatattat

SEQ ID NO: 38023 - DNA, 201 bp, Homo sapiens
taagcagggtgtttggaggcgagctgccatcatccaccgcctttgtctggaagcgcagggcctcacacgcgggatccatcggaagcccgagcattgtcaakctctgctgctgcacctgggtcagcaaggtgggctctgccagcgaaactcgttagaaacaatgcaaatggggagtaaacatgacctcgcccatgaagggga

SEQ ID NO: 38024 - DNA, 201 bp, Homo sapiens
ttgctttgaatggaatatctgaaccaggagaatgtgaaagtgggctgagtcatacaagacaaaacccgaaatgagataacaatacatacccactagaatgrctaaaatgaaaaagattgaccgagccaagtgttggcgataaggtggagtaactggaattataatatactgctatttggcaggtaaaattataacattaac

SEQ ID NO: 38025 - DNA, 201 bp, Homo sapiens
gaagtccagaaaagggaactgatctgctcaaagacaaactgaaattactttttccattttataacagttttatgtaatttatttgagatccaaatgtgttytgatttcccaagatcagatcaactacattaagagagagcctgagatgccgttacaatatgttgtgtgaaattacactctcattatggtgacagtaggtct

SEQ ID NO: 38026 - DNA, 201 bp, Homo sapiens
tcctgctttttaatttggtatatatgcctccaattggcagaacctaaccagagcctagctatcaaggaagatgaacgatttatttttaaggcctccattgytagctgtcaaaagacagtgcagaagtgtgaggctgggggccaacagaaatttaaccagcacagcacctcaatattacatcaccaggcattgattagtcca

SEQ ID NO: 38027 - DNA, 201 bp, Homo sapiens
aagaggaaaagttaagcagggtgtttggaggcgagctgccatcatccaccgcctttgtctggaagcgcagggcctcacacgcgggatccatcggaagcccragcattgtcaagctctgctgctgcacctgggtcagcaaggtgggctctgccagcgaaactcgttagaaacaatgcaaatggggagtaaacatgacctcgc

SEQ ID NO: 38028 - DNA, 201 bp, Homo sapiens
atcatcctgctttttaatttggtatatatgcctccaattggcagaacctaaccagagcctagctatcaaggaagatgaacgatttatttttaaggcctccwttgttagctgtcaaaagacagtgcagaagtgtgaggctgggggccaacagaaatttaaccagcacagcacctcaatattacatcaccaggcattgattag

SEQ ID NO: 38029 - DNA, 201 bp, Homo sapiens; identical to SEQ ID NO: 8306

SEQ ID NO: 38030 - DNA, 201 bp, Homo sapiens
cacattccctgtacaccgtacacatcgcctgcaattgcccttcaacacggagagcaggcatttcattagctgaccttcccacacacattcttgcaaagagraaaagttaagcagggtgtttggaggcgagctgccatcatccaccgcctttgtctggaagcgcagggcctcacacgcgggatccatcggaagcccgagcat

SEQ ID NO: 38031 - DNA, 201 bp, Homo sapiens
tgccatcatcctgctttttaatttggtatatatgcctccaattggcagaacctaaccagagcctagctatcaaggaagatgaacgatttatttttaaggcytccattgttagctgtcaaaagacagtgcagaagtgtgaggctgggggccaacagaaatttaaccagcacagcacctcaatattacatcaccaggcattga

SEQ ID NO: 38032 - DNA, 201 bp, Homo sapiens
ggaggtagggtggaagtctctctgctaactttgatattcctgtggtttttctctccaggtcactgtaaaaccccagagcagtttccatttgccagtcctaygatcccaattaatgactttgagtttccagtcgggacatctttgaattatgaatgccgtcctgggtattttgggaaaatgttctctatctcctgcctagaa

SEQ ID NO: 38033 - DNA, 201 bp, Homo sapiens
gaacagattctgccatcatcctgctttttaatttggtatatatgcctccaattggcagaacctaaccagagcctagctatcaaggaagatgaacgatttakttttaaggcctccattgttagctgtcaaaagacagtgcagaagtgtgaggctgggggccaacagaaatttaaccagcacagcacctcaatattacatcac

SEQ ID NO: 38034 - DNA, 201 bp, Homo sapiens
gaagtagaacagattctgccatcatcctgctttttaatttggtatatatgcctccaattggcagaacctaaccagagcctagctatcaaggaagatgaacratttatttttaaggcctccattgttagctgtcaaaagacagtgcagaagtgtgaggctgggggccaacagaaatttaaccagcacagcacctcaatatta

SEQ ID NO: 38035 - DNA, 201 bp, Homo sapiens
ccctaagcatgaacgaacaggactataaataaaggcagatgttgagtcaaatactctccaaataatatgccctctcgtgacaaaggactgtcttatttaakggcttgtgtttttgatggctcatcttgtctactgatgccacaatagctggcttagcagctgtgtaggaggtgttatggttgatacatagggacagagaag

SEQ ID NO: 38036 - DNA, 201 bp, Homo sapiens
ccttgttagtgagatgtggctactgaactaccaatcttctcttttaatagctgcactctgcaatgacgatttttaagccctctggtaagcataagatatarcaaaggaaattgccccatatctaacaagtgctctggaactgtcctttccacagtgtgtcagccgcctccagaaatcctgcatggtgagcataccctaagc

SEQ ID NO: 38037 - DNA, 201 bp, Homo sapiens; identical to SEQ ID NO: 8316

SEQ ID NO: 38038 - DNA, 201 bp, Homo sapiens
agccccccaaagtgctggaattacaggggtgagccactgtgaagggcctaatttggccttctttaatgaatcttattgataaaagcccatccatgcatccrtgcatccatacttttaaggcaaagaaatacatacaacaggactgtatacacacatatacatgtatatatatgacagcttccctgcactcaagaactttgt

SEQ ID NO: 38039 - DNA, 201 bp, Homo sapiens
ctcaaagacaaactgaaattactttttccattttataacagttttatgtaatttatttgagatccaaatgtgttttgatttcccaagatcagatcaactayattaagagagagcctgagatgccgttacaatatgttgtgtgaaattacactctcattatggtgacagtaggtctttcagattttgttcgacagtttccca

SEQ ID NO: 38040 - DNA, 201 bp, Homo sapiens
tgagatccaaatgtgttttgatttcccaagatcagatcaactacattaagagagagcctgagatgccgttacaatatgttgtgtgaaattacactctcatyatggtgacagtaggtctttcagattttgttcgacagtttcccaccttctcactgaagtgaaatgaatgactaggcagcaccttgctacatagcatgaaga

SEQ ID NO: 38041 - DNA, 201 bp, Homo sapiens
cgtggtgagagtttgccctgtgttcccttggtgccttggtgagtagggtgttcattagggcttggacagtacccgcggtaagggttgcagtgcgtctgctktgccccatgggctgggctggcctgggctgggctgggcgagcaggggcctggccaggtgttgctgggagcgtgctgtgcgcaagtggcctgtgtgcggagt

SEQ ID NO: 38042 - DNA, 201 bp, Homo sapiens
tgaaaagcacaaggaaagtgaaatatctataatcttaaccattgttaattttgttgtgttccaaattagtgtatgtatatatatatatatatatatatatwgcatttttgttttaataaaaggactgccaaaatgcacatgccaatttggactctgctttttccacttacaatgatatcatagtttctcacatttggtatt

SEQ ID NO: 38043 - DNA, 201 bp, Homo sapiens
ttctaaaccgggtccacaaacacacatatcctcattctctccttttcttctctttggcagtttgacaaaatctttagggggaattggaggaaacattaatytcctaaatcaacttcattcaaagctttggcttcaagttctacccgttaaggcctcaggaagttcattgtcgacattgaactcagtcactaaaatgacctc

SEQ ID NO: 38044 - DNA, 201 bp, Homo sapiens
acagtttaatgacatccctgcacaccagcctccacccatactgcccttcataagccccttaaaggagatcccatagttctaaaccgggtccacaaacacasatatcctcattctctccttttcttctctttggcagtttgacaaaatctttagggggaattggaggaaacattaatctcctaaatcaacttcattcaaagc

SEQ ID NO: 38045 - DNA, 201 bp, Homo sapiens
aatactttattttgcaaatctacttatggaatatagttctgtacctgattgttttcataatccctgtgttgatgtgtaatgccacagacatgctcttgatrgtaacaggaaagaaaatcagacacagctaaacataaaggtcagttggctggcaggtgcttagcaggtgtaaatagaggcccattcatgctgctccacttg

SEQ ID NO: 38046 - DNA, 201 bp, Homo sapiens; identical to SEQ ID NO: 8312

SEQ ID NO: 38047 - DNA, 201 bp, Homo sapiens; identical to SEQ ID NO: 8314

SEQ ID NO: 38048 - DNA, 201 bp, Homo sapiens
gggtagagattcctttttctccctattcccaagggtagaaagactgtaattttttagcttatgtttgtctaaactttctgttaagtcgctatcaacagctrgactcacttgtgcactgggacacgactgagtttgtcctgtgcaattgtggtagaattgacctcgaggtgcccaatctataatagttccgaattcactgtt

SEQ ID NO: 38049 - DNA, 201 bp, Homo sapiens
tgttttaccatactcttccttctctcagtcatatcttgtgagccacctccaaccatatccaatggagacttctacagcaacaatagaacatcttttcacartggaacggtggtaacttaccagtgccacactggaccagatggagaacagctgtttgagcttgtgggagaacggtcaatatattgcaccagcaaagatgat

SEQ ID NO: 38050 - DNA, 201 bp, Homo sapiens
tggtggcagtaataaccggggaacagatgagctggaggcctcatcaggaggggtgtcccttggtggaaggacaccattcccggccttaaaaggagacgctycagcacggctggggaagcacgtggataccttgtactaaatccactactgcagctcattcttaactgtaagtagaagaggaggacatgctttctgaagctg

SEQ ID NO: 38051 - DNA, 201 bp, Homo sapiens
cacaggaatgggctctgagcagtgctggcggctggaccaggcatgtcacactgaagggaacgtggtggtgcccaaacaggggtgcccatgaccccaaagcmcagaggaggtgttacagcacactaatggctcttagcatttgataatgcctgcagcccaacagatggcagtgtgcttaacagctctgtcaatcctgtcgcc

SEQ ID NO: 38052 - DNA, 201 bp, Homo sapiens
agcctctcagttgccccgtcctgattcagctgcccattcccaaacaataagcagcccagttgccaagcccaaatacccagctctcaactggattctcatcwtctcctagatcatggcccaggaatgcttcactagtttgttagctttctgatgctttaacagataaatatttttaattctccagtatttctagcctttctt

SEQ ID NO: 38053 - DNA, 201 bp, Homo sapiens
gctgggaatgcaggtgtgcaccaccacacctacacatctggataatatatatatatatatatgtatatatacttttttttttttgtcgagacagggtttcsccatgttgcccaggctggtctcaaactcctgagctcaaacgatccactctcctcagcctcccatagcgttagaattacaggcgtgagccaccacatccca

SEQ ID NO: 38054 - DNA, 201 bp, Homo sapiens
gtaacctaaatattttaaactatggtttggaaataatctactagtaggaaaaagatgtgttcaaatgaccattataaagaattccctaagaaacataaaayagctatgcagaatgaaaataagtatatccatacactggcatggtattcagccataaaaaatgacagcataaagaagcacttaatgactagaaagagatgt

SEQ ID NO: 38055 - DNA, 201 bp, Homo sapiens
tttttttttttttttttttttgagacagggtctcactttgttgcccaggttggagcacagtagcataatcatagctcactgcagcctcaaccttcacaggstcaagcaattctcccacctcagccacctgagtagctgggaatgcaggtgtgcaccaccacacctacacatctggataatatatatatatatatatgtata

SEQ ID NO: 38056 - DNA, 201 bp, Homo sapiens
agtctaacctgctattaatctcacacaaattcttaatttcagcaatcatattttacttttacaattctagactttttattttccaaatctgccctcttccytttttttttttttttttttttttttgagacagggtctcactttgttgcccaggttggagcacagtagcataatcatagctcactgcagcctcaaccttca

SEQ ID NO: 38057 - DNA, 201 bp, Homo sapiens
ccgcctccggggttcaagttatcctcccacttcagccttccaagtagctgcaattacaggcctgtgcctccatgcctggctaatttttacccttttagtaragatgggttttcaccatgttgaccaggctggtctcaaactcctgacaagaggtgatctgcccacctcggcctcccaaactgctgggattacaggcatgag

SEQ ID NO: 38058 - DNA, 201 bp, Homo sapiens
tagaactccccatgggagataccttggcttgtagatgcaagatgctgggtcatactctggtccccaataaaggcattggctgatgggtccccttctctctstctgtctcctcgcgctgaccaacctctgtgtgatcttcaggcgtgccatacccccagcccgtaataaaatctttactgccatcttgtgtttcttgtaatg

SEQ ID NO: 38059 - DNA, 201 bp, Homo sapiens
cgatgggtgggctgagcgcgcgacccggcagggcggcgggtgtaggatccttctgcgcactggagaccctcggtgcttctgggtaagcgtggagttcccasgtgcaggggcttaagtcgtgacgagcgcagtggaaggcgcagatgctgagcgggtgccgcacgaaattccttgcctttgtgtattcacagcctcggctgg

SEQ ID NO: 38060 - DNA, 201 bp, Homo sapiens
atatacatatacatatataggtatatacatatatatacgtatatatacatatacatatataggtatatacgtatacgtatacatatataggtatatgtatrcatatatacacactatatatatatacacatatatatagtgtgtatatatgcacacatcttaatcatgcagttcaatggagttttacaaagtaaatgtatc

SEQ ID NO: 38061 - DNA, 201 bp, Homo sapiens
tatatgtatatatgtatatatacgtatatacgtatgcatacgtgtatgtatatgtgtatatatgtacgtatatatacatacgtacgtatatatacgtgtayacgtatatatacatatacatatataggtatatacatatatatacgtatatatacatatacatatataggtatatacatatatatacgtatatatacatat

SEQ ID NO: 38062 - DNA, 201 bp, Homo sapiens
ttttttttccaaccattttcctgtaccatgtagacttttggctgaagtataacatatatatatatatacacacacacacacacacacacacacacacacayatatacatatatacttatatgtatatatgtatatatacgtatatacgtatgcatacgtgtatgtatatgtgtatatatgtacgtatatatacatacgtac

SEQ ID NO: 38063 - DNA, 201 bp, Homo sapiens
ttgtgcatttgccacaatggaatgccaaaccaatgatagatggttctaaggtaggtcaacacataagatcctgatgacctttgcagatggagggactgatraaaaaagagggaggcggtgagtggtgggaaagtccttcattagaatcatatgaattaaaaacagatgcctgtgaatctccttattgaaatgtttggttta

SEQ ID NO: 38064 - DNA, 201 bp, Homo sapiens
atataccatgctaatgctagtcacagaaagcaggaatagctgtgttaatttcaaacacagcagacttcagaccaagaaaaattattagggataaagagggrcatcatataatgataaaggggccaattatccaagaagacgtaacaatatcccatatgtatgcacctgatggagagacaaaatacgtgaggcaaaacccat

SEQ ID NO: 38065 - DNA, 201 bp, Homo sapiens
agtctgtttgctcttctgtaaaatggggacactggtatctctgcatcgtggagttgctgcctcagtggcattaagcctgtcgagtatctaacacagggctrtgtgtccccgagtccatttctatcccccaaccgttacctctgtacttagctcccaatggtgtttagacaagcagtcctagggatgcaggtgttacctgac

SEQ ID NO: 38066 - DNA, 201 bp, Homo sapiens
gagtatcacttgagcccaggagctcaagaccagcctagacaacatggcaaaaacccatctctacaaaaaagtataaaaattagctgggcatggcagcatawgcctgtagtcacagctaggcaggagactaaagtgggaggatcacctgagcccaggaggctgaggcttcagtgagccttgatggcaacctgcactccagcc

SEQ ID NO: 38067 - DNA, 201 bp, Homo sapiens
tgtctccttttaatggttaaggaaaacaagtttaacataaaattagcaacaacaacaacaacaacaacaaaatcaaggtttaaagtcaaaattattttaasagaaaaacccaggcaaaatagcctacctacagacaggcagtacatgtcagaaggacaggccacccccaataaaaaagataaaatattattttttctacct

SEQ ID NO: 38068 - DNA, 201 bp, Homo sapiens
aatctggtggcagtaataaccggggaacagatgagctggaggcctcatcaggaggggtgtcccttggtggaaggacaccattcccggccttaaaaggagasgcttcagcacggctggggaagcacgtggataccttgtactaaatccactactgcagctcattcttaactgtaagtagaagaggaggacatgctttctgaa

SEQ ID NO: 38069 - DNA, 201 bp, Homo sapiens
caggtagcgaatacgggttatgtttgtgtcaccacaacagacactgaaaggaagtttgtggtgtccagcacacttgccagcataggcctcacagaccacarcacctagaatctgacaaaaattagaataaatccgatgtctccttttctctcttttttttaagcatttttaaatgcaattggtaaatttcctgactgtacc

SEQ ID NO: 38070 - DNA, 201 bp, Homo sapiens
atacaggtaacaggtgatgctgggaagtcctgtgaaatggaaggagaacgaagatgaggaatctggtggcagtaataaccggggaacagatgagctggaggcctcatcaggaggggtgtcccttggtggaaggacaccattcccggccttaaaaggagacgcttcagcacggctggggaagcacgtggataccttgtacta

SEQ ID NO: 38071 - DNA, 201 bp, Homo sapiens
tcttgaaaggccccatgcactataaacctcagaagtgaacatatattttaacctacttcttaaaatttatacttaggaaataatcacacactttttaaagyagtttggtataaacttttcattgcagcattatttatattagttaaaatgttagagtaacctaaatattttaaactatggtttggaaataatctactagta

SEQ ID NO: 38072 - DNA, 201 bp, Homo sapiens
gagaattgattctaaccagtaatgttgttttgtctaatggctataataacccaagagaagggtgagggagctaacagtgggtgcaagatggtgattataawgacagagtatggaatttaacctggtagtgatgaaagtgaagacacaaaggaggtgagaagctgagagagatagcggtaggatcaatgggctgcaggcact

SEQ ID NO: 38073 - DNA, 201 bp, Homo sapiens
tgtgtgttggacatgagagtatttggaggaatacaggtaacaggtgatgctgggaagtcctgtgaaatggaaggagaacgaagatgaggaatctggtggcmgtaataaccggggaacagatgagctggaggcctcatcaggaggggtgtcccttggtggaaggacaccattcccggccttaaaaggagacgcttcagcacg

SEQ ID NO: 38074 - DNA, 201 bp, Homo sapiens
tccagctgttggtgctcacccttgctcagcacacggtggaggctctgcctcaatctcattcttcatgggaacagctaagccaggtagcgaatacgggttaygtttgtgtcaccacaacagacactgaaaggaagtttgtggtgtccagcacacttgccagcataggcctcacagaccacagcacctagaatctgacaaaaa

SEQ ID NO: 38075 - DNA, 201 bp, Homo sapiens
gcatgtggcagcagaactccaatttctgtctctgtcctcatatggccatcttccctctgggtctgtgtcctcatatgctgttctctctgtgcatgtctgtytccaaagttttcccttttaataaggacaccagtcacactggattagggcctactttcatgacctcaccttaacttgattgcgtctgcaaagattgtattt

SEQ ID NO: 38076 - DNA, 201 bp, Homo sapiens
ggcaggctccaaagacatagctgtgtgttggacatgagagtatttggaggaatacaggtaacaggtgatgctgggaagtcctgtgaaatggaaggagaacraagatgaggaatctggtggcagtaataaccggggaacagatgagctggaggcctcatcaggaggggtgtcccttggtggaaggacaccattcccggcctt

SEQ ID NO: 38077 - DNA, 201 bp, Homo sapiens
gaatgtctgtaacacgaagtgggcggcttaatacaacagaagtttttggagttccattctagagactggaaatccaaaatcaaggttttgggagggccacrctccctctgaatcctgtagggaaggatccttcattgcatcttccagcttctggagccacaggccttccttggcatgtggcagcagaactccaatttctgt

SEQ ID NO: 38078 - DNA, 201 bp, Homo sapiens
gttctggggcggagtaaagaggcaggctccaaagacatagctgtgtgttggacatgagagtatttggaggaatacaggtaacaggtgatgctgggaagtcytgtgaaatggaaggagaacgaagatgaggaatctggtggcagtaataaccggggaacagatgagctggaggcctcatcaggaggggtgtcccttggtgga

SEQ ID NO: 38079 - DNA, 201 bp, Homo sapiens
cattcatgtagttgcttatttattcttcaaacattcttagccacttacaatgtgccatacattgtgcttatgtgtgttttcttttccatgctaaattaacytctgatgaatagagacaattttttaaagatctccccaatctctgagtataatcaaatgagaaatgttcagtaatcaactgagcacgttaatcaattgaga

SEQ ID NO: 38080 - DNA, 201 bp, Homo sapiens
tgagaacactttttctttggacaaaattaaaaaaggaaaaggtcaagttaatcattaatctctctgttttctactaatgtctccattttcgccatactttstatgtcctacatagcagccatcacagagggcaataaacacttctaatgaccgtgtaatttatatggaatgctgaaggggtgggttggccctccacacctg

SEQ ID NO: 38081 - DNA, 201 bp, Homo sapiens
catcattgttaaaaacaagaaataggggaaaatataaaaaatataaaaattacctgcaataatctctatctagtagtattcttaagcttctttgcatattrttagacatttgcatatacaccttgagattatattgattgcacaatattgaatcctgctttttttaccaaatgacaaacatttctcccatcattataacag

SEQ ID NO: 38082 - DNA, 201 bp, Homo sapiens
accatggtgtagaacaacagaatcaaaaaaacattttttctgttatgggtgacctgtacgttttctagaatggaaggaggctgtttagtagctcaactctragaacactttttctttggacaaaattaaaaaaggaaaaggtcaagttaatcattaatctctctgttttctactaatgtctccattttcgccatactttct

SEQ ID NO: 38083 - DNA, 201 bp, Homo sapiens
gcttcagcacggctggggaagcacgtggataccttgtactaaatccactactgcagctcattcttaactgtaagtagaagaggaggacatgctttctgaarctgacccctccaagatgaccagttcctatttctgtcccctgctaccaccatggtgtagaacaacagaatcaaaaaaacattttttctgttatgggtgacc

SEQ ID NO: 38084 - DNA, 201 bp, Homo sapiens
gagaacgaagatgaggaatctggtggcagtaataaccggggaacagatgagctggaggcctcatcaggaggggtgtcccttggtggaaggacaccattccyggccttaaaaggagacgcttcagcacggctggggaagcacgtggataccttgtactaaatccactactgcagctcattcttaactgtaagtagaagagga

SEQ ID NO: 38085 - DNA, 201 bp, Homo sapiens
ccactgttttggggtgatgactctataagttagtacagtcacagtcactactttttcaaagcattcctataatttcctgtatttatgctatgaaactttgmgaagtagtatgcttttttcttgtggaacccaagaatttgctgcctgcttgtacctccaagtcttccagcttcccttaaatgcacagagtcactttaatgt

SEQ ID NO: 38086 - DNA, 201 bp, Homo sapiens
aacaaagtgaatcatctgtggcaaaatatgctagtcaagaagtgagttagaatctgtgccaagcgttaagaccttgtgcacccaggttctggggcggagtraagaggcaggctccaaagacatagctgtgtgttggacatgagagtatttggaggaatacaggtaacaggtgatgctgggaagtcctgtgaaatggaagga

SEQ ID NO: 38087 - DNA, 201 bp, Homo sapiens
ttttaaagatctccccaatctctgagtataatcaaatgagaaatgttcagtaatcaactgagcacgttaatcaattgagaaatttttcatgcacgtccctrtgaagagatcaccaaacaggctttgtgtgagcaacatggctgtttatttcacctgggtgcaggcgggctgagtctgaaaagagtcagcgaagggagatag

SEQ ID NO: 38088 - DNA, 201 bp, Homo sapiens
cattgtgcttatgtgtgttttcttttccatgctaaattaacctctgatgaatagagacaattttttaaagatctccccaatctctgagtataatcaaatgwgaaatgttcagtaatcaactgagcacgttaatcaattgagaaatttttcatgcacgtccctgtgaagagatcaccaaacaggctttgtgtgagcaacatg

SEQ ID NO: 38089 - DNA, 201 bp, Homo sapiens
cttagccacttacaatgtgccatacattgtgcttatgtgtgttttcttttccatgctaaattaacctctgatgaatagagacaattttttaaagatctccycaatctctgagtataatcaaatgagaaatgttcagtaatcaactgagcacgttaatcaattgagaaatttttcatgcacgtccctgtgaagagatcacca

SEQ ID NO: 38090 - DNA, 201 bp, Homo sapiens
gggcgctgtggctcacgcctgtaatcccagcactttgggcggccgaggcgagtggatcatgagtcaggagatcgaggccattctggctaacacggtgaaaycccttctctactaaatacacacacacacacacaaaatttagccaggcgtggtggtgggcgcctgtagtcccagctactcgggaggctgaggcaggagaat

SEQ ID NO: 38091 - DNA, 201 bp, Homo sapiens
atctattgagagaaatagatacttctaaaagcacacaaagataaaaagcacaaattgtaataacaaacaattattgatatgaaaggaaaagcaaagtgtcrgactagaaattattatagggtggggcagagggaagtagtttagattccaaatccctaagagggtcagggaaggcttcagatgagattgggtgtgttcagg

SEQ ID NO: 38092 - DNA, 201 bp, Homo sapiens
tgttattatgagttactcacagtacccgtaaagtggtatagtgctatttgaaagaggacttagattagctgcaaatagatattgcaaatgtaggacaaccmctgaaaaatgtgaaaaaaagaactataatttatatgttaataagtaagagagaattgcatcatataaaatgctcagttaaaacaataaagatggctgggg

SEQ ID NO: 38093 - DNA, 201 bp, Homo sapiens
cagttctttttattacttctgaatctgtaagtatcatgtttattatatgtaatattgtatatttgtgctttgtctttattagttcttccagagcttttgtycttattatttaataaagatgttatactgagccacgtgtggtgactcaaacttgtaatcccagcactttgggaggcctaggtgagcagatggctttagccc

SEQ ID NO: 38094 - DNA, 201 bp, Homo sapiens
ggtgtaatgcatgtgacagtgttttgtaatctgaaaacccccatgcatgtctgaaaaaccatgactaagaagtcgtgcaagactgcaggatcaccgaaaarcgagaaatctcaactcctatgatcaggaaaggatgagtgaaaggtatatggctttactagcacttaaagagtgaatctagaaacagattgcatacgacaa

SEQ ID NO: 38095 - DNA, 201 bp, Homo sapiens
ttactaaagtaaggctagtcattgtggctatgtgtcttttccagccacattcagtttcacaggtatgacagcaaaataatggagaattgattctaaccagkaatgttgttttgtctaatggctataataacccaagagaagggtgagggagctaacagtgggtgcaagatggtgattataaagacagagtatggaatttaa

SEQ ID NO: 38096 - DNA, 201 bp, Homo sapiens
gatattgcactaggtaggtcattgataccaaagaatttagaaagtacttcaggagttggaaacttcttttttttttattggattattattgtcatttccamtgttttggggtgatgactctataagttagtacagtcacagtcactactttttcaaagcattcctataatttcctgtatttatgctatgaaactttgagaa

SEQ ID NO: 38097 - DNA, 201 bp, Homo sapiens
ctgactcaagcgatcttcatgcctcagcctcctgagtagctaggactacaggaatgtgccaccacgcctggcttttttataaattttttgtacagacagcktctcactatattgcccaggctggtctcgaactcctgagctcaagcaatcctcttgcctcagccccccaaagtgctggaattacaggggtgagccactgtg

SEQ ID NO: 38098 - DNA, 201 bp, Homo sapiens
gtaaagaggcaggctccaaagacatagctgtgtgttggacatgagagtatttggaggaatacaggtaacaggtgatgctgggaagtcctgtgaaatggaasgagaacgaagatgaggaatctggtggcagtaataaccggggaacagatgagctggaggcctcatcaggaggggtgtcccttggtggaaggacaccattcc

SEQ ID NO: 38099 - DNA, 201 bp, Homo sapiens
aagcatgcgctttgaaaaccagcacaagacaaggatgccctctctcaccactcctattcaacatagtattggaagctctggccagggcaatcaggcaagaraaaggaataaagggtattcaaataggaagagaggaagtcaaattgtctctgtttgcatatgacatgactgtatatttagaaaaccccattatctcagctt

SEQ ID NO: 38100 - DNA, 201 bp, Homo sapiens
tactttttccattttataacagttttatgtaatttatttgagatccaaatgtgttttgatttcccaagatcagatcaactacattaagagagagcctgagmtgccgttacaatatgttgtgtgaaattacactctcattatggtgacagtaggtctttcagattttgttcgacagtttcccaccttctcactgaagtgaaa

SEQ ID NO: 38101 - DNA, 201 bp, Homo sapiens
ataggtaaacatcttcagttagaacccttctattattatttttcggctccccagaagtcttcttggttgcctagactcactggcaacatctcatttgaagygacagtcttggttgtttttgtccagcctattcctgacaactccgggttcgcccttctctgccactagacattttacattcattatttgagtgttccttct

SEQ ID NO: 38102 - DNA, 201 bp, Homo sapiens
gtggaaggcgcagatgctgagcgggtgccgcacgaaattccttgcctttgtgtattcacagcctcggctggctatagccaagacgtggcgttgatcctagygaaagggaacttggggatccgacaaacctgagttctggtcctagaaacttaactgtgaggcaacttagcacacctgagtctgtttgctcttctgtaaaat

SEQ ID NO: 38103 - DNA, 201 bp, Homo sapiens
acgagcgcagtggaaggcgcagatgctgagcgggtgccgcacgaaattccttgcctttgtgtattcacagcctcggctggctatagccaagacgtggcgtygatcctagtgaaagggaacttggggatccgacaaacctgagttctggtcctagaaacttaactgtgaggcaacttagcacacctgagtctgtttgctctt

SEQ ID NO: 38104 - DNA, 201 bp, Homo sapiens
cactgcagtgcaaagtcattcatgttgtgcagcttaagtgtcaaaatctcgatgtaaatcctatttactaatcaaaattatgtcagaaatagtgaaatgtrttaaggcatggacatctgcctataaacaatttagagtactctgacagaaaatataggatgattttagtattattttctaatctaagtttttgcttagtat

SEQ ID NO: 38105 - DNA, 201 bp, Homo sapiens
ctgtgttcacagtcactcactctctatgagaccctgagcaagatacttatcctcagtaaatttcattttccttgcctgtgaaatggagataataatagttmctaccttacttaacatagtgcctcatttatgatgcatgtcagaaaatgttagctattatttacacatgattgttattactgatattaaaaagtgagtaaa

SEQ ID NO: 38106 - DNA, 201 bp, Homo sapiens; identical to SEQ ID NO: 8313

SEQ ID NO: 38107 - DNA, 201 bp, Homo sapiens
ctctgcgcgcccgggtccgaaggcagcgcgatgggtgggctgagcgcgcgacccggcagggcggcgggtgtaggatccttctgcgcactggagaccctcgstgcttctgggtaagcgtggagttcccaggtgcaggggcttaagtcgtgacgagcgcagtggaaggcgcagatgctgagcgggtgccgcacgaaattcctt

SEQ ID NO: 38108 - DNA, 201 bp, Homo sapiens
tttcattgataaaagatgaagtgtttattaacccccaaagaggcagtgtaccataccaagtgagggtgagggctttgcaaccgctaaggcctgtgttcacrgtcactcactctctatgagaccctgagcaagatacttatcctcagtaaatttcattttccttgcctgtgaaatggagataataatagttcctaccttact

SEQ ID NO: 38109 - DNA, 201 bp, Homo sapiens
tgtcattctaatttccataagatggtaaagaataactgagtgatgaggaaacagtggtacatgttgaagtgagttaactcttcaagcttccattctaaaayccctaataccaactcatacataaaatctccaggtactggtactgttttatcatttcattgataaaagatgaagtgtttattaacccccaaagaggcagtg

SEQ ID NO: 38110 - DNA, 201 bp, Homo sapiens
aagcacatatgcttaaacgatatcacacttgatttcatgtgccttctcaatcctcagctttccctgattaagaatacctaattactctgcccatttcctcygcaccctccaccttggcctttccactcactattactactatctcctgccttcttggtctctactattctcctcaccatccctgctccctggactatgatc

SEQ ID NO: 38111 - DNA, 201 bp, Homo sapiens
gaaagtgggctgagtcatacaagacaaaacccgaaatgagataacaatacatacccactagaatggctaaaatgaaaaagattgaccgagccaagtgttgrcgataaggtggagtaactggaattataatatactgctatttggcaggtaaaattataacattaactttagaaaatagttcaacagattcttaaaacctta

SEQ ID NO: 38112 - DNA, 201 bp, Homo sapiens
ggaggtggaggttgcagtgagttgagattgtgccactgcactccagcctgggcaacaaaggcaaaactccatctgaaaaaaataaataaataaattaaatwaaataaaacaagaaaagaaactaaagtgatagagaaatagaaggaatacacacacagaaatgatctcaccttctttaaaatgctcctcaaggaggtctac

SEQ ID NO: 38113 - DNA, 201 bp, Homo sapiens
taaaaatcataagatgaaaatggcatggtttcctagagaatatatttttctaatattactccaatagttcaaataaaaattgtattatttcaacatgaacmcaaacacatttataagggaggaaaagacaaataaataatgcaggaagtttaagataaaataagacggctgggcgctgtggctcacgcctgtaatcccagc

SEQ ID NO: 38114 - DNA, 201 bp, Homo sapiens
aggagaattgcttgaacccaggaggtggaggttgcagtgagttgagattgtgccactgcactccagcctgggcaacaaaggcaaaactccatctgaaaaamataaataaataaattaaataaaataaaacaagaaaagaaactaaagtgatagagaaatagaaggaatacacacacagaaatgatctcaccttctttaaaa

SEQ ID NO: 38115 - DNA, 201 bp, Homo sapiens
acttcatttggcctctttgactgctccttcttttggtcctcattcccttgggcttattaaatacctaacctttcattctacctattcaaagcaggcttacygcaagctgttgtgcagtacacattgctaaagatttggggtgaaaagggaaattataccattatcaaaagtggtatgtatcaatattagaaatcactgaac

SEQ ID NO: 38116 - DNA, 201 bp, Homo sapiens
tactactgattggttggggatgggggtgtgggaaatgttcctcatgtgctgtgtccacctctggttgggggccacaggaccagttgagtcatgagtcacargtccaggtagagtcagtcagttgccaaatgcaaaaacctgaaaaacatctcagaagaccaatcttatattctacatagtgatgttatctataggagcaat

SEQ ID NO: 38117 - DNA, 201 bp, Homo sapiens
cagaagctgcataagcagtctgaagacttactaagaaactaaaatgaggctgggtgcgatggctcaggcctgtaatccctgcactttgggaggctgaggcrggtgggtcacctgaggtcaggagttggagatcagcctggccaagatggcaaaaccctgtctctactaaaaatacaaaaattagcctggtgtagtggcaca

SEQ ID NO: 38118 - DNA, 201 bp, Homo sapiens
ggaaggtactgtaagatagaaaactacccacatcatggagcagatgagcaaagttaataatgaacagcctttcttaatccaagttagtgctacactttccyttctccccatctcttatgactcttctaatacatggttctacaccaagattgttcaagatccagttttacaattaatcctgtaaatatgctaatatgactc

SEQ ID NO: 38119 - DNA, 201 bp, Homo sapiens
ttaagtaccatataattagtgagttaattttttaaaaaattactactacgtctgaattaaaggagttggggcttctaattttctgtatctatatcagtctstagttaaaaccacacaggggaaatgattatcccttcttcttggaagtattcaagatactttaatatcttgaagatatttgattatctccacccttctaac

SEQ ID NO: 38120 - DNA, 201 bp, Homo sapiens
atactgaattggtagatatttaaatttaaatatccatccttcctaactaatgttctctatattttacggcttgacatatattctttgctcttttccattayaaaaagaaaaggtaagtagctgggcactttaccttaacaaagtacttgtgtcaatacatttttcctcttaaagtttctcattaagtaccatataattagt

SEQ ID NO: 38121 - DNA, 201 bp, Homo sapiens
agggatgcaggtgttacctgacaactgccccgcatggaactgtcctcgccccccacaccaagccaccacggccatcatcaccatgcacttaattgacagcrtactttaagacagatgcatgccaggcacttgcggattagaagagcaagggaagccccagaacatgcaatgtaaccgttgcaggtagaagggacagtagat

SEQ ID NO: 38122 - DNA, 201 bp, Homo sapiens
agcaaatattctaaacaagtacagtttcctacaacaagctttacagaaactgaagttttgatatttcacaaagatgccaatatactttttaaaaagtagtytgtcatagtagatcttgctgtaaagaacctagacaggaactcaatttcatggaaaaatactgaattggtagatatttaaatttaaatatccatccttcct

SEQ ID NO: 38123 - DNA, 201 bp, Homo sapiens
acacacaactgtaataccagctactcgggaggttgaagcatgagaattgcttgaacccaggaggcagaggttgtagtgagccaagactgtgccattgcacwccagcctgggtgacagagtgagactacatctcaaaacacacacacaaacacacacacacacacacacacacacacacacacagcattttaagaaggaatt

SEQ ID NO: 38124 - DNA, 201 bp, Homo sapiens
ctctactaaaaatacaaaagttagctgggtttggtggcatgtgcctgtaatcccagctactccggaggctgaggcaccagaatcacttgaacctgggaggyggagtttgcagtgagccgagatggcaccattgcactccagcgtgaacaatgagtgaaactccatctcaggaaaaaaatcatattttacaagcaaaaggga

SEQ ID NO: 38125 - DNA, 201 bp, Homo sapiens; identical to SEQ ID NO: 8292

SEQ ID NO: 38126 - DNA, 201 bp, Homo sapiens
gcaacatggtaaaaccctgtctctactaaacatacacaaaattagctgggcgaggtgggacacacaactgtaataccagctactcgggaggttgaagcatragaattgcttgaacccaggaggcagaggttgtagtgagccaagactgtgccattgcactccagcctgggtgacagagtgagactacatctcaaaacacac

SEQ ID NO: 38127 - DNA, 201 bp, Homo sapiens
atacacacacagaaatgatctcaccttctttaaaatgctcctcaaggaggtctactttaactatcctagtaaagatgacatgaccccacccccacattccyagtctctcttatcctgctttatttttttcatagccttattctcttttattataattaattaaataattacattccatgtttattctctctctccctccat

SEQ ID NO: 38128 - DNA, 201 bp, Homo sapiens
acggtggctcacgtgtgtaatcccagcacctttgggaggttgaggcaggcagatcacctgaggtcaggagttggagaccagcctggacaacatggtgaaamcctgtctctactaaaaatacaaaagttagctgggtttggtggcatgtgcctgtaatcccagctactccggaggctgaggcaccagaatcacttgaacctg

SEQ ID NO: 38129 - DNA, 201 bp, Homo sapiens
tgggggcctcttctccaagaagcccggagcctgtcgggccgccggcgcccggtctccccttctgctgcggaggatccctgctggcggttgtggtgctgctygcgctgccggtggcctggggtgagaggcgggcgggcgtggggaggcgcccgggcggacgaggaacccggggccccgcagagaactcgcgtgcagcgctga

SEQ ID NO: 38130 - DNA, 201 bp, Homo sapiens
gcttggggagaatgggggcctcttctccaagaagcccggagcctgtcgggccgccggcgcccggtctccccttctgctgcggaggatccctgctggcggtygtggtgctgcttgcgctgccggtggcctggggtgagaggcgggcgggcgtggggaggcgcccgggcggacgaggaacccggggccccgcagagaactcgc

SEQ ID NO: 38131 - DNA, 201 bp, Homo sapiens
ggctgtgatttttccagaataaggtagcctgtgcaactctgccatctgctggcctcagatcctcaaaatcctgaaattggggctgggccttagattgtgarctaagtgtcctcttggctgaaacagctcactattcactcctattttcttctttagatttcaattaaaaggcagctctgctagttattgtgtcttggctgg

SEQ ID NO: 38132 - DNA, 201 bp, Homo sapiens
ttggtaatttgtatttccatttatatcatttagattttcaaaatatttaaccccctgtagtctacagttttataaatattctcatatacataaaaatatgyttaaattctttttcctactgtgtatatttgtgttttctctcatcccttatactttatcttttagcaaatgtttttgtattttatttttctaaaaaagcta

SEQ ID NO: 38133 - DNA, 201 bp, Homo sapiens
atctcattcttcatgggaacagctaagccaggtagcgaatacgggttatgtttgtgtcaccacaacagacactgaaaggaagtttgtggtgtccagcacayttgccagcataggcctcacagaccacagcacctagaatctgacaaaaattagaataaatccgatgtctccttttctctcttttttttaagcatttttaaa

SEQ ID NO: 38134 - DNA, 201 bp, Homo sapiens
ttcccttttaataaggacaccagtcacactggattagggcctactttcatgacctcaccttaacttgattgcgtctgcaaagattgtatttccaaataagrtcacatccacagggactggaggttaagacttcagcatacttggggggagacacaattcaacctataacagagcccctttgaaaatgtcaggcatcaggtg

SEQ ID NO: 38135 - DNA, 201 bp, Homo sapiens
gtctgtttccaaagttttcccttttaataaggacaccagtcacactggattagggcctactttcatgacctcaccttaacttgattgcgtctgcaaagatygtatttccaaataagatcacatccacagggactggaggttaagacttcagcatacttggggggagacacaattcaacctataacagagcccctttgaaaa

SEQ ID NO: 38136 - DNA, 201 bp, Homo sapiens
tgcagaaattggccagaattatgcatttaataaagagcagagtgccagtatttgttgtgaagccagacagaattaacatggtactcctgttccctcacagmgtgaccccagtggctccagggctagatcaccgttagcctaattcctaatctttccacagctttccagttgcagagctgttaatcaacagtgaatgcacag

SEQ ID NO: 38137 - DNA, 201 bp, Homo sapiens
ctctgggtctgtgtcctcatatgctgttctctctgtgcatgtctgtttccaaagttttcccttttaataaggacaccagtcacactggattagggcctacyttcatgacctcaccttaacttgattgcgtctgcaaagattgtatttccaaataagatcacatccacagggactggaggttaagacttcagcatacttggg

SEQ ID NO: 38138 - DNA, 201 bp, Homo sapiens
agccttcaaacttgattttacttcaataaacgtgaaattatgttgtttctaccacctccagtataataatcatcttgcttggcaaatcagtaaagattttwaaaattgatactcttcaaggttagcgaagctgtggaagaacctggactctcatgtaccacgagatcaacacatcctcttgaaaggccccatgcactataa

SEQ ID NO: 38139 - DNA, 201 bp, Homo sapiens
taactgtcctctttgcatggtcgatagcagtgcttctccatccagagcattaacaaaatcaccttgttaaaaagattctcaaactccattccatggcctcygattctgttttaaagtggggtcaaaagtctatttttaacaaactcatcagaatgctctgatgcaggaagaccacagaccacacttcaagaaataccactt

SEQ ID NO: 38140 - DNA, 201 bp, Homo sapiens
tctttggcaccatttaatctgagtaaaaacagccttactggtgtctgatgacaccactggaaatttggtattggtcctgatggtaatggtcttgaatcacyaagaaacatttacattgctaaagatgatagctcatgtttattaaagttcatagatttccttgaaacttatggtctctgatgaccaaaactttgtctgtct

SEQ ID NO: 38141 - DNA, 201 bp, Homo sapiens
aggtaaaattcaagcatgagaagtcaatcattgtttgatgtactaggtcttttatatacacataattctgataaatttgggtatctcttcctaaattcatrtcaaactagaagcatcaattgcttttagggaaggaactgttctaagcagactaaaaggaggaagaaatggtggctaataattggaagaaatcaaaaaagg

SEQ ID NO: 38142 - DNA, 201 bp, Homo sapiens
gagacccaccaacagaatattctgagataataacaagaagggtgtttgataccagatcagaggtgggtttgatacccacctctcagtgtctggtaaccacmtttctactctctacttctacgagttcaactattttagatttcacatgtaagaaagatcatgcggtattagttcttctgtccctagcttattttggaaggt

SEQ ID NO: 38143 - DNA, 201 bp, Homo sapiens
tcgcatatcataaacaatttagtcagcttgttttttagcctgcagtatttaatgacatagggcttcccatgtgccaggactttccatgtgtagaaaaagcratgaatagtgaatgaatagtgaagacacctccctactttcctgggatgtattttcttgttgggaagcagactatgaacaaggaaataaataagtaaacaa

SEQ ID NO: 38144 - DNA, 201 bp, Homo sapiens
actgtggcatattactcttacatccctttttacgcatctggacactgagacacagagagttaacgtaacttgtccaagaccacagaatggggtagcctggrtctacttatctgtggagactgtgcactttaacaatcaataaatggacaaaatgacctaaatatgtaattcaacaagagagagaattccagtattttcaca

SEQ ID NO: 38145 - DNA, 201 bp, Homo sapiens
ttcatccatattggcatcaagtgtagtgtgatgtttatggcatatgctatgagctatagagtacaatatgagcatccacctattccaaaactcccatagtragagtaaggccagacttcctcttctcatacttctcactgcagctctgcaccttttttgtctatatcactttgtggttgcatgagccacacagtaatgatt

SEQ ID NO: 38146 - DNA, 201 bp, Homo sapiens
gcatttaataaagagcagagtgccagtatttgttgtgaagccagacagaattaacatggtactcctgttccctcacagcgtgaccccagtggctccagggytagatcaccgttagcctaattcctaatctttccacagctttccagttgcagagctgttaatcaacagtgaatgcacagtacattccatattctattactt

SEQ ID NO: 38147 - DNA, 201 bp, Homo sapiens
cgtttggtgggtcctgagttgttgtcccgcatccaagaagaacaaggttatactgacaatagaagggtgaggagggtggagaagagttttattgagtgacraaacagcttctcagcggagacgagacacgagggtggaccccagatgaagtcagggggtcattctctctctcagcgtggctggttctggggcttttatgga

SEQ ID NO: 38148 - DNA, 201 bp, Homo sapiens
ggtggctcacacctgtaatcccagcactttgggaggctgaggcgggaagatcatgtcaagagatcgagaccatcctggccaacatggtgaaaccccgtttytactaaaaatacaaaaattagctgggtggtggtgcgcgcctatagtcccagctactcgtgaggctgaggcatgagaatcacttgaacccagaggcagagg

SEQ ID NO: 38149 - DNA, 201 bp, Homo sapiens
tgtgtgtgtgtgtgtgtgtgtgtgtgtgtgtatgtgtgtatatatatatgtgtatatatatgtgtgtgtgtgtatatatatatatatatatatagagagakagagagagagagagagagagagagagagagagagattgtactcttagcctccatagctcattcctttgatatattagtctggctttaaacgacagtacct

SEQ ID NO: 38150 - DNA, 201 bp, Homo sapiens
aagtatatatatatatatatatatatatgtgtgtgtgtgtgtgtgtgtgtgtgtgtgtgtatgtgtgtatatatatatgtgtatatatatgtgtgtgtgtrtatatatatatatatatatatagagagagagagagagagagagagagagagagagagagagagattgtactcttagcctccatagctcattcctttgata

SEQ ID NO: 38151 - DNA, 201 bp, Homo sapiens
gcaaaccaatatggcacatgtatacctatgtatcaaacctgcacattgtgcatatgtaccctagaacttaaagtatatatatatatatatatatatatgtrtgtgtgtgtgtgtgtgtgtgtgtgtgtgtatgtgtgtatatatatatgtgtatatatatgtgtgtgtgtgtatatatatatatatatatatagagagaga

SEQ ID NO: 38152 - DNA, 201 bp, Homo sapiens
tttatgttcttttatcccctcgcatatcataaacaatttagtcagcttgttttttagcctgcagtatttaatgacatagggcttcccatgtgccaggactktccatgtgtagaaaaagcaatgaatagtgaatgaatagtgaagacacctccctactttcctgggatgtattttcttgttgggaagcagactatgaacaag

SEQ ID NO: 38153 - DNA, 201 bp, Homo sapiens
agtggtgcaatcacagctcactgcagcctcaacctcctgggctcaaatgaccctcgcacctcagcctcccagtagttgggactacaggtgcatgccaccayacctggctaatttttgtactttttgtagagatagaatctcgccatattgccccagctggtctcaaactcctgggctcaagctatcctcccaccttggcct

SEQ ID NO: 38154 - DNA, 201 bp, Homo sapiens
aatctgtggaaccatcagaactgcgtgtgttcctcagtaagctacaggcaggttgagaccttatgtactaaaaaaagtttttagtttactctacttggctycaaaattctgtttctttcctgtaggtaaatcatgtcgtaatcctccagatcctgtgaatggcatggtgcatgtgatcaaaggcatccagttcggatccca

SEQ ID NO: 38155 - DNA, 201 bp, Homo sapiens
ttccttccttccttccttcctccctcccttccttcctttccttctttccttctttgctttctttctttcctttttactttcttttttttttttgatacaakgtcttgctttgttgcccaggctggagtgcagtggcatgatcagcactcactgcagcctcaacctccctgactcaagcgatcttcatgcctcagcctcctg

SEQ ID NO: 38156 - DNA, 201 bp, Homo sapiens
acgttggacatagccatatgatcaaaggaatacaaaaaagaaggtacaatatgtattgtattgtaaaccagaggagggcaacatgttcctgtcaaaggtgrtacatgtgaaacctggtcaggcattcattggatgaaaaggagcagcttacaaataaggaaaaggaaaaaaggtagttgaaccatgtaaacctccttaact

SEQ ID NO: 38157 - DNA, 201 bp, Homo sapiens
ccttccttccttccttcctttccttccttccttccttcctccctcccttccttcctttccttctttccttctttgctttctttctttcctttttactttcytttttttttttgatacaaggtcttgctttgttgcccaggctggagtgcagtggcatgatcagcactcactgcagcctcaacctccctgactcaagcgatc

SEQ ID NO: 38158 - DNA, 201 bp, Homo sapiens
cccttccttccttccttccttcctttccttccttccttccttcctccctcccttccttcctttccttctttccttctttgctttctttctttcctttttaytttcttttttttttttgatacaaggtcttgctttgttgcccaggctggagtgcagtggcatgatcagcactcactgcagcctcaacctccctgactcaag

SEQ ID NO: 38159 - DNA, 201 bp, Homo sapiens
tgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaaggtcttgctttgttgcccagg

SEQ ID NO: 38160 - DNA, 201 bp, Homo sapiens
tagtattttaagtataaaatgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaagg

SEQ ID NO: 38161 - DNA, 201 bp, Homo sapiens
ctttagtattttaagtataaaatgagtgttcaattctttttgatcagcctggatttcctttggttctagttatgtatccccttccttccttccttccttcytttccttccttccttccttcctccctcccttccttcctttccttctttccttctttgctttctttctttcctttttactttcttttttttttttgataca

SEQ ID NO: 38162 - DNA, 201 bp, Homo sapiens
taattccagaagtttaaatacataaaagccttcaaacttgattttacttcaataaacgtgaaattatgttgtttctaccacctccagtataataatcatcytgcttggcaaatcagtaaagatttttaaaattgatactcttcaaggttagcgaagctgtggaagaacctggactctcatgtaccacgagatcaacacatc

SEQ ID NO: 38163 - DNA, 201 bp, Homo sapiens
aataaatatataaaattagctgggctcagtggcacatgcctgtagtcccagctacttgggaggctgaggtgggaggatcccttgagcacagaggttcaagscttcagtgagttatgatggtgccactgcactccagcctaggtgacaaagccctgtttcttatggatgggcaatagatctaatatcatctattaaaaagac

SEQ ID NO: 38164 - DNA, 201 bp, Homo sapiens
atttaattatttctttcttttttcttttttttgtttcttttttttattatactttaagttttagggtacatgtgcacaacgtgcaggtttgttacatatgyatacatgtgcgacgttggtgtgctgcacccattaactcgtcctttacattaggtatatctcctaatgctatccctcccccctccccccaccccacaacag

SEQ ID NO: 38165 - DNA, 201 bp, Homo sapiens
ttctacatttataggtcagtgatcatttaattgagtcaatactggttatgtgtgtatatgtgtgtagtcacttagccaatatgtgaatattattatcttaygatagaacacagtattcatttatcattttattgcccttaaatctgccattatttcatttctcatgccttatcttttgtgtttccttttctctctttttct

SEQ ID NO: 38166 - DNA, 201 bp, Homo sapiens
aaatgaatgagaatgtatacaaggtgcctcccatatctgccaagaacttgaaattctatgaaataattcaaattatcaaagaattatcagtttactatacraagttttcaaggcatggcaccttttgtagggggttatcttttataaaaaaatttccacttctacatttataggtcagtgatcatttaattgagtcaatac

SEQ ID NO: 38167 - DNA, 201 bp, Homo sapiens
acatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtc

SEQ ID NO: 38168 - DNA, 201 bp, Homo sapiens
gaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatac

SEQ ID NO: 38169 - DNA, 201 bp, Homo sapiens
gaatgttctttctaattgatcactgcatgtattgagattatcatgtttctttttcactctgttaatgtaatatattacattgattgatgtttaaaagacaracgctgaattcctagaataaacctatgttgcttgtgatgtgttatagatgattatcctatgtatgggggatatgcgtgtgtgtgtgtgcaggattgctca

SEQ ID NO: 38170 - DNA, 201 bp, Homo sapiens
agaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatata

SEQ ID NO: 38171 - DNA, 201 bp, Homo sapiens
gtcatctccttagcatattttcagcaacaccaatcatagcaccctgtaattgcagaatacctctggtgaaactcctgaatgaaacttagagctttcatgtkttttctagaaatcttttgtccaagtcctccagttattcctaatgggagacacacaggaaaacctctggaagtctttccctttgggaaaacagtaaattac

SEQ ID NO: 38172 - DNA, 201 bp, Homo sapiens
aagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatat

SEQ ID NO: 38173 - DNA, 201 bp, Homo sapiens
atgaatgagcaacccttcaaaatggctatttttctttttcaaatgttttgctacttcattaaagttgtaaagtttccattgtccaggaaccgttactatcyggaagattcaggatagacaagtctcttttgtactttgcaatacactttcattgatatctcatttaatccaactcttcaaagtcctaatgtctactgtcat

SEQ ID NO: 38174 - DNA, 201 bp, Homo sapiens
ccagtccatggatttacctggaacttgtagctaggctttaaactgtcttcagcttgaaggtcgggtttcaccgggatctgccccatctgcctaggatttgwctgcctcctgcttctatcagtttcaagtggtattattagttgtttatgtgtatccattactcttggtggtgtgcactatgagtctggagggataactaga

SEQ ID NO: 38175 - DNA, 201 bp, Homo sapiens
aaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatat

SEQ ID NO: 38176 - DNA, 201 bp, Homo sapiens
ggggatgtgtgagtgagtgagtgtggggtccagctggccactccaagcacctgcacaggaatgggctctgagcagtgctggcggctggaccaggcatgtcrcactgaagggaacgtggtggtgcccaaacaggggtgcccatgaccccaaagcccagaggaggtgttacagcacactaatggctcttagcatttgataatg

SEQ ID NO: 38177 - DNA, 201 bp, Homo sapiens
gttcaattctttttgatcagcctggatttcctttggttctagttatgtatccccttccttccttccttccttcctttccttccttccttccttcctccctyccttccttcctttccttctttccttctttgctttctttctttcctttttactttcttttttttttttgatacaaggtcttgctttgttgcccaggctgga

SEQ ID NO: 38178 - DNA, 201 bp, Homo sapiens
atttggtcaaagggcgcagggtttcagttagacaggaggagtaagtttcagagatctattccacagcatggtgactatagttaataataatgtgtatttcmaaattgctggccgggcacagtgtctcatgcctatagctctttgggaggctgaggcatacgaattgcttaagcctagaagttagaaactaggctgggcaaa

SEQ ID NO: 38179 - DNA, 201 bp, Homo sapiens
atgatcgtatctctatccctggagtggggcagtaggcaagtgagccatgaggaccaaaatgagagcatcaaatcaaaaaggccttggacttcaacttcaaytttttctcattataattgaaaagactgaagctcagaaaaagtgttttgctcaaatccaaacaaatatatatatatgtatatacacacacacacatatata

SEQ ID NO: 38180 - DNA, 201 bp, Homo sapiens
gagtgttcaattctttttgatcagcctggatttcctttggttctagttatgtatccccttccttccttccttccttcctttccttccttccttccttcctycctcccttccttcctttccttctttccttctttgctttctttctttcctttttactttcttttttttttttgatacaaggtcttgctttgttgcccaggc

SEQ ID NO: 38181 - DNA, 201 bp, Homo sapiens
aagtggaattcctgggggatatggtaattctgtttaacttttcaaagaattgccagactattttccacagctgctgtaccattttacatccccatcagcartgcacaaatgttccaatttctctacatcctcaccaacacttgtcatttttctggtttaaaaaaaattattattataccaccctaaaaggggctgaagtca

SEQ ID NO: 38182 - DNA, 201 bp, Homo sapiens
tctcatctatagtagacatattttagatgcatttttgaatttaacatttacagcaaatatatgaagtagctactattggtatccccattttactttgagaraactgagtcttagtgatattaaagaacttttccaaggctctgactccagagcctaatcataatgtacagtggaatgtatcatgaacaataatgtgtaata

SEQ ID NO: 38183 - DNA, 201 bp, Homo sapiens
cactgtgcagtgccagaccaatggcagatgggggcccaagctgccacactgctccaggggtgagtgtgacccatcaagactttgctgggtgtgagggtacrtatagatgataggagttgttgaaattaaggaagaagtgtataaggactatgaaattggcataaacataatagtagcttcactgtctgttatctctgttaa

SEQ ID NO: 38184 - DNA, 201 bp, Homo sapiens
agacaaaattagatctgtctttgccaactcttactatctatcaggttacaattccacaaagtaggctactcactttcttgttattctaatccaaataataraaagaactcttcttccagttcttagcaattttcctaagcctctgatcattttgagttctaatcctccttcaattcttttaggcccatgtcttcagttgta

SEQ ID NO: 38185 - DNA, 201 bp, Homo sapiens
aacagaaacatatatcaaaacaccacattttaccctataaatatatacaattattgtttgttcataaaaataaaatcagattttaaaaaatattcactgtstttttttcagccatacataggctggaaccttcttcacattttggctccaacaatctagcttagtcacagcgagcacatctaaaacaacctctaggaggcc

SEQ ID NO: 38186 - DNA, 201 bp, Homo sapiens
ttagcaaaaacactacaatgcacgatcctgcacacgtgaaaagaaatgagatgaggacttcactaacttcaaagacagcttaaggattcagatcttcacakgtacacaagagacaagatttgcagatttgagtgaaaggctatgcacgattttaagcctttcagtacatattgccaaagtgccctccactaaactttgacc

SEQ ID NO: 38187 - DNA, 201 bp, Homo sapiens
catcctccaaggcaaaagacagccctccagaacaaagaattatctggtccacgatgtcaataatattgaggtcgagaaaccatagtcttccagaatcacaytgaactatgggaaagaggggatttcccagtggaaaaatctaggggcaaatcccagaggaagggacccatttagagcaacagatatccaccttcacctcca

SEQ ID NO: 38188 - DNA, 201 bp, Homo sapiens
attaggaggcaaagaaccatctaacatggttcttttttttttttttttttttttttgagataaagtcttgctctgtcaccaggctggagtgcagtggcgcratcttgactcactgcaacctccgcctcccaggttcaagcaattcccctgcctcagcctcctgagtagctgggactacaggtgtgcgccaccacgcccagc

SEQ ID NO: 38189 - DNA, 201 bp, Homo sapiens
tctgctttttccagcctctgctacttaccagctggtgtcttggacccagtaagttaagtcacatcactgaccttcagtgtccacatgtataaaatgagcayaactgacatcctgatctctgagagagacgttttgaaaatcagatggtgtaatgcatgtgacagtgttttgtaatctgaaaacccccatgcatgtctgaaa

SEQ ID NO: 38190 - DNA, 201 bp, Homo sapiens
cctcgaaggccaacgggctgcccctgcgcgccgaggccccgccccgcggcccgccgattggccccagccgccccggcgctaagactcaatttcacactacrcgcccaggccacgcccacctgtcatgcggccctggaaactgtgagtttggggattgttgtgtccactaaccggactcagaagggacttccctgctcggct

SEQ ID NO: 38191 - DNA, 201 bp, Homo sapiens
acgttgttaaatttctgaaaacaagtgcaacttaagcatataactaaggagtagatgttaacctggacaaatgaaacatagattgttttgagcaagagacrgcaaaattttttgtcaagagccagatagcaaaattttcaattttgcagaccatgcaatctctattgcaattactcagttctgccattgcagtggaaaaat

SEQ ID NO: 38192 - DNA, 201 bp, Homo sapiens
atataaaaatgaggaaagaatatgcacaggcaattcacaaaaggaaacataaaaatggccttaaaaattgctaaaataaatatttaagcaaaaaagctcarcttcactatggtttggggaaatgcaaattaaagcaacaatatgtcatgttttcacagtcacattaataaaagtttaaaagacggaagtagaggtaaatag

SEQ ID NO: 38193 - DNA, 201 bp, Homo sapiens
gagaaagaggatggtcaccatcccaaccagattggccattagatctatgtatcaacagagtgacatacgggagaattaaaattctagtatgcaaaaatacrccgtatgttaacagaaaatagactgcagggaaatttgtattaggtaaaaccgagagaaagttaagagcatacaacagtagataagcaatagacaacccga

SEQ ID NO: 38194 - DNA, 201 bp, Homo sapiens
cgcctggcctgaagacaagaacttttgaacaagagagcgctaactaacgtattgaaatacataaaacaaatactgatatatagaagagctcattcagctgyttcaaagacagagctctgtaacacatgtactcttacctaaagaactgtctcccaccactggaaaggaggtcttctctgaccaaatacacagcatcttgga

SEQ ID NO: 38195 - DNA, 201 bp, Homo sapiens
tgtgcaattttaaatagtggccaaggaaggctccattaagaaggtctcatttgagccaaataactcaaggagatgaggtagtagccatgcagagcgatatstgggcaaagagcattctaagcaaaaggaatattaaatgggaggaaaaaactgaagagaaaaatacacctgctgcacttggagaaataatttgtttgcaag

SEQ ID NO: 38196 - DNA, 201 bp, Homo sapiens
gaaaactcagtaactgaaaatgagcaaatgatgtgatagacatgtctccaagggaaatatacaaatgcccaataaacacatcaaaagatgttcaacatcaytagtcattagggaagtgcaagtcaacctgactttgtactaggatgttttgtattaggatggttataatatttttaaaaaataggaaataaaaggtgttgg

SEQ ID NO: 38197 - DNA, 201 bp, Homo sapiens
tatttaggggtttttgtggactaatatatgatcacttttacacagatatcatcttatgatatcaaacttagatttgatgaaatgagttggtaagcttcatrtcttttatatgttgtgaaaccttgaaattacatttggaagtatatttttgaatgaattttggtaatttgtatttccatttatatcatttagattttcaaa

SEQ ID NO: 38198 - DNA, 201 bp, Homo sapiens
tactcgggaggctgaggcaggagaatcacttgaacccgggaggcggaggttgcagtgagccgagatggtgccactgcaccccagcctgggcaacaagagcraaactctgtctcaaaaaataataataataataataacaataacaataacaaaaatgtttaagagtgaaaagaattcttgagaccaaaaaagtttaagaac

SEQ ID NO: 38199 - DNA, 201 bp, Homo sapiens
taaatcataagacgtctactatgaactattttgcagcaatcaagaagacttaattagatctctgtttagtgatttgaatgggtgaccatgttgtgatgtcmacagaaaaaaataatttgcagaaaagcatatagagtttgttctcaatttggaaaaataatgacaaatttggaggagatatcctatacacatatgtgtgtt

SEQ ID NO: 38200 - DNA, 201 bp, Homo sapiens
accctgtctctactaaaaaatacaaaattagccaggtgtggtggcgcatgcctgtaatcccagctactcgggaggctgaggcaggagaatcacttgaaccygggaggcggaggttgcagtgagccgagatggtgccactgcaccccagcctgggcaacaagagcgaaactctgtctcaaaaaataataataataataataa

SEQ ID NO: 38201 - DNA, 201 bp, Homo sapiens
ggataaagaaaatgtggcacatatacaccatggaatactatgcagccataaaaaaggatgagttcatgtcctttgcagggacatttatgaagctagaaacyatcattctcagcaaactaacacaagaacagaaaaccaaccaccgcatgttctcattcctaagtgggagttgaacaatgagaacacatggacacaccgagg

SEQ ID NO: 38202 - DNA, 201 bp, Homo sapiens
ctgaagaaaaatcaggatgacttgtcactggctgagaggtcctgttcaatcatgttgcatgccagagtgatgttttgtgacttttgtcttccttttaggtrcacatgatgctctcatagttggtaagttttatgaaagttttgctgaggaattctggcatctataacagtaagtacctacctataatgaatgaaatgtaaa

SEQ ID NO: 38203 - DNA, 201 bp, Homo sapiens
tatcctgcctcagcctgccgagtagctgggactacaggcatgcgccaccacgctgagctcatttctgtatttatagtagagacagggtttcaccatgttgkccaggatggtcttgatctcttgacctcgtgatctgcctgcctcggcctcccaaagtgctgggattacaggtgggagccaccgcgcctggcctgaagacaa

SEQ ID NO: 38204 - DNA, 201 bp, Homo sapiens
gggagtgtaaattcgttcaaccattgtggatgacagtgtggtgattcctcaaggatctagaaccagaaataccatttgacccagcaatcccattactgagyatatacccaaaggattataaatcatccttctataaagacacatgcacacgtatgtttattgcagcactgttcacaatagcaaagacttggaaccaaccca

SEQ ID NO: 38205 - DNA, 201 bp, Homo sapiens
tttgttttgtacagtgctgagttccaacccatagaattgttaaataaataaaaaggaaagaacactataagatcaaactcatcagttataatagtaaatgygaatgattccaatccccccttttgaaagacaaaggcttctaaatatggtcagaatcctatttacagtagcatcaaaaagaataaaatacttaggaatcaa

SEQ ID NO: 38206 - DNA, 201 bp, Homo sapiens
aaaaacaagcaatggggaaaggattccctatttaataaatggtgttgggaaaactggctagccagatgcagaaaactgaagctggaccccttcctttacaycttatacaaaaactaactcaagatgtattaaagacttaaatgtaagacctaaaactataaaaaccctagaagaaaacctaggcaataccattcaggacat

SEQ ID NO: 38207 - DNA, 201 bp, Homo sapiens
gtttttcttacttcattcctaacttcctagttgtagtgataaaatctattattttatatcaataaaaatattgatataaattttatttacatgatatacartatttaaatataacatattttatattacaaaatatactactatgtattacaaaaaaaaaaacaaactccatttagcagagcaagaatggagtttgttttg

SEQ ID NO: 38208 - DNA, 201 bp, Homo sapiens
aaaaaaaacaccaaagggataatgaagacaagattgaattctccagaattcatcaaggaccagacttgaaatgacacatatatacacacaaacacactacrcacaaacacacagggatataatatagaaattccagaaaaaataaaagaaagcagaatgaatagaagcattaattagcacataatggaagacaatttctca

SEQ ID NO: 38209 - DNA, 201 bp, Homo sapiens
ggaagaatcaatatcatgaaaatggccatactgcccaaggtaatttatacagtcaatgctatccccatcaaattaccaatggctttcttcacagaattacmaaaaaaaaaaaaaaaaaaactactttaaacttcatatggaaccaaaaaatagcccatatagccaagacaatcctaagcaaaaagaacaaagctggaggca

SEQ ID NO: 38210 - DNA, 201 bp, Homo sapiens
caagttctgaaattgaggaagtaattaatagcctaccaaccaaaaaaagcccaggaacagatggattcatagctgaatcctaccagaggtacaaagaggakctggtaccattccttctaaactattccaaacaatagaaaaagagggactcctccctaactcattttatgaggccagcatcatcctgataccaaaacctgg

SEQ ID NO: 38211 - DNA, 201 bp, Homo sapiens
gtctaggtaagaatttctttgtattgcttgggtttgcacatttttttttttttggttgttttttttttttttttttttttttgacagaatttcactcttaycacctgggctggagtgcagtggtgggatatctcggctcactgcaacctccgcctccggggttcaagttatcctcccacttcagccttccaagtagctgca

SEQ ID NO: 38212 - DNA, 201 bp, Homo sapiens
gcctcagcatccatttagaatatgtttagctttctcatgccagaagcagggcttagtcacccttaatgccctttctagttctgtacctcctcccaattttkcaacgtggtcgagccagatatctgccttatacaactgcctcctggtgaccacctctctatgggacagctagataaaacctacttgactagcgtccctgac

SEQ ID NO: 38213 - DNA, 201 bp, Homo sapiens
aggttagaggaattactaactagaataaccagtttagaaaagaacataaatgacctgatggagctgaaaaacacagcacaagaacttcatgaagcatacamaagtatcaatagccgaatcgatcaagtgaaacaaaggatatcagagattgaagatcaacttaatgaaataaagcatgaagacaaaaaaagaatgaaaagg

SEQ ID NO: 38214 - DNA, 201 bp, Homo sapiens
aagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgc

SEQ ID NO: 38215 - DNA, 201 bp, Homo sapiens
ttcagaaaatttgcatttatattctcaagagatcttgggttataatttgcttttattttaatgtccttatcaggtttgggcatcaagattatgttggcctsataaaatgtgttaaaaattatttattttttctagtgtctggaacaatttgtgtaacattatttttccttatatgtttggaagaattcagcagtgaagcaa

SEQ ID NO: 38216 - DNA, 201 bp, Homo sapiens
aggtatatacatatatatacgtatatatacatatacatatataggtatatacatatatatacgtatatatacatatacatatataggtatatacgtatacrtatacatatataggtatatgtatacatatatacacactatatatatatacacatatatatagtgtgtatatatgcacacatcttaatcatgcagttcaat

SEQ ID NO: 38217 - DNA, 201 bp, Homo sapiens
gtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacgtatacatatataggtata

SEQ ID NO: 38218 - DNA, 201 bp, Homo sapiens
tgtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacgtatacatatataggtat

SEQ ID NO: 38219 - DNA, 201 bp, Homo sapiens
ttccagggtctgtacaggaagcatgctgctgacttcttcctgccttctggggaggccttgggaaactcacaaccatggaggaaggcaaaggggaagcaagrcatctcatacggtgggagcaggaggaagagagagagggggcaggtgctacacacttttaaactactagatttggtgagaactcactccctacatggtacc

SEQ ID NO: 38220 - DNA, 201 bp, Homo sapiens
tcaaaaagaacactttgagaaataacctcagtggggtcaaaagccagaggagcctccaggatcccttgttcctaagacaaacaggcaggaggaggtgcacmtataggattgcagctgttcttcacttcatttgttcacatacttcatacttgtgtttatgtctgttggcagtgcaatagaaaatgatttcatttttggtgg

SEQ ID NO: 38221 - DNA, 201 bp, Homo sapiens
acacaagtcatttccactttaagacttttaacattctgaaaagttatgttacaaacagagtgctggtccccctgcaacatgctcactcacattggctgacrttttaattctttgccaatctgaggggaagagatgtcaactttttttgtttgctcttttaatgccagtcatgttcccttttttttcccccttttaccagtc

SEQ ID NO: 38222 - DNA, 201 bp, Homo sapiens
ttgggaggctgaggtgggtggattacctgaagtcaggaattcaagaccagcctggtcaatgtggtgaagcctgtttctactaaaaatgcaaaaatcagccragtgtggtggcaggcacctgtagtcccagcagctaaggaggctgaggcaggagaatctcttgaatccgggaggtggaggttgcagtgagccaagatcgca

SEQ ID NO: 38223 - DNA, 201 bp, Homo sapiens
ggtgcccaaacaggggtgcccatgaccccaaagcccagaggaggtgttacagcacactaatggctcttagcatttgataatgcctgcagcccaacagatgrcagtgtgcttaacagctctgtcaatcctgtcgccccacatctcctgtcgcccagctctggcttgatccgctgctgcttcctttcgcgtggtacagctgcc

SEQ ID NO: 38224 - DNA, 201 bp, Homo sapiens
tagcagaggcctaatacatttattttgcagtttctactttccttaagaagaaaagtacgcttaattggcaacacagtcacagtatgacaactgtagaatcrccttggattatactttaaaattttttatggaattgagagctcttgttttctttctagatatcttttgtccaaatcctccagctatccttaatgggagaca

SEQ ID NO: 38225 - DNA, 201 bp, Homo sapiens
tcttcaggaagcataggaaattcccccataactaacaagtactctggaactgtcctttccacagtgtgtcagccgcctccagaaatcctgcatggtgagcrtaccccaagccatcaggacaacttttcacctgggcaggaagtgttctacagctgtgagcctggctatgacctcagaggggctgcgtctctgcactgcaca

SEQ ID NO: 38226 - DNA, 201 bp, Homo sapiens
tctacctcattggttctcaggtgggatgattttgccctcccaaggacatttggcagtgtctagagacatttttggttactacaactgaaggacggaagggyttccagcctctagtaggtagaggccagggatactgccaaacatcctccaaggcaaaagacagccctccagaacaaagaattatctggtccacgatgtcaa

SEQ ID NO: 38227 - DNA, 201 bp, Homo sapiens
ctttagtcattggtgtgcaatcagagaaattgggggaaatctgtaaaacagatttggtctcaggtgacagtctcattacctgaataacaatggtacaaatygggattaccttcctaggaaatatgtagatggagaatccaccaatactgataacttcacattggatagccagagctaggagaaaatacctcatgccctgta

SEQ ID NO: 38228 - DNA, 201 bp, Homo sapiens
tagaccaatggaacagaacagaggcctcagaaataatgccacacatctacaaccatctgatctttgatgaacctgacaaaaacaagcaatggggaaaggaktccctatttaataaatggtgttgggaaaactggctagccagatgcagaaaactgaagctggaccccttcctttacaccttatacaaaaactaactcaaga

SEQ ID NO: 38229 - DNA, 201 bp, Homo sapiens
atgaggcaagaacccttccagagtaagccccaatttaggggcatgcctgtcccgaaacagtatgactgtactttagtcattggtgtgcaatcagagaaatygggggaaatctgtaaaacagatttggtctcaggtgacagtctcattacctgaataacaatggtacaaatcgggattaccttcctaggaaatatgtagatg

SEQ ID NO: 38230 - DNA, 201 bp, Homo sapiens
aaatggccatactgcccaaggtaatttatacagtcaatgctatccccatcaaattaccaatggctttcttcacagaattacaaaaaaaaaaaaaaaaaaaactactttaaacttcatatggaaccaaaaaatagcccatatagccaagacaatcctaagcaaaaagaacaaagctggaggcaccacgctacatgacttcaa

SEQ ID NO: 38231 - DNA, 201 bp, Homo sapiens
aaaatatccgtaatctgataagcaacttcagcaaagtctcaggatacaaaatcaatgcaaaaatcacaagcattcctatacaccaataatagacaaacagmgagccaaatcatgagtgaactcccattctaaattcctgcaaagtgaataaactaccttggaatacaacttacaagggaagtgaaggacatcttcaaggag

SEQ ID NO: 38232 - DNA, 201 bp, Homo sapiens
ggccataggcaggctggggaaggcttctataagaaagtgacattttagcagatgcctgaaggaagaattgaagtcagagtgaagataaaattgcgtcacayagaaggaatgtcatagacgggaaaaatgtgtgtctttgggaaactgaaaaaggggaaagggccacaccttggtgaggggaccaagtggcacaagatgagg

SEQ ID NO: 38233 - DNA, 201 bp, Homo sapiens
ccattatctcagcttaaaatatccgtaatctgataagcaacttcagcaaagtctcaggatacaaaatcaatgcaaaaatcacaagcattcctatacaccartaatagacaaacagagagccaaatcatgagtgaactcccattctaaattcctgcaaagtgaataaactaccttggaatacaacttacaagggaagtgaag

SEQ ID NO: 38234 - DNA, 201 bp, Homo sapiens
acagtgtataacatctttgtcttactcttctctttggataactggactcctttacttttcttcttggtatttaaaaatgttacttttactagaaagtttamgagcttcagaatctaagtttacaaatgacattggtcacacatttattgctgtttatccactttaagaaacagttttgctattttgtaaaacaaattggga

SEQ ID NO: 38235 - DNA, 201 bp, Homo sapiens
ctaaaaactctcaataaactaggtattgatggaatatgtcccaaaataataggagctatttataacaaacccaccactaatatcatactgaatgggcaaawgctggaagcatgcgctttgaaaaccagcacaagacaaggatgccctctctcaccactcctattcaacatagtattggaagctctggccagggcaatcagg

SEQ ID NO: 38236 - DNA, 201 bp, Homo sapiens
gataccaaaacctggcagagacacaataaaaaaggaaaatttcaggccaatatccctgatgaacattgatgcaaaaatcctcaataaaatactggcaaacraaattcagcagcacatcaaaaagcttatccacaacgatcaagctggcttcatccctgagatacaaggctggttcaacatacgcaaatcaataaacgtaat

SEQ ID NO: 38237 - DNA, 201 bp, Homo sapiens
tggagttgctgcctcagtggcattaagcctgtcgagtatctaacacagggctatgtgtccccgagtccatttctatcccccaaccgttacctctgtacttwgctcccaatggtgtttagacaagcagtcctagggatgcaggtgttacctgacaactgccccgcatggaactgtcctcgccccccacaccaagccaccacg

SEQ ID NO: 38238 - DNA, 201 bp, Homo sapiens
aaacaacgtaggtgggatttgattcaatttgctcaaattttggaagcaagatgtctatatttgcccaagatattttgataaaggaaaggatggtcttgtayatcaccccttcttcttgcttgtagttcctgaaccttgactagatgctcatttcatgagaatggctctcacaaaagaattagagagaaaatttacattcac

SEQ ID NO: 38239 - DNA, 201 bp, Homo sapiens
gaaaagatctaaaatcgacgccctgacatcgcaattaaagaactagagaagcaagagcaaacaaattcaaaagctagcagaagagaagaaataactaagawcagagcagaactgaaggagatagagaaacaaaaaacccttcaaaaaatcaatgaatccaggagctggttttttgaaaagattaacaaaatagaccactag

SEQ ID NO: 38240 - DNA, 201 bp, Homo sapiens
agtgaggaataatactggttagacttcttcattcagagcccattattgcctcttgttactgcctcgtacccactcccatttctacacaaaacagccttgtmcacagtcaaaatttcaaagtttccattgttgtgatgtttagaatgataaaatacttaaggccatcctctgtgaagtctccctgaattttcctatgttcac

SEQ ID NO: 38241 - DNA, 201 bp, Homo sapiens
tgatattcctgtggtttttctctccaggtcactgtaaaaccccagagcagtttccatttgccagtcctacgatcccaattaatgactttgagtttccagtygggacatctttgaattatgaatgccgtcctgggtattttgggaaaatgttctctatctcctgcctagaaaacttggtctggtcaagtgttgaagacaact

SEQ ID NO: 38242 - DNA, 201 bp, Homo sapiens
gaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagatcaga

SEQ ID NO: 38243 - DNA, 201 bp, Homo sapiens
aacacatacaggagtacatagcatttttttttcattgtgacagcattactgcaatctttcatctgtattttgaaaatcatagcctggcatcatcaagaaarattaaatcactgatatacaaataataaatgtataatatattttagaaagatgtctctaggatgaagactcttgatgtcaaagatcatatttatcctgtgc

SEQ ID NO: 38244 - DNA, 201 bp, Homo sapiens
atggaggaatatttaccaagcaaatggaaagcaaataaaagcaggggttacagtcctagtctctgataaaacatactttaaaccaacgaagatcaaaagaracaagagcattacataatggcaaaggatgcaacaagaagagctaactatcctaaatatatatgcacccaatacaggagcacccagattcataaagcaagt

SEQ ID NO: 38245 - DNA, 201 bp, Homo sapiens
aataccataaaggcaaatgccttctatatagagagaactagattaataatggtgagataacatagttaaattctcgtttagcaggagaaataaaaacataractataggctaggcacagtggctcatgcctgtactcccagcacattaggaggctgaggtgggcagatcacttgaggtcaggagttcgagaccagcctggc

SEQ ID NO: 38246 - DNA, 201 bp, Homo sapiens
tttgtcaccaccagacttgccttacaagggctcctgaaggaagcactaaacatggaaaggaataactggtaccagccactgcaaaaacataccaaattgtraagaccatcaacaatatgaagaaaccacatcaactaatgggcaaaataacaaatcagcatcataatgacaggatcaaatttacacataacaattctaaca

SEQ ID NO: 38247 - DNA, 201 bp, Homo sapiens
tacaaaaaatacaaaaactaaacaggcacggtggcacatgcctgtagtcccaactactcgggagactgagaggtgggaggattgcttgagccagagaggtygaggctgcaatgagccatgatcgtgccactgcactccagcccgggcagcagagccagaccttgtctcaaaaaaaaatgctatgctgtatgctttattata

SEQ ID NO: 38248 - DNA, 201 bp, Homo sapiens
ggtgactcaaacttgtaatcccagcactttgggaggcctaggtgagcagatggctttagcccaggagtttgagaccagcctgtacaacatggtgaaatcaygtctctacaaaaaatacaaaaactaaacaggcacggtggcacatgcctgtagtcccaactactcgggagactgagaggtgggaggattgcttgagccaga

SEQ ID NO: 38249 - DNA, 201 bp, Homo sapiens
cctagtgagaaattagtatcctaacaaaggaaggcagataatgttaatcttgttttcccctacagctcataaactgaagcttaaggcctatcccactgttytgtatttcattgaatggaatcaatatttttaaaaatgcatgctaggccaggcccagttgctcacacctgtgatcccagcactttgggaggcccaagttgg

SEQ ID NO: 38250 - DNA, 201 bp, Homo sapiens
tgtggcctggagtttacgttcttgggaagtttttttttttccaaccattttcctgtaccatgtagacttttggctgaagtataacatatatatatatatayacacacacacacacacacacacacacacacatatatacatatatacttatatgtatatatgtatatatacgtatatacgtatgcatacgtgtatgtatat

SEQ ID NO: 38251 - DNA, 201 bp, Homo sapiens
ggtgtccagcacacttgccagcataggcctcacagaccacagcacctagaatctgacaaaaattagaataaatccgatgtctccttttctctctttttttwaagcatttttaaatgcaattggtaaatttcctgactgtaccctcctcatcttgcattgctgaataagtgaggaacctctctatggcatgaagcagaaaac

SEQ ID NO: 38252 - DNA, 201 bp, Homo sapiens
cgagcgcggactctgcggctagggagggcatgttgagtgagagcaggctctcagtgcctggggttagagaggtggtaagggcgcaccatgcttttagtgcyttctgtgaacagtgtccgtgttgcctgagatcgtattggtcttgaattttaagtggctgcttttttggggggtgggtgggccatcgagtcatcttcctgt

SEQ ID NO: 38253 - DNA, 201 bp, Homo sapiens
atgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtata

SEQ ID NO: 38254 - DNA, 201 bp, Homo sapiens
tatgtggcctggagtttacgttcttgggaagtttttttttttccaaccattttcctgtaccatgtagacttttggctgaagtataacatatatatatatayacacacacacacacacacacacacacacacacatatatacatatatacttatatgtatatatgtatatatacgtatatacgtatgcatacgtgtatgtat

SEQ ID NO: 38255 - DNA, 201 bp, Homo sapiens
ggtatgtggcctggagtttacgttcttgggaagtttttttttttccaaccattttcctgtaccatgtagacttttggctgaagtataacatatatatatayatacacacacacacacacacacacacacacacacatatatacatatatacttatatgtatatatgtatatatacgtatatacgtatgcatacgtgtatgt

SEQ ID NO: 38256 - DNA, 201 bp, Homo sapiens
gaagatagtagagcaaagcatttaggcatgagggaaaagtgaggagcaacattagacaaggcgagcagtttgagactccttaaattctcaaaacatgtacytaaataatttatgctgagagattcataaataatgtcatttttaaaaatttattatacttttaagttctagggtacatgtgcacaacgtgcaggtttgtta

SEQ ID NO: 38257 - DNA, 201 bp, Homo sapiens
atttccgtaattacaatgtggtatttatttgtgcatttgccacaatggaatgccaaaccaatgatagatggttctaaggtaggtcaacacataagatcctkatgacctttgcagatggagggactgatgaaaaaagagggaggcggtgagtggtgggaaagtccttcattagaatcatatgaattaaaaacagatgcctgt

SEQ ID NO: 38258 - DNA, 201 bp, Homo sapiens
taacacagaatcttggcagcctccaaatgccagcacccagtaagagttaggagggcatcggggtccagcagacattgagaattttcgacaattgcatgcaraaaataagtcctctcttctttcctttttcccctagaatattcatgcttactcttcagcagcccaaattgcccttttgagccttcttcacgccatcacaga

SEQ ID NO: 38259 - DNA, 201 bp, Homo sapiens
ttccagcttcccttaaatgcacagagtcactttaatgtcctctagagactttcactttacctccccagccaccaacccccttgatttctgacttccactgmattctctacttcatttggcctctttgactgctccttcttttggtcctcattcccttgggcttattaaatacctaacctttcattctacctattcaaagca

SEQ ID NO: 38260 - DNA, 201 bp, Homo sapiens
aaaatcagcattttttaaaaaaatccagccatatatcatctggttaatcatgggctctgggctctgagctggggtcctgatggctgctgttaatatttccrgcaagctcattaccttgtttatgtccacctagtgctcttcgcagggtgcacatctctacacgggagctgaccggcatgggcaacaaagcacctgatccca

SEQ ID NO: 38261 - DNA, 201 bp, Homo sapiens
catttacgcaggatctggctgcgttcccaaaagaagcgtgaatcgtgttttcgggattgagcccagtcagcaaggggagggcttactgggcgccccaggtragggcttgctctggagtgcacaggtgcgtgggattgttgctagagcccgtgctgtgcccgtggtgagagtttgccctgtgttcccttggtgccttggtga

SEQ ID NO: 38262 - DNA, 201 bp, Homo sapiens
acaattagctgtactttgtttctctctccccagtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagccccca

SEQ ID NO: 38263 - DNA, 201 bp, Homo sapiens
agctttcatgttttttctagaaatcttttgtccaagtcctccagttattcctaatgggagacacacaggaaaacctctggaagtctttccctttgggaaarcagtaaattacacatgcgacccccacccagacagagggacgagcttcgacctcattggagagagcaccatccgctgcacaagtgaccctcaagggaatgg

SEQ ID NO: 38264 - DNA, 201 bp, Homo sapiens
tactctcagtacctcatataagtggaatcatacagtacctgtccttttgtgacttatttcacttagcataatgtcctcaaggttcattaatgttgtagcaygtgtcagaatttctttcctttttaaggaaaggaagaaattcattgtgtgtatatgcaattttgtttacattttgtttatccatttatctgtcgatagaca

SEQ ID NO: 38265 - DNA, 201 bp, Homo sapiens
gtgtaaaaaaccaattagggaagctcaggtatatgtaaactaaatgaacagtgaggatcaatcagaggaaagcacaccaaatgggaagagaggttctcaarccagtccatggatttacctggaacttgtagctaggctttaaactgtcttcagcttgaaggtcgggtttcaccgggatctgccccatctgcctaggatttg

SEQ ID NO: 38266 - DNA, 201 bp, Homo sapiens
tgccatggcaacgacctagaagttaccgcccctttcctggaaagttctaaataactcgcccctcaatctgcattgatccactccttaatttacatgtaacygaaatgggtttacagcagtataaacacagttgcctgccaggaacccttatgttgctgactctgggtgtgctgcctgtgagttagccctgctctgcaagaa

SEQ ID NO: 38267 - DNA, 201 bp, Homo sapiens
gcaccatgacagtttacaaatgccatggcaacgacctagaagttaccgcccctttcctggaaagttctaaataactcgcccctcaatctgcattgatccaytccttaatttacatgtaactgaaatgggtttacagcagtataaacacagttgcctgccaggaacccttatgttgctgactctgggtgtgctgcctgtgag

SEQ ID NO: 38268 - DNA, 201 bp, Homo sapiens
atggaaccaagttggaaaacactcttcaagatattatccaggagaactgccccaacctagcaagacagtccagcattcaaattcaggaaatacagagaacrccacaaagatactccttgagaagagcaaccccaagacacgtaattgtcagattcaccaaggttgaaatgaaggaaaaaaatgttaagggcagccagagag

SEQ ID NO: 38269 - DNA, 201 bp, Homo sapiens
ccactgcctgagccacttctagaagtagaacagattctgccatcatcctgctttttaatttggtatatatgcctccaattggcagaacctaaccagagccyagctatcaaggaagatgaacgatttatttttaaggcctccattgttagctgtcaaaagacagtgcagaagtgtgaggctgggggccaacagaaatttaac

SEQ ID NO: 38270 - DNA, 201 bp, Homo sapiens
aagaatgaaaaggaatgaacaaagcctccaagaaatatgggactatgtgaaaagaccaaacctacgtttgattggtgtacctgaaagtgacggggagaatrgaaccaagttggaaaacactcttcaagatattatccaggagaactgccccaacctagcaagacagtccagcattcaaattcaggaaatacagagaacacc

SEQ ID NO: 38271 - DNA, 201 bp, Homo sapiens
gcacaagaacttcatgaagcatacacaagtatcaatagccgaatcgatcaagtgaaacaaaggatatcagagattgaagatcaacttaatgaaataaagcwtgaagacaaaaaaagaatgaaaaggaatgaacaaagcctccaagaaatatgggactatgtgaaaagaccaaacctacgtttgattggtgtacctgaaagt

SEQ ID NO: 38272 - DNA, 201 bp, Homo sapiens
aaagaacataaatgacctgatggagctgaaaaacacagcacaagaacttcatgaagcatacacaagtatcaatagccgaatcgatcaagtgaaacaaaggwtatcagagattgaagatcaacttaatgaaataaagcatgaagacaaaaaaagaatgaaaaggaatgaacaaagcctccaagaaatatgggactatgtgaa

SEQ ID NO: 38273 - DNA, 201 bp, Homo sapiens
cttttaaaaactctggagtggacctccatcaaactccagcagacctgcagcagaggggcctgactgttagaagataaactaacaaacataaaggaatagcrtcaacattaacaaaaaggacgtccacatgaaaaccccatccaaaggtcaccaacatcaaagaccaatgatagataaatccacgaagatgaggaaaaacca

SEQ ID NO: 38274 - DNA, 201 bp, Homo sapiens
agacattatggggttcttgctcttgacttctccttgggacaagtagccacaccaaaagccattgcctcaactgagaaggggcttttaaaaactctggagtrgacctccatcaaactccagcagacctgcagcagaggggcctgactgttagaagataaactaacaaacataaaggaatagcatcaacattaacaaaaagga

SEQ ID NO: 38275 - DNA, 201 bp, Homo sapiens
aaaaagaaaataccctcatgaacccaacatatacctgaaatcgcttactagagtgtaaacattggttaagctattttaacctttgattagtttatctatarttcttttaagctgtaatatcctcttcccaaattcaaagcaaattagaaaagggaaggagtgtccccaaatagaggcattccaaggaataaatgtgtttct

SEQ ID NO: 38276 - DNA, 201 bp, Homo sapiens
tagtttgccccatgggattatctattgtttgtcccgctgtttgtgcccgcttttgatagaaattgttctttgttggaatagatacaagcaatgttttgggraaaaataaacatgagaatcatgtgttttgggtaccatcctataaatatttatgaggagagtctgtgctataaatagagagaaatgcttcatagaaataaa

SEQ ID NO: 38277 - DNA, 201 bp, Homo sapiens
gccagggttctccgaggggtgccgtgctcagatcccgggggtatgtggcgggggatgcgggaaccacgcagaagcttgtttggtggcatcgtgtgcgcggscgacatttacgcaggatctggctgcgttcccaaaagaagcgtgaatcgtgttttcgggattgagcccagtcagcaaggggagggcttactgggcgcccca

SEQ ID NO: 38278 - DNA, 201 bp, Homo sapiens
atatgtagacgtatacatatggacacgtatatgtatacgtatacatatggacacgtatatgtatacgtatacatgtacatgtgtatatgtatacgtatacrtgtccatatgtatacgtatatgtatacatatgtatatatacatatgtatatacatatatatggaacatatgtatatatacatatgtatatacatatatac

SEQ ID NO: 38279 - DNA, 201 bp, Homo sapiens
tacaaaaaaaaaaacaaactccatttagcagagcaagaatggagtttgttttgtacagtgctgagttccaacccatagaattgttaaataaataaaaaggraagaacactataagatcaaactcatcagttataatagtaaatgtgaatgattccaatccccccttttgaaagacaaaggcttctaaatatggtcagaatc

SEQ ID NO: 38280 - DNA, 201 bp, Homo sapiens
tctgggaactgagagcctaacacaagtcatttccactttaagacttttaacattctgaaaagttatgttacaaacagagtgctggtccccctgcaacatgytcactcacattggctgacattttaattctttgccaatctgaggggaagagatgtcaactttttttgtttgctcttttaatgccagtcatgttcccttttt

SEQ ID NO: 38281 - DNA, 201 bp, Homo sapiens
aacattagacagggtgagcagtttgagactccttaaattctcaaaacatgtacctaaataatttatgctgagagattcataaataataagtcatttttttwaaatgagcctcatatgttcaataatcagtagactactgatttctcctagtctacccatgtataatttccccaatggaagatagaactttgcttcaattct

SEQ ID NO: 38282 - DNA, 201 bp, Homo sapiens
aatataatacccgcaaaagaaataagtttattgacaccacattgattctatacaacactaaattgtagaagatagcatttctcttgagccaagctaatatkcacacctagaggctccagatacacattaaaggataagaaagacacaaaaattgtaccatttaagtatgtttcccaggtaattcataagcaaatttttaaa

SEQ ID NO: 38283 - DNA, 201 bp, Homo sapiens
ccctgtgtaatacaagttctactcccataattctatgaacaaaacaacaattgatacatagatttgatttttaaaatacattttctttaccttattctaartgtaacatagggtcaacatagaaaaagaaaactgaaaagcacaaggaaagtgaaatatctataatcttaaccattgttaattttgttgtgttccaaatta

SEQ ID NO: 38284 - DNA, 201 bp, Homo sapiens
gaggcaggcggattgtttgaggccaggagttcaagactagcctgcccaacatggccaaaccccatctctactaaaaatacaaaaataaaccagacatggtrgtgcatgcctgtgatcccagctactcgggaggttgaggtgggaggattgcttgacctgggaagtagaggttgcagttagccatgattgtgccactgcact

SEQ ID NO: 38285 - DNA, 201 bp, Homo sapiens
gaggaaactggaacatatattaactggcaagttcaaaggcaagtataactagtggttatgaatatataggtaacacattaagcaaaaaatatcagccagamacggtggctcacgtgtgtaatcccagcacctttgggaggttgaggcaggcagatcacctgaggtcaggagttggagaccagcctggacaacatggtgaaa

SEQ ID NO: 38286 - DNA, 201 bp, Homo sapiens
cacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaaccgaaattatt

SEQ ID NO: 38287 - DNA, 201 bp, Homo sapiens
ttccagaaataaaatgtgaaaatataatacccgcaaaagaaataagtttattgacaccacattgattctatacaacactaaattgtagaagatagcatttytcttgagccaagctaatattcacacctagaggctccagatacacattaaaggataagaaagacacaaaaattgtaccatttaagtatgtttcccaggtaa

SEQ ID NO: 38288 - DNA, 201 bp, Homo sapiens
cccagaaagtcttcagtacatctcagttatagaactgtattaaatacatttaaactctataattccataagacccattttaggtttatacactaagcatcyaattcctcactatcctctcatacaaaccctgtgtaatacaagttctactcccataattctatgaacaaaacaacaattgatacatagatttgatttttaa

SEQ ID NO: 38289 - DNA, 201 bp, Homo sapiens
tgaaattacactctcattatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatgga

SEQ ID NO: 38290 - DNA, 201 bp, Homo sapiens
ctgtcatctccttagcatattttcagcaacaccaatcatagcaccctgtaattgcagaatacctctggtgaaactcctgaatgaaacttagagctttcatrttttttctagaaatcttttgtccaagtcctccagttattcctaatgggagacacacaggaaaacctctggaagtctttccctttgggaaaacagtaaatt

SEQ ID NO: 38291 - DNA, 201 bp, Homo sapiens
tttaatgtgaaagtcttcgagtatattaagaatggcttgattaaccccagggatggaaattttactgattgaaagaaagtttcaataaaataccgatcttygaatctaatctgacacctgaaactaggaaatcaaacactagccatattttttcttctattctttataataatttttctcatgagaaaaaggtatctttct

SEQ ID NO: 38292 - DNA, 201 bp, Homo sapiens
tcctaagaatgtaggctccttcctcagcgctgtgtccccaggatcctgatgaagggctgacacaggataagtgctcaattaatatatattgactaaatgawtaaataacccttcaaaatggttatttttcttcttcaaatgttttgctacttcattaaagttgtaaagtttctactgtccaggaactgttactatccggaa

SEQ ID NO: 38293 - DNA, 201 bp, Homo sapiens
tactgtcatctccttagcatattttcagcaacaccaatcatagcaccctgtaattgcagaatacctctggtgaaactcctgaatgaaacttagagctttcrtgttttttctagaaatcttttgtccaagtcctccagttattcctaatgggagacacacaggaaaacctctggaagtctttccctttgggaaaacagtaaa

SEQ ID NO: 38294 - DNA, 201 bp, Homo sapiens
gccttactggtgtctgatgacaccactggaaatttggtattggtcctgatggtaatggtcttgaatcaccaagaaacatttacattgctaaagatgatagytcatgtttattaaagttcatagatttccttgaaacttatggtctctgatgaccaaaactttgtctgtcttgaacctcattgtcaactcaggaatcttact

SEQ ID NO: 38295 - DNA, 201 bp, Homo sapiens
agatctatcaattacctttgagtataataatggttgatacaaaatgagtgattcctctgcccaggcactataatacaggctacatgtgaattttaatcctkaaaacaaagttattaggtagttcccagttgttctatgtttgtctgttttgttttgcttgagatactgtcttgatctgtcactcaggttggactgcagtgg

SEQ ID NO: 38296 - DNA, 201 bp, Homo sapiens
ctactgtcatctccttagcatattttcagcaacaccaatcatagcaccctgtaattgcagaatacctctggtgaaactcctgaatgaaacttagagctttyatgttttttctagaaatcttttgtccaagtcctccagttattcctaatgggagacacacaggaaaacctctggaagtctttccctttgggaaaacagtaa

SEQ ID NO: 38297 - DNA, 201 bp, Homo sapiens
ctcctgagtagctgggactacaggtgtgcgccaccacgcccagctaattttttgtattttagtacagacggggtttcaccatgttggccaggatggtctaratctcctgacctcgtgatctgcccacctcggcctcccaaagtgctgggattacaggcatgagccaccgcgcccagccctaacatcaaattttaaaagagt

SEQ ID NO: 38298 - DNA, 201 bp, Homo sapiens
tgctgaaattgcgaagcaaagctcaacctgggcaagggatatgatgtttctttggggttcttataaacagatctatcaattacctttgagtataataatgkttgatacaaaatgagtgattcctctgcccaggcactataatacaggctacatgtgaattttaatcctgaaaacaaagttattaggtagttcccagttgtt

SEQ ID NO: 38299 - DNA, 201 bp, Homo sapiens
agagagagagagcaaggcagaggtgctacacactttggaacaagcagatctcgagagaactctatcacaagacagcactagggtgatggtgctcaaccatwagaaaccacctccatgatccagtcacttcccaccaggctccttctccaacactgggaattaccatttgacatgagatttgggaggggacatagagccaaa

SEQ ID NO: 38300 - DNA, 201 bp, Homo sapiens
ggagtgcagtggtgctatctaggcttactgcaacctcacctgtcactttttaattgcaagaaagctgaaaggtttttttctattatatcagttataatgakaaatactgtatatactaactatgagtaaaatactatattgcctaacttgtattattaagcaattctgctaacctgtgaccttacattttcatctgaaaag

SEQ ID NO: 38301 - DNA, 201 bp, Homo sapiens; identical to SEQ ID NO: 8303

SEQ ID NO: 38302 - DNA, 201 bp, Homo sapiens
gctggtctcgaactcctcagctcaagcaattcacccaccttggcctcccaaagtgctgggattataggcatgagccaccgtgcccggcctctatgttttayagagaatatgtgccttagacacatcagataacattctgagacagtaacttgcagacaaaactggattgcaagtccacctcactccagagccttggctttg

SEQ ID NO: 38303 - DNA, 201 bp, Homo sapiens
tacttaaaaattaaagaccaaacttctctccacccaacaaaaatgggcaaaggacatacagctaggtcaccaagaaagaagggcaaataggtggtgagtayatgtaaagatacttgataggacttttgcttagttgaatctttagcaaatctcttttatttcttgggattttgaagaagtaatttttaaaggaggactaga

SEQ ID NO: 38304 - DNA, 201 bp, Homo sapiens
aggattgcttgacctgggaagtggaggttgcagtgagccatgatcgtgccactacactccagcctgggtgacagagcaagactctgtcccaaggttttgtyttggttaacttgctgtccctttttccaggaattccttgtgggctaccccccaccatcgccaatggagatttcattagcaccaacagagagaattttcact

SEQ ID NO: 38305 - DNA, 201 bp, Homo sapiens
gtactgtctcgattatctggccctaaacaatgtaaaatcacagtactttgatacacttctgaggctgtgcctacgctgacaagccctgtaacagcctttastttaggccaatttttggccactgatttaaagcaatgatagagacatctgctccagtgtctactaacccttcaaactgttttccttgaataatggccttac

SEQ ID NO: 38306 - DNA, 201 bp, Homo sapiens
taatgaccgtgtaatttatatggaatgctgaaggggtgggttggccctccacacctgtggatgtttctcattaggtggaactagagacttggaaaagaaaragacacagagacaaagtatagagaaagaaaaaagggggcccaggggaccggtgttcagcatacggaggatccaccggcctctgagttcccttagtattta

SEQ ID NO: 38307 - DNA, 201 bp, Homo sapiens
cacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaactgaaattact

SEQ ID NO: 38308 - DNA, 201 bp, Homo sapiens
catacactggcatggtattcagccataaaaaatgacagcataaagaagcacttaatgactagaaagagatgtattttacgtggaaaaagaatcagatgaayggcatatatggcaagatctcactttattaaaaaataatacacctatgtagtgagggccaggctgaggctgagagaaatacagtgtataacatctttgtct

SEQ ID NO: 38309 - DNA, 201 bp, Homo sapiens
tgtacatgtgtatacatatgtgtatacatggacacgtatatgtagacgtatacatatggacacgtatatgtagacgtatacatatggacacgtatatgtakacgtatacatatggacacgtatatgtatacgtatacatatggacacgtatatgtatacgtatacatgtacatgtgtatatgtatacgtatacatgtccat

SEQ ID NO: 38310 - DNA, 201 bp, Homo sapiens
tatggacacgtatatgtatacgtatacatgtacatgtgtatacatatgtgtatacatggacacgtatatgtagacgtatacatatggacacgtatatgtakacgtatacatatggacacgtatatgtagacgtatacatatggacacgtatatgtatacgtatacatatggacacgtatatgtatacgtatacatgtacat

SEQ ID NO: 38311 - DNA, 201 bp, Homo sapiens
tgtatatatatgtatacatacgtatacatatggacacgtatatgtatacgtatacatgtacatgtgtatacatatgtgtatacatggacacgtatatgtakacgtatacatatggacacgtatatgtagacgtatacatatggacacgtatatgtagacgtatacatatggacacgtatatgtatacgtatacatatggac

SEQ ID NO: 38312 - DNA, 201 bp, Homo sapiens
tgaacctgggaggcgggggttgcagtgagctgagatcacgccactgcactccagcgtggggaacagagtgaggatctgttaaaacaaacaaacaaacaaamaaaaaacacatggactctaataatacatggatacatttagtgaaataaggttaactgagtagagcagcactcataacattttaaaactataagaacatgt

SEQ ID NO: 38313 - DNA, 201 bp, Homo sapiens
tgcctgtaatcccagctactcaggaggctgaggcaggaaaatcgcttgaacctgggaggcgggggttgcagtgagctgagatcacgccactgcactccagygtggggaacagagtgaggatctgttaaaacaaacaaacaaacaaaaaaaaaacacatggactctaataatacatggatacatttagtgaaataaggttaa

SEQ ID NO: 38314 - DNA, 201 bp, Homo sapiens
cgagattgggcgcattcagggtggtatggctgtaaatcagtatccagttctttttattacttctgaatctgtaagtatcatgtttattatatgtaatattrtatatttgtgctttgtctttattagttcttccagagcttttgttcttattatttaataaagatgttatactgagccacgtgtggtgactcaaacttgtaa

SEQ ID NO: 38315 - DNA, 201 bp, Homo sapiens
actttataaaaatgtacctatgtgttagcaaagattaaaagcaaataatgaatgtaaaaatagctatagtttagtgactcatgagatttctgtcattcatwatttaaactgactgttatttatcctgctcttcctttttccaggaattccttgtgggctaccccccaccatcaccaatggagatttcattagcaccaacag

SEQ ID NO: 38316 - DNA, 201 bp, Homo sapiens
tagatgagaatagtattttcaatatttacttctggtaatttggaattaaaaaaaaaacttttgggaaaatttacaataaagtatgattttaacaaaccagkctaggcgtggtggctcacgcttataatcccagcactttgaaaagcagaggcatgcagattgcttgaggccaggagttcaagactagcctgcccaacatgg

SEQ ID NO: 38317 - DNA, 201 bp, Homo sapiens
ttacaaagaatggatctcatccctcttggaaatggtatccttctgatatttgaagaatctagtcatatccttaaaatggctcacagcattccaaacttccrccttcacctagaaatgcttttttttttcttatctcagtctaatgtattttaaactagtctttagctcatttaaccagcccccaatgtcctcttctgttgg

SEQ ID NO: 38318 - DNA, 201 bp, Homo sapiens
aaagtggactctaataatacatggacacatttagtgaaataaacttaactgagtagagcagaacttataatattttaaaactgtaagaacatgtctgtacmttagcaaatagtagatgagaatagtattttcaatatttacttctggtaatttggaattaaaaaaaaaacttttgggaaaatttacaataaagtatgattt

SEQ ID NO: 38319 - DNA, 201 bp, Homo sapiens
tgaaatctctttccccattcaccccaccattgaatcctagagttgtcctcctagaattacaaagaatggatctcatccctcttggaaatggtatccttctsatatttgaagaatctagtcatatccttaaaatggctcacagcattccaaacttccgccttcacctagaaatgcttttttttttcttatctcagtctaatg

SEQ ID NO: 38320 - DNA, 201 bp, Homo sapiens
cgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacatt

SEQ ID NO: 38321 - DNA, 201 bp, Homo sapiens
gtgggcagatcacttgaggtcagtagtttgagaccaccctggccaacataatgaaaccccgcctctactaaaaatacaaaagttagccgagtttggtggcrcatgcctgaaatcccagctactcaggaggctgaggcaggaaaatcgcttgaacctgggaggcaagggctgcagtgagccaagatcacgccactgcactcc

SEQ ID NO: 38322 - DNA, 201 bp, Homo sapiens
gtaaaaagagaaaataaatcatcaacagacctagacattttcaaaagcaaagccatctgaatccatttggagttttttttttttttttatcatggcctgaytatgtttcaattcactgtgacagggctattgttatcactgagattgatgatcaatatcaataagtaatcagtgaaaggtttcacctatttaagatgatta

SEQ ID NO: 38323 - DNA, 201 bp, Homo sapiens
cctgacccagagagtaaaaagagaaaataaatcatcaacagacctagacattttcaaaagcaaagccatctgaatccatttggagttttttttttttttttatcatggcctgactatgtttcaattcactgtgacagggctattgttatcactgagattgatgatcaatatcaataagtaatcagtgaaaggtttcaccta

SEQ ID NO: 38324 - DNA, 201 bp, Homo sapiens
cgagattgggcgcatttagggtggtatggttgtagatcagtatccagttctttttattatttctgaatctgtaagtatcatgtttattatatgtaatattrtatatttgtactttgtctttgttagttcttccagagcttttgttcttattatttaataaagatgttatactgagccacatgtggtgactcaaacgtgtaa

SEQ ID NO: 38325 - DNA, 201 bp, Homo sapiens
agggacctattagatgggacatgggcaggggcactcctttattgcttaaaatgcaagactaaattggtgatgcctttctagaaaggaagtatgaagatacraaaatccatcattcctcccaattttgtactgggtgaacagtaattggaagcattctagaaggaactgtccattgtgaaatcttagttgcatactttagat

SEQ ID NO: 38326 - DNA, 201 bp, Homo sapiens
ccaggagatccaaaaaggtagggtaggatgtaaaggcttcaatctgttcaagtggatatgagactccctggctccccttacaataagtagcatggattttstctctctgccttacttcctccaaacattctgaatgagaagtgttcaaaccactatttgttcaattgcttaatctactttgggacacaagtttaataaatt

SEQ ID NO: 38327 - DNA, 201 bp, Homo sapiens
cattctttgtgacgttgctcacagtaacattatggatacctaataaattttttaaaagacaaaatgttctacgttttgtggcctactctggatggctttawggtaaagtgggtgagtatccctaccctttacatttcaagtgtaggggtgtttagctgtctcttctggctctcatttactgactcttctgggtaaatccat

SEQ ID NO: 38328 - DNA, 201 bp, Homo sapiens
cattcatttggagttggtctcttccaggtggctacccttaacctttgtgctcaaataaactctatccttaaatatattttctgaatctcattatttaaggktgaaaatgtgctaacctaaataattcacaggatttgttttttattctcattttttcctaacctatccacctggttcaaggcacatagattaagaaggaaa

SEQ ID NO: 38329 - DNA, 201 bp, Homo sapiens
cttccttggaatgtagcaatctgtaaccaatcaaaatgctgtaactatgcatggtcccatatggaaaatataatcctgctaaaatttctctgtctctgccyatgtaagtgataccttatgtcctccactttggagtgctgaccccattcatttggagttggtctcttccaggtggctacccttaacctttgtgctcaaata

SEQ ID NO: 38330 - DNA, 201 bp, Homo sapiens
cagaagtataatggtccatttgaaattatttgttactaaagtaaggctagtcattgtggctatgtgtcttttccagccacattcagtttcacaggtatgasagcaaaataatggagaattgattctaaccagtaatgttgttttgtctaatggctataataacccaagagaagggtgagggagctaacagtgggtgcaaga

SEQ ID NO: 38331 - DNA, 201 bp, Homo sapiens
cgaagtcatatagtgtacaataccaagagtggaccctaacataaactatggacttggggtggccatgatgtgtcagtgtaggttcctcaattgcgaaaaaygtaccaccctggtgaaagatgtttataataggggaggttatccatgtataggggcagggagtacataggaaatctctgtatcttctgttcattattgctg

SEQ ID NO: 38332 - DNA, 201 bp, Homo sapiens
aacatatgattccaactatatgccattctggaaaaggcaaaactatggagacagtgaaaatatcagtggttgtcaggggttagggaagaaggggatgaatsggaagagcacagaggattttgagggtagtgaaactactctgtatgatgccataacagtaggtacatgtcataataaatttatccgaagtcatatagtgta

SEQ ID NO: 38333 - DNA, 201 bp, Homo sapiens
ttgcagtccacagtgaagccaagatattaagaagcaatgtgggccaggagaagttagagcagaaatatctctttcaataatgaaagaataagaaaaagaartagaagagctggaaacaataggtaaagtttaggctaggccttagacttctcctgcattgtaatccttctggtttgccacatatgcatgctgtcaggaagt

SEQ ID NO: 38334 - DNA, 201 bp, Homo sapiens
atggtgtaatctgtcctgtaatgtctaatgtctacctgctattattttctaaatggtgagttaaatgggaaatatgtgtagcgtataaccattttctatcmtttgctttaggtttcgactcattggttccccatctactacttgtctcgtctcaggcaataatgtcacatgggataagaaggcacctatttgtgagagtaa

SEQ ID NO: 38335 - DNA, 201 bp, Homo sapiens
agacaagatcaaaagcaacaaatcttgtatttataaaaaacatgtctcaagtaaaatgacatagtattatacacacacacacacacacacacacacacacmcaaattaagtgaaaatgcaaacaaaaaaaggcaaaaataatatttagagaaagatagaatttaagaaaaaaattgtcaaactggtctacaaaataattgt

SEQ ID NO: 38336 - DNA, 201 bp, Homo sapiens
gcaccaaatttaaatgggcttttgatgtttcaaaaatttgttcctttaatttggaaatgtctaaagtgagattatcttctgttccctgtagatggcatctraccatgtcccagtgatgctcagactcattataaacttggggtgtaatacaaaaatctgagatattccagtcacactgtaactggaaacgatggtctaagt

SEQ ID NO: 38337 - DNA, 201 bp, Homo sapiens
atttgagtgttccttcttctctaaaagagtaaataaaataaaataaagtagaaccaagtcccgcaagagttgttattaatatttgatctccttaggcaccrgaaagtaacctgtcaggtgcagagatgtgataaaacgtacaatcttatttttaggagagaagcatgcccagtaagttaagcaatctgttgtcaacgctta

SEQ ID NO: 38338 - DNA, 201 bp, Homo sapiens
ggacatctttgaattatgaatgccgtcctgggtattttgggaaaatgttctctatctcctgcctagaaaacttggtctggtcaagtgttgaagacaactgyagacgtgagtaacccctccctgggaactacttcatgtctgttaaagcataggtgggaccgggcttggtggctcacgcctgtaatcccatcactttgggag

SEQ ID NO: 38339 - DNA, 201 bp, Homo sapiens
agaaaagatgagtagactgactatatagagtttgactctaaaattgagaaaataggtttaaatatctgttgtgtgcatatccatgtgtgtaatatacatgyacatatataaaatgaaattcctcattagaaaaaataataagtttaatttccaaattattagaataactaaaacagctgaatctatctcttccatatagca

SEQ ID NO: 38340 - DNA, 201 bp, Homo sapiens
gagacagcaagaaaaggtaggctaaacttacattacagaaaagatgagtagactgactatatagagtttgactctaaaattgagaaaataggtttaaatakctgttgtgtgcatatccatgtgtgtaatatacatgcacatatataaaatgaaattcctcattagaaaaaataataagtttaatttccaaattattagaat

SEQ ID NO: 38341 - DNA, 201 bp, Homo sapiens
gcaaatgtttttgtattttatttttctaaaaaagctaaccttggttaataacaaaaatggaaattaagaaagcaaacggaaaagagtaggagaaaactgtrtaaatactataacactatgatcaaagagctatttaaaatgaaaagaatgtggattgagttaatacatgcatgcaaatactataggaaatcatatcagtaa

SEQ ID NO: 38342 - DNA, 201 bp, Homo sapiens
taggatattggtaaaaagaaaaaacaacaataaaaaaatacacacaaaaactcggcaatgtaatcataatttactaataatctctctaaactcatagaacrtatcaataaaactagaaaatgtgagacagcaagaaaaggtaggctaaacttacattacagaaaagatgagtagactgactatatagagtttgactctaaa

SEQ ID NO: 38343 - DNA, 201 bp, Homo sapiens
ggcaagcacagtggctcacatatgtaatcccaacacactgagaggctgaggcaagagtatcacttgagcccaggagctcaagaccagcctagacaacatgrcaaaaacccatctctacaaaaaagtataaaaattagctgggcatggcagcatatgcctgtagtcacagctaggcaggagactaaagtgggaggatcacct

SEQ ID NO: 38344 - DNA, 201 bp, Homo sapiens
aggaggtagggtggaagtctctctgctaactttgatattcctgtggtttttctctccaggtcactgtaaaaccccagagcagtttccatttgccagtcctwcgatcccaattaatgactttgagtttccagtcgggacatctttgaattatgaatgccgtcctgggtattttgggaaaatgttctctatctcctgcctaga

SEQ ID NO: 38345 - DNA, 201 bp, Homo sapiens
agaccagtctgaaaaatcaggagaaattttacaaaagagatttactgccaagaaaccagggaaactttcagaacactctccttttcatatttgtaacaagwttcaattgtacaaatacttctgtgaaactagccatgaagtgtgtacatgaatgaatatatgtattcagtgtgtttatatatttcatttcatacatgtgat

SEQ ID NO: 38346 - DNA, 201 bp, Homo sapiens
tcatcccaaggtaacatcaaggagaagaaaatcttttgctattcttgtaagtctctttgtttctgtgatccacctatcagcttaattgaagagaaagaggmggtagggtggaagtctctctgctaactttgatattcctgtggtttttctctccaggtcactgtaaaaccccagagcagtttccatttgccagtcctacga

SEQ ID NO: 38347 - DNA, 201 bp, Homo sapiens
agcatttttaaatgcaattggtaaatttcctgactgtaccctcctcatcttgcattgctgaataagtgaggaacctctctatggcatgaagcagaaaaccmttgagcttatgagaagaaacaggaaatacatgtaaaagagaccagtctgaaaaatcaggagaaattttacaaaagagatttactgccaagaaaccaggga

SEQ ID NO: 38348 - DNA, 201 bp, Homo sapiens
cctagaatctgacaaaaattagaataaatccgatgtctccttttctctcttttttttaagcatttttaaatgcaattggtaaatttcctgactgtaccctmctcatcttgcattgctgaataagtgaggaacctctctatggcatgaagcagaaaaccattgagcttatgagaagaaacaggaaatacatgtaaaagagac

SEQ ID NO: 38349 - DNA, 201 bp, Homo sapiens
caggtggccgctgagagaagacttgaaaggagatgagcatagatgtatggacgctctttgttgcaccagtgtgataggtgatggagggacctattagatgrgacatgggcaggggcactcctttattgcttaaaatgcaagactaaattggtgatgcctttctagaaaggaagtatgaagatacaaaaatccatcattcct

SEQ ID NO: 38350 - DNA, 201 bp, Homo sapiens
tgccagcataggcctcacagaccacagcacctagaatctgacaaaaattagaataaatccgatgtctccttttctctcttttttttaagcatttttaaatrcaattggtaaatttcctgactgtaccctcctcatcttgcattgctgaataagtgaggaacctctctatggcatgaagcagaaaaccattgagcttatgag

SEQ ID NO: 38351 - DNA, 201 bp, Homo sapiens
ggcgctttcctgggttgcttctggcggccctggtgttgctgctgtcctccttctccggtaggaccccggggtggattcgcgcgtccgcggcgaggctagarctctgctcagtcagtcgggcaggaggcgcggggcgaagctcactgcacgtcgtgcctgcttgggatagagagcgaggccagggttctccgaggggtgccg

SEQ ID NO: 38352 - DNA, 201 bp, Homo sapiens
gaatcatttcagtaaattctttaaatcgtcaacagtgaaatttgtaataggactgaaaatgtaaaaatcagcattttttaaaaaaatccagccatatatcrtctggttaatcatgggctctgggctctgagctggggtcctgatggctgctgttaatatttccagcaagctcattaccttgtttatgtccacctagtgctc

SEQ ID NO: 38353 - DNA, 201 bp, Homo sapiens; identical to SEQ ID NO: 8310

SEQ ID NO: 38354 - DNA, 201 bp, Homo sapiens
taataacaaaaatggaaattaagaaagcaaacggaaaagagtaggagaaaactgtataaatactataacactatgatcaaagagctatttaaaatgaaaaraatgtggattgagttaatacatgcatgcaaatactataggaaatcatatcagtaagaaaggcaggacacatcatattatgcccattgaagctacaacttt

SEQ ID NO: 38355 - DNA, 201 bp, Homo sapiens
ttcctgggccaactccctcatggccgtgtgctacttccacttaatctccagcttggggcaaaggtgtcctttgtttgcgatgaagggtgagtgtgacccakcgttgagaccaaggactcagtgtggagaatcactctcttgagatcaggggttaatccaattaaggagctgacctagtagataagaagtacccagagagat

SEQ ID NO: 38356 - DNA, 201 bp, Homo sapiens
cctatttgtgacagtgagttgaaatatcccttcctatttcttttaccgacacattctaatttttctctggaataataaaaatcttaactgaattccttctrtgcaatctgtccttcacacggctgaagactgcggtaatgttctcgaatattcctatggggttcctggcaactctttctttaagttcttccttatcctggg

SEQ ID NO: 38357 - DNA, 201 bp, Homo sapiens
agatcaaactcatcagttataatagtaaatgtgaatgattccaatccccccttttgaaagacaaaggcttctaaatatggtcagaatcctatttacagtarcatcaaaaagaataaaatacttaggaatcaatttaatcaaggaggcacaagacctgtgcactgaaaactcagtaactgaaaatgagcaaatgatgtgata

SEQ ID NO: 38358 - DNA, 201 bp, Homo sapiens
aaacacctatttgtgacagtgagttgaaatatcccttcctatttcttttaccgacacattctaatttttctctggaataataaaaatcttaactgaattcyttctgtgcaatctgtccttcacacggctgaagactgcggtaatgttctcgaatattcctatggggttcctggcaactctttctttaagttcttccttatc

SEQ ID NO: 38359 - DNA, 201 bp, Homo sapiens
tacctctcttacaccaaattttctgaaagagtggttggccttagctgtctcaaccactgtagtcattcattcaagtgatgataattatggagctccttctrtgtgctaagcattattttaggtcatgggatttggcagtcgtaaactgacatgttctcatgcagcttttattctggtgggagagacacacaataagcagat

SEQ ID NO: 38360 - DNA, 201 bp, Homo sapiens
cactttatccacccagtcagggccgccatcaaacctcacttggatgtcggcaaaagctcccctgactggtcttcgcagtccattattgccctattctaatmtaccttccatactatacacagatttacattttttaaatgtgtatctaattgtccctcccttttaaaaaatcttacaatggcatgacgtctcaattcaggg

SEQ ID NO: 38361 - DNA, 201 bp, Homo sapiens
gtaagctacaggcaggttgagaccttatgtactaaaaaaagtttttagtttactctacttggctccaaaattctgtttctttcctgtaggtaaatcatgtygtaatcctccagatcctgtgaatggcatggtgcatgtgatcaaaggcatccagttcggatcccaaattaaatattcttgtactaaagggtgagttggcat

SEQ ID NO: 38362 - DNA, 201 bp, Homo sapiens
ggacaagaaagagaagtggattaaataactaaaagatgtgacaatcttgggctttgagatctttggattataccagttgaattgaattacagataataacraagtttacatttttctgggaggcataatatggggatgaaacagatctgaaaggaaagttttttttgaaagggagctgatcctgaggcagtctggtgagtt

SEQ ID NO: 38363 - DNA, 201 bp, Homo sapiens
gtgaacaaataatcacatgttgaggaataaggctgctttgattcttgtgtgttcaactttgaaacctttatcacagttataaaaaccatttataaaagtgrtataactccacagagtatacctcaataaatttgcacatagaagaaatcaaaatgggtatattttctcatcgcaatacaccaaaaactaggaattaataag

SEQ ID NO: 38364 - DNA, 201 bp, Homo sapiens
cctcccttttataaggacccttgtgatcacatttaaggtccacctagataacccaggataatctgcccatctcaagattcttaatcacatctgcaaagccstttaaccattacaggtaacaatcacaggcttcagggatcagaacatggatatctctgagaggtccttacttagcctaccacacctttccatatagattct

SEQ ID NO: 38365 - DNA, 201 bp, Homo sapiens
tgattctccctgcaaacctggtaggaaaatattattccctttatgaagatgaaactgaggctcagcaagattaagcggtttgcctaagacctcatagccaytaagtagaagacattgggttcaagattcaatctatgaacccaacatttttaatactatataccattctctttttgtattaatttcctattgctgctgtaa

SEQ ID NO: 38366 - DNA, 201 bp, Homo sapiens; identical to SEQ ID NO: 8295

SEQ ID NO: 38367 - DNA, 201 bp, Homo sapiens
tttctacttctgtaacctctctgtatccaaatcctggtaaatggcctcaagtcttcttggaaaaggctaggggaagatttacaatacatgcttttgattgygtagcatggtgcttcctcaagagaatccagtctcccatccgttggtgctgctctgggtctataaactattcaagtctaggaattgttgatgaacaatgaa

SEQ ID NO: 38368 - DNA, 201 bp, Homo sapiens; identical to SEQ ID NO: 8297

SEQ ID NO: 38369 - DNA, 201 bp, Homo sapiens
tggataaagagtcaagacccattggtgtgctgtattcaggagacccatctcatgtgcaaagacacacataggcgcaaaataaagggatggaggaatatttwccaagcaaatggaaagcaaataaaagcaggggttacagtcctagtctctgataaaacatactttaaaccaacgaagatcaaaagagacaagagcattaca

SEQ ID NO: 38370 - DNA, 201 bp, Homo sapiens
tgattgtgctaagtcatgatgattaacaaagcatttaaaatatttattttatctgtgttacatttcaaaaatttatattgaggcatataatttatgttcgygtacatatataatttataaatttatatatttgaaagggcatgctctttttttaaactgatagaggtgcctaagcaaagcaagtgcaaatctattccttaa

SEQ ID NO: 38371 - DNA, 201 bp, Homo sapiens
aatggtgagataacatagttaaattctcgtttagcaggagaaataaaaacatagactataggctaggcacagtggctcatgcctgtactcccagcacattrggaggctgaggtgggcagatcacttgaggtcaggagttcgagaccagcctggccaacatggtgaaaccccatctctactaaaaatacaaaagttagccga

SEQ ID NO: 38372 - DNA, 201 bp, Homo sapiens
acatgtcagaaaggacaactaaactattaccatctgctctttaacggcttcaacacagatgtttagctcctgactgaaatgagcaaaggtatgacaagatygggggaaaatcatctgtatccttgctggaaaccaaggcagagcatatatgaaaagtgtggcattcattgggtgggaaggaagaaaatgggggaagagtat

SEQ ID NO: 38373 - DNA, 201 bp, Homo sapiens
tgtggaagaacctggactctcatgtaccacgagatcaacacatcctcttgaaaggccccatgcactataaacctcagaagtgaacatatattttaacctayttcttaaaatttatacttaggaaataatcacacactttttaaagtagtttggtataaacttttcattgcagcattatttatattagttaaaatgttagag

SEQ ID NO: 38374 - DNA, 201 bp, Homo sapiens
tctgctgcggaggatccctgctggcggttgtggtgctgcttgcgctgccggtggcctggggtgagaggcgggcgggcgtggggaggcgcccgggcggacgrggaacccggggccccgcagagaactcgcgtgcagcgctgagctgcgctgctctgcgcgcccgggtccgaaggcagcgcgatgggtgggctgagcgcgcga

SEQ ID NO: 38375 - DNA, 201 bp, Homo sapiens
aacataaaattagcaacaacaacaacaacaacaacaaaatcaaggtttaaagtcaaaattattttaacagaaaaacccaggcaaaatagcctacctacagrcaggcagtacatgtcagaaggacaggccacccccaataaaaaagataaaatattattttttctaccttttttaaacttaattatttaattatttctttct

SEQ ID NO: 38376 - DNA, 201 bp, Homo sapiens
aacaacaacaacaacaacaaaatcaaggtttaaagtcaaaattattttaacagaaaaacccaggcaaaatagcctacctacagacaggcagtacatgtcaraaggacaggccacccccaataaaaaagataaaatattattttttctaccttttttaaacttaattatttaattatttctttcttttttcttttttttgtt

SEQ ID NO: 38377 - DNA, 201 bp, Homo sapiens
actcagcccctggtgggaggggatgtgtgagtgagtgagtgtggggtccagctggccactccaagcacctgcacaggaatgggctctgagcagtgctggcrgctggaccaggcatgtcacactgaagggaacgtggtggtgcccaaacaggggtgcccatgaccccaaagcccagaggaggtgttacagcacactaatggc

SEQ ID NO: 38378 - DNA, 201 bp, Homo sapiens
agattggttaaagggcacaggatcacagatagataggaggaatacattcatccttgaatacttaaccctctgccctaaatctgtcagtcctacatccatayttcttatttcagtaagtagcaccaccattcatttctaatcctggggctaactcttttttttttttcttttctgaatcatgtctccttttaatggttaagg

SEQ ID NO: 38379 - DNA, 201 bp, Homo sapiens
ctgtttctacttctgtaacctctctgtatccaaatcctggtaaatggcctcaagtcttcttggaaaaggctaggggaagatttacaatacatgcttttgaytgtgtagcatggtgcttcctcaagagaatccagtctcccatccgttggtgctgctctgggtctataaactattcaagtctaggaattgttgatgaacaat

SEQ ID NO: 38380 - DNA, 201 bp, Homo sapiens
agttctggaggccgacgtctaaaatagatccatagggctgtgttccttgtggaggctccaggggagcaggggttttcttgctctttccagcttccaggggstgcttccgtcctttggctcttggcctccttcctctaccttccaaaccagcaccatagtgtctctgaatatccttcttctgtctcctttcaccctcttgcc

SEQ ID NO: 38381 - DNA, 201 bp, Homo sapiens
caagatagcgccactgcactccagcctgggtgatggagccagtctccgtctcaaaaaagaaaaaaaaaagtatggtaatttctccattaactttgatgctkctatggtcttgatctccaggtcaatgcaatgccccagaatggcttccatttgccaggcctaccaacctaactgatgagtttgagtttcccattgggacat

SEQ ID NO: 38382 - DNA, 201 bp, Homo sapiens
tgatgatagcaaatccttaaaagaatgtcactggatgtactaaaaactgtgataagtgatatgatcaaagtagacatttcttccactagaattttgggagraagcctaatggaaaccaatgcgcacagaaagacaaatgctgtatgttattagtcatatgtggactctaaaaaactcatctcatagaagtagagggtagaa

SEQ ID NO: 38383 - DNA, 201 bp, Homo sapiens
aggcactgagacagacaaagattgctggattcagtttaacgttactagggtaaaagaaaagagttggattggtggttagagagtgggatcattgaaatcaytgagaggttgaaagtgacaagtctccgagcatgcacatgagcattagagtcagaggagagtggaggacaagaccacaggcagagaagaggtcaaggcact

SEQ ID NO: 38384 - DNA, 201 bp, Homo sapiens
tttctccattaactttgatgcttctatggtcttgatctccaggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactg

SEQ ID NO: 38385 - DNA, 201 bp, Homo sapiens
gcttcctcttagccaagggcaaaataggttttggctattttctcctattctcgcagttaaaacggacaatcaacaataaaatatcaatttctttctgattkgtctaatttcagaagtaaattgtagcttcccactgtttatgaatggaatctcgaaggagttagaaatgaaaaaagtatatcactatggagattatgtgac

SEQ ID NO: 38386 - DNA, 201 bp, Homo sapiens
ttaaaaacatgcttcctcttagccaagggcaaaataggttttggctattttctcctattctcgcagttaaaacggacaatcaacaataaaatatcaatttmtttctgatttgtctaatttcagaagtaaattgtagcttcccactgtttatgaatggaatctcgaaggagttagaaatgaaaaaagtatatcactatggag

SEQ ID NO: 38387 - DNA, 201 bp, Homo sapiens
gtaacacaaatattgtctttcaggctgtggcttttcttttttccttcttaatgatgtcttttgtttatgaaagttctacattttaataatattcaatttakgagtcttcttttttccagttactgctttttctattctacttaagcaattgggccaagtgaggtggctcatgtctataatcccagcattttggaaggccaa

SEQ ID NO: 38388 - DNA, 201 bp, Homo sapiens
gatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaaggtgacttatttcttggtattccttattcttgctgggttgtatg

SEQ ID NO: 38389 - DNA, 201 bp, Homo sapiens
aaggcttctaaatatggtcagaatcctatttacagtagcatcaaaaagaataaaatacttaggaatcaatttaatcaaggaggcacaagacctgtgcactraaaactcagtaactgaaaatgagcaaatgatgtgatagacatgtctccaagggaaatatacaaatgcccaataaacacatcaaaagatgttcaacatcat

SEQ ID NO: 38390 - DNA, 201 bp, Homo sapiens
ttctctgtctctgcctatgtaagtgataccttatgtcctccactttggagtgctgaccccattcatttggagttggtctcttccaggtggctacccttaamctttgtgctcaaataaactctatccttaaatatattttctgaatctcattatttaaggttgaaaatgtgctaacctaaataattcacaggatttgttttt

SEQ ID NO: 38391 - DNA, 201 bp, Homo sapiens
aagtaaaaagttttttttttttttaaagttcctactaaatttccaaggggatgggcttcccctcagatcactaccccttttcagggagcaataaagtaatyttccttggaatgtagcaatctgtaaccaatcaaaatgctgtaactatgcatggtcccatatggaaaatataatcctgctaaaatttctctgtctctgcct

SEQ ID NO: 38392 - DNA, 201 bp, Homo sapiens
atgtataggggcagggagtacataggaaatctctgtatcttctgttcattattgctgtgaaccaaaaactgtgctaaaacacaaagtctattttttaaaaytgcatagacataaatacatgggcatatgtgcataaacagacacgcacacaaataagtgcaggtaaaacaggaaatttgaacaaaatctgtggattataac

SEQ ID NO: 38393 - DNA, 201 bp, Homo sapiens
taagaacctccatatttctatagtgacagtcatttttgcttgtgaaaatggctttgctgtaactgtcagagacagaactacctcccaagtgaatgacaaaygggttatagataggcacgctgtctcaattgttggtattctgatggtccttcctatggggtgaagagtgtgggatggtaaggagagaagggggtggacagt

SEQ ID NO: 38394 - DNA, 201 bp, Homo sapiens
acagggggaaggtttcataagtatatatataatatatatataatataacataaaattcatatatattataaaaataataaatatgatataaatttgatatraaatattatataaatctgatttttaacatattttgattttatactggtgtaaagtactattttctctttattttttacatcaagaatatgtatcccctac

SEQ ID NO: 38395 - DNA, 201 bp, Homo sapiens
gatattggatgtgttcatgtattcatatgtctatgtttaactgagtgtcttttcttgtgtttgtgtgggaacttgttcttagcctgcccacatccacccargatccaaaacgggcattacattggaggacacgtatctctatatcttcctgggatgacaatcagctacatttgtgaccccggctacctgttagtgggaaag

SEQ ID NO: 38396 - DNA, 201 bp, Homo sapiens
ttctgtgcctctctccaggcttccttccagtggctgctggcaatcgttgatgttccttggcttgtagatgcatcatttccttctctgtctccatcttctcrtcgccttctcctctgtgtgtgtcctttgctcttctgtctcctataaagacactggacatggatttagaggccaccctggcaatccagaatggtcacagct

SEQ ID NO: 38397 - DNA, 201 bp, Homo sapiens
agggtggtatggccataggcaggctggggaaggcttctataagaaagtgacattttagcagatgcctgaaggaagaattgaagtcagagtgaagataaaaktgcgtcacatagaaggaatgtcatagacgggaaaaatgtgtgtctttgggaaactgaaaaaggggaaagggccacaccttggtgaggggaccaagtggca

SEQ ID NO: 38398 - DNA, 201 bp, Homo sapiens
gtaataaacatggaattggaataggaattttcctggaaatatgaaaaagattagtaaaatagagaaaacaaaaaatataataatacacctatacctgtatytattttttatctctgtttctacttctgtaacctctctgtatccaaatcctggtaaatggcctcaagtcttcttggaaaaggctaggggaagatttacaat

SEQ ID NO: 38399 - DNA, 201 bp, Homo sapiens
catatcaactagaggaaaggtgaatgcataacactgaaaataacagcaactgttttactcagtgttttttttttttacagtatcctcaaagtgctgttatstatcaaaatcagctgtgaaaatttttaaaaatagactcctgggccctaacctagacccactaaatcagagatttgggggacatagcttggattcttgatt

SEQ ID NO: 38400 - DNA, 201 bp, Homo sapiens
ccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctggttagtacctgcttccacatatcctaaatgggttcagaata

SEQ ID NO: 38401 - DNA, 201 bp, Homo sapiens
cactctcttgagatcaggggttaatccaattaaggagctgacctagtagataagaagtacccagagagattaatttatggaagggtagttttgaaataagrgtagggactaagtggcaccactttcagaaggcaatgagaaaatggcacatacagctcaatgtcaggtacaaacctaaatacagtcactgatcttgagtac

SEQ ID NO: 38402 - DNA, 201 bp, Homo sapiens
ctatcattgatggacatttgggttggttccaagtctttgctattgtgaataatgcagcaataaacatatgtgtgcatgtgtctttatagcagcatgatttrtaatcctttgggtatatacccagtaatgggatcgctgggtcaaatggtatttctagttctagatctttgaggaatcaccacactgtcttccacaatggtt

SEQ ID NO: 38403 - DNA, 201 bp, Homo sapiens
tcaatatttacttctggtaatttggaattaaaaaaaaaacttttgggaaaatttacaataaagtatgattttaacaaaccagtctaggcgtggtggctcaygcttataatcccagcactttgaaaagcagaggcatgcagattgcttgaggccaggagttcaagactagcctgcccaacatggccaaaccccatctctact

SEQ ID NO: 38404 - DNA, 201 bp, Homo sapiens
actcactctctatgagaccctgagcaagatacttatcctcagtaaatttcattttccttgcctgtgaaatggagataataatagttcctaccttacttaamatagtgcctcatttatgatgcatgtcagaaaatgttagctattatttacacatgattgttattactgatattaaaaagtgagtaaatatttctttttact

SEQ ID NO: 38405 - DNA, 201 bp, Homo sapiens
taaaagatggacaacattataaaaagaaatagacaaatgtacaataaataaaatattttaacacaactcatttagtatctagtaagacaagtactcccccmaaaatcagtaaagtatctagaagatttgaataaatattaacagattggattcactgaccttgttacaagaaagaattatacatgatgataggagagagga

SEQ ID NO: 38406 - DNA, 201 bp, Homo sapiens; identical to SEQ ID NO: 6890

SEQ ID NO: 38407 - DNA, 201 bp, Homo sapiens
ggtggtcggggctccatctggccctctgagacttaaaggagctttgcttttcagagttgagaatggagagaatgttacctctcctggctctggggctcttrgcggctgggttctgccctgctgtcctctgccaccctaacagcccacttgacgaggagaatctgacccaggagaaccaagaccgagggacacacgtggacc

SEQ ID NO: 38408 - DNA, 201 bp, Homo sapiens; identical to SEQ ID NO: 6891

SEQ ID NO: 38409 - DNA, 201 bp, Homo sapiens; identical to SEQ ID NO: 34073

SEQ ID NO: 38410 - DNA, 201 bp, Homo sapiens
gggtgcttcaaactggccagtaacctgaaggactcatattcttaaggatatcctggtggccacgtagaaaacagtcaggtggggtgagggtggaagtaagraccagctcagaggtcactgagggtgcagccagacaggctgggacccacgtgggcagcagaggtggagagtagggatgtggagggggagacccagccccac

SEQ ID NO: 38411 - DNA, 201 bp, Homo sapiens
tgtgttgcccaggctggagtgcagtggcgtgatcttggctcactgcaacctctgcctcctgggttcaagcgattctcctgcctcagcctcgcctcccaagyagctgggttacaggcatgcgccatgatgccctgctagtttgtttgttttttttttttttgtatttttagtaaagatggggtttcgccatgttggccaagc

SEQ ID NO: 38412 - DNA, 201 bp, Homo sapiens
acaaaagagtttcagagaggtaaagttatggccctaaagtcacccagcaagtagatgtggcaaagccatgttgcaaaagaagccctggtgggtgacactcwttggatggcccctgcctctccggaaggcaccagcgttggtttctctccgcctcaccttcccatgcaggtgggcacgtttgtgcttgggctcctgctggtt

SEQ ID NO: 38413 - DNA, 201 bp, Homo sapiens
ccaggtgagtctttagacttgggtcaattcatcctttgtatccgaacttgaattggtgaaggccagatggacttttgggtactcttgaacttgggttaatrcacgtgcatttctcattatatactcaccctgcttgggacacccccaagccaagaagagctaggttacagcccagctcctcctgccgtgttaggggttgag

SEQ ID NO: 38414 - DNA, 201 bp, Homo sapiens
ccagctgggcattgaggaagccttcaccagcaaggctgacctgtcagggatcacaggggccaggaacctagcagtctcccaggtgagtctttagacttggrtcaattcatcctttgtatccgaacttgaattggtgaaggccagatggacttttgggtactcttgaacttgggttaatgcacgtgcatttctcattatata

SEQ ID NO: 38415 - DNA, 201 bp, Homo sapiens
caaaagaagccctggtgggtgacactctttggatggcccctgcctctccggaaggcaccagcgttggtttctctccgcctcaccttcccatgcaggtggghacgtttgtgcttgggctcctgctggttatgccccagaagcacactcttccctatctgcagtcccagcccatgtgtggacacaacccatttcctagggtgt

SEQ ID NO: 38416 - DNA, 201 bp, Homo sapiens
tggtgcccatgatgagtttgcatcacctgactataccttacttccgggacgaggagctgtcctgcaccgtggtggagctgaagtacacaggcaatgccagygcactcttcatcctccctgatcaagacaagatggaggaagtggaagccatgctgctcccagagaccctgaagcggtggagagactctctggagttcaggt

SEQ ID NO: 38417 - DNA, 201 bp, Homo sapiens; identical to SEQ ID NO: 34078

SEQ ID NO: 38418 - DNA, 201 bp, Homo sapiens
aaaagaagccctggtgggtgacactctttggatggcccctgcctctccggaaggcaccagcgttggtttctctccgcctcaccttcccatgcaggtgggcmcgtttgtgcttgggctcctgctggttatgccccagaagcacactcttccctatctgcagtcccagcccatgtgtggacacaacccatttcctagggtgtt

SEQ ID NO: 38419 - DNA, 201 bp, Homo sapiens; identical to SEQ ID NO: 34079

SEQ ID NO: 38420 - DNA, 201 bp, Homo sapiens
tagacataggaagctttttcctccttcctactccccttcctggaggttgacacagaccaaagcttggtaagaaaacttaggataaaagaaggggcagaggycgggcaaggtggctcatgcctgtagtcccagcactttgagtggccaaggtgcgtggatcaattgagcccaggtgattgagaccagcctgggcaacatggt

SEQ ID NO: 38421 - DNA, 201 bp, Homo sapiens; identical to SEQ ID NO: 34080

SEQ ID NO: 38422 - DNA, 201 bp, Homo sapiens
tactccccttcctggaggttgacacagaccaaagcttggtaagaaaacttaggataaaagaaggggcagaggccgggcaaggtggctcatgcctgtagtcycagcactttgagtggccaaggtgcgtggatcaattgagcccaggtgattgagaccagcctgggcaacatggtgaaaccatgtctctgcaaaaaattacaa

SEQ ID NO: 38423 - DNA, 201 bp, Homo sapiens; identical to SEQ ID NO: 34081

SEQ ID NO: 38424 - DNA, 201 bp, Homo sapiens; identical to SEQ ID NO: 34082

SEQ ID NO: 38425 - DNA, 201 bp, Homo sapiens
agcctgggcaacatggtgaaaccatgtctctgcaaaaaattacaaaaattagctgggcatggtggtgtgcacctgtaatcccaactactcgggaggctgargggggaggatcacttgagcccaggatgttgaagctgcacatgaggtgagattgcaccactgcactccagcttgggctacagagtgagtccctatctcaaa

SEQ ID NO: 38426 - DNA, 201 bp, Homo sapiens; identical to SEQ ID NO: 34083

SEQ ID NO: 38427 - DNA, 201 bp, Homo sapiens
gcctgggcaacatggtgaaaccatgtctctgcaaaaaattacaaaaattagctgggcatggtggtgtgcacctgtaatcccaactactcgggaggctgaasggggaggatcacttgagcccaggatgttgaagctgcacatgaggtgagattgcaccactgcactccagcttgggctacagagtgagtccctatctcaaaa

SEQ ID NO: 38428 - DNA, 201 bp, Homo sapiens
cacatgtgctgtacagcaaggatgtcaaagctctcttcctcaaaggcaggagcatctcctcagaccctagtatcctcctcatttcctctttgcttcctttkgtcgggttccaaaaaacagtagaagtgccctggattctgatgagagaacattctcaagggattgctgactcgggaggcaaacaggctccagcgatcctgc

SEQ ID NO: 38429 - DNA, 201 bp, Homo sapiens
agtggccatggcatgtgtggccctgtctgcttatccttggaaggtgacagcgattccctgtgtagctctcacatgcacaggggcccatggactcttcagtytggagggtcctgggcctcctgacagcaataaataatttcgttggacacgttgcttgtgcctttccatgctgactatcagactctgcgcccctgaggctac

SEQ ID NO: 38430 - DNA, 201 bp, Homo sapiens
taaaggcttgtagagcttgggtggtgatttcatccaccaaacctatctctctccccattctggcatacaaggcagcagtcagggtccccagaggcagcccrtctttctggcagggacccatgctggagatctggccagctgaaaggccccaaaggagctcggtgccctgggtaatatgggaaggtgctccatggcactgcc

SEQ ID NO: 38431 - DNA, 201 bp, Homo sapiens
ctagacaaacagacgtggaggggcagctgagcaaccagacaggaggacgtggtttctgacaacgtggaggcaccatatcaacccactgcctccagctggasctgcaggagagggaaatgaacttcagtctcattttagcaactatttctttaggattctgtgtaacttaaacatatgtattggccaggtacagtggctcac

SEQ ID NO: 38432 - DNA, 201 bp, Homo sapiens
gctgttggttgattcctgggcaagccacttcccctcctgggcctgggttttcatctgtaaatgaaggcgtggatccagatctccctctaagactactccaygcctcacgtgccatttgttctctgagtttcccatgttctcgcctcctactacctagccctatgctaggactctcccctccaggacacagtagccagccta

SEQ ID NO: 38433 - DNA, 201 bp, Homo sapiens; identical to SEQ ID NO: 8324

SEQ ID NO: 38434 - DNA, 201 bp, Homo sapiens
cctttcctgcctttgggactcagcctcaacaccacctcctacaggaagccctcctggtgcccccgtgaagcaggctgccatgcagccactgcagctggccyagcccaggctctcaacacactcaggggtccctgctggtgtgaaggtgcttcaactgcattgcaagctgcagggaaagggcagggccaggctcgagcaggg

SEQ ID NO: 38435 - DNA, 201 bp, Homo sapiens
tgcccaatcccattgatagaaactcaaccaatgcaaacctcagcctgcaagctccgaaggggcagagtgcaagccggtagcttttgcctcctggagcccayagtccagatggggacaaaaaaagagatagggacacaaagagtgatcactgagccagagggtggaaaggtgcttaggagacatgagctgcttggaggcaga

SEQ ID NO: 38436 - DNA, 201 bp, Homo sapiens; identical to SEQ ID NO: 34086

SEQ ID NO: 38437 - DNA, 201 bp, Homo sapiens; identical to SEQ ID NO: 34087

SEQ ID NO: 38438 - DNA, 201 bp, Homo sapiens; identical to SEQ ID NO: 34088

SEQ ID NO: 38439 - DNA, 201 bp, Homo sapiens
tattatatatgtgtatacgtatatatgtatatatatacacacacacacatagagagagatatatatataaagacacacacacacacacacacacacacacrcacacacacacattcaattccaaaactgggagcctgaaagtcatttaagaaagatgggcccagacagttattggtcatcttagtgccttacagtcaacaa

SEQ ID NO: 38440 - DNA, 201 bp, Homo sapiens; identical to SEQ ID NO: 8332

SEQ ID NO: 38441 - DNA, 201 bp, Homo sapiens; identical to SEQ ID NO: 34089

SEQ ID NO: 38442 - DNA, 201 bp, Homo sapiens
ccttgggttcagaccgtggtggctggtgtgacctggagcaggtcgctgctcttctctggagctcagctacctcctgaagagaaaggaatgtcctttccccrccacccctgttttcactgggtgattgtgagaatccggtgaggtattgtatgttgaagccataataaaccactaagggcaagggagctgcttcaacactaa

SEQ ID NO: 38443 - DNA, 201 bp, Homo sapiens
aataaaaatagaaataggacaccttcctccttcaggggactcagagtttaatggaagacacagcctcctgtataattgtaagaccaggcagacagtgacargcatcttaagagggctataaactaagggagggggagtttgcaggtggcaggtgtgacctgggcctctaggagcttgctacctgctctatgccagcccaca

SEQ ID NO: 38444 - DNA, 201 bp, Homo sapiens
tgtgcccggcttttccactgcaagaaaatggcaacaattatggtacctacctcaaagggtgaaatgaagcagagtgatgtgtgtcgggtgccccagagagyacctacctgagggaggctccaaagctagcaagaggcagcaggacagggaccaggacgcaggctgggtggagggcagtgggaggtggtcggggctccatct

SEQ ID NO: 38445 - DNA, 201 bp, Homo sapiens; identical to SEQ ID NO: 6912

SEQ ID NO: 38446 - DNA, 201 bp, Homo sapiens; identical to SEQ ID NO: 34093

SEQ ID NO: 38447 - DNA, 201 bp, Homo sapiens
agaaaagaaatagtcccctggagcccctggccctgacctcccaaaagccagagtgaactttcaatctcaccgtaggctgaccccctgtgtccattttaagycagaggactatacccatccacagtcaaagaagagggtggtgaccaatgtggacaaagctcccattcagctgagaccccaatcagtaaagaaaatctttcc

SEQ ID NO: 38448 - DNA, 201 bp, Homo sapiens; identical to SEQ ID NO: 34095

SEQ ID NO: 38449 - DNA, 201 bp, Homo sapiens
agccagagtgaactttcaatctcaccgtaggctgaccccctgtgtccattttaagtcagaggactatacccatccacagtcaaagaagagggtggtgaccratgtggacaaagctcccattcagctgagaccccaatcagtaaagaaaatctttccctacacagatctacagacaaccaaagccttaaaaaggcatcaacc

SEQ ID NO: 38450 - DNA, 201 bp, Homo sapiens
ctgactttcaggactcagctgcagctaagaagctcatcaacgactacgtgaagaatggaactagggggaaaatcacagatctgatcaaggaccttgactcrcagacaatgatggtcctggtgaattacatcttctttaaaggtgagtgtgcctggcttggggttcagaagaggtggatctcagggccatttctgtcctgac

SEQ ID NO: 38451 - DNA, 201 bp, Homo sapiens; identical to SEQ ID NO: 34096

SEQ ID NO: 38452 - DNA, 201 bp, Homo sapiens
ttcccttcccctgtggccctttctatggactggaaggtggacatagcagtgagccatcttagcctagacaaacagacgtggaggggcagctgagcaaccasacaggaggacgtggtttctgacaacgtggaggcaccatatcaacccactgcctccagctggacctgcaggagagggaaatgaacttcagtctcattttag

SEQ ID NO: 38453 - DNA, 201 bp, Homo sapiens; identical to SEQ ID NO: 34098

SEQ ID NO: 38454 - DNA, 201 bp, Homo sapiens
tgccatgttggctgggctggtcttgaagccctgacctcaggtgatccacctgccttggcctcccaaagtgctgggattacaggcatgagccactgcccccrgcctacatactattttaaatccactgcacctgttcttattctggagtggatgctgaattctgcccttggacaaggccctcagtgtgttctgggagagcct

SEQ ID NO: 38455 - DNA, 201 bp, Homo sapiens
atgtgccatcatgcctggctaatttttttgtatttttattagagatggggttttgccatgttggctgggctggtcttgaagccctgacctcaggtgatccrcctgccttggcctcccaaagtgctgggattacaggcatgagccactgcccccagcctacatactattttaaatccactgcacctgttcttattctggagt

SEQ ID NO: 38456 - DNA, 201 bp, Homo sapiens
agctctgcagggagggtccggctctaggggactttgctcctgggcatcctagctgcagagattggtggggcttgtccagaaaggggggtcttctggacctsgggatgatgcagttgggcctcagggtactgggaggccagtaggggtgcttcaaactggccagtaacctgaaggactcatattcttaaggatatcctggtg

SEQ ID NO: 38457 - DNA, 201 bp, Homo sapiens
aaggatgtagaactagaaatacaatttgacccagcaatcccattactggatatatacccaaaggattatacatcatgctactataaagacacatgcacacrtatgtttattgtggcaccattcacaatagcaaagacttggaaccaacccaaatgtccaccaataatagactggataaagaaaatatggcacatatacacc

SEQ ID NO: 38458 - DNA, 201 bp, Homo sapiens; identical to SEQ ID NO: 34109

SEQ ID NO: 38459 - DNA, 201 bp, Homo sapiens
gcctcagcattcatgaaaatccactactccagacagacggctttggaatccaccagctacatccagctccctgaggcaggtaatccatgatgttttacatyctgggagcggaggaatctgtttttccaggagagttttaggcagcagcctggagtgtgtggagtgtgaggggtaagcagaggccaggaggaggtgtactca

SEQ ID NO: 38460 - DNA, 201 bp, Homo sapiens; identical to SEQ ID NO: 34111

SEQ ID NO: 38461 - DNA, 201 bp, Homo sapiens
caatcaaaagtggccaaaataaaatcccagtccaagtctgggagactccaaagccctctctgccttctccccactaagaggcccttccaggcttatggtgracacagacaccacgtggcaacctggcaggggcagagaagaacatttgcctttctttggtcttgctgccaaccattatcagggccatcgaggctccagaca

SEQ ID NO: 38462 - DNA, 201 bp, Homo sapiens; identical to SEQ ID NO: 8328

SEQ ID NO: 38463 - DNA, 201 bp, Homo sapiens
aaagtggccaaaataaaatcccagtccaagtctgggagactccaaagccctctctgccttctccccactaagaggcccttccaggcttatggtggacacaracaccacgtggcaacctggcaggggcagagaagaacatttgcctttctttggtcttgctgccaaccattatcagggccatcgaggctccagacactgtac

SEQ ID NO: 38464 - DNA, 201 bp, Homo sapiens; identical to SEQ ID NO: 8329

SEQ ID NO: 38465 - DNA, 201 bp, Homo sapiens; identical to SEQ ID NO: 34113

SEQ ID NO: 38466 - DNA, 201 bp, Homo sapiens; identical to SEQ ID NO: 8387

SEQ ID NO: 38467 - DNA, 201 bp, Homo sapiens
ctctcacatgcacaggggcccatggactcttcagtctggagggtcctgggcctcctgacagcaataaataatttcgttggacacgttgcttgtgcctttcyatgctgactatcagactctgcgcccctgaggctacctgtgccccaaagacaagccccttgagctcccatgcaggctcagctccaccccaagatctgggct

SEQ ID NO: 38468 - DNA, 201 bp, Homo sapiens
ctcttgtctgccctctgtgctcacacagcactgggttgaggtctgcactccacctttcaaacagcaaagtaagagagggttgtgtgtagaggagcagaccygtatggttcaggaattcaaggccatgaaaagtacttgaaagccccaaggatgtttaagctagagcaggagagatgctgaaagccatgctggcttggctga

SEQ ID NO: 38469 - DNA, 201 bp, Homo sapiens
atgagggcagagggagctgatcactgaggaagactgaggatggggagatggggtccctaggaggtccaagaatgacctgttagaagtgccatatgaactayaaaggctacttttcccccccaaagaggattttttcacattgactctcagttttctcaactgtaaagtggaaaccatgacagtgtgtgcatgcctgtgtca

SEQ ID NO: 38470 - DNA, 201 bp, Homo sapiens
cagagggagctgatcactgaggaagactgaggatggggagatggggtccctaggaggtccaagaatgacctgttagaagtgccatatgaactataaaggcyacttttcccccccaaagaggattttttcacattgactctcagttttctcaactgtaaagtggaaaccatgacagtgtgtgcatgcctgtgtcatccgtgt

SEQ ID NO: 38471 - DNA, 201 bp, Homo sapiens
agtgatgagccacagtgaatattatacacggggagctgttttgattaagtttcattagaaagatcaccgtggctgagcagggaaggatggatacagtattragtgtggatttggtgaaaagaagagaagcagaatgaccaagaggttcagccttagctaggaattgggagaggacagagaggaaaggagactaattggaga

SEQ ID NO: 38472 - DNA, 201 bp, Homo sapiens
atgttagttaccagagacctctgataaagacagagccacaggtaaaacgcagcggcacaacccctcgaccctaaaatcagaagcctatctgtgtcctggcraggagagaagcacgagtgatcatccacaccgccaggacgcaagcccgttatttctgatgcaaaacccaggctccctccagggctggcacagaggactgcc

SEQ ID NO: 38473 - DNA, 201 bp, Homo sapiens
gcttggtaaaagtcatcgccattctctagtctcaataaaccaggggcacaatgcactgcggaaagctgcagggacctctgcccttgaaagcagggtattgyccaaggtttctccccatgtgatagtctgaaatatggcctcatgggatgggaaagacctgaccgtcccccagcccgacacccgtaaagggtctgtgctgag

SEQ ID NO: 38474 - DNA, 201 bp, Homo sapiens; identical to SEQ ID NO: 34116

SEQ ID NO: 38475 - DNA, 201 bp, Homo sapiens; identical to SEQ ID NO: 34117

SEQ ID NO: 38476 - DNA, 201 bp, Homo sapiens; identical to SEQ ID NO: 34118

SEQ ID NO: 38477 - DNA, 201 bp, Homo sapiens
aatggaagacacagcctcctgtataattgtaagaccaggcagacagtgacaggcatcttaagagggctataaactaagggagggggagtttgcaggtggcrggtgtgacctgggcctctaggagcttgctacctgctctatgccagcccacacctggcttgagggacagtgcccactggtgaggcaagatgggaacctcca

SEQ ID NO: 38478 - DNA, 201 bp, Homo sapiens
atttgagtaggtctaacaagcccgtattaccagaaattatcatctggtcatttccagtccgagaacagaacacttggttgtcctggcatttcccaagcagkgggaggagttctctgcaggaataaataagcctcagcattcatgaaaatccactactccagacagacggctttggaatccaccagctacatccagctccct

SEQ ID NO: 38479 - DNA, 201 bp, Homo sapiens; identical to SEQ ID NO: 34120

SEQ ID NO: 38480 - DNA, 201 bp, Homo sapiens; identical to SEQ ID NO: 34124

SEQ ID NO: 38481 - DNA, 201 bp, Homo sapiens; identical to SEQ ID NO: 8326

SEQ ID NO: 38482 - DNA, 201 bp, Homo sapiens; identical to SEQ ID NO: 34126

SEQ ID NO: 38483 - DNA, 201 bp, Homo sapiens; identical to SEQ ID NO: 34128

SEQ ID NO: 38484 - DNA, 201 bp, Homo sapiens; identical to SEQ ID NO: 34127

SEQ ID NO: 38485 - DNA, 201 bp, Homo sapiens; identical to SEQ ID NO: 34129

SEQ ID NO: 38486 - DNA, 201 bp, Homo sapiens
taccaaggtgactgcaatccagggacagtgagagtcactaggccttggactaagcatctgcttgtcccaggtcccaggctgaacatttgatgtgaatcttyagtctcttcacttttgagacaggcactacagccacactcacacaggtcccaaaggccagtgccacccactacctctgccatctccactcctgcattccac

SEQ ID NO: 38487 - DNA, 201 bp, Homo sapiens; identical to SEQ ID NO: 34130

SEQ ID NO: 38488 - DNA, 201 bp, Homo sapiens
gtagagattggagtgaactgagatcatgccattgcactccagcctgggcaacagagtgagactccatctcaaaaagaaaaaaaaaagaaaagaaatagtcycctggagcccctggccctgacctcccaaaagccagagtgaactttcaatctcaccgtaggctgaccccctgtgtccattttaagtcagaggactataccc

SEQ ID NO: 38489 - DNA, 201 bp, Homo sapiens
agtcagagtcttcagtaagcaatgagcaatgattgcgccactacattccagcctgggtgacaaagcgagtctctctctctctctctctctctctctctatmtatatatatatatataatatatatataaaaatatataatatattatatatgtgtatacgtatatatgtatatatatacacacacacacatagagagagat

SEQ ID NO: 38490 - DNA, 201 bp, Homo sapiens; identical to SEQ ID NO: 34132

SEQ ID NO: 38491 - DNA, 201 bp, Homo sapiens
atgcagccactgcagctggcccagcccaggctctcaacacactcaggggtccctgctggtgtgaaggtgcttcaactgcattgcaagctgcagggaaaggrcagggccaggctcgagcagggccacaactccaggcttggtgtgctgcctggagactttcacacttgcagatctgaatgaataattaatgaataagaagag

SEQ ID NO: 38492 - DNA, 201 bp, Homo sapiens; identical to SEQ ID NO: 34133

SEQ ID NO: 38493 - DNA, 201 bp, Homo sapiens
aaataaaaaagaaatataccaaaatgttagctggggtcttctctgggtagtaaagtgctgggggatattttccaaagtccttctttacattctctgagttyttccatgttcttcaatgagtatttaataagcagataaaaactaatacaacaaaggattttttctgtgtgcttttttgacctttggaggaagagattagag

SEQ ID NO: 38494 - DNA, 201 bp, Homo sapiens
agcaggctgccatgcagccactgcagctggcccagcccaggctctcaacacactcaggggtccctgctggtgtgaaggtgcttcaactgcattgcaagctkcagggaaagggcagggccaggctcgagcagggccacaactccaggcttggtgtgctgcctggagactttcacacttgcagatctgaatgaataattaatg

SEQ ID NO: 38495 - DNA, 201 bp, Homo sapiens
aaggcatttccactggcctcccctccttcccctccttcccctccttcccctccttcccttcctttccttccttcccttccttccactctctcttccccttytcttctcctctctctacccctctcccctcccctcccttccaatcgcctctcttccccactcttctccccagcacccaagctgccccttttctcttctgaa

SEQ ID NO: 38496 - DNA, 201 bp, Homo sapiens; identical to SEQ ID NO: 34135

SEQ ID NO: 38497 - DNA, 201 bp, Homo sapiens
ggagtcagagtcttcagtaagcaatgagcaatgattgcgccactacattccagcctgggtgacaaagcgagtctctctctctctctctctctctctctctmtatatatatatatatataatatatatataaaaatatataatatattatatatgtgtatacgtatatatgtatatatatacacacacacacatagagagag

SEQ ID NO: 38498 - DNA, 201 bp, Homo sapiens; identical to SEQ ID NO: 34136

SEQ ID NO: 38499 - DNA, 201 bp, Homo sapiens; identical to SEQ ID NO: 8333

SEQ ID NO: 38500 - DNA, 201 bp, Homo sapiens; identical to SEQ ID NO: 34137

SEQ ID NO: 38501 - DNA, 201 bp, Homo sapiens; identical to SEQ ID NO: 34141

SEQ ID NO: 38502 - DNA, 201 bp, Homo sapiens; identical to SEQ ID NO: 34142

SEQ ID NO: 38503 - DNA, 201 bp, Homo sapiens; identical to SEQ ID NO: 34143

SEQ ID NO: 38504 - DNA, 201 bp, Homo sapiens
tggccagggcaatcccagaaggctcacttgtggggctgttggtagaaggtctcagttcctccctatgtgggctactcacagggctgctcaaatgtgacttrgagagagagagagagagagagagagagagagagagaggcttgtttgtttagtgtccaggaccgagagaggatatagagagaaagcacaaaagagagagag

SEQ ID NO: 38505 - DNA, 201 bp, Homo sapiens; identical to SEQ ID NO: 8337

SEQ ID NO: 38506 - DNA, 201 bp, Homo sapiens
aagtagatgtggcaaagccatgttgcaaaagaagccctggtgggtgacactctttggatggcccctgcctctccggaaggcaccagcgttggtttctctcygcctcaccttcccatgcaggtgggcacgtttgtgcttgggctcctgctggttatgccccagaagcacactcttccctatctgcagtcccagcccatgtgt

SEQ ID NO: 38507 - DNA, 201 bp, Homo sapiens; identical to SEQ ID NO: 8338

SEQ ID NO: 38508 - DNA, 201 bp, Homo sapiens; identical to SEQ ID NO: 34147

SEQ ID NO: 38509 - DNA, 201 bp, Homo sapiens
accaatgcctggggaaaagcagaccaatgaagacttgtaagagcccagaaaagaggctgggagaaggtcaggaatggggtaaacgtggccttggggcatcygcctggagctccaggtgaccagtggcacccagaacaattcttgaccctctgcaggtcctccaaagcatcctcagtaggacctgcagaaggtcaaaaattt

SEQ ID NO: 38510 - DNA, 201 bp, Homo sapiens; identical to SEQ ID NO: 6913

SEQ ID NO: 38511 - DNA, 201 bp, Homo sapiens
cacatatgtttattgtggcaccattcacaatagcaaagacttggaaccaacccaaatgtccaccaataatagactggataaagaaaatatggcacatatamaccatggaatactatgcagccataaaaaaggatgagttcgtgtccttttcagggacatggatgaagctggaaaccatcattctcagcaaactaatacagg

SEQ ID NO: 38512 - DNA, 201 bp, Homo sapiens
cgagtgatcatccacaccgccaggacgcaagcccgttatttctgatgcaaaacccaggctccctccagggctggcacagaggactgccagaggagtcaggrggcctccaccttccccagctgcgcaacctcagagggtgtctccttatctctggggtcactgtgtcttcatggccaggctgggcacaggtcagctgggagt

SEQ ID NO: 38513 - DNA, 201 bp, Homo sapiens
ttggaaccaacccaaatgtccaccaataatagactggataaagaaaatatggcacatatacaccatggaatactatgcagccataaaaaaggatgagttcrtgtccttttcagggacatggatgaagctggaaaccatcattctcagcaaactaatacaggaacaggaaaccaaacaccacatgttctcactcataagtgg

SEQ ID NO: 38514 - DNA, 201 bp, Homo sapiens; identical to SEQ ID NO: 34149

SEQ ID NO: 38515 - DNA, 201 bp, Homo sapiens
ggcttgagggacagtgcccactggtgaggcaagatgggaacctccaattgattgtttcaggatccccaaagctcttctaacacaatcagactcttcagagrcccccaggccctttttgacctgcctctggctcctggcccacctcatccctcactaccctcctccctgaaacactgagatcacccaccgccccgtggagca

SEQ ID NO: 38516 - DNA, 201 bp, Homo sapiens
acctatggttccagctactcagaaggctgaggcggcaggatatcttgagtcgaggcggcaggatatcttgagtccaggagtcagagtcttcagtaagcaaygagcaatgattgcgccactacattccagcctgggtgacaaagcgagtctctctctctctctctctctctctctctatatatatatatatatataatatat

SEQ ID NO: 38517 - DNA, 201 bp, Homo sapiens; identical to SEQ ID NO: 34150

SEQ ID NO: 38518 - DNA, 201 bp, Homo sapiens
caaagttttccatctcgagggactataacctgaacgacatacttctccagctgggcattgaggaagccttcaccagcaaggctgacctgtcagggatcacrggggccaggaacctagcagtctcccaggtgagtctttagacttgggtcaattcatcctttgtatccgaacttgaattggtgaaggccagatggacttttg

SEQ ID NO: 38519 - DNA, 201 bp, Homo sapiens
agtcgaggcggcaggatatcttgagtccaggagtcagagtcttcagtaagcaatgagcaatgattgcgccactacattccagcctgggtgacaaagcgagyctctctctctctctctctctctctctctatatatatatatatatataatatatatataaaaatatataatatattatatatgtgtatacgtatatatgta

SEQ ID NO: 38520 - DNA, 201 bp, Homo sapiens; identical to SEQ ID NO: 6920

SEQ ID NO: 38521 - DNA, 201 bp, Homo sapiens
atatatatatatatataatatatatataaaaatatataatatattatatatgtgtatacgtatatatgtatatatatacacacacacacatagagagagakatatatataaagacacacacacacacacacacacacacacacacacacacacattcaattccaaaactgggagcctgaaagtcatttaagaaagatgggc

SEQ ID NO: 38522 - DNA, 201 bp, Homo sapiens; identical to SEQ ID NO: 6893

SEQ ID NO: 38523 - DNA, 201 bp, Homo sapiens; identical to SEQ ID NO: 34154

SEQ ID NO: 38524 - DNA, 201 bp, Homo sapiens
aggcatttccactggcctcccctccttcccctccttcccctccttcccctccttcccttcctttccttccttcccttccttccactctctcttcccctttycttctcctctctctacccctctcccctcccctcccttccaatcgcctctcttccccactcttctccccagcacccaagctgccccttttctcttctgaat

SEQ ID NO: 38525 - DNA, 201 bp, Homo sapiens; identical to SEQ ID NO: 6895

SEQ ID NO: 38526 - DNA, 201 bp, Homo sapiens
gcagtgggcccagggagtgcatgtgggcagctgtgtggggtagagaggaaggagcaccagccttgggttcagaccgtggtggctggtgtgacctggagcargtcgctgctcttctctggagctcagctacctcctgaagagaaaggaatgtcctttccccaccacccctgttttcactgggtgattgtgagaatccggtga

SEQ ID NO: 38527 - DNA, 201 bp, Homo sapiens; identical to SEQ ID NO: 34156

SEQ ID NO: 38528 - DNA, 201 bp, Homo sapiens; identical to SEQ ID NO: 34157

SEQ ID NO: 38529 - DNA, 201 bp, Homo sapiens
cctcctctcctccaatgactctgatgattcctagtataggaggcaaagtcacctgcttagtgatatttgccacaggttggggcaggaaaaggcacaaaatrggacacagagtgggccacggtgtcacggcagttcagccaggctcactgatgagcgccttggagatccagctgcaggaattcttggtggttccaggcttta

SEQ ID NO: 38530 - DNA, 201 bp, Homo sapiens; identical to SEQ ID NO: 34159

SEQ ID NO: 38531 - DNA, 201 bp, Homo sapiens; identical to SEQ ID NO: 34161

SEQ ID NO: 38532 - DNA, 201 bp, Homo sapiens; identical to SEQ ID NO: 34160

SEQ ID NO: 38533 - DNA, 201 bp, Homo sapiens; identical to SEQ ID NO: 34162

SEQ ID NO: 38534 - DNA, 201 bp, Homo sapiens
ctcctccaatgactctgatgattcctagtataggaggcaaagtcacctgcttagtgatatttgccacaggttggggcaggaaaaggcacaaaatgggacayagagtgggccacggtgtcacggcagttcagccaggctcactgatgagcgccttggagatccagctgcaggaattcttggtggttccaggctttacagaca

SEQ ID NO: 38535 - DNA, 201 bp, Homo sapiens; identical to SEQ ID NO: 34164

SEQ ID NO: 38536 - DNA, 201 bp, Homo sapiens; identical to SEQ ID NO: 34165

SEQ ID NO: 38537 - DNA, 201 bp, Homo sapiens
cagagccacaggtaaaacgcagcggcacaacccctcgaccctaaaatcagaagcctatctgtgtcctggcaaggagagaagcacgagtgatcatccacacygccaggacgcaagcccgttatttctgatgcaaaacccaggctccctccagggctggcacagaggactgccagaggagtcagggggcctccaccttcccca

SEQ ID NO: 38538 - DNA, 201 bp, Homo sapiens
cacctgctggtcactagctattgcccttaaatggcttcctgacgctagctgcagggacaagacagcacctgtcctgatttactacctccctcactaaccaraagtgaagtccaagcctgagaggcactgacaccaataaaagacacctacttactctctcattcagcccacgcaaattgccaaccctccaaatgcaggccc

SEQ ID NO: 38539 - DNA, 201 bp, Homo sapiens; identical to SEQ ID NO: 34166

SEQ ID NO: 38540 - DNA, 201 bp, Homo sapiens; identical to SEQ ID NO: 34167

SEQ ID NO: 38541 - DNA, 201 bp, Homo sapiens; identical to SEQ ID NO: 34168

SEQ ID NO: 38542 - DNA, 201 bp, Homo sapiens; identical to SEQ ID NO: 34169

SEQ ID NO: 38543 - DNA, 201 bp, Homo sapiens; identical to SEQ ID NO: 34170

SEQ ID NO: 38544 - DNA, 201 bp, Homo sapiens; identical to SEQ ID NO: 34171

SEQ ID NO: 38545 - DNA, 201 bp, Homo sapiens; identical to SEQ ID NO: 34172

SEQ ID NO: 38546 - DNA, 201 bp, Homo sapiens
ccaaaacagacagcttttaaatatttcacaagctaagcttcatacatttttaaaagattatgaggaagaaggaagaaaaggagaaagacaaagaggagtcrggggagaagaggagacagagatcatatgcgaccatcaaagtctaaagcacttactatttggcccattacagaaaaaagtttgcagatccctggaatgtag

SEQ ID NO: 38547 - DNA, 201 bp, Homo sapiens
ggaggatgaaaggatcaggaaaactggaactcgtgttagtttgtgattttagatagagtagccattaggtgatgtttgagcatccatataacagaggggargggtggagtcatgttggtatattagggaaaagcattcctggcagagggaacagtcagtgcaaggcctctgaggtggaagtgagcttgatgtggtcaaaga

SEQ ID NO: 38548 - DNA, 201 bp, Homo sapiens
caggagtcagagtcttcagtaagcaatgagcaatgattgcgccactacattccagcctgggtgacaaagcgagtctctctctctctctctctctctctctmtatatatatatatatatataatatatatataaaaatatataatatattatatatgtgtatacgtatatatgtatatatatacacacacacacatagagag

SEQ ID NO: 38549 - DNA, 201 bp, Homo sapiens; identical to SEQ ID NO: 6907

SEQ ID NO: 38550 - DNA, 201 bp, Homo sapiens
aggagtcagagtcttcagtaagcaatgagcaatgattgcgccactacattccagcctgggtgacaaagcgagtctctctctctctctctctctctctctcwatatatatatatatatataatatatatataaaaatatataatatattatatatgtgtatacgtatatatgtatatatatacacacacacacatagagaga

SEQ ID NO: 38551 - DNA, 201 bp, Homo sapiens
tctctctctatatatatatatatatataatatatatataaaaatatataatatattatatatgtgtatacgtatatatgtatatatatacacacacacacatagagagagatatatatataaagacacacacacacacacacacacacacacacacacacacacattcaattccaaaactgggagcctgaaagtcatttaa

SEQ ID NO: 38552 - DNA, 201 bp, Homo sapiens; identical to SEQ ID NO: 6914

SEQ ID NO: 38553 - DNA, 201 bp, Homo sapiens
ctctctctatatatatatatatatataatatatatataaaaatatataatatattatatatgtgtatacgtatatatgtatatatatacacacacacacatagagagagatatatatataaagacacacacacacacacacacacacacacacacacacacacattcaattccaaaactgggagcctgaaagtcatttaag

SEQ ID NO: 38554 - DNA, 201 bp, Homo sapiens; identical to SEQ ID NO: 6916

SEQ ID NO: 38555 - DNA, 201 bp, Homo sapiens
atataaaaatatataatatattatatatgtgtatacgtatatatgtatatatatacacacacacacatagagagagatatatatataaagacacacacacmcacacacacacacacacacacacacacacattcaattccaaaactgggagcctgaaagtcatttaagaaagatgggcccagacagttattggtcatctta

SEQ ID NO: 38556 - DNA, 201 bp, Homo sapiens
tgcaccgagtggccatggcatgtgtggccctgtctgcttatccttggaaggtgacagcgattccctgtgtagctctcacatgcacaggggcccatggactyttcagtctggagggtcctgggcctcctgacagcaataaataatttcgttggacacgttgcttgtgcctttccatgctgactatcagactctgcgcccctg

SEQ ID NO: 38557 - DNA, 201 bp, Homo sapiens
ttgcttgtgcctttccatgctgactatcagactctgcgcccctgaggctacctgtgccccaaagacaagccccttgagctcccatgcaggctcagctccaycccaagatctgggctccttctgccttcagctgcagcagcctgcccaggactacctaagcttgtggccaagctcacccagacctcaggcccagggttggga

SEQ ID NO: 38558 - DNA, 201 bp, Homo sapiens
agagaatgctcaatagatacttgttgaatgaaggatggaatgaacggacaaacacatgaatgaatgaataaaaatagaaataggacaccttcctccttcakgggactcagagtttaatggaagacacagcctcctgtataattgtaagaccaggcagacagtgacaggcatcttaagagggctataaactaagggaggggg

SEQ ID NO: 38559 - DNA, 201 bp, Homo sapiens
tgtgtcttgttaacaaaatgtttacaggcagtgtgcttggtaaaagtcatcgccattctctagtctcaataaaccaggggcacaatgcactgcggaaagcygcagggacctctgcccttgaaagcagggtattgtccaaggtttctccccatgtgatagtctgaaatatggcctcatgggatgggaaagacctgaccgtcc

SEQ ID NO: 38560 - DNA, 201 bp, Homo sapiens
gtgtcttgttaacaaaatgtttacaggcagtgtgcttggtaaaagtcatcgccattctctagtctcaataaaccaggggcacaatgcactgcggaaagctrcagggacctctgcccttgaaagcagggtattgtccaaggtttctccccatgtgatagtctgaaatatggcctcatgggatgggaaagacctgaccgtccc

SEQ ID NO: 38561 - DNA, 201 bp, Homo sapiens; identical to SEQ ID NO: 34177

SEQ ID NO: 38562 - DNA, 201 bp, Homo sapiens; identical to SEQ ID NO: 34178

SEQ ID NO: 38563 - DNA, 201 bp, Homo sapiens; identical to SEQ ID NO: 34179

SEQ ID NO: 38564 - DNA, 201 bp, Homo sapiens; identical to SEQ ID NO: 34180

SEQ ID NO: 38565 - DNA, 201 bp, Homo sapiens; identical to SEQ ID NO: 34181

SEQ ID NO: 38566 - DNA, 201 bp, Homo sapiens; identical to SEQ ID NO: 34182

SEQ ID NO: 38567 - DNA, 201 bp, Homo sapiens; identical to SEQ ID NO: 34183

SEQ ID NO: 38568 - DNA, 201 bp, Homo sapiens; identical to SEQ ID NO: 6894

SEQ ID NO: 38569 - DNA, 201 bp, Homo sapiens
agcagaatgaccaagaggttcagccttagctaggaattgggagaggacagagaggaaaggagactaattggagagatatttattagacagaattgatgagrcttcatggttgattgtgtgggggacagaaaggaagcaaagttgctgggtcgggaacttggggaactgaaatccacatgccattctatgagctaagcatta

SEQ ID NO: 38570 - DNA, 201 bp, Homo sapiens; identical to SEQ ID NO: 6896

SEQ ID NO: 38571 - DNA, 201 bp, Homo sapiens; identical to SEQ ID NO: 6897

SEQ ID NO: 38572 - DNA, 201 bp, Homo sapiens; identical to SEQ ID NO: 34189

SEQ ID NO: 38573 - DNA, 201 bp, Homo sapiens; identical to SEQ ID NO: 6898

SEQ ID NO: 38574 - DNA, 201 bp, Homo sapiens; identical to SEQ ID NO: 34190

SEQ ID NO: 38575 - DNA, 201 bp, Homo sapiens
ttggaaggctttgaggagaatgggtgtgaatttatgattgcaggtggggtggaagggagaataactatttgggtttgggtgcctgggtgatccccagttckctgaataggaaacccagcagggacttgctggcaagggaagtcgatacattcagatttgaacctcccatgtctgaggttcctgggagacaccccaggggtt

SEQ ID NO: 38576 - DNA, 201 bp, Homo sapiens; identical to SEQ ID NO: 34191

SEQ ID NO: 38577 - DNA, 201 bp, Homo sapiens; identical to SEQ ID NO: 34192

SEQ ID NO: 38578 - DNA, 201 bp, Homo sapiens; identical to SEQ ID NO: 6899

SEQ ID NO: 38579 - DNA, 201 bp, Homo sapiens; identical to SEQ ID NO: 6900

SEQ ID NO: 38580 - DNA, 201 bp, Homo sapiens; identical to SEQ ID NO: 34195

SEQ ID NO: 38581 - DNA, 201 bp, Homo sapiens
cttctatttttccctgtgccatacaaagagatgttatctgctgagtccaccatggggaagcataaaacccagaagtctggaggaggggagacgaggacacwtcaggaaacctcgatgttctagcagtcactaataagggtcccttgggggctggagactactgtgtcactagcctgtacagttgtgtggttctaggtatac

SEQ ID NO: 38582 - DNA, 201 bp, Homo sapiens
caggaaacctcgatgttctagcagtcactaataagggtcccttgggggctggagactactgtgtcactagcctgtacagttgtgtggttctaggtatactmggtagttcagacatagacaaaaaggggatagactgcaagtggctactggagccaaagtttcccctggctacaggacggagggaccatcagtggctgacac

SEQ ID NO: 38583 - DNA, 201 bp, Homo sapiens; identical to SEQ ID NO: 34196

SEQ ID NO: 38584 - DNA, 201 bp, Homo sapiens; identical to SEQ ID NO: 34197

SEQ ID NO: 38585 - DNA, 201 bp, Homo sapiens
atagtctgaaatatggcctcatgggatgggaaagacctgaccgtcccccagcccgacacccgtaaagggtctgtgctgaggtggattagtaaaagaggaargcctcttgcagttgagatagaggaaggccactgtctcctgcctgcccctgggaactgaatgtctcggtataaaacctgattgtacatttgttcaattctg

SEQ ID NO: 38586 - DNA, 201 bp, Homo sapiens; identical to SEQ ID NO: 34198

SEQ ID NO: 38587 - DNA, 201 bp, Homo sapiens; identical to SEQ ID NO: 34199

SEQ ID NO: 38588 - DNA, 201 bp, Homo sapiens
aaacaccacatgttctcactcataagtgggagctgaacaacgaaaacatatggacacagggaggggactatcacacattggggcctgttggggggttgggkgctggcagagggatagcattaggagaaatacctaatgtaaatgacaagttgatgggtgcagcaaaccaatatggcacatgtatacctatgtaaaaaacct

SEQ ID NO: 38589 - DNA, 201 bp, Homo sapiens; identical to SEQ ID NO: 34200

SEQ ID NO: 38590 - DNA, 201 bp, Homo sapiens
ctttagaaatacaccaaaatgtggctgggtgcggtggctcatgcctgtaatcccagcactttgggaggctgaggtgggcagatcacgaggtcaggagttcragaccagtccgaccaacaaggtgaaaccctgtctctacgaaaaatacaaaaattagctgggcgtggtggtgtgtgcctgtagtcccagctactcgggagg

SEQ ID NO: 38591 - DNA, 201 bp, Homo sapiens
tagaggcatcctctgtgtctgggttttcacacctgcaaagggtggaggtgccctggggcctctatggtcatttctgccttgatacttacagattcggattygagtcagctgtgcatctgaccctcagggaagaggtgctgtccccttgcctggagcagggtgcagctctcagaacatgtggcagatgtgattattgcagca

SEQ ID NO: 38592 - DNA, 201 bp, Homo sapiens
aaaatggcaacaattatggtacctacctcaaagggtgaaatgaagcagagtgatgtgtgtcgggtgccccagagagcacctacctgagggaggctccaaarctagcaagaggcagcaggacagggaccaggacgcaggctgggtggagggcagtgggaggtggtcggggctccatctggccctctgagacttaaaggagct

SEQ ID NO: 38593 - DNA, 201 bp, Homo sapiens
ggagggcagtgggaggtggtcggggctccatctggccctctgagacttaaaggagctttgcttttcagagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 38594 - DNA, 201 bp, Homo sapiens; identical to SEQ ID NO: 6909

SEQ ID NO: 38595 - DNA, 201 bp, Homo sapiens
tcagcctctggtctgagtcagtgtggtgcttttcactctgatttaaacttgtccggcaaacagaaagaaggagctctcctttcaaaccactccagggcgcrtaggagctagagctccctccttgcaggggtgctgctagactaggccaggaagtccctctgtctggatgcacctggggctcctgccctgcacatgtgggag

SEQ ID NO: 38596 - DNA, 201 bp, Homo sapiens
aaatgagggcagaaatggcattgttcccatctggggaagagcctcaagggtgggcagtatacaaaacatgaccctttgccagattctaactggtccagtgmccaatcccattgatagaaactcaaccaatgcaaacctcagcctgcaagctccgaaggggcagagtgcaagccggtagcttttgcctcctggagcccacag

SEQ ID NO: 38597 - DNA, 201 bp, Homo sapiens; identical to SEQ ID NO: 6915

SEQ ID NO: 38598 - DNA, 201 bp, Homo sapiens
gaattcaagaaaggaaggtttcccctagaaaacggttttcgtcttttctcttaaatccagatagaataagaagcgaaggccgttacagcagagagaaagtygagtcaagcagagatcagatactaaagacactagactaaccagacattcgggccctcagttgaacagctgaggatgtcagaagatgttaaggaggcaaaa

SEQ ID NO: 38599 - DNA, 201 bp, Homo sapiens; identical to SEQ ID NO: 34203

SEQ ID NO: 38600 - DNA, 201 bp, Homo sapiens; identical to SEQ ID NO: 34204

SEQ ID NO: 38601 - DNA, 201 bp, Homo sapiens; identical to SEQ ID NO: 8388

SEQ ID NO: 38602 - DNA, 201 bp, Homo sapiens
ctggaagagtatgatttggccttagtgttgcttcacttttctgtcttaattgccctgtggtttcatctggtcatgggagtccacgatgacatgtgccatcyttgtatgaatggtgcttgcagaaccgaaggaagggcctgtaccaatgcctggggaaaagcagaccaatgaagacttgtaagagcccagaaaagaggctgg

SEQ ID NO: 38603 - DNA, 201 bp, Homo sapiens
agctaaagagaaaaacatgaacaagaccatgctttgtaaatcatgttaaggatctcagagtttattcaaagagtgatgagccacagtgaatattatacacrgggagctgttttgattaagtttcattagaaagatcaccgtggctgagcagggaaggatggatacagtattgagtgtggatttggtgaaaagaagagaagc

SEQ ID NO: 38604 - DNA, 201 bp, Homo sapiens; identical to SEQ ID NO: 34205

SEQ ID NO: 38605 - DNA, 201 bp, Homo sapiens
acagcgattccctgtgtagctctcacatgcacaggggcccatggactcttcagtctggagggtcctgggcctcctgacagcaataaataatttcgttggamacgttgcttgtgcctttccatgctgactatcagactctgcgcccctgaggctacctgtgccccaaagacaagccccttgagctcccatgcaggctcagct

SEQ ID NO: 38606 - DNA, 201 bp, Homo sapiens
aggcagtgtgcttggtaaaagtcatcgccattctctagtctcaataaaccaggggcacaatgcactgcggaaagctgcagggacctctgcccttgaaagcwgggtattgtccaaggtttctccccatgtgatagtctgaaatatggcctcatgggatgggaaagacctgaccgtcccccagcccgacacccgtaaagggtc

SEQ ID NO: 38607 - DNA, 201 bp, Homo sapiens
tcgccattctctagtctcaataaaccaggggcacaatgcactgcggaaagctgcagggacctctgcccttgaaagcagggtattgtccaaggtttctcccyatgtgatagtctgaaatatggcctcatgggatgggaaagacctgaccgtcccccagcccgacacccgtaaagggtctgtgctgaggtggattagtaaaag

SEQ ID NO: 38608 - DNA, 201 bp, Homo sapiens
gcccctgggaactgaatgtctcggtataaaacctgattgtacatttgttcaattctgagataggacaaaaaccgccctatggtgggaggcgagacatgttkgcagcaatgctgccttgttattctttactccactgagatgtttgggtggagagaaacataaatctggcctacgtgcacatccaggcatagtaccttccct

SEQ ID NO: 38609 - DNA, 201 bp, Homo sapiens
gctgggatccaggagggagccatgcatgtgagaagtcattgagttctggataaatctgagggtagaggaacttgctgggacacacggaattgagctgaccratttcatggggacacagtgaggaggagcagtagttccgggcccagaccctgcagtgggcccagggagtgcatgtgggcagctgtgtggggtagagaggaa

SEQ ID NO: 38610 - DNA, 201 bp, Homo sapiens
aggcgagacatgtttgcagcaatgctgccttgttattctttactccactgagatgtttgggtggagagaaacataaatctggcctacgtgcacatccaggyatagtaccttcccttaaacttaattatgacgtagattctattgctcacatgtttgttgctgaccttctccttattatcaccctgccctcctactacattc

SEQ ID NO: 38611 - DNA, 201 bp, Homo sapiens
gttattctttactccactgagatgtttgggtggagagaaacataaatctggcctacgtgcacatccaggcatagtaccttcccttaaacttaattatgacrtagattctattgctcacatgtttgttgctgaccttctccttattatcaccctgccctcctactacattcctttttgctgaaataatgaagataataatca

SEQ ID NO: 38612 - DNA, 201 bp, Homo sapiens; identical to SEQ ID NO: 34207

SEQ ID NO: 38613 - DNA, 201 bp, Homo sapiens
tactccactgagatgtttgggtggagagaaacataaatctggcctacgtgcacatccaggcatagtaccttcccttaaacttaattatgacgtagattctwttgctcacatgtttgttgctgaccttctccttattatcaccctgccctcctactacattcctttttgctgaaataatgaagataataatcaataaaaact

SEQ ID NO: 38614 - DNA, 201 bp, Homo sapiens; identical to SEQ ID NO: 34208

SEQ ID NO: 38615 - DNA, 201 bp, Homo sapiens; identical to SEQ ID NO: 34209

SEQ ID NO: 38616 - DNA, 201 bp, Homo sapiens; identical to SEQ ID NO: 6903

SEQ ID NO: 38617 - DNA, 201 bp, Homo sapiens
cttacccacttcccatgattcctgagagtcaagaggacgggagctgtggaatgtgttagtcatctactgctgcagagtaaatagcccatgattatctcacrgagttcctgagggtcaggaatccaggattgctgttggccagggcaatcccagaaggctcacttgtggggctgttggtagaaggtctcagttcctccctat

SEQ ID NO: 38618 - DNA, 201 bp, Homo sapiens
cccacttcccatgattcctgagagtcaagaggacgggagctgtggaatgtgttagtcatctactgctgcagagtaaatagcccatgattatctcacggagytcctgagggtcaggaatccaggattgctgttggccagggcaatcccagaaggctcacttgtggggctgttggtagaaggtctcagttcctccctatgtgg

SEQ ID NO: 38619 - DNA, 201 bp, Homo sapiens; identical to SEQ ID NO: 34212

SEQ ID NO: 38620 - DNA, 201 bp, Homo sapiens; identical to SEQ ID NO: 34213

SEQ ID NO: 38621 - DNA, 201 bp, Homo sapiens; identical to SEQ ID NO: 34214

SEQ ID NO: 38622 - DNA, 201 bp, Homo sapiens; identical to SEQ ID NO: 6921

SEQ ID NO: 38623 - DNA, 201 bp, Homo sapiens; identical to SEQ ID NO: 6889

SEQ ID NO: 38624 - DNA, 201 bp, Homo sapiens; identical to SEQ ID NO: 34218

SEQ ID NO: 38625 - DNA, 201 bp, Homo sapiens; identical to SEQ ID NO: 34220

SEQ ID NO: 38626 - DNA, 201 bp, Homo sapiens
ggcatcaggactgtgcaaaactagttggcaggggagttgggaggagcaaacattcaacagcacaaagacaggccagcactaggtgctcaatgcacattagwccccttagtggcacacaggcaggtcgctgaactcctgcgcatctgtgtttcccgtgtgtaatgttctgctgtccccacaggtggtccataaggctgtgct

SEQ ID NO: 38627 - DNA, 201 bp, Homo sapiens; identical to SEQ ID NO: 8325

SEQ ID NO: 38628 - DNA, 201 bp, Homo sapiens
agctgatcactgaggaagactgaggatggggagatggggtccctaggaggtccaagaatgacctgttagaagtgccatatgaactataaaggctacttttyccccccaaagaggattttttcacattgactctcagttttctcaactgtaaagtggaaaccatgacagtgtgtgcatgcctgtgtcatccgtgtgtaagaa

SEQ ID NO: 38629 - DNA, 201 bp, Homo sapiens; identical to SEQ ID NO: 34221

SEQ ID NO: 38630 - DNA, 201 bp, Homo sapiens
acaaacaaaaaatcctgtcctcgtagagtgtacatttaatatcatttcatttcatcttgattaccactctgtcagggaatattgccttgcatcttagacaygaggaaattaagctgtagagatttcccatgatttgtttgaagtgagtcagttggtgagtcagacatcagagattcaagccaggtcagctcatgccagagc

SEQ ID NO: 38631 - DNA, 201 bp, Homo sapiens
cctcccggagggagaacggacccaacaccaaggaggaagggatgactcagcagccctcaaaacagagtcaggagttctccctgcttttgccaaaccctctrcaggcacctcttatccatacagggacgcagccaaaggcctagctgtgctgaaggaaatttgcaaatcctgcctcaaatctgcagccagtatctcccccag

SEQ ID NO: 38632 - DNA, 201 bp, Homo sapiens
caggacgcaggctgggtggagggcagtgggaggtggtcggggctccatctggccctctgagacttaaaggagctttgcttttcagagttgagaatggagaraatgttacctctcctggctctggggctcttggcggctgggttctgccctgctgtcctctgccaccctaacagcccacttgacgaggagaatctgacccag

SEQ ID NO: 38633 - DNA, 201 bp, Homo sapiens; identical to SEQ ID NO: 34222

SEQ ID NO: 38634 - DNA, 201 bp, Homo sapiens; identical to SEQ ID NO: 34223

SEQ ID NO: 38635 - DNA, 201 bp, Homo sapiens
aggtgctccattctttacctcgatggctctgggcaaatcatactcagcatctgggtctccatttgcacatctaggcatcaggactgtgcaaaactagttgrcaggggagttgggaggagcaaacattcaacagcacaaagacaggccagcactaggtgctcaatgcacattagaccccttagtggcacacaggcaggtcgc

SEQ ID NO: 38636 - DNA, 201 bp, Homo sapiens; identical to SEQ ID NO: 8335

SEQ ID NO: 38637 - DNA, 201 bp, Homo sapiens
acaggggttaagaaattgaggaacagattatttattttccaatcagaagggggtgactgtagaggaaaccagggaagaccatgctgcgaggtgggaggcasgtaggtactgatcagcagaggttcagatactttttttttctcgttttctagagagataggtgagctctacctgccaaagttttccatctcgagggactat

SEQ ID NO: 38638 - DNA, 201 bp, Homo sapiens
ggatcacaggggccaggaacctagcagtctcccaggtgagtctttagacttgggtcaattcatcctttgtatccgaacttgaattggtgaaggccagatgkacttttgggtactcttgaacttgggttaatgcacgtgcatttctcattatatactcaccctgcttgggacacccccaagccaagaagagctaggttacag

SEQ ID NO: 38639 - DNA, 201 bp, Homo sapiens; identical to SEQ ID NO: 8384

SEQ ID NO: 38640 - DNA, 201 bp, Homo sapiens; identical to SEQ ID NO: 6910

SEQ ID NO: 38641 - DNA, 201 bp, Homo sapiens; identical to SEQ ID NO: 6917

SEQ ID NO: 38642 - DNA, 201 bp, Homo sapiens; identical to SEQ ID NO: 34235

SEQ ID NO: 38643 - DNA, 201 bp, Homo sapiens
gaaaacagtcaggtggggtgagggtggaagtaaggaccagctcagaggtcactgagggtgcagccagacaggctgggacccacgtgggcagcagaggtggrgagtagggatgtggagggggagacccagccccacgctgggggccctgaggggaggtggaggctgagccaggagaagaggcaccacccactcacttcctgc

SEQ ID NO: 38644 - DNA, 201 bp, Homo sapiens
taaataaagaggacatgggtaacaaaagggtaaattggggaggccacacagtagggagaaagctatgggatctgtattcttgtggaccacaatgagctcgrgggttaaaggataaagtccaaggtaaataatagtgttgagacctctgggtatatcaaatattaaaacatcagaaacatcaatgttctggaagaaagtaag

SEQ ID NO: 38645 - DNA, 201 bp, Homo sapiens
aggctgaggtgggtggatcacgaggtcaggagttcaagacaagcctggccaagatagtgaaaccccatctctactaaaaatacaaaaattagcatacctgyaatcctagctacttgggaggctgaggtagggaattgcttgaacccgggaggcagaggttgcagtgagccgagatcatgccactgcaccccagcctgggcg

SEQ ID NO: 38646 - DNA, 201 bp, Homo sapiens; identical to SEQ ID NO: 34327

SEQ ID NO: 38647 - DNA, 201 bp, Homo sapiens
tgcttgaacccgggaggcagaggttgcagtgagccgagatcatgccactgcaccccagcctgggcgacagagagagactctctctcaaaaaaaaaaaaaawgattataagagaatactaggaacaactgttcactgaaaattggatgatgtagacaaaattggatgatgtagatcctttagtatctactggctaaatgagg

SEQ ID NO: 38648 - DNA, 201 bp, Homo sapiens
ttaaggacattatgctatgtgaaataagtcagtcaaaaaaaggcaaatactatatgattcaacttatatgaggtacctagaatagtcaaattcataaagayagaaagtagaatggtgattgccaagtactgggtgcaggggagaatgagtaattgttcaatgggtatggattttgagttttgcaagatgaaaatagttctg

SEQ ID NO: 38649 - DNA, 201 bp, Homo sapiens
actatatgattcaacttatatgaggtacctagaatagtcaaattcataaagacagaaagtagaatggtgattgccaagtactgggtgcaggggagaatgartaattgttcaatgggtatggattttgagttttgcaagatgaaaatagttctggggattgattgcacaacaaagaatgtacttaacacaattaaactatat

SEQ ID NO: 38650 - DNA, 201 bp, Homo sapiens
tagcattcagcatcgaaaaggaaggaaattctgacatatgctacaagacagatgaaccttaaggacattatgctatgtgaaataagtcagtcaaaaaaagkcaaatactatatgattcaacttatatgaggtacctagaatagtcaaattcataaagacagaaagtagaatggtgattgccaagtactgggtgcaggggag

SEQ ID NO: 38651 - DNA, 201 bp, Homo sapiens
ttgggaggctgaggtagggaattgcttgaacccgggaggcagaggttgcagtgagccgagatcatgccactgcaccccagcctgggcgacagagagagacwctctctcaaaaaaaaaaaaaatgattataagagaatactaggaacaactgttcactgaaaattggatgatgtagacaaaattggatgatgtagatccttt

SEQ ID NO: 38652 - DNA, 201 bp, Homo sapiens
ggttcatggtccgctcctctacctgctggggccctcacaggtcctgaaggctttgtgggttcgaaacccagccctctcctccccgcaaagcgctgcttctraggccccttcccgttgtccagcttcacatttacattgatttcacctcattctccccatattcccacttcaaaaggaagatggagaggtggaaatactttt

SEQ ID NO: 38653 - DNA, 201 bp, Homo sapiens
cttgggaggctgaggtagggaattgcttgaacccgggaggcagaggttgcagtgagccgagatcatgccactgcaccccagcctgggcgacagagagagastctctctcaaaaaaaaaaaaaatgattataagagaatactaggaacaactgttcactgaaaattggatgatgtagacaaaattggatgatgtagatcctt

SEQ ID NO: 38654 - DNA, 201 bp, Homo sapiens
accctggagcccttggatggcacttgtcagctggtgtcaccaccctaagtacccacacaaatgggctaggaagcccaagctacatgaatttcagctcctgrtgagagattcttgggccagggtcttggtagacacaagcctggtgacttcaggcagctggcaattactgggcatctaccaagggtcagccacggttccagg

SEQ ID NO: 38655 - DNA, 201 bp, Homo sapiens
ctcctctacctgctggggccctcacaggtcctgaaggctttgtgggttcgaaacccagccctctcctccccgcaaagcgctgcttctgaggccccttcccrttgtccagcttcacatttacattgatttcacctcattctccccatattcccacttcaaaaggaagatggagaggtggaaatacttttctgagatcacatc

SEQ ID NO: 38656 - DNA, 201 bp, Homo sapiens
caggtctatcaatctacattttcccaaactgtccatttctggaacctacaaactcaagagagtccttaggaatctgggcatcaccaagatcttcagcaacraggccgacctctctggagtcagtcaggaggcacccctgaagctctccaaggtgaggtcacccagaagaccgtgttgtcccctggtgtcggctggcagatt

SEQ ID NO: 38657 - DNA, 201 bp, Homo sapiens
tcccagtcacaccctggagcccttggatggcacttgtcagctggtgtcaccaccctaagtacccacacaaatgggctaggaagcccaagctacatgaattycagctcctgatgagagattcttgggccagggtcttggtagacacaagcctggtgacttcaggcagctggcaattactgggcatctaccaagggtcagcca

SEQ ID NO: 38658 - DNA, 201 bp, Homo sapiens
ctctgtgggcacagcccctgagtctccctgggggctggcattaagccctgggtcagggaggaaccttatggatgtgagagctccatcatgtcagtgaggasatcggctataggttcctgagacctgggacagcagacgcagtgcaatcctggggaccctaaacagggcccccatcccagaggaatggacatcccacacggc

SEQ ID NO: 38659 - DNA, 201 bp, Homo sapiens
tgctgctccatgccttgattctctttcctgcatggcaggtctatcaatctacattttcccaaactgtccatttctggaacctacaaactcaagagagtccytaggaatctgggcatcaccaagatcttcagcaacaaggccgacctctctggagtcagtcaggaggcacccctgaagctctccaaggtgaggtcacccaga

SEQ ID NO: 38660 - DNA, 201 bp, Homo sapiens
gtctatgtgtgttagggtacctaggtgtttctgtgtgtttgcatgtggttgtgggtgaggctgtgtgtgtgatgtttctctgtttgtctgagtctatatgkgtctgtgtgtctaggtgtttctatctagactgaggatgtgtctgtggctatgtgtctgtgtgtgtgtgtttctgtgattgtgtgtctctgagttggtgtt

SEQ ID NO: 38661 - DNA, 201 bp, Homo sapiens
agtcaggaggcacccctgaagctctccaaggtgaggtcacccagaagaccgtgttgtcccctggtgtcggctggcagattgtgtggaggttgcagttctgycctgaggctgaagaaggggctaagagacacaaatgaagacccaggccgagctcctgaggatgcctgagattcactgagatgggccatggtcagacggcgg

SEQ ID NO: 38662 - DNA, 201 bp, Homo sapiens
gatatgtctgtgtgtctaagtagttctgtctttgtgtctgcatatggctgtggatatgtctgtgtgtgtctgtgtatgtgtgtgcttctgtgtttgtgtgyccctgagtcaatgtgagtctgagagtctgtgtgtctgagtctatgtgtgttagggtacctaggtgtttctgtgtgtttgcatgtggttgtgggtgaggct

SEQ ID NO: 38663 - DNA, 201 bp, Homo sapiens
tgcgtgtgtgtctgtgtgtgtgtctgtgcatgtgtgtctgtgtgtctaggtagttctgtctttgtgtctgcatatggctgtggatatgtctgtgtgtctargtagttctgtctttgtgtctgcatatggctgtggatatgtctgtgtgtgtctgtgtatgtgtgtgcttctgtgtttgtgtgtccctgagtcaatgtgagt

SEQ ID NO: 38664 - DNA, 201 bp, Homo sapiens
gtgtgtgtgtgtggctgcgtgggtgtgtctctgcgtgtgtgtgtctctgtgtgggtatgtctgtttgtgactatgtgtgtgtgtgtctctgtgtgtgtttktgtgtgtctgtatatgtgtgtgtctctgtgtgtacatctgtgtgtctgcgtgtgtgtgtgtggctgcgtgggtatgtctgtgtgtgtgtgtctctgtgtg

SEQ ID NO: 38665 - DNA, 201 bp, Homo sapiens
cttttttcttttttttttttttctttcagatggagtttccctctgttgcccaggctggagtgcaatggtgcaatcttggctcactgtaacctctacctccyaggctcaagcgattctcctgcctcagcctcccaggtagctggcatcacaggcatgcgctaccatgcccggctaatttttttttgtatttaatagagaccg

SEQ ID NO: 38666 - DNA, 201 bp, Homo sapiens
tccctaatagggagggggcagaatatgaaatgcttcccacatgctaaagccagaaaaatattttgtggcacatgcataaaggaatagtttcatggaacatrctttagacgaccctagtgtcccagaagcagtgtcagctttgccgtctaaaatattggggttcaaatcctgcctctaccacttactagcttttgataaagg

SEQ ID NO: 38667 - DNA, 201 bp, Homo sapiens
ttttttcttttttttttttttctttcagatggagtttccctctgttgcccaggctggagtgcaatggtgcaatcttggctcactgtaacctctacctcccrggctcaagcgattctcctgcctcagcctcccaggtagctggcatcacaggcatgcgctaccatgcccggctaatttttttttgtatttaatagagaccgg

SEQ ID NO: 38668 - DNA, 201 bp, Homo sapiens
caatgcattctacctctctgaggtgctaatttcccgtcttagcatggacaaaatagcatccttgctgtcaggttgttttaaggattaaacaagtgacagakaccatggggatggtgtgtggcatacagcaggtgatggactcttctgtatctcaggctgccttcctgcccctgaggggttaaaatgccagggtgctggggg

SEQ ID NO: 38669 - DNA, 201 bp, Homo sapiens
tcaggttgttttaaggattaaacaagtgacagagaccatggggatggtgtgtggcatacagcaggtgatggactcttctgtatctcaggctgccttcctgmccctgaggggttaaaatgccagggtgctgggggccccagggcattctaagccagctcctattgtcccaggaaaacagcataggggaggggaggtggaggc

SEQ ID NO: 38670 - DNA, 201 bp, Homo sapiens
agagaggaacctggatcttggatggccatggggctcccttccacccacatccccacatgactgcacagcacaggctggttctgctggactgagcccatccrgggaagaacagcgagaccctcaggtgagatcgggctcactggagacaaacagcatggcaggagctggaggtgccccaggctgatttccaggatagggggt

SEQ ID NO: 38671 - DNA, 201 bp, Homo sapiens
gaacagcgagaccctcgggtgagatcgggctcactggagacaaaaagcatggcaggagctggaggcgccccaggctgatttccgggacaggagtttcctgracacagggactgagcatccccacagccccctagactggcccatgagcacgagaagccctgagagtgcgtggggatggcctgtgtgcaaggcagcgcagcg

SEQ ID NO: 38672 - DNA, 201 bp, Homo sapiens
cggggaagaacagcgagaccctcgggtgagatcgggctcactggagacaaaaagcatggcaggagctggaggcgccccaggctgatttccgggacaggagkttcctgaacacagggactgagcatccccacagccccctagactggcccatgagcacgagaagccctgagagtgcgtggggatggcctgtgtgcaaggcag

SEQ ID NO: 38673 - DNA, 201 bp, Homo sapiens; identical to SEQ ID NO: 8401

SEQ ID NO: 38674 - DNA, 201 bp, Homo sapiens; identical to SEQ ID NO: 8400

SEQ ID NO: 38675 - DNA, 201 bp, Homo sapiens
tgagcccatccggggaagaacagcgagaccctcgggtgagatcgggctcactggagacaaaaagcatggcaggagctggaggcgccccaggctgatttccrggacaggagtttcctgaacacagggactgagcatccccacagccccctagactggcccatgagcacgagaagccctgagagtgcgtggggatggcctgtg

SEQ ID NO: 38676 - DNA, 201 bp, Homo sapiens
ttgttacaagaaagcaatgagttaacacacgtgtgcttagaacagttcttggcataagctaagtaccttacacgtgcttgctatctttcttattctttcartgatgatggtgtaggaaagtgtttgcaatgggctgggcacatggtggatgtttaataattcatggttgcaatcacacaatgtcagtccctggtcactggg

SEQ ID NO: 38677 - DNA, 201 bp, Homo sapiens
tgtgtgtgtgtgtgtgtgattgtgtgtgtgcatctgagtatccgtgtctctgtgtgatgctatatgtcaatgtgtctttgtgtgtgtgtgtgtgtgtgtgkctctgtgtgttggcatgtaactgtaatgtctttccttgtttgtgtgtgtgtctgtgagtgtgtgtgcctgagtgcacatgtgtctctgtctctaggtgtt

SEQ ID NO: 38678 - DNA, 201 bp, Homo sapiens; identical to SEQ ID NO: 34345

SEQ ID NO: 38679 - DNA, 201 bp, Homo sapiens; identical to SEQ ID NO: 34349

SEQ ID NO: 38680 - DNA, 201 bp, Homo sapiens; identical to SEQ ID NO: 34350

SEQ ID NO: 38681 - DNA, 201 bp, Homo sapiens
gtatgaattccttggctcctctcgtcacctctctgagggtgtgtcaaggagagaggaacctggatcttggatggccatggggctcccttccacccacatcyccacatgactgcacagcacaggctggttctgctggactgagcccatccagggaagaacagcgagaccctcaggtgagatcgggctcactggagacaaaca

SEQ ID NO: 38682 - DNA, 201 bp, Homo sapiens; identical to SEQ ID NO: 34352

SEQ ID NO: 38683 - DNA, 201 bp, Homo sapiens
catgtttttctggagagctcaacctccccgggtcccttattgctgttaggcccagggctggaaccagcaatacctgagtctcccctgagctgacagcaggmgcctcagcccacgtgtgtggcagggacctccgactcatagcggggcaactccaggacaggctccaggggctggggcacaggctcctctgtgggcacagcc

SEQ ID NO: 38684 - DNA, 201 bp, Homo sapiens
tatcacagttgggaggagagggagatgcatgaagtgtgtggaatctggggagagcctaggcagaattcaggtaggctgggtttacacagcgcctctgagcyctggctgtgtgtcacggtacagtatcccgtccctctggggacagagcttctctgtccattaaataagggaggtcagtggagatctccaaggactgttgtg

SEQ ID NO: 38685 - DNA, 201 bp, Homo sapiens
cacccaaaaataactggctgtcactcctcagcccctcccctccacccctggccccctccctggatgacattaaagaaaggctgaattgccctctgcctgcrtgtgactgcaaacccctcccctgttgtttctgagtctccctttgtgcactgaggctgtgtgtggactccaggtcacagtgctgtctccgggcctcctgaa

SEQ ID NO: 38686 - DNA, 201 bp, Homo sapiens
ggactgttgtggtgtgtggaagtcattgctgatcctgacttaacccacttccttagtaaccctgggcaagtcccttatgcttcccgtgccccagtttcctmttttctaaaatgggggccagatgctgtggctcatgcctctaatcacagcattttgggaggccaagtagggaggatcccttgaggtcaggagttcaagacc

SEQ ID NO: 38687 - DNA, 201 bp, Homo sapiens; identical to SEQ ID NO: 34279

SEQ ID NO: 38688 - DNA, 201 bp, Homo sapiens
cagatgctgtggctcatgcctctaatcacagcattttgggaggccaagtagggaggatcccttgaggtcaggagttcaagaccagccagggcaacatgacraaaccctgtcttcactaaaatacaaaaaattagcctggcgtggtgtgcacgcctataatccccgctacttgggagactgaggcaggagaaacgcttgaac

SEQ ID NO: 38689 - DNA, 201 bp, Homo sapiens
acaaaaaattagcctggcgtggtgtgcacgcctataatccccgctacttgggagactgaggcaggagaaacgcttgaacccgggaggcggaggttgcagtsagccgagatcacaccactgcattccaccctgggcggtagagccagactctgtctccaaaaatataaaataaaacaaaatggggctgtggcatttgcacct

SEQ ID NO: 38690 - DNA, 201 bp, Homo sapiens
cacctcaaggtcattacagaggtaagtggagctgcagagagcaaggactcaagacccagccggccaggctgagggatgcttgcttttcctgtttgctgacyttgggcttgagtctcacctctctgggctttggtttcctcatgtgtaaaaggaagatagtagcattaccacctcacaggattgttacaagaaagcaatgag

SEQ ID NO: 38691 - DNA, 201 bp, Homo sapiens; identical to SEQ ID NO: 8390

SEQ ID NO: 38692 - DNA, 201 bp, Homo sapiens
tccttggctcctctcgtcacctctctgagggtgtgtcaaggagagaggaacctggatcttggatggccatggggctcccttccacccacatccccacatgrctgcacagcacaggctggttctgctggactgagcccatccagggaagaacagcgagaccctcaggtgagatcgggctcactggagacaaacagcatggca

SEQ ID NO: 38693 - DNA, 201 bp, Homo sapiens
tcacaaagtgcccagcacagggtgggcccctacagagggtaagagctggggggcggggctcggtcgggtgtgattttccccttctcctgccttccccagggtgggactcccctctggtgtcctggtattcacctgtgtctccacctgtagaggcaggaaggattcagccttagggatgcccccttgctctccaacaggccc

SEQ ID NO: 38694 - DNA, 201 bp, Homo sapiens
ctgtgtgtgtgtgtggctgcgtgggtgtgtctctgcgtgtgtgtgtctctgtgtgggtatgtctgtttgtgactatgtgtgtgtgtgtctctgtgtgtgtktgtgtgtgtctgtatatgtgtgtgtctctgtgtgtacatctgtgtgtctgcgtgtgtgtgtgtggctgcgtgggtatgtctgtgtgtgtgtgtctctgtg

SEQ ID NO: 38695 - DNA, 201 bp, Homo sapiens
tggaagagcaaggggctaccaggagcggccgccaagtgcgggtcacccagagagagccaggccagggcctgagtgctagaacgctgtggcactgtgtgacmcagaaaagccactttgctgagcctcccgttctcagtggcagcatgaggagagaatgcccccacctgtgagtgcaaagcagcccgtcagaggcgacggcgg

SEQ ID NO: 38696 - DNA, 201 bp, Homo sapiens
gacaaatgaaaatgaaaacacaacataccaaaatttcgtgtgcaaaaatgcagtgctaagagagaaatttgtagctgaaaatatttatgttaaaaaataaygatctcaaaccagcacctaactacacctttaggaactagagagaaaagagaacagactaaacctaaagctagcagaaagaaggaaactaaagattagagc

SEQ ID NO: 38697 - DNA, 201 bp, Homo sapiens
ggtgatttccagttcaggggctgagtcagaagctgcccagacctttgagccatgtcaggactgaggcccaacaggactggccagagggctggggagggtgracctcacatccctgggtcacagctactgcagaggccaccactgagttcaggcaggaccatccatgctccatgaggaggacagtacccaggggtgaggagg

SEQ ID NO: 38698 - DNA, 201 bp, Homo sapiens
atggttccacaggctgtacaagaagcatgatgctggcatctactcagcttctggggaggcctcaggaaacttaaaattatggcagaaggagaatcttccawggtatatatgtaacatattttctttatccaatccaccattgacgggcacatagattgagtccgtctgtgctattgtgaatagtgttgcaatgaacataca

SEQ ID NO: 38699 - DNA, 201 bp, Homo sapiens
ctctcctacctggttcatggtccgctcctctacctgctggggccctcacaggtcctgaaggctttgtgggttcgaaacccagccctctcctccccgcaaarcgctgcttctgaggccccttcccgttgtccagcttcacatttacattgatttcacctcattctccccatattcccacttcaaaaggaagatggagaggtg

SEQ ID NO: 38700 - DNA, 201 bp, Homo sapiens
ttgcttgaacccgggaggcagaggttgcagtgagccgagatcatgccactgcaccccagcctgggcgacagagagagactctctctcaaaaaaaaaaaaaatgattataagagaatactaggaacaactgttcactgaaaattggatgatgtagacaaaattggatgatgtagatcctttagtatctactggctaaatgag

SEQ ID NO: 38701 - DNA, 201 bp, Homo sapiens
ggcagcacagcgagcctctctgcacaacccacaggctctgctgggtgaggagttctccctcagcctcctctggagctgacgctgggggagagcgccgtgarcctccctgcctgaattcttatctgcgcttcacacaggaggaaactgaggcacgcagagttttagctcctcttggccagagccaggatctgaacccaggcg

SEQ ID NO: 38702 - DNA, 201 bp, Homo sapiens
aggctggttctgttggactgagcccatccggggaagaacagcgagaccctcgggtgagatcgggctcactggagacaaaaagcatggcaggagctggaggygccccaggctgatttccgggacaggagtttcctgaacacagggactgagcatccccacagccccctagactggcccatgagcacgagaagccctgagagt

SEQ ID NO: 38703 - DNA, 201 bp, Homo sapiens
tcctggacacaggcactgagcatccccacagccccctagactggcccatgagcacgagaagccctgagagtgcgtgggggtggcctgtgtgcaaggcagcrcagcgagcctctctgcacaacccacaggctctgctgggtgaggagttctccctcagcctcctctggagctgacgctgggggagagcgccgtgagcctccc

SEQ ID NO: 38704 - DNA, 201 bp, Homo sapiens
cagcgagaccctcaggtgagatcgggctcactggagacaaacagcatggcaggagctggaggtgccccaggctgatttccaggatagggggttcctggacrcaggcactgagcatccccacagccccctagactggcccatgagcacgagaagccctgagagtgcgtgggggtggcctgtgtgcaaggcagcacagcgagc

SEQ ID NO: 38705 - DNA, 201 bp, Homo sapiens
gtatgaattccttggctcctctcgtcacctctctgagggtgtgtcaaggagagaggaacctggatcttggatggccatggggctcccttccacccacatcyccacatggctgcacagcacaggctggttctgttggactgagcccatccggggaagaacagcgagaccctcgggtgagatcgggctcactggagacaaaaa

SEQ ID NO: 38706 - DNA, 201 bp, Homo sapiens
ctgagggtgtgtcaaggagagaggaacctggatcttggatggccatggggctcccttccacccacatccccacatgactgcacagcacaggctggttctgytggactgagcccatccagggaagaacagcgagaccctcaggtgagatcgggctcactggagacaaacagcatggcaggagctggaggtgccccaggctga

SEQ ID NO: 38707 - DNA, 201 bp, Homo sapiens
ctctctttttcttaccctgctcattcaaacctccagcctgagccagagtccaagaccctgttggaccccatggccactccctaagagtctcagaggaggarggatgcccttttagctctggcccttcagagcttgttacccagattccagaggacactgtgtcatctcctcactgctctccggtccccaccttcctgcccc

SEQ ID NO: 38708 - DNA, 201 bp, Homo sapiens
ccacggttccaggcccctagcgtgtatgaattccttggctcctctcgtcacctctctgagggtgtgtcaaggagagaggaacctggatcttggatggccayggggctcccttccacccacatctccacatggctgcacagcacaggctggttctgttggactgagcccatccggggaagaacagcgagaccctcgggtgag

SEQ ID NO: 38709 - DNA, 201 bp, Homo sapiens
gtcttaattctctttattctgaaacaaggacccctcactggagtggagagaatgagtccttcccagtcacaccctggagcccttggatggcacttgtcagstggtgtcaccaccctaagtacccacacaaatgggctaggaagcccaagctacatgaatttcagctcctgatgagagattcttgggccagggtcttggtag

SEQ ID NO: 38710 - DNA, 201 bp, Homo sapiens
aactgaggcacgcagagttttagctcctcttggccagagccaggatttgaacccaggcgtccgaaccttggtgatcctgcggggcagagtgagttgggggwtggaattccatttctcacaaagtgcccagcacagggtgggcccctacagagggtaagagctggggggcggggctcggtcgggtgtgattttccccttctc

SEQ ID NO: 38711 - DNA, 201 bp, Homo sapiens
gcagcgcagcgagcctctctgcacaacccacaggctctgctgggtgaggagttctccctcagcctcctctggagctgacgctgggggagagcgccgtgagyctccctgcctgaattcttatctgcgcttcacacaggaggaaactgaggcacgcagagttttagctcctcttggccagagccaggatttgaacccaggcgt

SEQ ID NO: 38712 - DNA, 201 bp, Homo sapiens
gtgtgtgtgtctctgtgtgggtatgtctgtttgtgactatgtgtgtgtgtgtctctgtgtgtgtttgtgtgtgtctgtatatgtgtgtgtctctgtgtgtrcatctgtgtgtctgcgtgtgtgtgtgtggctgcgtgggtatgtctgtgtgtgtgtgtctctgtgtgggtatgtctgtgtgtgtccgcgtgcatgtgtctc

SEQ ID NO: 38713 - DNA, 201 bp, Homo sapiens
atagtagcattaccacctcacaggattgttacaagaaagcaatgagttaacacacgtgtgcttagaacagttcttggcataagctaagtaccttacacgtrcttgctatctttcttattctttcaatgatgatggtgtaggaaagtgtttgcaatgggctgggcacatggtggatgtttaataattcatggttgcaatcac

SEQ ID NO: 38714 - DNA, 201 bp, Homo sapiens
tgcccaggctggagtgcaatggtgcaatcttggctcactgtaacctctacctcccaggctcaagcgattctcctgcctcagcctcccaggtagctggcatyacaggcatgcgctaccatgcccggctaatttttttttgtatttaatagagaccgggtttcaccatgttggtcaggctggtcttgaactcctgacctcagc

SEQ ID NO: 38715 - DNA, 201 bp, Homo sapiens
aagggtccctgaggcacctgcccacttggcatgcctcgatggtgaagctttcttggtacggcagaggggagtctgcctaggcatctgcatctcccctgctsatccagggaaaggcctcaggagaagtaagcacaatgctgtcctcgtatctcaacagaaccagccctctgcatgagatcagaagcctccagccaaaggtgg

SEQ ID NO: 38716 - DNA, 201 bp, Homo sapiens
aactctggattcttctttatcttcaggtgattctcacaaaagctctccagcagccagatagttccatttgaatcccattttacagatgataaagctgaagsagagggaagtgtcctgccaaaggggctcagggctcctttcattcacacacttccacccttttatcccacacctggctgatgcccaccttccttttcttcc

SEQ ID NO: 38717 - DNA, 201 bp, Homo sapiens
catccctgggtcacagctactgcagaggccaccactgagttcaggcaggaccatccatgctccatgaggaggacagtacccaggggtgaggaggtaaagawctcgtccctggggacttcccactccagtgtggacactgtcccttcccaatatccagtgcccagggcagggacagcagcaccaccacacattctggcagaa

SEQ ID NO: 38718 - DNA, 201 bp, Homo sapiens
cccaccttcctgcccccaggggcctctgcccttgatctcttggttagaactcctggcttgaaagggtgaggtgaattcattaacttctctgatggcctgaygaccttttcagtcccctcttccctctctcctacctggttcatggtccgctcctctacctgctggggccctcacaggtcctgaaggctttgtgggttcgaa

SEQ ID NO: 38719 - DNA, 201 bp, Homo sapiens
gtgcttgctatctttcttattctttcaatgatgatggtgtaggaaagtgtttgcaatgggctgggcacatggtggatgtttaataattcatggttgcaatmacacaatgtcagtccctggtcactgggagtcatcatgtgccctgacttggggcctggccctctgcctctgtcttgcaggacaatgccattctctgtctca

SEQ ID NO: 38720 - DNA, 201 bp, Homo sapiens
aatgatgatggtgtaggaaagtgtttgcaatgggctgggcacatggtggatgtttaataattcatggttgcaatcacacaatgtcagtccctggtcactgkgagtcatcatgtgccctgacttggggcctggccctctgcctctgtcttgcaggacaatgccattctctgtctcatggggcgtcctcctgctggcaggcct

SEQ ID NO: 38721 - DNA, 201 bp, Homo sapiens; identical to SEQ ID NO: 8396

SEQ ID NO: 38722 - DNA, 201 bp, Homo sapiens
tccacccttttatcccacacctggctgatgcccaccttccttttcttccaggcaagtggaaagataaattcaaggctgagcgcattatggtagagggcttycatgtggatgataagaccatcatcagagtgcctatgataaaccacctgggtagatttgacatccaccgggacagggagttatccagctgggtgctggcac

SEQ ID NO: 38723 - DNA, 201 bp, Homo sapiens
ttgtcagctggtgtcaccaccctaagtacccacacaaatgggctaggaagcccaagctacatgaatttcagctcctgatgagagattcttgggccagggtyttggtagacacaagcctggtgacttcaggcagctggcaattactgggcatctaccaagggtcagccacggttccaggcccctagcgtgtatgaattcctt

SEQ ID NO: 38724 - DNA, 201 bp, Homo sapiens
gacctttgagccatgtcaggactgaggcccaacaggactggccagagggctggggagggtggacctcacatccctgggtcacagctactgcagaggccacyactgagttcaggcaggaccatccatgctccatgaggaggacagtacccaggggtgaggaggtaaagatctcgtccctggggacttcccactccagtgtgg

SEQ ID NO: 38725 - DNA, 201 bp, Homo sapiens
accacccttccgtcccaagtggactctacctttgatctcttgtttagaatcctggcctgaaaaggagatatgtattcattaactcctcaggtgacctggcratcttttccatcaccttcttcctctttcttatctgggttcatggccccatcctttacctactggggccctcactgtttctccagcctgtatctctaattc

SEQ ID NO: 38726 - DNA, 201 bp, Homo sapiens
ttgagttttgcaagatgaaaatagttctggggattgattgcacaacaaagaatgtacttaacacaattaaactatatacttaaaaatagtcaaaatgatarattttatactaagtgtactttactacaatttaaaaaaattaaatacaaattatctttaaataacaaacataataataattgtgcagccaatattttcata

SEQ ID NO: 38727 - DNA, 201 bp, Homo sapiens; identical to SEQ ID NO: 34383

SEQ ID NO: 38728 - DNA, 201 bp, Homo sapiens
ctataggttcctgagacctgggacagcagacgcagtgcaatcctggggaccctaaacagggcccccatcccagaggaatggacatcccacacggcctgggsccaggcagattcacatgggcctcacttgacttaagtccagtctgaaggagagaagcttctgtccaattaggcaagaggagaccttcaagacagccagggt

SEQ ID NO: 38729 - DNA, 201 bp, Homo sapiens; identical to SEQ ID NO: 34386

SEQ ID NO: 38730 - DNA, 201 bp, Homo sapiens
ggtctaactccctttatcctcacacaaggacccctcactagagtggagagaacgagtccttcccagtcacacccaggagccctcgggtggcacttggcagstggtgtcaccaccctaagtacccacacaaatgggctatggaggcagagcaacaaggattccagctcctggtgagagattcccaggccagggtcttggtag

SEQ ID NO: 38731 - DNA, 201 bp, Homo sapiens
ggtcagggaggaaccttatggatgtgagagctccatcatgtcagtgaggagatcggctataggttcctgagacctgggacagcagacgcagtgcaatcctkgggaccctaaacagggcccccatcccagaggaatggacatcccacacggcctgggcccaggcagattcacatgggcctcacttgacttaagtccagtctg

SEQ ID NO: 38732 - DNA, 201 bp, Homo sapiens; identical to SEQ ID NO: 8395

SEQ ID NO: 38733 - DNA, 201 bp, Homo sapiens
ggtacctagaatagtcaaattcataaagacagaaagtagaatggtgattgccaagtactgggtgcaggggagaatgagtaattgttcaatgggtatggatyttgagttttgcaagatgaaaatagttctggggattgattgcacaacaaagaatgtacttaacacaattaaactatatacttaaaaatagtcaaaatgata

SEQ ID NO: 38734 - DNA, 201 bp, Homo sapiens
ggcctggccaagagcagcatccaaggccccagcctctgaggaggcagtactacagctctacgcaaagcacttggccagcagctggtggcttgtcggctccyggttctgcctgaccagctatgtggccttgaacaagttactgaaccactctgagttcacctttcccatcctatgaaaatggaaattacaagacatatcttt

SEQ ID NO: 38735 - DNA, 201 bp, Homo sapiens
gaggtacctagaatagtcaaattcataaagacagaaagtagaatggtgattgccaagtactgggtgcaggggagaatgagtaattgttcaatgggtatggmttttgagttttgcaagatgaaaatagttctggggattgattgcacaacaaagaatgtacttaacacaattaaactatatacttaaaaatagtcaaaatga

SEQ ID NO: 38736 - DNA, 201 bp, Homo sapiens
caaggccaggggctgcttcctccactctgaggctcccttgctcttgaggcaaaggagggcagtggagagcagccaggctgcagtcagcacagctgaggtcygggctctgctgtggccttagggcaggcccaggcccctctccagcccccgtctcctccttctgtccaatgagaaagctgagctcaagggtccctgaggcac

SEQ ID NO: 38737 - DNA, 201 bp, Homo sapiens
ctgtagaggcaggaaggattcagccttagggatgcccccttgctctccaacaggcccctccgcctcaggctctttttttcttttttcttttttttttttttctttcagatggagtttccctctgttgcccaggctggagtgcaatggtgcaatcttggctcactgtaacctctacctcccaggctcaagcgattctcctgc

SEQ ID NO: 38738 - DNA, 201 bp, Homo sapiens
gaccttcaagacagccagggtgatctgagcccccaccccaggggtgctccacaggggcaatcagcaaggccaggggatggtttatcaccatccctgtgagytgagggtcactacatgactgtggttttcttgagaatgttgtcaaacatcctaggatgcaccacagagtcccccacagcatagcactgcccagcccaatat

SEQ ID NO: 38739 - DNA, 201 bp, Homo sapiens; identical to SEQ ID NO: 8392

SEQ ID NO: 38740 - DNA, 201 bp, Homo sapiens; identical to SEQ ID NO: 8394

SEQ ID NO: 38741 - DNA, 201 bp, Homo sapiens; identical to SEQ ID NO: 8397

SEQ ID NO: 38742 - DNA, 201 bp, Homo sapiens
tccacccctggccccctccctggatgacattaaagaaaggctgaattgccctctgcctgcgtgtgactgcaaacccctcccctgttgtttctgagtctccytttgtgcactgaggctgtgtgtggactccaggtcacagtgctgtctccgggcctcctgaactgtgttcatggagcacctgactgggcaggcatgtgctag

SEQ ID NO: 38743 - DNA, 201 bp, Homo sapiens; identical to SEQ ID NO: 8404

SEQ ID NO: 38744 - DNA, 201 bp, Homo sapiens
gcctcagcctcccgagtagctggggctacaggcacccgccaccacgcctggctaatgtttgtatttttagtagagacggggttccaccatgttggccaggmtggtctcaatctcttgacctcatgatccgcccgccttggccccccacagtgctggggttacagctgtgagccaccgcgcctggctctgccaaaataattt

SEQ ID NO: 38745 - DNA, 201 bp, Homo sapiens
tggctgtggccggacaccaggtcctgtggtggtgtgggcagggcgcgctctctcctctgagcagcctggggctgcgtgtgtgaacagaaacaggcctgccratttgaagatggtttgaccaagtctcccaaagctgaagagaggtccctgcccatgtcccccgggtggcaatccacagacgcacctgtgtccatcagacgg

SEQ ID NO: 38746 - DNA, 201 bp, Homo sapiens
atcccacggccccacggtgctgcagctgcaggaggggcggaggctgcagccagacagcatcagaagccagcgtggttctggaaggatcgagaacaccaagstgttagggctgcagcaggggtcctgtcccctggcacccctcaccgccctaatcttttacccttaggaggcagcagacacgaggggctgcccgaggctcta

SEQ ID NO: 38747 - DNA, 201 bp, Homo sapiens; identical to SEQ ID NO: 29382

SEQ ID NO: 38748 - DNA, 201 bp, Homo sapiens; identical to SEQ ID NO: 29383

SEQ ID NO: 38749 - DNA, 201 bp, Homo sapiens; identical to SEQ ID NO: 8407

SEQ ID NO: 38750 - DNA, 201 bp, Homo sapiens; identical to SEQ ID NO: 29385

SEQ ID NO: 38751 - DNA, 201 bp, Homo sapiens
cagtcttgttcctccaagcaagtggggtggagatgttggggtcctttggctggatgccactatctgttgaatctgacaaaataattttcttttttttttttgagacaagagtctcactgtgtcgcgcaggctggagtgcagtggcgcagtctcggctcactgcaagctccgcctcccgggttcacgccattctcctgcctc

SEQ ID NO: 38752 - DNA, 201 bp, Homo sapiens; identical to SEQ ID NO: 29387

SEQ ID NO: 38753 - DNA, 201 bp, Homo sapiens; identical to SEQ ID NO: 8408

SEQ ID NO: 38754 - DNA, 201 bp, Homo sapiens; identical to SEQ ID NO: 29389

SEQ ID NO: 38755 - DNA, 201 bp, Homo sapiens; identical to SEQ ID NO: 29388

SEQ ID NO: 38756 - DNA, 201 bp, Homo sapiens; identical to SEQ ID NO: 8409

SEQ ID NO: 38757 - DNA, 201 bp, Homo sapiens; identical to SEQ ID NO: 29391

SEQ ID NO: 38758 - DNA, 201 bp, Homo sapiens; identical to SEQ ID NO: 8410

SEQ ID NO: 38759 - DNA, 201 bp, Homo sapiens; identical to SEQ ID NO: 8411

SEQ ID NO: 38760 - DNA, 201 bp, Homo sapiens; identical to SEQ ID NO: 8412

SEQ ID NO: 38761 - DNA, 201 bp, Homo sapiens; identical to SEQ ID NO: 8413

SEQ ID NO: 38762 - DNA, 201 bp, Homo sapiens; identical to SEQ ID NO: 8415

SEQ ID NO: 38763 - DNA, 201 bp, Homo sapiens
gggtgcacgtgtgtgcacgtgtgtgggtaaacattgtgtgtgcgcatacgtgtgtgggtaaacatttgtatgtgcacgcgtgtgtgggtaaacgtgtgtgygcacgtatgtatgtgtgtacatttgtatgtgtgtacatttgtatgcatgtgtgcctgtgtgtgtgtgcctgtgtgtgtgggtgcacatttgtgtgtgtgt

SEQ ID NO: 38764 - DNA, 201 bp, Homo sapiens; identical to SEQ ID NO: 8414

SEQ ID NO: 38765 - DNA, 201 bp, Homo sapiens; identical to SEQ ID NO: 8417

SEQ ID NO: 38766 - DNA, 201 bp, Homo sapiens; identical to SEQ ID NO: 8418

SEQ ID NO: 38767 - DNA, 201 bp, Homo sapiens; identical to SEQ ID NO: 8420

SEQ ID NO: 38768 - DNA, 201 bp, Homo sapiens; identical to SEQ ID NO: 8423

SEQ ID NO: 38769 - DNA, 201 bp, Homo sapiens; identical to SEQ ID NO: 8421

SEQ ID NO: 38770 - DNA, 201 bp, Homo sapiens; identical to SEQ ID NO: 8424

SEQ ID NO: 38771 - DNA, 201 bp, Homo sapiens; identical to SEQ ID NO: 8425

SEQ ID NO: 38772 - DNA, 201 bp, Homo sapiens; identical to SEQ ID NO: 29336

SEQ ID NO: 38773 - DNA, 201 bp, Homo sapiens; identical to SEQ ID NO: 29339

SEQ ID NO: 38774 - DNA, 201 bp, Homo sapiens; identical to SEQ ID NO: 8428

SEQ ID NO: 38775 - DNA, 201 bp, Homo sapiens; identical to SEQ ID NO: 29341

SEQ ID NO: 38776 - DNA, 201 bp, Homo sapiens; identical to SEQ ID NO: 29342

SEQ ID NO: 38777 - DNA, 201 bp, Homo sapiens; identical to SEQ ID NO: 8435

SEQ ID NO: 38778 - DNA, 201 bp, Homo sapiens; identical to SEQ ID NO: 29345

SEQ ID NO: 38779 - DNA, 201 bp, Homo sapiens; identical to SEQ ID NO: 29346

SEQ ID NO: 38780 - DNA, 201 bp, Homo sapiens; identical to SEQ ID NO: 29347

SEQ ID NO: 38781 - DNA, 201 bp, Homo sapiens; identical to SEQ ID NO: 8439

SEQ ID NO: 38782 - DNA, 201 bp, Homo sapiens; identical to SEQ ID NO: 29349

SEQ ID NO: 38783 - DNA, 201 bp, Homo sapiens; identical to SEQ ID NO: 8440

SEQ ID NO: 38784 - DNA, 201 bp, Homo sapiens; identical to SEQ ID NO: 29350

SEQ ID NO: 38785 - DNA, 201 bp, Homo sapiens; identical to SEQ ID NO: 29351

SEQ ID NO: 38786 - DNA, 201 bp, Homo sapiens; identical to SEQ ID NO: 29353

SEQ ID NO: 38787 - DNA, 201 bp, Homo sapiens; identical to SEQ ID NO: 29354

SEQ ID NO: 38788 - DNA, 201 bp, Homo sapiens; identical to SEQ ID NO: 8450

SEQ ID NO: 38789 - DNA, 201 bp, Homo sapiens; identical to SEQ ID NO: 8452

SEQ ID NO: 38790 - DNA, 201 bp, Homo sapiens; identical to SEQ ID NO: 8403

SEQ ID NO: 38791 - DNA, 201 bp, Homo sapiens; identical to SEQ ID NO: 29407

SEQ ID NO: 38792 - DNA, 201 bp, Homo sapiens; identical to SEQ ID NO: 29408

SEQ ID NO: 38793 - DNA, 201 bp, Homo sapiens; identical to SEQ ID NO: 8405

SEQ ID NO: 38794 - DNA, 201 bp, Homo sapiens; identical to SEQ ID NO: 29409

SEQ ID NO: 38795 - DNA, 201 bp, Homo sapiens; identical to SEQ ID NO: 8406

SEQ ID NO: 38796 - DNA, 201 bp, Homo sapiens
tcagcctcccgagtagctggggctacaggcacccgccaccacgcctggctaatgtttgtatttttagtagagacggggttccaccatgttggccaggatgstctcaatctcttgacctcatgatccgcccgccttggccccccacagtgctggggttacagctgtgagccaccgcgcctggctctgccaaaataattttat

SEQ ID NO: 38797 - DNA, 201 bp, Homo sapiens; identical to SEQ ID NO: 8416

SEQ ID NO: 38798 - DNA, 201 bp, Homo sapiens; identical to SEQ ID NO: 8419

SEQ ID NO: 38799 - DNA, 201 bp, Homo sapiens; identical to SEQ ID NO: 8422

SEQ ID NO: 38800 - DNA, 201 bp, Homo sapiens
gagcacaggctggtcctcctggtgtcccacccacccctttttccatgggggatctgcactcatctccagggaagatggttgggagataaccccagtctgcyctaggtccccaccctccacagccagggtggtccgtggtgagcttcagccatcgagatgcgggagtctgctagagtcttcagggtcttttctctgaaaatg

SEQ ID NO: 38801 - DNA, 201 bp, Homo sapiens; identical to SEQ ID NO: 8427

SEQ ID NO: 38802 - DNA, 201 bp, Homo sapiens; identical to SEQ ID NO: 29423

SEQ ID NO: 38803 - DNA, 201 bp, Homo sapiens; identical to SEQ ID NO: 8429

SEQ ID NO: 38804 - DNA, 201 bp, Homo sapiens; identical to SEQ ID NO: 8430

SEQ ID NO: 38805 - DNA, 201 bp, Homo sapiens; identical to SEQ ID NO: 8431

SEQ ID NO: 38806 - DNA, 201 bp, Homo sapiens; identical to SEQ ID NO: 8432

SEQ ID NO: 38807 - DNA, 201 bp, Homo sapiens; identical to SEQ ID NO: 8433

SEQ ID NO: 38808 - DNA, 201 bp, Homo sapiens
ggagtgcagtggcgcagtctcggctcactgcaagctccgcctcccgggttcacgccattctcctgcctcagcctcccgagtagctggggctacaggcaccygccaccacgcctggctaatgtttgtatttttagtagagacggggttccaccatgttggccaggatggtctcaatctcttgacctcatgatccgcccgcct

SEQ ID NO: 38809 - DNA, 201 bp, Homo sapiens; identical to SEQ ID NO: 8434

SEQ ID NO: 38810 - DNA, 201 bp, Homo sapiens
agcccaggcctgctgtcctgagaggtggctggatcactgacactttggcagtggtgctggggtttatgtcatgacctgcagctgagcctacttccaatgamcgtgagatctgaaagactgttttgagggcgtagcctctgccatgattgtggggaatgctgtcctgtttcctcccttggccctgctcagcccagcgagagg

SEQ ID NO: 38811 - DNA, 201 bp, Homo sapiens; identical to SEQ ID NO: 8437

SEQ ID NO: 38812 - DNA, 201 bp, Homo sapiens; identical to SEQ ID NO: 8436

SEQ ID NO: 38813 - DNA, 201 bp, Homo sapiens; identical to SEQ ID NO: 8438

SEQ ID NO: 38814 - DNA, 201 bp, Homo sapiens
tctctcccctgtgctcatgctggaagcacagcgtgagggggcaaaggtcatgggaggcaaaaggctgggctgaggccgaggctctgtggctgtggccggayaccaggtcctgtggtggtgtgggcagggcgcgctctctcctctgagcagcctggggctgcgtgtgtgaacagaaacaggcctgccgatttgaagatggtt

SEQ ID NO: 38815 - DNA, 201 bp, Homo sapiens; identical to SEQ ID NO: 29438

SEQ ID NO: 38816 - DNA, 201 bp, Homo sapiens; identical to SEQ ID NO: 29440

SEQ ID NO: 38817 - DNA, 201 bp, Homo sapiens; identical to SEQ ID NO: 8441

SEQ ID NO: 38818 - DNA, 201 bp, Homo sapiens
aaacacgaacgtccttgaaatgtgaggggacagtgctctggggcaggggctgctcactggttcatggccagaggtgagcgggctctgggtctgggtctgtraggtgctgtggacgtcgggggtgctcctggggcagggacacagccacggccctcacaccagtggagccgtcttccttcccgaggcagaggcttggccttc

SEQ ID NO: 38819 - DNA, 201 bp, Homo sapiens; identical to SEQ ID NO: 29376

SEQ ID NO: 38820 - DNA, 201 bp, Homo sapiens; identical to SEQ ID NO: 8442

SEQ ID NO: 38821 - DNA, 201 bp, Homo sapiens; identical to SEQ ID NO: 8443

SEQ ID NO: 38822 - DNA, 201 bp, Homo sapiens; identical to SEQ ID NO: 29377

SEQ ID NO: 38823 - DNA, 201 bp, Homo sapiens; identical to SEQ ID NO: 8446

SEQ ID NO: 38824 - DNA, 201 bp, Homo sapiens; identical to SEQ ID NO: 8444

SEQ ID NO: 38825 - DNA, 201 bp, Homo sapiens; identical to SEQ ID NO: 8445

SEQ ID NO: 38826 - DNA, 201 bp, Homo sapiens; identical to SEQ ID NO: 8447

SEQ ID NO: 38827 - DNA, 201 bp, Homo sapiens; identical to SEQ ID NO: 8448

SEQ ID NO: 38828 - DNA, 201 bp, Homo sapiens; identical to SEQ ID NO: 8449

SEQ ID NO: 38829 - DNA, 201 bp, Homo sapiens; identical to SEQ ID NO: 8451

SEQ ID NO: 38830 - DNA, 201 bp, Homo sapiens; identical to SEQ ID NO: 8453

SEQ ID NO: 38831 - DNA, 201 bp, Homo sapiens; identical to SEQ ID NO: 8454

SEQ ID NO: 38832 - DNA, 201 bp, Homo sapiens
tctgaaagactgttttgagggcgtagcctctgccatgattgtggggaatgctgtcctgtttcctcccttggccctgctcagcccagcgagaggctgaggcrcacgtggctccccgggtgcccacaggcagcgtggctcaccagccgggcccttttccactgagccagaaccccccaaagccttcaatgcaggcaccacggt

SEQ ID NO: 38833 - DNA, 201 bp, Homo sapiens
gtggcgcagtctcggctcactgcaagctccgcctcccgggttcacgccattctcctgcctcagcctcccgagtagctggggctacaggcacccgccaccaygcctggctaatgtttgtatttttagtagagacggggttccaccatgttggccaggatggtctcaatctcttgacctcatgatccgcccgccttggccccc

SEQ ID NO: 38834 - DNA, 201 bp, Homo sapiens
ggtggagatgttggggtcctttggctggatgccactatctgttgaatctgacaaaataattttcttttttttttttgagacaagagtctcactgtgtcgcrcaggctggagtgcagtggcgcagtctcggctcactgcaagctccgcctcccgggttcacgccattctcctgcctcagcctcccgagtagctggggctaca

SEQ ID NO: 38835 - DNA, 201 bp, Homo sapiens; identical to SEQ ID NO: 8455

SEQ ID NO: 38836 - DNA, 201 bp, Homo sapiens; identical to SEQ ID NO: 29461

SEQ ID NO: 38837 - DNA, 201 bp, Homo sapiens; identical to SEQ ID NO: 29463

SEQ ID NO: 38838 - DNA, 201 bp, Homo sapiens; identical to SEQ ID NO: 6890

SEQ ID NO: 38839 - DNA, 201 bp, Homo sapiens; identical to SEQ ID NO: 6891

SEQ ID NO: 38840 - DNA, 201 bp, Homo sapiens; identical to SEQ ID NO: 34073

SEQ ID NO: 38841 - DNA, 201 bp, Homo sapiens; identical to SEQ ID NO: 6893

SEQ ID NO: 38842 - DNA, 201 bp, Homo sapiens; identical to SEQ ID NO: 34154

SEQ ID NO: 38843 - DNA, 201 bp, Homo sapiens; identical to SEQ ID NO: 34156

SEQ ID NO: 38844 - DNA, 201 bp, Homo sapiens; identical to SEQ ID NO: 34159

SEQ ID NO: 38845 - DNA, 201 bp, Homo sapiens; identical to SEQ ID NO: 34161

SEQ ID NO: 38846 - DNA, 201 bp, Homo sapiens; identical to SEQ ID NO: 34162

SEQ ID NO: 38847 - DNA, 201 bp, Homo sapiens; identical to SEQ ID NO: 34164

SEQ ID NO: 38848 - DNA, 201 bp, Homo sapiens; identical to SEQ ID NO: 34165

SEQ ID NO: 38849 - DNA, 201 bp, Homo sapiens; identical to SEQ ID NO: 38537

SEQ ID NO: 38850 - DNA, 201 bp, Homo sapiens; identical to SEQ ID NO: 34166

SEQ ID NO: 38851 - DNA, 201 bp, Homo sapiens; identical to SEQ ID NO: 38410

SEQ ID NO: 38852 - DNA, 201 bp, Homo sapiens; identical to SEQ ID NO: 34168

SEQ ID NO: 38853 - DNA, 201 bp, Homo sapiens; identical to SEQ ID NO: 34167

SEQ ID NO: 38854 - DNA, 201 bp, Homo sapiens; identical to SEQ ID NO: 34170

SEQ ID NO: 38855 - DNA, 201 bp, Homo sapiens; identical to SEQ ID NO: 34169

SEQ ID NO: 38856 - DNA, 201 bp, Homo sapiens; identical to SEQ ID NO: 34172

SEQ ID NO: 38857 - DNA, 201 bp, Homo sapiens; identical to SEQ ID NO: 34171

SEQ ID NO: 38858 - DNA, 201 bp, Homo sapiens; identical to SEQ ID NO: 34078

SEQ ID NO: 38859 - DNA, 201 bp, Homo sapiens; identical to SEQ ID NO: 34079

SEQ ID NO: 38860 - DNA, 201 bp, Homo sapiens; identical to SEQ ID NO: 34080

SEQ ID NO: 38861 - DNA, 201 bp, Homo sapiens; identical to SEQ ID NO: 34081

SEQ ID NO: 38862 - DNA, 201 bp, Homo sapiens; identical to SEQ ID NO: 34178

SEQ ID NO: 38863 - DNA, 201 bp, Homo sapiens; identical to SEQ ID NO: 34180

SEQ ID NO: 38864 - DNA, 201 bp, Homo sapiens; identical to SEQ ID NO: 34181

SEQ ID NO: 38865 - DNA, 201 bp, Homo sapiens; identical to SEQ ID NO: 34183

SEQ ID NO: 38866 - DNA, 201 bp, Homo sapiens; identical to SEQ ID NO: 6894

SEQ ID NO: 38867 - DNA, 201 bp, Homo sapiens; identical to SEQ ID NO: 6896

SEQ ID NO: 38868 - DNA, 201 bp, Homo sapiens; identical to SEQ ID NO: 6897

SEQ ID NO: 38869 - DNA, 201 bp, Homo sapiens; identical to SEQ ID NO: 34189

SEQ ID NO: 38870 - DNA, 201 bp, Homo sapiens; identical to SEQ ID NO: 6898

SEQ ID NO: 38871 - DNA, 201 bp, Homo sapiens; identical to SEQ ID NO: 34190

SEQ ID NO: 38872 - DNA, 201 bp, Homo sapiens; identical to SEQ ID NO: 34191

SEQ ID NO: 38873 - DNA, 201 bp, Homo sapiens; identical to SEQ ID NO: 34192

SEQ ID NO: 38874 - DNA, 201 bp, Homo sapiens; identical to SEQ ID NO: 34086

SEQ ID NO: 38875 - DNA, 201 bp, Homo sapiens; identical to SEQ ID NO: 34195

SEQ ID NO: 38876 - DNA, 201 bp, Homo sapiens; identical to SEQ ID NO: 34087

SEQ ID NO: 38877 - DNA, 201 bp, Homo sapiens; identical to SEQ ID NO: 34088

SEQ ID NO: 38878 - DNA, 201 bp, Homo sapiens; identical to SEQ ID NO: 34197

SEQ ID NO: 38879 - DNA, 201 bp, Homo sapiens; identical to SEQ ID NO: 34196

SEQ ID NO: 38880 - DNA, 201 bp, Homo sapiens; identical to SEQ ID NO: 34089

SEQ ID NO: 38881 - DNA, 201 bp, Homo sapiens; identical to SEQ ID NO: 34198

SEQ ID NO: 38882 - DNA, 201 bp, Homo sapiens; identical to SEQ ID NO: 34199

SEQ ID NO: 38883 - DNA, 201 bp, Homo sapiens; identical to SEQ ID NO: 34200

SEQ ID NO: 38884 - DNA, 201 bp, Homo sapiens; identical to SEQ ID NO: 6912

SEQ ID NO: 38885 - DNA, 201 bp, Homo sapiens; identical to SEQ ID NO: 34093

SEQ ID NO: 38886 - DNA, 201 bp, Homo sapiens; identical to SEQ ID NO: 34204

SEQ ID NO: 38887 - DNA, 201 bp, Homo sapiens; identical to SEQ ID NO: 34095

SEQ ID NO: 38888 - DNA, 201 bp, Homo sapiens; identical to SEQ ID NO: 38456

SEQ ID NO: 38889 - DNA, 201 bp, Homo sapiens; identical to SEQ ID NO: 34113

SEQ ID NO: 38890 - DNA, 201 bp, Homo sapiens; identical to SEQ ID NO: 38617

SEQ ID NO: 38891 - DNA, 201 bp, Homo sapiens; identical to SEQ ID NO: 38618

SEQ ID NO: 38892 - DNA, 201 bp, Homo sapiens; identical to SEQ ID NO: 38472

SEQ ID NO: 38893 - DNA, 201 bp, Homo sapiens; identical to SEQ ID NO: 34117

SEQ ID NO: 38894 - DNA, 201 bp, Homo sapiens; identical to SEQ ID NO: 34118

SEQ ID NO: 38895 - DNA, 201 bp, Homo sapiens; identical to SEQ ID NO: 34213

SEQ ID NO: 38896 - DNA, 201 bp, Homo sapiens; identical to SEQ ID NO: 34214

SEQ ID NO: 38897 - DNA, 201 bp, Homo sapiens; identical to SEQ ID NO: 6921

SEQ ID NO: 38898 - DNA, 201 bp, Homo sapiens; identical to SEQ ID NO: 6889

SEQ ID NO: 38899 - DNA, 201 bp, Homo sapiens; identical to SEQ ID NO: 34120

SEQ ID NO: 38900 - DNA, 201 bp, Homo sapiens; identical to SEQ ID NO: 34218

SEQ ID NO: 38901 - DNA, 201 bp, Homo sapiens; identical to SEQ ID NO: 34220

SEQ ID NO: 38902 - DNA, 201 bp, Homo sapiens; identical to SEQ ID NO: 34124

SEQ ID NO: 38903 - DNA, 201 bp, Homo sapiens; identical to SEQ ID NO: 8326

SEQ ID NO: 38904 - DNA, 201 bp, Homo sapiens; identical to SEQ ID NO: 34126

SEQ ID NO: 38905 - DNA, 201 bp, Homo sapiens; identical to SEQ ID NO: 34127

SEQ ID NO: 38906 - DNA, 201 bp, Homo sapiens; identical to SEQ ID NO: 34128

SEQ ID NO: 38907 - DNA, 201 bp, Homo sapiens; identical to SEQ ID NO: 34221

SEQ ID NO: 38908 - DNA, 201 bp, Homo sapiens; identical to SEQ ID NO: 34130

SEQ ID NO: 38909 - DNA, 201 bp, Homo sapiens; identical to SEQ ID NO: 34133

SEQ ID NO: 38910 - DNA, 201 bp, Homo sapiens; identical to SEQ ID NO: 34132

SEQ ID NO: 38911 - DNA, 201 bp, Homo sapiens; identical to SEQ ID NO: 38631

SEQ ID NO: 38912 - DNA, 201 bp, Homo sapiens; identical to SEQ ID NO: 34222

SEQ ID NO: 38913 - DNA, 201 bp, Homo sapiens; identical to SEQ ID NO: 34135

SEQ ID NO: 38914 - DNA, 201 bp, Homo sapiens; identical to SEQ ID NO: 34223

SEQ ID NO: 38915 - DNA, 201 bp, Homo sapiens; identical to SEQ ID NO: 34136

SEQ ID NO: 38916 - DNA, 201 bp, Homo sapiens; identical to SEQ ID NO: 34137

SEQ ID NO: 38917 - DNA, 201 bp, Homo sapiens; identical to SEQ ID NO: 34141

SEQ ID NO: 38918 - DNA, 201 bp, Homo sapiens; identical to SEQ ID NO: 34143

SEQ ID NO: 38919 - DNA, 201 bp, Homo sapiens; identical to SEQ ID NO: 34142

SEQ ID NO: 38920 - DNA, 201 bp, Homo sapiens; identical to SEQ ID NO: 8337

SEQ ID NO: 38921 - DNA, 201 bp, Homo sapiens; identical to SEQ ID NO: 38504

SEQ ID NO: 38922 - DNA, 201 bp, Homo sapiens; identical to SEQ ID NO: 8338

SEQ ID NO: 38923 - DNA, 201 bp, Homo sapiens; identical to SEQ ID NO: 6910

SEQ ID NO: 38924 - DNA, 201 bp, Homo sapiens; identical to SEQ ID NO: 38512

SEQ ID NO: 38925 - DNA, 201 bp, Homo sapiens; identical to SEQ ID NO: 34149

SEQ ID NO: 38926 - DNA, 201 bp, Homo sapiens; identical to SEQ ID NO: 6917

SEQ ID NO: 38927 - DNA, 201 bp, Homo sapiens; identical to SEQ ID NO: 34150

SEQ ID NO: 38928 - DNA, 201 bp, Homo sapiens; identical to SEQ ID NO: 34235

SEQ ID NO: 38929 - DNA, 201 bp, Homo sapiens; identical to SEQ ID NO: 6920

SEQ ID NO: 38930 - DNA, 201 bp, Homo sapiens; identical to SEQ ID NO: 38643

SEQ ID NO: 38931 - DNA, 201 bp, Homo sapiens; identical to SEQ ID NO: 8464

SEQ ID NO: 38932 - DNA, 201 bp, Homo sapiens; identical to SEQ ID NO: 8466

SEQ ID NO: 38933 - DNA, 201 bp, Homo sapiens; identical to SEQ ID NO: 8467

SEQ ID NO: 38934 - DNA, 201 bp, Homo sapiens; identical to SEQ ID NO: 8470

SEQ ID NO: 38935 - DNA, 201 bp, Homo sapiens
acatccttactgtggaaatgagctactaactgcaggtctccttcctcttcatcttccttatccttctgttccattgctcagtaatgctcctcttcatctgkctcattctccacttgtctgcttgatgcaggagctgaggagctgcacagcaaggttaaaagagctgtaacacaaacagggctgcaacatgccccttgctcc

SEQ ID NO: 38936 - DNA, 201 bp, Homo sapiens
gtttttttcattcatatgataaaagattaatacaatggaaataggatggaatgccattttgtcacattttttccgttttagggtatataagcaaacatccraattctctgaagataaaactttctgctgtgtacatatcaatgaattgttcagatacatggttatatagctagatttaggaggttggatgaataaagacag

SEQ ID NO: 38937 - DNA, 201 bp, Homo sapiens
actcaatgggaagacctgtttgcagagaggagccagccactccagggtctcctttctgctagaagctgaacactcgttgggacacacttgctgtggaaagracatccttactgtggaaatgagctactaactgcaggtctccttcctcttcatcttccttatccttctgttccattgctcagtaatgctcctcttcatctg

SEQ ID NO: 38938 - DNA, 201 bp, Homo sapiens
acactgactttcaggcgctccttggcatgaacagcctgggagcaggaggcagacaggttcctgggtggaaggggatgggtccccagtgaagtcccaccctsaagctggtgagggcttgaagcctgcagaccagagaggtaacttgtggtgctgctccctgggcccactcatggctgcccatggaccaatcagcatgcattt

SEQ ID NO: 38939 - DNA, 201 bp, Homo sapiens
accttgccgcggctgtggacattttctgtgctctcagaggcccagcaaagtcccctgcccactgcaggctccagggtgcctactccggctgcctggcttcyctccactgttagcacccactctgaactcagagcaaggtcgggccgagcctgggtactgtcacagcctggccgagcgtgcacacgctcaggacagtgctga

SEQ ID NO: 38940 - DNA, 201 bp, Homo sapiens
gtaaagatgaatgagcctatgttaaagtgtcattgaaagaaattattaatggtcagtcgtggtgactcacccctgtaattccagcactttgagaggcttargtagaaggatctcttgagcccaggagtttgagaccagcctgggcagcatagcgagaccctatctctacaaaaaataaataaataagatgaaaaagaagtt

SEQ ID NO: 38941 - DNA, 201 bp, Homo sapiens
ctcatgatctgcccaccttggcctcccaaagtgctgggattacaggcgtgagccatcgcacccggccccagccctggcatctttaagtagctttgctaacyattcctgtgtccttagtggtctttcaactgctgggaataaatagcctttactgtcagtgtgaatggttctgaaaactaactgcatgatagaaccacctac

SEQ ID NO: 38942 - DNA, 201 bp, Homo sapiens
ttttttttttttttttttgagatggagtttcgctctgtcgcccaggctggagtgcagtggcgtgatctcggctcactgcaagctccgcctcctgggttcamgccattctgctgcctcagcctcccgagtagttgggactacaggtgcctgccaccacatccggctaattttttgtattttgtttgtttgtttgtttgtttg

SEQ ID NO: 38943 - DNA, 201 bp, Homo sapiens
atccgccttggcctcccaaaccaaagtgttggggttacaggtgtgagccactgtgcccagccagccctggcatctttttttttttttttttttttttttttgagatggagtttcgctctgtcgcccaggctggagtgcagtggcgtgatctcggctcactgcaagctccgcctcctgggttcaagccattctgctgcctca

SEQ ID NO: 38944 - DNA, 201 bp, Homo sapiens
gaaaagggaactaaatatcccacaggtgttttgtattagtagttgataaatttataatgtaggttgtttctataatgtatgtataagagacaaaaagaggrgcatcagacttgatggagacaaaatgaagtgataatgtaattacttaatgtaataaataaccccaacacatctcctaaacctgaatttctgtgatcagga

SEQ ID NO: 38945 - DNA, 201 bp, Homo sapiens; identical to SEQ ID NO: 8460

SEQ ID NO: 38946 - DNA, 201 bp, Homo sapiens
tgctgaaagctgaacactcaatgggaagacctgtttgcagagaggagccagccactccagggtctcctttctgctagaagctgaacactcgttgggacacmcttgctgtggaaaggacatccttactgtggaaatgagctactaactgcaggtctccttcctcttcatcttccttatccttctgttccattgctcagtaat

SEQ ID NO: 38947 - DNA, 201 bp, Homo sapiens
ggagagaaactacccattccagaacctcctctctgctgaaagctgaacactcaatgggaagacctgtttgcagagaggagccagccactccagggtctcckttctgctagaagctgaacactcgttgggacacacttgctgtggaaaggacatccttactgtggaaatgagctactaactgcaggtctccttcctcttcat

SEQ ID NO: 38948 - DNA, 201 bp, Homo sapiens
tacgccagccccctgccgtctcggccccctttggaacttgggcaccaacaagcgtgggagggaggctgagaggggtctgaagacagctggacactgacttkcaggcgctccttggcatgaacagcctgggagcaggaggcagacaggttcctgggtggaaggggatgggtccccagtgaagtcccaccctgaagctggtga

SEQ ID NO: 38949 - DNA, 201 bp, Homo sapiens
tatcagatatattatacatttaaacagttaaacacctaaacagcccaattttatgtggatcagtactactaacggcttagggtaaaatgacagctacagcrtaactagaatgttaaagtggcatgtctcagacaacgtggatggacataaagtatttgagagaatattgcataatagaaaaaaacattgtaaagactaaaa

SEQ ID NO: 38950 - DNA, 201 bp, Homo sapiens; identical to SEQ ID NO: 8465

SEQ ID NO: 38951 - DNA, 201 bp, Homo sapiens; identical to SEQ ID NO: 8469

SEQ ID NO: 38952 - DNA, 201 bp, Homo sapiens
gggaactcttccttttctgggagaatattgtatttcaaggatgtctatagaacatcaaagacaaaatcagttttttgccctttcccagaattcctgtccaygtccctaaccctttctctgatctgtcccattgttttctgagttaggacttctcagagagaacagctgctgtcctcatctgtcctgtcctcacctgcccaa

SEQ ID NO: 38953 - DNA, 201 bp, Homo sapiens
aattgaaaagcaggaacctgctgacaatctttttcttgtagtcatgggtcctagcgcagtgctctgcacatggtcagcattcatacaaacacatgtgattrtatttctgagctggaaaaaggataaggctttgatagagattgactttaatagtattttgatattagtattgtcttatgctggggatacatacatcattaa

SEQ ID NO: 38954 - DNA, 201 bp, Homo sapiens
tagaaacacctagcgtcttgtccccgagagtttgcatccgaaatttggactgcttaatttattttttggcatatatatacaccaaattaaatgaaaaaaawatatatatatatacttaacttttaggttcaggcgtacacatgcaggtttgttatataggtaaactcgtgtcatgggggtttggtgtacagattactttat

SEQ ID NO: 38955 - DNA, 201 bp, Homo sapiens
tttcagtctacattatttacaaaaacaacaataatttataatgtttacttaaacactggctttcaacaaaacacttagaaacacctagcgtcttgtccccyagagtttgcatccgaaatttggactgcttaatttattttttggcatatatatacaccaaattaaatgaaaaaaatatatatatatatacttaacttttag

SEQ ID NO: 38956 - DNA, 201 bp, Homo sapiens
atttcagtctacattatttacaaaaacaacaataatttataatgtttacttaaacactggctttcaacaaaacacttagaaacacctagcgtcttgtcccygagagtttgcatccgaaatttggactgcttaatttattttttggcatatatatacaccaaattaaatgaaaaaaatatatatatatatacttaactttta

SEQ ID NO: 38957 - DNA, 201 bp, Homo sapiens
agtacagacggggtttctccatgttggtcaggctggtcttgaactcccgacctaaggtaatctgcccgccttggcctcccaaagtgctgagattacaggcrtgagccaccacgcccggctgaggatctgcattttaagaaagctctacaagtgatgcacaggctgtttgtgacctctaatctatgccagttattttattta

SEQ ID NO: 38958 - DNA, 201 bp, Homo sapiens
gcctcccgagtagctgggattacaggcatgcaccaccacgtccgactaattttgtatttttagtacagacggggtttctccatgttggtcaggctggtctygaactcccgacctaaggtaatctgcccgccttggcctcccaaagtgctgagattacaggcgtgagccaccacgcccggctgaggatctgcattttaagaa

SEQ ID NO: 38959 - DNA, 201 bp, Homo sapiens
agttaggacttctcagagagaacagctgctgtcctcatctgtcctgtcctcacctgcccaagagtctcacctggaggtagacacatccttctcctgtcacyttcatgctgtattccccaggcagctctggcaatgagacctgctgcagtaacaggcggttgttgttgtccacttggaatttgctggaaaatgtccctgaag

SEQ ID NO: 38960 - DNA, 201 bp, Homo sapiens
ttttattggatgactaactgtgttcattttttaatatccagagatttggtatagtttgacttctctgtcttgcaggaatacttgcgtagactcaaagaggdtctaaaaggttgatcttcccaggcttaagtttcataaaatttgtaaactataattcccatcaacttatgcatgaacaaactctcctaccacacatatcta

SEQ ID NO: 38961 - DNA, 201 bp, Homo sapiens
ctacgtgaaaatcactctcactcacccgtctcgtagtaatcatagactttcactatggctggtttcagatctcttactgggacatcttgcagaaccgtgargaacaagctcagtgtctgatttgacacctggaaagcaaaagtcaattaaatgacctttcaggaagctttcttctctctttgaattagtttaagtattcac

SEQ ID NO: 38962 - DNA, 201 bp, Homo sapiens; identical to SEQ ID NO: 8468

SEQ ID NO: 38963 - DNA, 201 bp, Homo sapiens
cgagtagttgggactacaggtgcctgccaccacatccggctaattttttgtattttgtttgtttgtttgtttgtttgtagagacggggcttcattgtgttagccaggatggtctcgatctcctgacctcatgatctgcccaccttggcctcccaaagtgctgggattacaggcgtgagccatcgcacccggccccagccct

SEQ ID NO: 38964 - DNA, 201 bp, Homo sapiens
ggagtgcagtggcgtgatctcggctcactgcaagctccgcctcctgggttcaagccattctgctgcctcagcctcccgagtagttgggactacaggtgccygccaccacatccggctaattttttgtattttgtttgtttgtttgtttgtttgtagagacggggcttcattgtgttagccaggatggtctcgatctcctga

SEQ ID NO: 38965 - DNA, 201 bp, Homo sapiens
atgataacctttaacaaaattacttagtttttttcattcatatgataaaagattaatacaatggaaataggatggaatgccattttgtcacattttttccrttttagggtatataagcaaacatccgaattctctgaagataaaactttctgctgtgtacatatcaatgaattgttcagatacatggttatatagctagat

SEQ ID NO: 38966 - DNA, 201 bp, Homo sapiens
gccaccactcaagcaaagttcagtctggctctctcccatattaaactttgctcagttgctgaggtcagtgtcctggagagaacccaaggttctttgcagcmatgagcagagtcatgcttcagtttctccaaaagaaataaaagatgagtattataattatcttctggatttaatgacatttttatttggctttcccttttt

SEQ ID NO: 38967 - DNA, 201 bp, Homo sapiens
ttgataattaactaataattgactaatcacaagggctacttccttatattactgggtatccaaaaaacttgtcaacataataaacacattttgtcaagatytcttgcttatgggattttaggaatattcatatcccaagatcataataagccatttctacctgtaatccctggtgaaatataaataaaggagagaagaaca

SEQ ID NO: 38968 - DNA, 201 bp, Homo sapiens
ctccaataaatgtgtttttctataataatgtgcagtgtgagtaatttgatgtttttgacaaatatttacccagcgttttatgaaggagaaggtttgggggrcaagctgaaggagctctgactgccttttggaggagtgtgagtggcttacctttgctgcaaggagcattgtactcagcaattgcaaactcatctgaaaaaa

SEQ ID NO: 38969 - DNA, 201 bp, Homo sapiens; identical to SEQ ID NO: 8472

SEQ ID NO: 38970 - DNA, 201 bp, Homo sapiens
gttcacaaaatcagatgtagaagatacatcacttttaaaaattctacgtaattttaattccaagattcccatgccaccaggctggtgggaaatccagtttwagttgtaattaggccttttctccagtattacatatgaatttgagtgtaataccccaaaacttgagaaggccattgtatctccagtccactggggcaatga

SEQ ID NO: 38971 - DNA, 201 bp, Homo sapiens
aaagccacagagaccaggccctactctagacctgatgaatcagaatgtctagtgtatgggggctgaggatctgcattttttttttttgatggagtttttcrctcttcttgcccaggctggagtgcaatggcatgatttcggctcaccgcaacctccgcctcctgggttcaagtgattctcctgcctcagcctcccgagtag

SEQ ID NO: 38972 - DNA, 201 bp, Homo sapiens
atatatttatatagtgtataaaaaatcacctgacacaatagatggataatatatctgatatatttatatatcgtataagaaatcacctgacacaatagatrtgtaatatatctgatatatttatatattgtataaaaaatcacctgacacaatagatggataatatatctgatatatttatatattgtataaaaaatcacc

SEQ ID NO: 38973 - DNA, 201 bp, Homo sapiens
ctgagccccggggccacgggaagaacttgcagcgacgtcatccctgccccggacacagtcccgggcccagggaggacctggaacattcccttcctcccccscccccccgcccccgcccatcagcccagcctgcaaggaggcgccaccggacctgcacactcaggagcaggtgagccagggacaagcaggagccccgcccct

SEQ ID NO: 38974 - DNA, 201 bp, Homo sapiens
ccaccactcaagcaaagttcagtctggctctctcccatattaaactttgctcagttgctgaggtcagtgtcctggagagaacccaaggttctttgcagccatgagcagagtcatgcttcagtttctccaaaagaaataaaagatgagtattataattatcttctggatttaatgacatttttatttggctttcccttttta

SEQ ID NO: 38975 - DNA, 201 bp, Homo sapiens; identical to SEQ ID NO: 8462

SEQ ID NO: 38976 - DNA, 201 bp, Homo sapiens
aagtccttgtggagactgacagttttttttccctttcatattgttgttgagtatgttgataattaactaataattgactaatcacaagggctacttccttrtattactgggtatccaaaaaacttgtcaacataataaacacattttgtcaagatttcttgcttatgggattttaggaatattcatatcccaagatcataa

SEQ ID NO: 38977 - DNA, 201 bp, Homo sapiens
tgcccaccttggcctcccaaagtgctgggattacaggcgtgagccatcgcacccggccccagccctggcatctttaagtagctttgctaaccattcctgtgtccttagtggtctttcaactgctgggaataaatagcctttactgtcagtgtgaatggttctgaaaactaactgcatgatagaaccacctacagagttcat

SEQ ID NO: 38978 - DNA, 201 bp, Homo sapiens
ccagattatttcttaaataactaacataacgcatatacctctgtcaatgccaatacatagctctgttcatgggggtaaatgatatatactttttattggaygactaactgtgttcattttttaatatccagagatttggtatagtttgacttctctgtcttgcaggaatacttgcgtagactcaaagaggctctaaaaggt

SEQ ID NO: 38979 - DNA, 201 bp, Homo sapiens
tggcatgatttcggctcaccgcaacctccgcctcctgggttcaagtgattctcctgcctcagcctcccgagtagctgggattacaggcatgcaccaccacktccgactaattttgtatttttagtacagacggggtttctccatgttggtcaggctggtcttgaactcccgacctaaggtaatctgcccgccttggcctcc

SEQ ID NO: 38980 - DNA, 201 bp, Homo sapiens
ttatcctacagcacactatagggtccttaattaaattgtgcagaaatctctcagaggggatgataaattctccagattatttcttaaataactaacataaygcatatacctctgtcaatgccaatacatagctctgttcatgggggtaaatgatatatactttttattggatgactaactgtgttcattttttaatatcca

SEQ ID NO: 38981 - DNA, 201 bp, Homo sapiens
tgttcatatcttttatcttcttagcaaaattctaagctaagaagaaattgaaaagcaggaacctgctgacaatctttttcttgtagtcatgggtcctagcrcagtgctctgcacatggtcagcattcatacaaacacatgtgattatatttctgagctggaaaaaggataaggctttgatagagattgactttaatagtat

SEQ ID NO: 38982 - DNA, 201 bp, Homo sapiens
tacattggattaaaaaaatccaaacacctagcacctatttaccattttcactgtgggtttcaatggataaaaccagatatcaacttggatacatccaagaytagacagctccctgtgtaactatagatataagaaagaaaaataagcctcagtgtcttttgaatcttgctctcagttaaggttcaacataagccctgacat

SEQ ID NO: 38983 - DNA, 201 bp, Homo sapiens
ataaaggagagaagaacattcttttagagttaacattagaattctcaaatttctagcatggaagtgatgtttctaaaatgcatttaccttcccagatgttyccttagaggattattatctacgtttttttgcaaatagactggaagttctcttaccttatcaaggtaaatcaagacatggttgctgctgacttctgtccgg

SEQ ID NO: 38984 - DNA, 201 bp, Homo sapiens
agtatgttgataattaactaataattgactaatcacaagggctacttccttatattactgggtatccaaaaaacttgtcaacataataaacacattttgtsaagatttcttgcttatgggattttaggaatattcatatcccaagatcataataagccatttctacctgtaatccctggtgaaatataaataaaggagaga

SEQ ID NO: 38985 - DNA, 201 bp, Homo sapiens
gagccccggggccacgggaagaacttgcagcgacgtcatccctgccccggacacagtcccgggcccagggaggacctggaacattcccttcctcccccccscccccgcccccgcccatcagcccagcctgcaaggaggcgccaccggacctgcacactcaggagcaggtgagccagggacaagcaggagccccgccccttc

SEQ ID NO: 38986 - DNA, 201 bp, Homo sapiens; identical to SEQ ID NO: 8473

SEQ ID NO: 38987 - DNA, 201 bp, Homo sapiens
tggcagctgctttggctggacgagcccgatagccacctccactgatgggcggtggggcaggcctcaggctgggagcctcttctctcttcttgtcaaggggycgatgaccacgggcactgaagaaaccctacaaggaatgaggcagaaatataatacagagtgttatagaagatttggaatgtaactattccaacaccctca

SEQ ID NO: 38988 - DNA, 201 bp, Homo sapiens
tcagtgaaacattagcagactgccatgactacaggctttctctgcatgagagagccaccactgcaagaaacatcagtgcacccaccaggtctgggtcagcrtgaagacagcctccagcatcaggggcttttctttctactttcttttgagtggcagctgctttggctggacgagcccgatagccacctccactgatgggcg

SEQ ID NO: 38989 - DNA, 201 bp, Homo sapiens
atcagacacataacatttcttaccaaatgacaccttaagaaagtgcatttcttttttcgttactgtattttcgtttgtttttacaagttttatagtagagmcagggtctcactatgttgccaagctggcctctaactcctggtctgaagcaatcttcccacctcatcccagcaaagtgctgggtttgcagatgggagccac

SEQ ID NO: 38990 - DNA, 201 bp, Homo sapiens; identical to SEQ ID NO: 8474

SEQ ID NO: 38991 - DNA, 201 bp, Homo sapiens
accaagaaatctgcatttttttttttgacttggagtctcagtcttatgcccaggctggagtgcagtggcgtgatctcagctcactgtaacctctgcctccygggttcaagtgattctcctgcctcagcctcccgagtagctgggattacaggtgcacaccaccacacccagctaatttttgtatttttagtagagacactg

SEQ ID NO: 38992 - DNA, 201 bp, Homo sapiens
cacccctgggactacctgtgccccatcctgctcatcaaaaccagcaaatgcaccaggccagtccaaaacacaactggctaaggatatttttatgatgtacygtaatgtcattatgatctgttgggaaaatccacttagcatttttgttgttgttgttgttctcttatttttggtgtgtgagttcttctggaactctctaaa

SEQ ID NO: 38993 - DNA, 201 bp, Homo sapiens
cacacccagctaatttttgtatttttagtagagacactgtttcgatttcaccatgttgtccaggatggtctcaatttcctgacctcatgattcaccccccytcggcctcccaaagtgctgggattacaagcgtcagtaagtttaaatgatcagcatacaggatattatgtgtgtaatgcttaaacagaaatgtgagctgag

SEQ ID NO: 38994 - DNA, 201 bp, Homo sapiens
gagcaaaaatctacgtattggggactattgctgtgggaagaagggcctgatcttcatactcatcttcctcattgagtaccatgaccccttccaattcatcyatactacaccatcatctgtgccatgctttgccatgtcccaggtgtactgtccaccccagtagtatctgccgtttggattggctgcatgacatctattata

SEQ ID NO: 38995 - DNA, 201 bp, Homo sapiens
agcaaaaatctacgtattggggactattgctgtgggaagaagggcctgatcttcatactcatcttcctcattgagtaccatgaccccttccaattcatccmtactacaccatcatctgtgccatgctttgccatgtcccaggtgtactgtccaccccagtagtatctgccgtttggattggctgcatgacatctattatac

SEQ ID NO: 38996 - DNA, 201 bp, Homo sapiens
attgagtaccatgaccccttccaattcatccatactacaccatcatctgtgccatgctttgccatgtcccaggtgtactgtccaccccagtagtatctgcygtttggattggctgcatgacatctattataccaccatccaccaccgtcttctttagaacactgttttctgggatctgatgttaacctgaaagaaaatgtg

SEQ ID NO: 38997 - DNA, 201 bp, Homo sapiens
atagtgcttatctggcaagttgcaggggaaggtgcccaaaagcgtatgaatgctattcactaacccagaaatgttaatcttctcacaaccatgcattctcrtggcagtctaacggttccaattttatagctgaaaatcgaatggaaagcacaaggatatctaccttttacttgcttctgcctcttttgccacaggtctttc

SEQ ID NO: 38998 - DNA, 201 bp, Homo sapiens
tccaggattgaacgaagcacacgaaggttagttgggatattgctattcacagtctcatctatatataattggtgcttttccagttctgaggagtactcatkgactacattttcattatctggaaaaatgaaattatgtagaaatagttagcatttttgcctcataaaactaatgtatttaactatacaattttgattttct

SEQ ID NO: 38999 - DNA, 201 bp, Homo sapiens
actacctgtgccccatcctgctcatcaaaaccagcaaatgcaccaggccagtccaaaacacaactggctaaggatatttttatgatgtactgtaatgtcaytatgatctgttgggaaaatccacttagcatttttgttgttgttgttgttctcttatttttggtgtgtgagttcttctggaactctctaaaaatatgttta

SEQ ID NO: 39000 - DNA, 201 bp, Homo sapiens
atattcaagaccggtttattagctatttgaggttgtgaacgcttctccttccttacaagtgcaaagcctaactcattgaatgtgtggattacaaaacaagraaacattaacttattgcaacagagtctggtttaattaataaatctttttggaagttttctttgacagatcctacataaataaatatagttttaaaagtgg

SEQ ID NO: 39001 - DNA, 201 bp, Homo sapiens; identical to SEQ ID NO: 8475

SEQ ID NO: 39002 - DNA, 201 bp, Homo sapiens; identical to SEQ ID NO: 8477

SEQ ID NO: 39003 - DNA, 201 bp, Homo sapiens
agcctaaaccaaaggcccaatatgtttatgttttgaattttatttccaaaataaacaaacaaaataacagtgatggtaatgtgggtcagtgaaacattagsagactgccatgactacaggctttctctgcatgagagagccaccactgcaagaaacatcagtgcacccaccaggtctgggtcagcgtgaagacagcctcca

SEQ ID NO: 39004 - DNA, 201 bp, Homo sapiens
tctgggaaacagcttccacattgttatttaactcatcaacactatttctgattggcctttcctgttgtagcaaagcctcttgcaactgacatcctgtaggrcacaacaccccctaaaaacaaagaaaatagcaggcattagatgaaggatttgggtcatggacatttgttaaaatagcacataggaaaattcagcgatacg

SEQ ID NO: 39005 - DNA, 201 bp, Homo sapiens
ctggcattttacggtatccaaataattacagatcaacaggtcaacaactgtcgaaagcttacctccattttctgtattcatgtcacagtatactctatacrgtttgacagaactgtcaggttgaatgagatacatttcagatgtttcacctcctttcctgataatttcctcacattctgcaaatgtaagacaacattatgt

SEQ ID NO: 39006 - DNA, 201 bp, Homo sapiens
aattcttcccatctgtgttggttgcaacatttccaaatccctgtttatatggatcccatttcctgccaaagtcaacactaccgtcttgacggttctgaatmactgtccatcctttggttgacagaaacaaaaagagcatatattaaccaacagcaaataatgtcactttgaaaataatatctgaatcccctgtccattcca

SEQ ID NO: 39007 - DNA, 201 bp, Homo sapiens
agaacatgccgttgtgaatggtcatggtcctgttttctcccatcagctgagatgctccatccatgagggcattaccggctgttcctctgtatttgttcacygagatctggtatttgttggcttcattctgtacagtgaatcctccatagtgagcctttactttgtctcctttccagtcctccatttctatcaaaagttctg

SEQ ID NO: 39008 - DNA, 201 bp, Homo sapiens; identical to SEQ ID NO: 8476

SEQ ID NO: 39009 - DNA, 201 bp, Homo sapiens
ttggctggacgagcccgatagccacctccactgatgggcggtggggcaggcctcaggctgggagcctcttctctcttcttgtcaaggggtcgatgaccacrggcactgaagaaaccctacaaggaatgaggcagaaatataatacagagtgttatagaagatttggaatgtaactattccaacaccctcattttataattt

SEQ ID NO: 39010 - DNA, 201 bp, Homo sapiens
gctttggctggacgagcccgatagccacctccactgatgggcggtggggcaggcctcaggctgggagcctcttctctcttcttgtcaaggggtcgatgacmacgggcactgaagaaaccctacaaggaatgaggcagaaatataatacagagtgttatagaagatttggaatgtaactattccaacaccctcattttataa

SEQ ID NO: 39011 - DNA, 201 bp, Homo sapiens
atcagtgcacccaccaggtctgggtcagcgtgaagacagcctccagcatcaggggcttttctttctactttcttttgagtggcagctgctttggctggacragcccgatagccacctccactgatgggcggtggggcaggcctcaggctgggagcctcttctctcttcttgtcaaggggtcgatgaccacgggcactgaag

SEQ ID NO: 39012 - DNA, 201 bp, Homo sapiens
ctttttaaatatcaggttgaattccacatcaaattactctttgtcagctatgttagatgttagagctaagtcttgtttcctggctttttaattaatttttytttttgagacaggatctcactatcctctgttgcccaggctacagttcagtagcatgatcaagactccaggttgtgggctcaggtgatctcccatctcagc

SEQ ID NO: 39013 - DNA, 201 bp, Homo sapiens
gaaaaaatataattgggctatgaaaattttaccaactaaacaaaggcagtggcaaaatacaaatggaaaggtggcacccacatatcctaatttgaaatttkgggcccagaccaaagaaaacaagaaagaaagcctaaaccaaaggcccaatatgtttatgttttgaattttatttccaaaataaacaaacaaaataacagt

SEQ ID NO: 39014 - DNA, 201 bp, Homo sapiens
agcaggcattagatgaaggatttgggtcatggacatttgttaaaatagcacataggaaaattcagcgatacgattagccaacataaaaatttattatttgrttttctgtaagaccagaaattcgaaagtcatcatcatactctcatagagatttaaaatattacttaccccagaaaaaatataattgggctatgaaaattt

SEQ ID NO: 39015 - DNA, 201 bp, Homo sapiens
tccaccttttgtgtcctggaatatccatgagctcccagaacacacaaaatggagaaacttctacatctatctgtggttctgccatctgttcaagccagtaygcagatgcacacatcagccacccctgggactacctgtgccccatcctgctcatcaaaaccagcaaatgcaccaggccagtccaaaacacaactggctaag

SEQ ID NO: 39016 - DNA, 201 bp, Homo sapiens
atggagaagcaaaataaaaattaaatatgttattctgtgcatcaaaggtaaattggtacaatctttctggagagttacttggctatatatatatatatatwttttttttaagtttaaaatgccaaaaacattttttttgaggcaggttctcactctgtcatctaggctgtagtgcagtagcagtagcacagtcagggctca

SEQ ID NO: 39017 - DNA, 201 bp, Homo sapiens
tggagaagcaaaataaaaattaaatatgttattctgtgcatcaaaggtaaattggtacaatctttctggagagttacttggctatatatatatatatatattttttttaagtttaaaatgccaaaaacattttttttgaggcaggttctcactctgtcatctaggctgtagtgcagtagcagtagcacagtcagggctcac

SEQ ID NO: 39018 - DNA, 201 bp, Homo sapiens
aataaggaaataaatatgagaggtaaacttgtaaaatctttggaaactgcaagtgctttatcttaccccaaattgtgaattatagatattttataactttwtaaatatcaggttgaattccacatcaaattactctttgtcagctatgttagatgttagagctaagtcttgtttcctggctttttaattaatttttttttt

SEQ ID NO: 39019 - DNA, 201 bp, Homo sapiens
gtcagtgaaacattagcagactgccatgactacaggctttctctgcatgagagagccaccactgcaagaaacatcagtgcacccaccaggtctgggtcagygtgaagacagcctccagcatcaggggcttttctttctactttcttttgagtggcagctgctttggctggacgagcccgatagccacctccactgatgggc

SEQ ID NO: 39020 - DNA, 201 bp, Homo sapiens
acaatattccatttgagctgagacatcagattctaacttttgtattttgcttctcaggttttccaggattgaacgaagcacacgaaggttagttgggataytgctattcacagtctcatctatatataattggtgcttttccagttctgaggagtactcattgactacattttcattatctggaaaaatgaaattatgtag

SEQ ID NO: 39021 - DNA, 201 bp, Homo sapiens
acagtgcatggggtgcgacaatattccatttgagctgagacatcagattctaacttttgtattttgcttctcaggttttccaggattgaacgaagcacacraaggttagttgggatattgctattcacagtctcatctatatataattggtgcttttccagttctgaggagtactcattgactacattttcattatctgga

SEQ ID NO: 39022 - DNA, 201 bp, Homo sapiens
taggccacagtaattcttcccatctgtgttggttgcaacatttccaaatccctgtttatatggatcccatttcctgccaaagtcaacactaccgtcttgayggttctgaatcactgtccatcctttggttgacagaaacaaaaagagcatatattaaccaacagcaaataatgtcactttgaaaataatatctgaatcccc

SEQ ID NO: 39023 - DNA, 201 bp, Homo sapiens
gctgttcctctgtatttgttcactgagatctggtatttgttggcttcattctgtacagtgaatcctccatagtgagcctttactttgtctcctttccagtmctccatttctatcaaaagttctgtgggtcccatcctggtaagctggctaattttatcatttccaagccaatattcacctaaaagaaaaacaaaataaaat

SEQ ID NO: 39024 - DNA, 201 bp, Homo sapiens; identical to SEQ ID NO: 8480

SEQ ID NO: 39025 - DNA, 201 bp, Homo sapiens
gtcatggtcctgttttctcccatcagctgagatgctccatccatgagggcattaccggctgttcctctgtatttgttcactgagatctggtatttgttggyttcattctgtacagtgaatcctccatagtgagcctttactttgtctcctttccagtcctccatttctatcaaaagttctgtgggtcccatcctggtaagc

SEQ ID NO: 39026 - DNA, 201 bp, Homo sapiens
acataatgtacaaaaatgttgtcacatacagaagagcaaaaatctacgtattggggactattgctgtgggaagaagggcctgatcttcatactcatcttcytcattgagtaccatgaccccttccaattcatccatactacaccatcatctgtgccatgctttgccatgtcccaggtgtactgtccaccccagtagtatct

SEQ ID NO: 39027 - DNA, 201 bp, Homo sapiens
ataccagccgtcattgtctctgtcatacgtgctgaagaacatgccgttgtgaatggtcatggtcctgttttctcccatcagctgagatgctccatccatgmgggcattaccggctgttcctctgtatttgttcactgagatctggtatttgttggcttcattctgtacagtgaatcctccatagtgagcctttactttgtc

SEQ ID NO: 39028 - DNA, 201 bp, Homo sapiens
catacgtgctgaagaacatgccgttgtgaatggtcatggtcctgttttctcccatcagctgagatgctccatccatgagggcattaccggctgttcctctrtatttgttcactgagatctggtatttgttggcttcattctgtacagtgaatcctccatagtgagcctttactttgtctcctttccagtcctccatttcta

SEQ ID NO: 39029 - DNA, 201 bp, Homo sapiens
atcatctgtgccatgctttgccatgtcccaggtgtactgtccaccccagtagtatctgccgtttggattggctgcatgacatctattataccaccatccaycaccgtcttctttagaacactgttttctgggatctgatgttaacctgaaagaaaatgtgtttggcgttattagaaacagaactacggtggtcaagttacg

SEQ ID NO: 39030 - DNA, 201 bp, Homo sapiens
catacagaagagcaaaaatctacgtattggggactattgctgtgggaagaagggcctgatcttcatactcatcttcctcattgagtaccatgaccccttcyaattcatccatactacaccatcatctgtgccatgctttgccatgtcccaggtgtactgtccaccccagtagtatctgccgtttggattggctgcatgaca

SEQ ID NO: 39031 - DNA, 201 bp, Homo sapiens
ccacaggaatattgcaactgacagtgcatggggtgcgacaatattccatttgagctgagacatcagattctaacttttgtattttgcttctcaggttttcyaggattgaacgaagcacacgaaggttagttgggatattgctattcacagtctcatctatatataattggtgcttttccagttctgaggagtactcattga

SEQ ID NO: 39032 - DNA, 201 bp, Homo sapiens
gtgcgacaatattccatttgagctgagacatcagattctaacttttgtattttgcttctcaggttttccaggattgaacgaagcacacgaaggttagttgsgatattgctattcacagtctcatctatatataattggtgcttttccagttctgaggagtactcattgactacattttcattatctggaaaaatgaaatta

SEQ ID NO: 39033 - DNA, 201 bp, Homo sapiens
gagttttagaggaatataatgtatgaaagaaaattccaataacataatgtacaaaaatgttgtcacatacagaagagcaaaaatctacgtattggggactwttgctgtgggaagaagggcctgatcttcatactcatcttcctcattgagtaccatgaccccttccaattcatccatactacaccatcatctgtgccatgc

SEQ ID NO: 39034 - DNA, 201 bp, Homo sapiens
gtcacccatatttttgccccatggtgggaatctgtagtcagtttaaaaacaatccctgagttagctgtttctcttggttcataaataaagaggaactagargcttatgtcccaagtgcatacatccattatagtttgttgcagactttcagtcctaattgtataattatatatacatatatataattatatatgtatatat

SEQ ID NO: 39035 - DNA, 201 bp, Homo sapiens
ttagtcaccaattctttaaaataacattacataagttactaaggagtgtgttattatagacctttgaaaataatataacaaatattagattttcattttamtttagtaagtccaacccagttttgaggacgtttatctgctaagaggatgaacaaagctcttctccaccttttgtgtcctggaatatccatgagctcccag

SEQ ID NO: 39036 - DNA, 201 bp, Homo sapiens
aatattccatttgagctgagacatcagattctaacttttgtattttgcttctcaggttttccaggattgaacgaagcacacgaaggttagttgggatattrctattcacagtctcatctatatataattggtgcttttccagttctgaggagtactcattgactacattttcattatctggaaaaatgaaattatgtagaa

SEQ ID NO: 39037 - DNA, 201 bp, Homo sapiens
tacattaactaagaattgaccatcagattatctactttagtggtttttcttctatggcattacttcaagctctagggattcatttgatcctctgtgaacaygtaaggagtgagcaaaggtctgatgactgcagtcttcccaacccgcatttttcattcagtgaacttttgcgactctcagtattgccccaaaagttccata

SEQ ID NO: 39038 - DNA, 201 bp, Homo sapiens
aatggagaaacttctacatctatctgtggttctgccatctgttcaagccagtacgcagatgcacacatcagccacccctgggactacctgtgccccatccwgctcatcaaaaccagcaaatgcaccaggccagtccaaaacacaactggctaaggatatttttatgatgtactgtaatgtcattatgatctgttgggaaaa

SEQ ID NO: 39039 - DNA, 201 bp, Homo sapiens
gccaccacgcctggctaatttttgtatttttagtagagatggggtttcaccatattggtcaggctggtcttgaactcctgaccttgtgaccgcccgcctcrgcctcccaaagtgttgggattatagtcgtgagccaccgtgcccgtcctagagtcagattttaaatcttcaaatattcaagaccggtttattagctatttg

SEQ ID NO: 39040 - DNA, 201 bp, Homo sapiens
tttgaggttgtgaacgcttctccttccttacaagtgcaaagcctaactcattgaatgtgtggattacaaaacaagaaaacattaacttattgcaacagagkctggtttaattaataaatctttttggaagttttctttgacagatcctacataaataaatatagttttaaaagtggacttttaaacatcagtttttccttt

SEQ ID NO: 39041 - DNA, 201 bp, Homo sapiens; identical to SEQ ID NO: 8478

SEQ ID NO: 39042 - DNA, 201 bp, Homo sapiens; identical to SEQ ID NO: 8479

SEQ ID NO: 39043 - DNA, 201 bp, Homo sapiens
gtagtttttaaagagaggccttaggataaagctgtatcagattatgaatagtaatgacctcatattcctaaaacatacattggaacttacgaaattgtaargaatctatactgtcaagaagaatgaatattctcaagccacttggattgttagattcctatgattattgttaatcatttccctactttcatttttgtgaat

SEQ ID NO: 39044 - DNA, 201 bp, Homo sapiens
agaagaaaagaaagtgtctgatggtgaatatccgtaccagttaagattatttgcataagtatatgactcccagtgtaattacttacaaattaaaatatttrtatagaggaaaataccatgtttctgattgctatcctacatattatgaaatgagtaattcatataaaagatgactttgctaatggaaaattgaggaaaggg

SEQ ID NO: 39045 - DNA, 201 bp, Homo sapiens
ggttggtgatagtgaatctgtaggttgcttactgttcagtaacagtagaaagaccaactgcacaaaaaagctatgatgcagtgtagtttttaaagagaggycttaggataaagctgtatcagattatgaatagtaatgacctcatattcctaaaacatacattggaacttacgaaattgtaaagaatctatactgtcaaga

SEQ ID NO: 39046 - DNA, 201 bp, Homo sapiens
atattagtgtgatttttaaagcaggagcaaagagtgccacacataccagccgtcattgtctctgtcatacgtgctgaagaacatgccgttgtgaatggtcrtggtcctgttttctcccatcagctgagatgctccatccatgagggcattaccggctgttcctctgtatttgttcactgagatctggtatttgttggcttc

SEQ ID NO: 39047 - DNA, 201 bp, Homo sapiens
tagagatataggtatttatctaaatgctcattattcagaaagtaactgtgctcaaattctagttttatctctgggtagttgtgtgacattggacaaatcaygtaatctctctaaatctcatctgtaaaatgagaataagaatgtctaccttatagttgaaatgctttcgagtgatgcataaagagcttaggacagtggctg

SEQ ID NO: 39048 - DNA, 201 bp, Homo sapiens
ttataatttaggttatcacaagcttgataatttgcttaagatccatcaactggctggttggtgatagtgaatctgtaggttgcttactgttcagtaacagyagaaagaccaactgcacaaaaaagctatgatgcagtgtagtttttaaagagaggccttaggataaagctgtatcagattatgaatagtaatgacctcata

SEQ ID NO: 39049 - DNA, 201 bp, Homo sapiens
atgtgggtcagtgaaacattagcagactgccatgactacaggctttctctgcatgagagagccaccactgcaagaaacatcagtgcacccaccaggtctgrgtcagcgtgaagacagcctccagcatcaggggcttttctttctactttcttttgagtggcagctgctttggctggacgagcccgatagccacctccactg

SEQ ID NO: 39050 - DNA, 201 bp, Homo sapiens
gagtcacaagtttcttgtatacttaaaataaggagtcatagtagaatttttcatagaaaatcacacttgctgatgtcagactgggaataagagctgaatartgcttatctggcaagttgcaggggaaggtgcccaaaagcgtatgaatgctattcactaacccagaaatgttaatcttctcacaaccatgcattctcgtgg

SEQ ID NO: 39051 - DNA, 201 bp, Homo sapiens
tattatggataactctctcattcaaaacctcaaatgttaaaactataaatgctaggggtttttttccactctgtaaatattatcttctgagtcacaagttwcttgtatacttaaaataaggagtcatagtagaatttttcatagaaaatcacacttgctgatgtcagactgggaataagagctgaatagtgcttatctggc

SEQ ID NO: 39052 - DNA, 201 bp, Homo sapiens
atcagagaaccctggaaatgaaaatgaaagttttcacacacactttagaatatagagatataggtatttatctaaatgctcattattcagaaagtaactgygctcaaattctagttttatctctgggtagttgtgtgacattggacaaatcacgtaatctctctaaatctcatctgtaaaatgagaataagaatgtctacc

SEQ ID NO: 39053 - DNA, 201 bp, Homo sapiens
attgaatgtgtggattacaaaacaagaaaacattaacttattgcaacagagtctggtttaattaataaatctttttggaagttttctttgacagatcctayataaataaatatagttttaaaagtggacttttaaacatcagtttttcctttccgtcatggttttcctacgacaaggataaaagacccctcttccttattt

SEQ ID NO: 39054 - DNA, 201 bp, Homo sapiens
tcaagaccggtttattagctatttgaggttgtgaacgcttctccttccttacaagtgcaaagcctaactcattgaatgtgtggattacaaaacaagaaaayattaacttattgcaacagagtctggtttaattaataaatctttttggaagttttctttgacagatcctacataaataaatatagttttaaaagtggactt

SEQ ID NO: 39055 - DNA, 201 bp, Homo sapiens; identical to SEQ ID NO: 5437

SEQ ID NO: 39056 - DNA, 201 bp, Homo sapiens; identical to SEQ ID NO: 29311

SEQ ID NO: 39057 - DNA, 201 bp, Homo sapiens; identical to SEQ ID NO: 29312

SEQ ID NO: 39058 - DNA, 201 bp, Homo sapiens; identical to SEQ ID NO: 29313

SEQ ID NO: 39059 - DNA, 201 bp, Homo sapiens; identical to SEQ ID NO: 29314

SEQ ID NO: 39060 - DNA, 201 bp, Homo sapiens; identical to SEQ ID NO: 29315

SEQ ID NO: 39061 - DNA, 201 bp, Homo sapiens; identical to SEQ ID NO: 29316

SEQ ID NO: 39062 - DNA, 201 bp, Homo sapiens; identical to SEQ ID NO: 29317

SEQ ID NO: 39063 - DNA, 201 bp, Homo sapiens; identical to SEQ ID NO: 8408

SEQ ID NO: 39064 - DNA, 201 bp, Homo sapiens; identical to SEQ ID NO: 29319

SEQ ID NO: 39065 - DNA, 201 bp, Homo sapiens; identical to SEQ ID NO: 8409

SEQ ID NO: 39066 - DNA, 201 bp, Homo sapiens; identical to SEQ ID NO: 29321

SEQ ID NO: 39067 - DNA, 201 bp, Homo sapiens; identical to SEQ ID NO: 8410

SEQ ID NO: 39068 - DNA, 201 bp, Homo sapiens; identical to SEQ ID NO: 8412

SEQ ID NO: 39069 - DNA, 201 bp, Homo sapiens; identical to SEQ ID NO: 8413

SEQ ID NO: 39070 - DNA, 201 bp, Homo sapiens; identical to SEQ ID NO: 8415

SEQ ID NO: 39071 - DNA, 201 bp, Homo sapiens; identical to SEQ ID NO: 8414

SEQ ID NO: 39072 - DNA, 201 bp, Homo sapiens; identical to SEQ ID NO: 29327

SEQ ID NO: 39073 - DNA, 201 bp, Homo sapiens; identical to SEQ ID NO: 8417

SEQ ID NO: 39074 - DNA, 201 bp, Homo sapiens; identical to SEQ ID NO: 8418

SEQ ID NO: 39075 - DNA, 201 bp, Homo sapiens; identical to SEQ ID NO: 29330

SEQ ID NO: 39076 - DNA, 201 bp, Homo sapiens; identical to SEQ ID NO: 8423

SEQ ID NO: 39077 - DNA, 201 bp, Homo sapiens; identical to SEQ ID NO: 29332

SEQ ID NO: 39078 - DNA, 201 bp, Homo sapiens; identical to SEQ ID NO: 8424

SEQ ID NO: 39079 - DNA, 201 bp, Homo sapiens; identical to SEQ ID NO: 8425

SEQ ID NO: 39080 - DNA, 201 bp, Homo sapiens; identical to SEQ ID NO: 29335

SEQ ID NO: 39081 - DNA, 201 bp, Homo sapiens; identical to SEQ ID NO: 29336

SEQ ID NO: 39082 - DNA, 201 bp, Homo sapiens; identical to SEQ ID NO: 29337

SEQ ID NO: 39083 - DNA, 201 bp, Homo sapiens; identical to SEQ ID NO: 29338

SEQ ID NO: 39084 - DNA, 201 bp, Homo sapiens; identical to SEQ ID NO: 29339

SEQ ID NO: 39085 - DNA, 201 bp, Homo sapiens; identical to SEQ ID NO: 29340

SEQ ID NO: 39086 - DNA, 201 bp, Homo sapiens; identical to SEQ ID NO: 29341

SEQ ID NO: 39087 - DNA, 201 bp, Homo sapiens; identical to SEQ ID NO: 29342

SEQ ID NO: 39088 - DNA, 201 bp, Homo sapiens; identical to SEQ ID NO: 29343

SEQ ID NO: 39089 - DNA, 201 bp, Homo sapiens; identical to SEQ ID NO: 29344

SEQ ID NO: 39090 - DNA, 201 bp, Homo sapiens; identical to SEQ ID NO: 29345

SEQ ID NO: 39091 - DNA, 201 bp, Homo sapiens; identical to SEQ ID NO: 29346

SEQ ID NO: 39092 - DNA, 201 bp, Homo sapiens; identical to SEQ ID NO: 29347

SEQ ID NO: 39093 - DNA, 201 bp, Homo sapiens; identical to SEQ ID NO: 8439

SEQ ID NO: 39094 - DNA, 201 bp, Homo sapiens; identical to SEQ ID NO: 29349

SEQ ID NO: 39095 - DNA, 201 bp, Homo sapiens; identical to SEQ ID NO: 29350

SEQ ID NO: 39096 - DNA, 201 bp, Homo sapiens; identical to SEQ ID NO: 29351

SEQ ID NO: 39097 - DNA, 201 bp, Homo sapiens; identical to SEQ ID NO: 29352

SEQ ID NO: 39098 - DNA, 201 bp, Homo sapiens; identical to SEQ ID NO: 29353

SEQ ID NO: 39099 - DNA, 201 bp, Homo sapiens; identical to SEQ ID NO: 29354

SEQ ID NO: 39100 - DNA, 201 bp, Homo sapiens; identical to SEQ ID NO: 8450

SEQ ID NO: 39101 - DNA, 201 bp, Homo sapiens; identical to SEQ ID NO: 29356

SEQ ID NO: 39102 - DNA, 201 bp, Homo sapiens; identical to SEQ ID NO: 8452

SEQ ID NO: 39103 - DNA, 201 bp, Homo sapiens; identical to SEQ ID NO: 29358

SEQ ID NO: 39104 - DNA, 201 bp, Homo sapiens; identical to SEQ ID NO: 8405

SEQ ID NO: 39105 - DNA, 201 bp, Homo sapiens; identical to SEQ ID NO: 29360

SEQ ID NO: 39106 - DNA, 201 bp, Homo sapiens; identical to SEQ ID NO: 29361

SEQ ID NO: 39107 - DNA, 201 bp, Homo sapiens; identical to SEQ ID NO: 5447

SEQ ID NO: 39108 - DNA, 201 bp, Homo sapiens; identical to SEQ ID NO: 29363

SEQ ID NO: 39109 - DNA, 201 bp, Homo sapiens; identical to SEQ ID NO: 29364

SEQ ID NO: 39110 - DNA, 201 bp, Homo sapiens; identical to SEQ ID NO: 29365

SEQ ID NO: 39111 - DNA, 201 bp, Homo sapiens; identical to SEQ ID NO: 8427

SEQ ID NO: 39112 - DNA, 201 bp, Homo sapiens; identical to SEQ ID NO: 29367

SEQ ID NO: 39113 - DNA, 201 bp, Homo sapiens; identical to SEQ ID NO: 29368

SEQ ID NO: 39114 - DNA, 201 bp, Homo sapiens; identical to SEQ ID NO: 29369

SEQ ID NO: 39115 - DNA, 201 bp, Homo sapiens; identical to SEQ ID NO: 38810

SEQ ID NO: 39116 - DNA, 201 bp, Homo sapiens; identical to SEQ ID NO: 29370

SEQ ID NO: 39117 - DNA, 201 bp, Homo sapiens; identical to SEQ ID NO: 8436

SEQ ID NO: 39118 - DNA, 201 bp, Homo sapiens; identical to SEQ ID NO: 29372

SEQ ID NO: 39119 - DNA, 201 bp, Homo sapiens; identical to SEQ ID NO: 29373

SEQ ID NO: 39120 - DNA, 201 bp, Homo sapiens; identical to SEQ ID NO: 29374

SEQ ID NO: 39121 - DNA, 201 bp, Homo sapiens; identical to SEQ ID NO: 29375

SEQ ID NO: 39122 - DNA, 201 bp, Homo sapiens; identical to SEQ ID NO: 29376

SEQ ID NO: 39123 - DNA, 201 bp, Homo sapiens; identical to SEQ ID NO: 29377

SEQ ID NO: 39124 - DNA, 201 bp, Homo sapiens; identical to SEQ ID NO: 29378

SEQ ID NO: 39125 - DNA, 201 bp, Homo sapiens; identical to SEQ ID NO: 29379

SEQ ID NO: 39126 - DNA, 201 bp, Homo sapiens; identical to SEQ ID NO: 29380

SEQ ID NO: 39127 - DNA, 201 bp, Homo sapiens; identical to SEQ ID NO: 8404

SEQ ID NO: 39128 - DNA, 201 bp, Homo sapiens; identical to SEQ ID NO: 38745

SEQ ID NO: 39129 - DNA, 201 bp, Homo sapiens; identical to SEQ ID NO: 29382

SEQ ID NO: 39130 - DNA, 201 bp, Homo sapiens; identical to SEQ ID NO: 29383

SEQ ID NO: 39131 - DNA, 201 bp, Homo sapiens; identical to SEQ ID NO: 8407

SEQ ID NO: 39132 - DNA, 201 bp, Homo sapiens; identical to SEQ ID NO: 29385

SEQ ID NO: 39133 - DNA, 201 bp, Homo sapiens; identical to SEQ ID NO: 29386

SEQ ID NO: 39134 - DNA, 201 bp, Homo sapiens; identical to SEQ ID NO: 29387

SEQ ID NO: 39135 - DNA, 201 bp, Homo sapiens; identical to SEQ ID NO: 29388

SEQ ID NO: 39136 - DNA, 201 bp, Homo sapiens; identical to SEQ ID NO: 29389

SEQ ID NO: 39137 - DNA, 201 bp, Homo sapiens; identical to SEQ ID NO: 29390

SEQ ID NO: 39138 - DNA, 201 bp, Homo sapiens; identical to SEQ ID NO: 29391

SEQ ID NO: 39139 - DNA, 201 bp, Homo sapiens; identical to SEQ ID NO: 29392

SEQ ID NO: 39140 - DNA, 201 bp, Homo sapiens; identical to SEQ ID NO: 8411

SEQ ID NO: 39141 - DNA, 201 bp, Homo sapiens; identical to SEQ ID NO: 29394

SEQ ID NO: 39142 - DNA, 201 bp, Homo sapiens; identical to SEQ ID NO: 29395

SEQ ID NO: 39143 - DNA, 201 bp, Homo sapiens; identical to SEQ ID NO: 38763

SEQ ID NO: 39144 - DNA, 201 bp, Homo sapiens; identical to SEQ ID NO: 29396

SEQ ID NO: 39145 - DNA, 201 bp, Homo sapiens; identical to SEQ ID NO: 29397

SEQ ID NO: 39146 - DNA, 201 bp, Homo sapiens; identical to SEQ ID NO: 8420

SEQ ID NO: 39147 - DNA, 201 bp, Homo sapiens; identical to SEQ ID NO: 8421

SEQ ID NO: 39148 - DNA, 201 bp, Homo sapiens; identical to SEQ ID NO: 8428

SEQ ID NO: 39149 - DNA, 201 bp, Homo sapiens; identical to SEQ ID NO: 8435

SEQ ID NO: 39150 - DNA, 201 bp, Homo sapiens; identical to SEQ ID NO: 8440

SEQ ID NO: 39151 - DNA, 201 bp, Homo sapiens; identical to SEQ ID NO: 29403

SEQ ID NO: 39152 - DNA, 201 bp, Homo sapiens; identical to SEQ ID NO: 29404

SEQ ID NO: 39153 - DNA, 201 bp, Homo sapiens; identical to SEQ ID NO: 29405

SEQ ID NO: 39154 - DNA, 201 bp, Homo sapiens; identical to SEQ ID NO: 8403

SEQ ID NO: 39155 - DNA, 201 bp, Homo sapiens; identical to SEQ ID NO: 29407

SEQ ID NO: 39156 - DNA, 201 bp, Homo sapiens; identical to SEQ ID NO: 29408

SEQ ID NO: 39157 - DNA, 201 bp, Homo sapiens; identical to SEQ ID NO: 29409

SEQ ID NO: 39158 - DNA, 201 bp, Homo sapiens; identical to SEQ ID NO: 29410

SEQ ID NO: 39159 - DNA, 201 bp, Homo sapiens; identical to SEQ ID NO: 8406

SEQ ID NO: 39160 - DNA, 201 bp, Homo sapiens; identical to SEQ ID NO: 29412

SEQ ID NO: 39161 - DNA, 201 bp, Homo sapiens; identical to SEQ ID NO: 8416

SEQ ID NO: 39162 - DNA, 201 bp, Homo sapiens; identical to SEQ ID NO: 8419

SEQ ID NO: 39163 - DNA, 201 bp, Homo sapiens; identical to SEQ ID NO: 8422

SEQ ID NO: 39164 - DNA, 201 bp, Homo sapiens; identical to SEQ ID NO: 29416

SEQ ID NO: 39165 - DNA, 201 bp, Homo sapiens; identical to SEQ ID NO: 29417

SEQ ID NO: 39166 - DNA, 201 bp, Homo sapiens; identical to SEQ ID NO: 5444

SEQ ID NO: 39167 - DNA, 201 bp, Homo sapiens; identical to SEQ ID NO: 5443

SEQ ID NO: 39168 - DNA, 201 bp, Homo sapiens; identical to SEQ ID NO: 29420

SEQ ID NO: 39169 - DNA, 201 bp, Homo sapiens; identical to SEQ ID NO: 29421

SEQ ID NO: 39170 - DNA, 201 bp, Homo sapiens; identical to SEQ ID NO: 29422

SEQ ID NO: 39171 - DNA, 201 bp, Homo sapiens; identical to SEQ ID NO: 29423

SEQ ID NO: 39172 - DNA, 201 bp, Homo sapiens; identical to SEQ ID NO: 29424

SEQ ID NO: 39173 - DNA, 201 bp, Homo sapiens; identical to SEQ ID NO: 8429

SEQ ID NO: 39174 - DNA, 201 bp, Homo sapiens; identical to SEQ ID NO: 8430

SEQ ID NO: 39175 - DNA, 201 bp, Homo sapiens; identical to SEQ ID NO: 8431

SEQ ID NO: 39176 - DNA, 201 bp, Homo sapiens; identical to SEQ ID NO: 8432

SEQ ID NO: 39177 - DNA, 201 bp, Homo sapiens; identical to SEQ ID NO: 8433

SEQ ID NO: 39178 - DNA, 201 bp, Homo sapiens; identical to SEQ ID NO: 29430

SEQ ID NO: 39179 - DNA, 201 bp, Homo sapiens; identical to SEQ ID NO: 8434

SEQ ID NO: 39180 - DNA, 201 bp, Homo sapiens; identical to SEQ ID NO: 29432

SEQ ID NO: 39181 - DNA, 201 bp, Homo sapiens; identical to SEQ ID NO: 8437

SEQ ID NO: 39182 - DNA, 201 bp, Homo sapiens; identical to SEQ ID NO: 29434

SEQ ID NO: 39183 - DNA, 201 bp, Homo sapiens; identical to SEQ ID NO: 29435

SEQ ID NO: 39184 - DNA, 201 bp, Homo sapiens; identical to SEQ ID NO: 8438

SEQ ID NO: 39185 - DNA, 201 bp, Homo sapiens; identical to SEQ ID NO: 38814

SEQ ID NO: 39186 - DNA, 201 bp, Homo sapiens; identical to SEQ ID NO: 29438

SEQ ID NO: 39187 - DNA, 201 bp, Homo sapiens; identical to SEQ ID NO: 29437

SEQ ID NO: 39188 - DNA, 201 bp, Homo sapiens; identical to SEQ ID NO: 29440

SEQ ID NO: 39189 - DNA, 201 bp, Homo sapiens; identical to SEQ ID NO: 29439

SEQ ID NO: 39190 - DNA, 201 bp, Homo sapiens; identical to SEQ ID NO: 8441

SEQ ID NO: 39191 - DNA, 201 bp, Homo sapiens; identical to SEQ ID NO: 29441

SEQ ID NO: 39192 - DNA, 201 bp, Homo sapiens; identical to SEQ ID NO: 38818

SEQ ID NO: 39193 - DNA, 201 bp, Homo sapiens; identical to SEQ ID NO: 8442

SEQ ID NO: 39194 - DNA, 201 bp, Homo sapiens; identical to SEQ ID NO: 8443

SEQ ID NO: 39195 - DNA, 201 bp, Homo sapiens; identical to SEQ ID NO: 8446

SEQ ID NO: 39196 - DNA, 201 bp, Homo sapiens; identical to SEQ ID NO: 8444

SEQ ID NO: 39197 - DNA, 201 bp, Homo sapiens; identical to SEQ ID NO: 8445

SEQ ID NO: 39198 - DNA, 201 bp, Homo sapiens; identical to SEQ ID NO: 8447

SEQ ID NO: 39199 - DNA, 201 bp, Homo sapiens; identical to SEQ ID NO: 8448

SEQ ID NO: 39200 - DNA, 201 bp, Homo sapiens; identical to SEQ ID NO: 5442

SEQ ID NO: 39201 - DNA, 201 bp, Homo sapiens; identical to SEQ ID NO: 8449

SEQ ID NO: 39202 - DNA, 201 bp, Homo sapiens; identical to SEQ ID NO: 5445

SEQ ID NO: 39203 - DNA, 201 bp, Homo sapiens; identical to SEQ ID NO: 8451

SEQ ID NO: 39204 - DNA, 201 bp, Homo sapiens; identical to SEQ ID NO: 8453

SEQ ID NO: 39205 - DNA, 201 bp, Homo sapiens; identical to SEQ ID NO: 8454

SEQ ID NO: 39206 - DNA, 201 bp, Homo sapiens; identical to SEQ ID NO: 29456

SEQ ID NO: 39207 - DNA, 201 bp, Homo sapiens; identical to SEQ ID NO: 5439

SEQ ID NO: 39208 - DNA, 201 bp, Homo sapiens; identical to SEQ ID NO: 29458

SEQ ID NO: 39209 - DNA, 201 bp, Homo sapiens; identical to SEQ ID NO: 38832

SEQ ID NO: 39210 - DNA, 201 bp, Homo sapiens; identical to SEQ ID NO: 8455

SEQ ID NO: 39211 - DNA, 201 bp, Homo sapiens; identical to SEQ ID NO: 29460

SEQ ID NO: 39212 - DNA, 201 bp, Homo sapiens; identical to SEQ ID NO: 29461

SEQ ID NO: 39213 - DNA, 201 bp, Homo sapiens; identical to SEQ ID NO: 29462

SEQ ID NO: 39214 - DNA, 201 bp, Homo sapiens; identical to SEQ ID NO: 29463

SEQ ID NO: 39215 - DNA, 201 bp, Homo sapiens; identical to SEQ ID NO: 29464

SEQ ID NO: 39216 - DNA, 201 bp, Homo sapiens
ccagaatgagtgtgttttctagctgtcactgcctgatgtttactgctcaaagcttaggacttggattagagcccaggacttggcagccaagataaaccagstgcaattacgctgaacatctcagcccagctcctgtccatccctgaacaggacacttagggtagaggatgttctcagcagtgccatttgcatcccccttca

SEQ ID NO: 39217 - DNA, 201 bp, Homo sapiens
ctaaagtcagttacataaccaagcccagcttcagaagggaaattgtatgccttacaaggaggtgagaggatggaaaatgaatatttgctgaacagactttytgtccagtttgttgtatttggtggtggtgcagggcaaatatatgtttaaaaccttgttcagatttttagctttcttcagaacagagcttttaaaactgag

SEQ ID NO: 39218 - DNA, 201 bp, Homo sapiens
cgatgagattggaggcacctgggtgtcagcctcttgggctggctcattacaggccactctgtctgaggaacactcaggtttgcaaaccgtttcttaaaatwacaggatacctagggacctgttggggtgggagggaagaaccctatgggcagaaatgtgactttctgtagcaaagatgtactgtttcccactgagaagaat

SEQ ID NO: 39219 - DNA, 201 bp, Homo sapiens
aaactggctgactgagttaaatgaatgccaaagtcacagagctgctgagtggcagagttgtaattcccatgcagaactgtgtggcatcaaagccatttttwaactcattgcaatgcacagtgggttaaaatgagatgattgaaaatgagatgtggctgggcatggtggctcacacctctaattccagcactttgagaggat

SEQ ID NO: 39220 - DNA, 201 bp, Homo sapiens
tacaggattttacatggcttagagaaatactgtggtggtgaaaatatgcataaaaaagcgagagattttacttttgaaatgctgccaaagtgaaatctctyttggataggcagatgacagtttagtacttgcaggtctttcgattctgacaactgtcagaagtgaatttaagtgctggtgactaggctgccagagaaacac

SEQ ID NO: 39221 - DNA, 201 bp, Homo sapiens
gttacatcaaggctgggaggaggtctttccactggttttccgggctgtttgtgtactacacagcctgtgtacctggcaaggcacgctctgctctgccctgmcttctgatgagctgactaacaccttatagatgaggttcccttagaaccaaagatgccccatgaaactccctaggatgaatgttggaagtccttccaactg

SEQ ID NO: 39222 - DNA, 201 bp, Homo sapiens
gaatcattttctttgattctctgcccttccccactacagtgtaaactccatttggactttctctagttcactgtgaatggtttttgaataacatcaattascataacctcatgcccagcatcgtccttattgttgagagcacagcagtgacaaaggtgcaactcttgctcttgagcgatcacagtttatttggggaacctg

SEQ ID NO: 39223 - DNA, 201 bp, Homo sapiens
agatttatccctgcccgaatcattttctttgattctctgcccttccccactacagtgtaaactccatttggactttctctagttcactgtgaatggttttygaataacatcaattagcataacctcatgcccagcatcgtccttattgttgagagcacagcagtgacaaaggtgcaactcttgctcttgagcgatcacagt

SEQ ID NO: 39224 - DNA, 201 bp, Homo sapiens
caaaatgctgatagcaatatggacaataatgtccaggctgaggtggtctcagatggagatgaggagctcgttgggaattggagcacaggtgactcttgttwtgttttaacaaagagactggcagcattttgcccctgcgctagagatttgtggaactttgaacttgagaaagatgatttagggtatctggccgaagaaatt

SEQ ID NO: 39225 - DNA, 201 bp, Homo sapiens
ggctttgcccaaaatgctgatagcaatatggacaataatgtccaggctgaggtggtctcagatggagatgaggagctcgttgggaattggagcacaggtgmctcttgttatgttttaacaaagagactggcagcattttgcccctgcgctagagatttgtggaactttgaacttgagaaagatgatttagggtatctggcc

SEQ ID NO: 39226 - DNA, 201 bp, Homo sapiens
ccctcaacctgttagaaacaagaaatgggactctggagtagatgttagcaacatcatgagctcaaacccctccagcttacagcggagacagtgaggtcctstaggatgaggttggagagcaggaacttgcccgaggtcatgtgcagagttcgaggcagggcctggatgggaagcccagcatggagaccccaggccgtctct

SEQ ID NO: 39227 - DNA, 201 bp, Homo sapiens
caaaaggagcctatgtagctttgggagttctctatttagtcaccttattttttttgtcttcttgttaaactagcatcctgttttactgaatctctgcctcmgttgctttatttactgtatacatacatagctcttttgaagacttgatgtcaaaagtaaagaagttcagaacctacggggcttgctttgggtcccaaatta

SEQ ID NO: 39228 - DNA, 201 bp, Homo sapiens
acaagagagcaggtatttattgagttatgactgtcaggcatggaacagatccattggtcagaaataaggaaattgtctctaccttcaaggttctcacagtytggagggaacagagagccatcagggacaataggtccctgtgccatcagctactgggatgtatgactttccagtagaggtacacagcacttgttccaaaag

SEQ ID NO: 39229 - DNA, 201 bp, Homo sapiens
ggagtgcagtggcgtaatctcggctcactgcaagttctgcctcctgggttcgtgccattctcctgccttagcctcccgagtagctgggactacaggtgccygccaccacacctggctaattttttttttttttttttttttgcatttttagtcgagacagggtttcaccgtgttagccaggatggtctcggtctgctgatc

SEQ ID NO: 39230 - DNA, 201 bp, Homo sapiens
tattctttcctgatcaggaaactccgcagagagaaagtgacagttgaagactatattgaattttggcccacaggaaaaggaaactttgctgttagggtcasctggaggagagactgcaggggtcagagatcagggccatatgctagagctgcaatgtgggtgctcaaatgatgttcagtgcatcttcacagatggacctcc

SEQ ID NO: 39231 - DNA, 201 bp, Homo sapiens
ccgagtttgtgttctccgattccacaccccatgttccttctactacaacttctggctctggcttctggactgtcagtcattagcactccctatccctaagrtttcaggaatgttcagctgttgcctagcttggaatggaccatcctctggtcccacccatgggtaagtcattggctgcagagcgcagacatttggctccct

SEQ ID NO: 39232 - DNA, 201 bp, Homo sapiens
gtgcggtggcatgattgtagctcactccagtcttgagctcctggactcaagagatcctcctgcctcagtttcctgagtagctgagaccacaggcacgggayaccatgccagtctaatttttaaattttttgtagggacagggcctcactgtgttgcccaggctcatctcaaactcctggcttcaagtgatccttctgcatt

SEQ ID NO: 39233 - DNA, 201 bp, Homo sapiens
caaaaagaaattaggtaacttgctcagtggctagtgagtggctagattgtaagcttcatgagggcaggggactttgacgattttgtcggtatcctaagccsctagaacagtgcctaaacatttgttgggcagttaatatatatttgttctattaataagtagagcccgagtttgtgttctccgattccacaccccatgttc

SEQ ID NO: 39234 - DNA, 201 bp, Homo sapiens
aattatgtagtgtctacagagccagtggtttattttgcattgtttatgtcagcattaagcagtattcttacacagtttgtaagtcttaaaactcagtatckactctagtagttgctccaaatgtgatgtcctcataaatcaccgagggatcttgttaaatttggattctgattcagtaggtctaggtggggcccgagcttc

SEQ ID NO: 39235 - DNA, 201 bp, Homo sapiens
tactagctaattccaggcttcaagccactggggcataggcatatgtttagctcattccacaggaggggaacagaggctcaaagaacctaggtaagttggcyaggcgcggtggctcacacctgtaatctcagcgctttgtggggcttaggcaggaggattgcttgagctcagaagtttgagaccagcctggacaacatagcg

SEQ ID NO: 39236 - DNA, 201 bp, Homo sapiens
ctttttttaacttgtattttgggttcaggggtacatgtgcaggtttgttatataggtaacttcatgtcacaaaggtttgttgaacagattatttcatcacscaggtaataagccttgtatccaatagttatttttctgatcctctccttcctctctccctctaccctcaggcaggccccagtgtctgttgttctttctttg

SEQ ID NO: 39237 - DNA, 201 bp, Homo sapiens
atgatacttccctctcagtgtattttaccaagggattattagtgtatatgtgtgttcttactggaaatgttaattggacttgtaattctttttttaacttktattttgggttcaggggtacatgtgcaggtttgttatataggtaacttcatgtcacaaaggtttgttgaacagattatttcatcacgcaggtaataagcc

SEQ ID NO: 39238 - DNA, 201 bp, Homo sapiens
tttgaaaagaatagtacaaaaatgatacttccctctcagtgtattttaccaagggattattagtgtatatgtgtgttcttactggaaatgttaattggacytgtaattctttttttaacttgtattttgggttcaggggtacatgtgcaggtttgttatataggtaacttcatgtcacaaaggtttgttgaacagattatt

SEQ ID NO: 39239 - DNA, 201 bp, Homo sapiens
tgcagtgagccaagattgtgccactgcacttcagcttgggcaacagagtaagactctgtctcacaataaataaataaataaataaataaataaataaatawgagttggatcacagcaaaggtgagctttaacgagttcagtctagctctctcacaaaaaaaaagttaaaatgacaaattttgtgttacatacattgtacta

SEQ ID NO: 39240 - DNA, 201 bp, Homo sapiens
ctgacttactctttgaaaagatcgctctggctgctgtgttgagtggattggtaagggacaggtggtgaagactgaaacagggtatccagttaggaagctaycacagtgatccaacccccagcttctgttgaggttgaagaacctgcatgcccaacctaaatatatgttcaaaggtggttattactgtttgaggtgatgaaa

SEQ ID NO: 39241 - DNA, 201 bp, Homo sapiens
gacatgaaggaagggattgctggaggcagaacattctaggcagaaggaaccgcacgtgcaaaggccctcaggtcagccggcatggcatgcaagtaagccasctgcaacacagcaggtgtggatgaagggaagagaattagcatttggccagagcacgcattttaagggatggagatccatttggatagtcttgaacacaga

SEQ ID NO: 39242 - DNA, 201 bp, Homo sapiens
tggtgggtcatgcatgtaatcccagcactttgggaatacgaggtgggccaatcactgaggtcaggagttcgagaccagcctggccaacatggtgaaacccygtctctactaaaaatacaaaagttagtcggggttggtggtgtgctcctgtagttccagctacttgggaggctgaggcaggagaatcacttgaatccggga

SEQ ID NO: 39243 - DNA, 201 bp, Homo sapiens
aatttgtaggagctgctcttaatgattattactgcataggctggaatagaagcaaaatttgcagtaatacttttgtacctttctctttaggccttggcatrtattaaagtactatacatttgtcttaaaaattgaaattgtagattattttcatctaagacccttttgttcacagatttttttttccaagtatacctattc

SEQ ID NO: 39244 - DNA, 201 bp, Homo sapiens
ttgtggtcaacagtggggcttagggggcaggttttgtggctgtgacagaacacgtggcccctagtgtgtctgttgaaagatgggcccctttcaggaaaatkgcttaccttactttttagacataatttttgttttctgttaaagggtcagttatagataagtatgctcccttgcaatgaaatgaacccactttatcaattt

SEQ ID NO: 39245 - DNA, 201 bp, Homo sapiens
aagaccaacgtgtaaattacatattaatctttctttttctccctagctcggttttaagaataatgttttagccaacatatctgcattactcttggctcaayatgagaaatccatttttggtttgcctaacagaagatcatgttgctttgcttctctacacagtatgaaaacccaaagaaaagaaaaacagaggcagttttt

SEQ ID NO: 39246 - DNA, 201 bp, Homo sapiens
ctgtttgaagcactgtattgagcataccatatgctgaaagacttggaatgcaaaaacctaaggccaagggcacttctcaatattaaaccctcagttgtaakggaggcatcaagactataagatccaagaccttaacttttgtgctccttgtcttgtggagggaacatccatcctcaaaacagaaacctgtgagatcccttg

SEQ ID NO: 39247 - DNA, 201 bp, Homo sapiens
tggccaaattctgtttgaagcactgtattgagcataccatatgctgaaagacttggaatgcaaaaacctaaggccaagggcacttctcaatattaaacccycagttgtaatggaggcatcaagactataagatccaagaccttaacttttgtgctccttgtcttgtggagggaacatccatcctcaaaacagaaacctgtg

SEQ ID NO: 39248 - DNA, 201 bp, Homo sapiens
gaagagattctcgtccgctcagttaaggtactcagactattttccaaccaatcaagagggtgctgcttcatggagttcgtttaagctgaagcggcagctgktgactgtcatttgcatcatctttatacatttactgtgaatgtcactgtccatttccactttctttctacttgtcttcaaattgatgcttatcaagtagac

SEQ ID NO: 39249 - DNA, 201 bp, Homo sapiens
tcaagtgatcctcctgccttgagctcccgaagcgctgggaccaatagagatttctctgagaattaggtcccccactattaataaggtcattgtcagctgarttggggaggtggcgtgggtagatacaattaatttagattttttaaaaggcttttgagaatattcggagaacctaatatattttgagacctgacatttatt

SEQ ID NO: 39250 - DNA, 201 bp, Homo sapiens
tactgctccatcaatacccatcccaggagacagtggcagtcttgatgtcaatcttgttttaggatcattgccagtggaattcaggactgcggttctacccrgtaccggggaaccaggtgagggggttaagaggcctgggcccatggaaggggtgagagagagccacatacttacagttgtgaagggggccagccaggatgg

SEQ ID NO: 39251 - DNA, 201 bp, Homo sapiens
tagactgtgaggtatgaagtacctcacagtaaagaagtcatgttattgctggaaaaggggacatgggtattaaaaagacaaaaacaacagggcttcatcayagcagctatactgctccatcaatacccatcccaggagacagtggcagtcttgatgtcaatcttgttttaggatcattgccagtggaattcaggactgcgg

SEQ ID NO: 39252 - DNA, 201 bp, Homo sapiens
gtcacatgtaaatcattgagccaatcaccgtctttctgtctggacctggaataaagaccaccttagagcatgggagcgggatccccttgatccacaccatrtagactgtgaggtatgaagtacctcacagtaaagaagtcatgttattgctggaaaaggggacatgggtattaaaaagacaaaaacaacagggcttcatca

SEQ ID NO: 39253 - DNA, 201 bp, Homo sapiens
ctcttcttattatagtgcaaggtgtttggcagaggtgtggtagctgaaggcccaaggataacattgtccagattttcagtctttggagccataaacatccrgttctttccagccccgctcaaccgcctctcttaattcaccaccctgttagcttcatctcaggccagacattgtaggtggcagcaattgtaggacaatgag

SEQ ID NO: 39254 - DNA, 201 bp, Homo sapiens
aaatctggaatgatctactggcatcatgcctaggactttggaaaacttgaaggttggcacctttggggaaaaccagacttttgaagcaggggctctgattktctcttcttattatagtgcaaggtgtttggcagaggtgtggtagctgaaggcccaaggataacattgtccagattttcagtctttggagccataaacatc

SEQ ID NO: 39255 - DNA, 201 bp, Homo sapiens
gagatgtggcagagggtaggcagagagattgcaagcagggaaggatttcacgtactgccactggctttgaagatggagggggcacatggctagaaatatgrgcggccctcagaagctaagaactagctctttctgacagccagaaggaaatagggaccttccacctacaatagcatggaaaacggggacctcagttctgca

SEQ ID NO: 39256 - DNA, 201 bp, Homo sapiens
agctgactttagaataggaaggttatcctgggtgattagcatggatcagagttctcacaggagcccttcaaagcagaaggggaaggtggacaagagaatcrgagagatgtggcagagggtaggcagagagattgcaagcagggaaggatttcacgtactgccactggctttgaagatggagggggcacatggctagaaata

SEQ ID NO: 39257 - DNA, 201 bp, Homo sapiens
tgagccagaggtctgtctcttgcggcatttctgcttttgagaacctcccgtttcctgaaaggcaccagaccccaagacagctctgctgcctgattggtagrtgcccatgacagctctgcttcatgcctgctgcctcctcatccctctggatgccttgtggtcctgcttgtctgaagagcataaacttgggggttcccactc

SEQ ID NO: 39258 - DNA, 201 bp, Homo sapiens
gtcactctaattgcccagcgttttaattatcggcgtgttttatgcttttgtgaaatgctcatttcacagcttgctggtgggtctttttgtggaacgagaargtgaatattcacaccagaaatgaggtactgaccctgaagggctttccagtcaaagagaaaggagagcatgacccgccaatgccgttgtttgtaagcagga

SEQ ID NO: 39259 - DNA, 201 bp, Homo sapiens
attatttatttgttgtcactgtttgggacccctgttgctgtctcaccaaagaacttcttgtctcccttttagaagtttccagagcgtcttcctgatgttgsatagagcactcacacctaacagatctcagaacttgtatcttttctgggtggctagactgaaaaatccattttcttatgagtgagccagaggtctgtctct

SEQ ID NO: 39260 - DNA, 201 bp, Homo sapiens
tgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaat

SEQ ID NO: 39261 - DNA, 201 bp, Homo sapiens
ccttggccttttctgggctactcaaaaaaggattccaccaggtaaacttgaatcacctagcgctggtagaaagccttgctcttcgtcatctctcctgtgtrtcgctagccttattaaaatgtgcagaggagaccgggcatggtagcacacttgtaatctcagcacttggagaggctgaggtgggagaattgcttgaggcta

SEQ ID NO: 39262 - DNA, 201 bp, Homo sapiens
ttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctattttt

SEQ ID NO: 39263 - DNA, 201 bp, Homo sapiens
ggatttcctgctcttaaggttttttgtttttgtttttctctccaaataaatggtatttattaaataaaaattcattttctcatttatcaaccagttgcagyctttggatgttttaattatataaaaaaagcatggaaactgggcattttaattagcaagtacagccttgacacaaataaaggcatggctttggttatgcag

SEQ ID NO: 39264 - DNA, 201 bp, Homo sapiens
cagtttactaaaaataacaaaacattcttccatcagtcatgcatgccttatatttatgtagatacaaaaatagagtttgatattaaacaatactccaagamagccatttctgcagagttaaaaaatacgtaggttcagttccttaccaacacgtagacatgttgtgatgaaagaaggaaaggaaggaaggaaggaggaagg

SEQ ID NO: 39265 - DNA, 201 bp, Homo sapiens
aacataactgtaagaatttatcagattatatatatatatatttatcagattatatatatatttatcagattttatatatatatatatatatatatatatatgcatatgtttgtatataaatatacatgtaaagacccaaaactcatataaaaagacaaggtgatacagcattttaaaacagtttactaaaaataacaaaac

SEQ ID NO: 39266 - DNA, 201 bp, Homo sapiens
caacataactgtaagaatttatcagattatatatatatatatttatcagattatatatatatttatcagattttatatatatatatatatatatatatatatgcatatgtttgtatataaatatacatgtaaagacccaaaactcatataaaaagacaaggtgatacagcattttaaaacagtttactaaaaataacaaaa

SEQ ID NO: 39267 - DNA, 201 bp, Homo sapiens
gagtgctgtttcaaacagttgaaaccattcctacttccaaaaagaatttgactcaaaagggaatagtacactacatataaaagacagatgtatttaatttrtgtttcgaactacatatcagaaattagttagaagaagatatgagataaatatacctggaaactttatgaattatttctgacatctagcattaaatttagc

SEQ ID NO: 39268 - DNA, 201 bp, Homo sapiens
aaattttcatagacatccaccccctcactgccacaccccctcatagatttcttcttttcctcctccttctcctcctccctcttcctcctctttttcccccmccttcaaatagttccaagaccagagttgagggtgggtgggtagagggctagtttacagataaaatggttggtgtagatcatctagtttggaaaaagcaca

SEQ ID NO: 39269 - DNA, 201 bp, Homo sapiens
taccaccacgcctggctaattttttgtatttttagtagagacgggatttcaccatgttggccatattggtcttgaactcctgacctcaagtgatcctcccrcctcagctgcccagggtgctgggatcacaggcgtgagccaccgtgcgcgacctcagggtcccttctaacctgtgctgttgtcataaaccctggaggagaa

SEQ ID NO: 39270 - DNA, 201 bp, Homo sapiens
ctgtcaaacaacacagtccccatctgtactttgggagggaaggacttcttaattccagctgcctgttgccatgggggaacatagacccagaactgccatcytttctaatttttttaaaaattagaggctaaaagttttggcttataaaaatggtatttcctgagtttttacaattatagtattaagatattcctaggtttt

SEQ ID NO: 39271 - DNA, 201 bp, Homo sapiens
cccacctcagcctgagtagatgggactacaggcatgtgtcaccatgccaggctaatgtttaaaaatttttcttagaggtagagcctcactttgctgcctargctgatctagaactcctggcttcaagtgatcctcctgccttgagctcccgaagcgctgggaccaatagagatttctctgagaattaggtcccccactatt

SEQ ID NO: 39272 - DNA, 201 bp, Homo sapiens
tgctgggaatgcgttcattttctttatcttgccattactgtacctctattgggaaatttactctctcttcatagataggatccgattcagtacatatttakaaaaccacacttacatttaaatacaggcctttcccatttcacagtgtttctagctcccctttccaatacatctctctctctctttctctctctctctctc

SEQ ID NO: 39273 - DNA, 201 bp, Homo sapiens
tggtggggaaggatgttgcggtggggttggggtggcaatgaaaggtgaaaaccactgtggtcccacctgcccatcgtcagatttcggttcctctcagagtyaacgtagaaggtttctgggggcatggacctgagtcttatcccctttgcaaaagtaagaattgtatcgtagcctgactcagggttttagccaacttctctg

SEQ ID NO: 39274 - DNA, 201 bp, Homo sapiens
gttttcgagacgaagtttcgctctcatttcccaggatggagtgcagtggtgcaatctcctccgcctcccagtttaagccattctcctgcctcagcctcctragtagctgggattacaggcgcccgccaccatgcccggctaattttttgtattttttagtacagacggggtttcagcatgttggccaggctggtctcaaac

SEQ ID NO: 39275 - DNA, 201 bp, Homo sapiens
tgcgggtggatcacctgatgataggagttcaagaccagcctcaccaacatggtgaaaccctatccctattaaaaatacaaaaattaacaggcgtggtggcrggcatctgttgttccaggtactcgggaggctgaggcagcagaattgcctgaactcgggaggtggaggtagcagtgagctgagatggcaccactgcactcc

SEQ ID NO: 39276 - DNA, 201 bp, Homo sapiens
ctgacttctgtgcctgttttcttgcctaagcggtggacgcattgagtaggagaaggccagttattcctctttgtcactgatacaactggggacctgttgcyggagatgtggagctgtgcattagggctgggtagaacacacataatgaaccatatgcacgagaactttttcatctttctgcatacacttggaactagttct

SEQ ID NO: 39277 - DNA, 201 bp, Homo sapiens
acctgcctccgtggtttgtcaggacatttagaaatgcagacttgctcaagacctggatctcaggtggtaggttggtccacagacagtggcaccactagctrttatttatttgttgtcactgtttgggacccctgttgctgtctcaccaaagaacttcttgtctcccttttagaagtttccagagcgtcttcctgatgttgc

SEQ ID NO: 39278 - DNA, 201 bp, Homo sapiens
gccaaaaagaatgtgccacctagatgctatttataaccattttcacctcttgcctccaggggctaaattggaaacctaattttagatgcataaaagccaawatatgtataggagaagctccaaaataaaatatcccagagtggcttgtaagcatccttccaacaggttcaggttgatttaccttgctgtggatatttaatt

SEQ ID NO: 39279 - DNA, 201 bp, Homo sapiens
tacatctttcagcctctaccacattgaattggaattatatgtctgttttatgtaccatgctgtgaactccttgaagataggagctgtcttatcttcaaggygctcaagacacgtttgttgcatcagttgaatggagtcaaattataaacaggtgatgggggcaaatatcacaatatgatactctgaacatcttctctgaca

SEQ ID NO: 39280 - DNA, 201 bp, Homo sapiens
cctccctttccagataaaagttgactctcataattgtaactctcccctactttatcagcatctacatctttcagcctctaccacattgaattggaattatwtgtctgttttatgtaccatgctgtgaactccttgaagataggagctgtcttatcttcaaggtgctcaagacacgtttgttgcatcagttgaatggagtca

SEQ ID NO: 39281 - DNA, 201 bp, Homo sapiens
cagaagagtgtaggacactggaaaagtagcagggtgtgcgattgcagggatgggaccagcagtaaaaggtagccctgccaagaccattaagcttcctgcarctccttctggatcccacaatttgaaggggaaatctttcccaccgcacatcactgtttggtggactaaatggctccccgatgtcccgaaagagcacagctt

SEQ ID NO: 39282 - DNA, 201 bp, Homo sapiens
agagggcgatggctccactctgtgtggccccgtcaatggcctggacgcagctgaaaaaatccagaagagtgtaggacactggaaaagtagcagggtgtgcrattgcagggatgggaccagcagtaaaaggtagccctgccaagaccattaagcttcctgcaactccttctggatcccacaatttgaaggggaaatctttcc

SEQ ID NO: 39283 - DNA, 201 bp, Homo sapiens
gccttgctcttgcagtttctgacacatcaccattgatcagtcctgggaaacaaacaaaatagagggcgatggctccactctgtgtggccccgtcaatggcstggacgcagctgaaaaaatccagaagagtgtaggacactggaaaagtagcagggtgtgcgattgcagggatgggaccagcagtaaaaggtagccctgcca

SEQ ID NO: 39284 - DNA, 201 bp, Homo sapiens
taacccatccagacctggagaactcctagagggagaaacagggaggacccaggcacataaacttgcagagcagctgagttatcagatcttccaagccatgsggttatcgagctttatcagagcagccttgctcttgcagtttctgacacatcaccattgatcagtcctgggaaacaaacaaaatagagggcgatggctcca

SEQ ID NO: 39285 - DNA, 201 bp, Homo sapiens
aaatggccaaaagtttgtttcaagtctagtctgatgaataaagcaggagatttatttttggcaaaagtggcaaataaagagggctgatttttgtatatggstactgaaatggcttagaatgccattttatcacatggtcaaattattcaatgatcaaatatcgaattattaaaaattatcaaaaggaagttccctgaaaca

SEQ ID NO: 39286 - DNA, 201 bp, Homo sapiens
ggttaaatcttgtaaagatgctttttaaagcatattaatccattagtaatccatttggatttgggaatacggtcatatactgtttggtacaatatgtactraacctggtcctggaaaattaagtggaaatataggtttaaactactggaacttcaaaatagcttctcagtaattccttctcagcaatcattccaattccta

SEQ ID NO: 39287 - DNA, 201 bp, Homo sapiens
cctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggctttttcggttgtgaagatcagtaccttgaaattcagaatagatggca

SEQ ID NO: 39288 - DNA, 201 bp, Homo sapiens
ggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgc

SEQ ID NO: 39289 - DNA, 201 bp, Homo sapiens
ggtcctccatgtacagccatgatcacaactctctaacgtggtcacttgcttgcacacacttgtttagatgtctctgccctgctgttaattagactgtgagyctccagagggtgagactgacatctcatttctctttgcagtcacagcagagatgcaggcccacagtagggactcaccagatgtggcagggtgagggaattg

SEQ ID NO: 39290 - DNA, 201 bp, Homo sapiens
aaaagtgtagtggtttgtagggtcatccccctaaagatatcccgccccaccaaagatatccctaaagacatcctgctggtttcagtggctcatgcctgcawtcccagcactttgggaggctgaggcaggcggatcacttgagctcaggaattcgagaccagcctggccaacatggtgaaaccttatccgtaaaaaaaataa

SEQ ID NO: 39291 - DNA, 201 bp, Homo sapiens
ccaaaagcggattattgacctctgtgcccatcttgggagaaattgccacttggtctgtgtctacacagacccaagaggagaagggatttgacaatggtctsattaattgaatcagtggtttgggggagtgggctgtctgtattgatccaattaaatagataattgtcagaatcgaggtcatgtctataagacaccaccatt

SEQ ID NO: 39292 - DNA, 201 bp, Homo sapiens
ataggaacatgaatttgcattccttccaactggtgtgtttccaaaatacagacaggcaagtttgaatcactttgactttgaaagcgtgattttgagcaatyatctggggaaaaaaatacctcctcttcactaaataagtctgtcaaaaagagtcatagtacagcgtgccattgccagaatacacgtgtgtgctggtaagct

SEQ ID NO: 39293 - DNA, 201 bp, Homo sapiens
cctggctaacatggtgaaaccccatctctactaaaaatacaaaaaattagctgggtgtgttggtgggcacctgtacttccaggtgcttgggaagctgaggmaggagaatcacttgaactcagaaggccaaggttgtagtaagctgagattgcaccactgcactgcagccttggcaacagagcgagactccatctcaaatca

SEQ ID NO: 39294 - DNA, 201 bp, Homo sapiens
ccatgtttctttatcttcttctttttttttttttttttagccatagtctcactctgtcacctaggctggagtgcagtggtgcgatctcggctcactgcaarttctgcctgctaagatcaactgattctcctgcctcagccttccaagtagctgggattataggcatgagccaccatgcctggctaatttttgtatttttag

SEQ ID NO: 39295 - DNA, 201 bp, Homo sapiens
taatggcccatcatttataatggctgcctgataattggagatacatgcaccagacttgacttaactgttctcttagtcatcagacatttagatttcaacakgctcctgttaagctctccttacagtgtgtgtggcactgtgcagttgaatgaaacatgccatggccagtggaaacaggcttgggctgatggagagggccta

SEQ ID NO: 39296 - DNA, 201 bp, Homo sapiens
tcccattgcacttctcttcaagtttgcccagatagtaagttctactagacatgtcaattttttctgaggtctaatcttgatttttttttcctgcacaatayggaattcagtgtttttatttaatcattcagtaagtcttgactgcctgctatggaggttaagccctttactaagttccaaggatgtacctgtgaataaggc

SEQ ID NO: 39297 - DNA, 201 bp, Homo sapiens
acctattgctcatttttaccagttaaaactatttaatgagcatttgcccactttctaaaaatatgatggtcttagttacccacatggacctactctatccyaggcagatgccacaaattattttgttttctttttgtatatatttatgctgtttcctcatttttaaatagtgggctttgatgactattcttctacataaat

SEQ ID NO: 39298 - DNA, 201 bp, Homo sapiens
tgcaggcttaaggctggaagaaaccccaagcatttggccaggaagaggcaactagttccagctggcccacatactacactttaaaaattacccagatgatstgattctgtagagagagagtgggtggagaggactccagggccatggaggaagattcggcctttctctccctaatcatgagcaatgtgatttggagagaga

SEQ ID NO: 39299 - DNA, 201 bp, Homo sapiens
cttcaaagatacaaagctagaaactacaaaactaggcatggttaataaataactgaaataccaggtgtatagaaatgcatctgtggaaaaatgaaatcatrtattctctaggatatattaggaaatggctctttggcaagtctagagggtaaagtatccctgaagggggaaaaggtttaaaaacagtaaactaaagaagat

SEQ ID NO: 39300 - DNA, 201 bp, Homo sapiens
ttgaaggtgacagagactgagaaagggctgcacacctttggcctaaagggtaatgagcaacacacaaggattgggagatgttcatggcaagaaaaattcasaagggacattgttgtttcactaattctgtaaaggagagcagcggcatttacttaggccgattccccattctctctttctgtttttaaacagagacagatc

SEQ ID NO: 39301 - DNA, 201 bp, Homo sapiens
tagttcaaataatacatatgctgaaattcctatatcccccccatactccagatcttcagtgtggaatttaaatataattccttattgtaaaaaaaaaaaawttttttttgatcaaggtgattttgataaactaaatgcatctttaattttactcacagcaaagcgattctttattttctctctaaaagcataattgatgtg

SEQ ID NO: 39302 - DNA, 201 bp, Homo sapiens
tctttccccctcaacttccataggaaccaaactctctttcttcctcccgtttggttggaaagttattttgcctcactgcgtgatttttctactgcaccaaytcccctttcaaacgttattccacaacatactaaattaatgtatactgtgttctttgggtaatggggaggggagcctgtctcacagcacgcatttgttcag

SEQ ID NO: 39303 - DNA, 201 bp, Homo sapiens
ccttttgactccctaaggaaccctgttttgggtttcttttgaggttgaagatatttcagactctttccccctcaacttccataggaaccaaactctctttmttcctcccgtttggttggaaagttattttgcctcactgcgtgatttttctactgcaccaactcccctttcaaacgttattccacaacatactaaattaat

SEQ ID NO: 39304 - DNA, 201 bp, Homo sapiens
agactggccataagttgggagggtaagtaattggttgtgattgaaaggaaagaaggaggtaatgatgagttttggtctgggaaccggagaatggtggtccrtggacagaaatagagaaggcaagatgagaagatgcaataggcaaaggcagtgagtttaatggttgacttttggtatttgctgtgtatgccctctgtacct

SEQ ID NO: 39305 - DNA, 201 bp, Homo sapiens
gaggagaacatagtccaggttgaaccttgctgcctgccctctggttgaaacatcagtgttgaatcaatagaccacgtcctgtccataccttgggaattagrctcacccagactctgagttaagagtttctatgagacagagggctggactgggggagcaaggcttgcaaatcgaaagcatcagttgctacccctgagcacc

SEQ ID NO: 39306 - DNA, 201 bp, Homo sapiens
gctcagggcctgggaagtggtagggagggaccttcccagaagagagatgactcaggctggtcccaagcccctcctgtagaacaaacagacaaggtgaggascaaggaggcatttggaggtcatctggcccagcacccttgtctggaagacagatttaagttccataaagtcacttaggaggagaacatagtccaggttgaa

SEQ ID NO: 39307 - DNA, 201 bp, Homo sapiens
aaggaaaatgctgtcctcgaaatgttcctggcaccgttttcaagaggtgccgaccaagcgctggaattgctgacctccctgaaagagaagcctgcagctgyggcctctggggtgaattccccccatgggaggacctggtggagttaaaacagactatatccacatcacagagagctggcccattgctcagggcctgggaag

SEQ ID NO: 39308 - DNA, 201 bp, Homo sapiens
ttgctgggcatgtgcttgaaggagaaaggtgaggatacaaaggcaatgagtacatgatccttgaccttgagaaacctatagtctaatagaggaggcacatrtaaaagtaattaggtaaaatatagtgcagaatatgcagtcatggagtcatctacagatctgcctggaatacagagggacaagtgtttagtattttccaac

SEQ ID NO: 39309 - DNA, 201 bp, Homo sapiens
taaattgaagtgtaaatattcgaattattttcataaactcttcagttctgttgggcttttatgttatcatacagtgatttttttttttgtatttaagtttyctagcagttctcttttttaagagcctcaagtgtccaataaaaagcaaatacttgaattttcagtttctatatagtgcatattttttctcctgcttgcctt

SEQ ID NO: 39310 - DNA, 201 bp, Homo sapiens
agcacctgctgatggaaaggtggactcactggtcatggggagtacagtaaaattaggagagtagatagaatcctgaagcatttgagctgcaaaatcatagyaacaacagctcttaatatcctataattgaaaaagagattgccattttcaaagacctttcacagtcattctcttaatcaagtctcataataaagatgtcat

SEQ ID NO: 39311 - DNA, 201 bp, Homo sapiens
accatttgctaatgaaagttctagctgccataatttcagcacctgctgatggaaaggtggactcactggtcatggggagtacagtaaaattaggagagtaratagaatcctgaagcatttgagctgcaaaatcatagtaacaacagctcttaatatcctataattgaaaaagagattgccattttcaaagacctttcacag

SEQ ID NO: 39312 - DNA, 201 bp, Homo sapiens
taaaaaaacataagggaactttttttttcaaacactgtaatgagggtattcaagtctgcaggcaaaacagagctgtttgaaaagacattagcctcgaaacygcactgtgccagaatagatacagctacgtcaaaatgccgcatttattttgccattacttttcactgactaaaaccatttgctaatgaaagttctagctgc

SEQ ID NO: 39313 - DNA, 201 bp, Homo sapiens
cccagccaaaattcattattttaagctgtacaattgagtgatttttattacgttcacaaagttacgttaccattaccacttttgaattgcagaacaatttmatcactccaaaaagaaatctcataacaattagcagttattttccatcgctacttcctccagtcccaaggcaatcagcagtctgctttctatctctacctg

SEQ ID NO: 39314 - DNA, 201 bp, Homo sapiens
ttctgtagagatgaggtttcaccatgttggccaggctagtcaactcctgacctcaagtgatctctccaccttggcctcccaaactgctggaattacaggcrtgagccaccctgcccgaccctttcattttaaatgtgatagaaacagactcagagaatgtgagtgactttcgcagggtcacttagcaggttggtgacgggc

SEQ ID NO: 39315 - DNA, 201 bp, Homo sapiens
cagctgtcaacaggcatcatttttggtgggacctgaagatgtatatcccttgttttcagattcctcgcctctcatcatgtaaggtgatgctctgagctggktcttaaagcttctgggcacagccccccttgagtcttcattatggcaaatctagtgcaggtgctgagaggcggtaactctttaaagggacaggatatggaa

SEQ ID NO: 39316 - DNA, 201 bp, Homo sapiens
ttttaaataaaaatgcaaataagctactttgtaaccacattaattacccacctagcctcttattaccatgtttgtattgtttgcaaatactatttacagtygtgtggaaattaacattactggtcctgaggaaagattgtgttggggaggttgtgctttggaaccaattagggcgaaccttgtctccactgagactctggg

SEQ ID NO: 39317 - DNA, 201 bp, Homo sapiens
ttgggctgaattagcgaggggagtgcggggtctggagactctgttggcctgttggccatggtcctgggcgcaaagagcagaaaaggacgagacggggactraacagacttgcttagttcctgacattcaaggaagaactttaacgtccatccacggagcctcaaaggctaaaaataatcatccctttcaatagttcctgtt

SEQ ID NO: 39318 - DNA, 201 bp, Homo sapiens
cactagaagtttcagaaagatgcagactgctttaaaaaaaaaaaaaaagggcaaggggaggtgtgagaagaaagtataattctttttcttctaactggagrtataaaaatcatataagcatgatttatgatttgattggaacattgtattttatggttgcagagcacacgtatcatcctatctgcttctgacacccagtaa

SEQ ID NO: 39319 - DNA, 201 bp, Homo sapiens
gtgcaggttagaggctatgtcagaagcaagtcaggatttgaaggcagatctgtctgcttttgcccctctgtaaatccagagctgctgcctcatttcttacrttgcccccacccgtgcagcaattcttcctgggaggcctcattgttcatattcataaagggccccattcagtctcctttttggagaaatggccactgcaac

SEQ ID NO: 39320 - DNA, 201 bp, Homo sapiens
cctcccaaagctcacgaactgagagtcaggaggcgtggttcccctaactcaaatcagaatttcgttatcaaaagaagagagggatggttctgtggtgtccsacactcaaataaacatcctttaaatacctctagatgcttataattcctgttgcagccttagtcagtgggagccactgacctgcattcgtgtaggaactga

SEQ ID NO: 39321 - DNA, 201 bp, Homo sapiens
cgaatcctaaacacgctgcacaaggaagaccttatgctgacagtagggaggaagcgacatgttaacaaacaagtttgccggccaggaagttttaatcagcsctttctactgcagggggtatgatggatggagaccctgtttcagaggggtttcctttagataaaacaataataccatgctttcaagaagctcgttcgacag

SEQ ID NO: 39322 - DNA, 201 bp, Homo sapiens
gatgatagtggggcctcagatttcccacctattgttttgaactctaattagggaaagggaatttggaaccattgtcttctctgagtgtgcagacacgatgytatcattgtgtttacagaggtggtcagattcccagcacagtgtactcccgcacagataaccgtcccatcttgataaaacaatgctctcagccgaatccta

SEQ ID NO: 39323 - DNA, 201 bp, Homo sapiens
catttgcttattggaatcacttcgaaaaggaacttggtatcgttcacatgtgtttataactctcaaatcttcttcttccaatttttaatcttgatcaccasagctttataacaggaagaacgctcaaagaagaaaaatagaagaagcctgaattttaatttgctatttcttcacacacaaaacaccccaagctcaatcaat

SEQ ID NO: 39324 - DNA, 201 bp, Homo sapiens
taaagtcttcagagcctagatattcactagaacccagtggtcacgtgttcctaatgggtggaatattattttgaatctttccatgatgagagttacattgmtgggtgaaagctttttatgcaacatcatcattgttgaataaacagacgcttagcatatttaggttggaatgcaagggaactaaaggtaggggagattctt

SEQ ID NO: 39325 - DNA, 201 bp, Homo sapiens
gtcattgactcagaagatagtttcttaccgtttggggaaagtgcttgtctattcctctccaaagccattttaaaaaaaaaattgcaccagttctcatcccrtcatctgccttgatcaaacatttgcttattggaatcacttcgaaaaggaacttggtatcgttcacatgtgtttataactctcaaatcttcttcttccaat

SEQ ID NO: 39326 - DNA, 201 bp, Homo sapiens
ggctgggagatttttccatctaaatagcttaattgttactctacagggcaatcataaatgtaaatcgacttaatatgacttgattgttagtaatgactgtscctctaatgacgctggccaatgagcctacacagaatgtcgcatgcagatcaatgagccaaatgttagcaggggactgggcatttgaagatttaaaaaaat

SEQ ID NO: 39327 - DNA, 201 bp, Homo sapiens
ccctttacatgaccattccagtcatgaaacagagaatctggtcacctgtcctttatcttggctggtccaattccataagaagtaaatgctgtgtgtctgcrattcaaaagacccctttcacgggaggctgggagatttttccatctaaatagcttaattgttactctacagggcaatcataaatgtaaatcgacttaatat

SEQ ID NO: 39328 - DNA, 201 bp, Homo sapiens
agccactaacacgggatctgtcaattgcattgctggtgatcaagaaatgccagctcctccgctcttccctgagtgccttgttggagacaaaaccagcaggrttatatccccagcactgtaatttagtgtggcagtcaggggaaaacaccttgtagaatttcatttcttatcatttaatgtcccctttaattctcatttaag

SEQ ID NO: 39329 - DNA, 201 bp, Homo sapiens
tggcctcaagtgatcctcccacctcagcctcccaaagtgctggaaataaggtatgagccaccaagcctagccttgatattattttttaatgggggtgtgtsggtgggtggtgatggggatattccagcagaatatcagaaacagagatgaggaaggcagagagagctcaaagacaaggctcaagttcatattccaacgcca

SEQ ID NO: 39330 - DNA, 201 bp, Homo sapiens
ccatatgcatcgtattttaaatggaacagggaggttgttccatgcgtcaacttagtccaaatgtagagggtcaggaaaacaatgatatgagaaaagggccrgttactgtctgggaatccataaatactgcttggcaaatggcacattgcatgcttattccttaggcatccgtttagcaaaataagatgtcaagctaattgt

SEQ ID NO: 39331 - DNA, 201 bp, Homo sapiens
gtttgttctttaagcaaaaccatatgcatcgtattttaaatggaacagggaggttgttccatgcgtcaacttagtccaaatgtagagggtcaggaaaacartgatatgagaaaagggccggttactgtctgggaatccataaatactgcttggcaaatggcacattgcatgcttattccttaggcatccgtttagcaaaat

SEQ ID NO: 39332 - DNA, 201 bp, Homo sapiens
tgtatgtgggcccatttgccatgtgtgtgtgtgtgtctgtctatctatctatctatgtatatatatatatatatatatatatatatatatatatatatatagttataatgtggtgggttctcgaatcacagttgtaattcacatttttctccaccaattctgataacttgcattaagaaattgactgtgtaagttaaattt

SEQ ID NO: 39333 - DNA, 201 bp, Homo sapiens
ttgtatgtgggcccatttgccatgtgtgtgtgtgtgtctgtctatctatctatctatgtatatatatatatatatatatatatatatatatatatatatatagttataatgtggtgggttctcgaatcacagttgtaattcacatttttctccaccaattctgataacttgcattaagaaattgactgtgtaagttaaatt

SEQ ID NO: 39334 - DNA, 201 bp, Homo sapiens
aaaaaaagtctgattgcaactacgtgtttgggaatcagggagactatggaagaacaatctcagatctcagcttgaggctccacttgcaatatcacaatttytaaaacatgttgtatgtgggcccatttgccatgtgtgtgtgtgtgtctgtctatctatctatctatgtatatatatatatatatatatatatatatatat

SEQ ID NO: 39335 - DNA, 201 bp, Homo sapiens
gaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaag

SEQ ID NO: 39336 - DNA, 201 bp, Homo sapiens
gagacctcccagcaggggttgccagagaacttacacaggagcgtttctgctggaatcagctcgatgcctcttgaggacagagactcccagaggaaggagcrggcagccatccttgctgtgctgcagcctccacaggtgacacctcctggtgtgggagggacccaggtgaacagggtctggagtagacccccagcaaactac

SEQ ID NO: 39337 - DNA, 201 bp, Homo sapiens
gccactatgcccagctaatttttgtagagatggagtttcaccatgttggccaggctggttttgaactcctgggctcaagtgatccacccaccttggcttcscaaagtgctgggattacaggcatgagccaccatgttcgaccccatttttataaatgtaaaattaacttaggtttaaactattaatacacaaggttgagaa

SEQ ID NO: 39338 - DNA, 201 bp, Homo sapiens
agagagactgtattccattttatttttatttatatttatttttgagacagagtcttgctctgtcacccaggttggagtgcagtggcacaatctcggctgamtgcaacctctgcctcccgggttcaagcaattctcctgcctcagtctgccgactagctgggactacaggcacacgccactatgcccagctaatttttgtag

SEQ ID NO: 39339 - DNA, 201 bp, Homo sapiens
gtgccaaaaataagaatctttaagaactcataaagtaatttagcaccacgttaataaaagaagcaccattttgaattagttctgtaagtatgtgtttgagktagaaatagagttttaaaaaactgtctgttcatatagttcatctgcttaataagtaaacagctctttcaaatcaccaagctcaaataaaacaaacaaata

SEQ ID NO: 39340 - DNA, 201 bp, Homo sapiens
ccgggaggcagaggttgcagtgagcctagactgcaccattgtactccatcctgggcgacagagcaagactccatctcaaaaaaaaaaaaaaaaaaaaaaaagtaactcattcaaggctacacatttactccatgaagtgagcacacttcagacttccagtcttgtgtggcctgtctaccacaccatgagacttcatgtctc

SEQ ID NO: 39341 - DNA, 201 bp, Homo sapiens
tgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttata

SEQ ID NO: 39342 - DNA, 201 bp, Homo sapiens
acatcttcccctttcttctcccccaggtttgtcccatttgtactgactctgacccaggttgtcatgacttgagactcactagaagtttcagaaagatgcasactgctttaaaaaaaaaaaaaaagggcaaggggaggtgtgagaagaaagtataattctttttcttctaactggagatataaaaatcatataagcatgatt

SEQ ID NO: 39343 - DNA, 201 bp, Homo sapiens
actgtctaagcatttttaatagttttgctttccatggcacgcaactcatatactaaattaaataagctgttatctggtgcaatttctccttgaatagactyagaattacctatagatattgacacggttattttataaattgagttccagcaacacaaggcaaaaattttggcctgtatgtaatgaaggaagagttgtcat

SEQ ID NO: 39344 - DNA, 201 bp, Homo sapiens
agggccacatcttcccctttcttctcccccaggtttgtcccatttgtactgactctgacccaggttgtcatgacttgagactcactagaagtttcagaaaratgcagactgctttaaaaaaaaaaaaaaagggcaaggggaggtgtgagaagaaagtataattctttttcttctaactggagatataaaaatcatataagc

SEQ ID NO: 39345 - DNA, 201 bp, Homo sapiens
tctccttttaaagaagcacacacacctttcttttattggtattacattccttttccctgttggtgcccctgttggttttccaaattgtcttcccatccttrtcctacctcccaatagagtacctcatcctatagtgttattataactacagaaaatatattttcattccttccacttcatgctttcagctagaaatgtgag

SEQ ID NO: 39346 - DNA, 201 bp, Homo sapiens
gaatatttcttaattaagtgcaggaaagaaaataaccattttttctccttttaaagaagcacacacacctttcttttattggtattacattccttttcccwgttggtgcccctgttggttttccaaattgtcttcccatccttgtcctacctcccaatagagtacctcatcctatagtgttattataactacagaaaatat

SEQ ID NO: 39347 - DNA, 201 bp, Homo sapiens
acaataggcgtatgtcaagatatctggtcaccctatctatgatctgtcacacttagtactttctaaaattctcgggcctttgcaccttctttttatcaacrcttagttctatgttactgaatatttcttaattaagtgcaggaaagaaaataaccattttttctccttttaaagaagcacacacacctttcttttattggt

SEQ ID NO: 39348 - DNA, 201 bp, Homo sapiens
ttattgaaagcaaaactacactccatagagtgggaacggcccaagcagccactcaggggccctggatagagaatcttctggagtctaaatactccctagakgtttcccattggccacttggggtacaccccttataaatgaagtggtggcctgcaatcagtcttattggttgcagaaagcaaccaatcagaggctgaagtg

SEQ ID NO: 39349 - DNA, 201 bp, Homo sapiens
aaataagactatgtcatgaaagctttagaatatccaacacattatagaatattttcacggaaatatttcggatggaattttggctttaattctttctcttyttttcctgttcttttccctctccccacaaccacttctgtttcattttctgttttgctccttcttttcataagtagctggtagtcagtgttctctttttct

SEQ ID NO: 39350 - DNA, 201 bp, Homo sapiens
ggaagacattcttcttttttatctgccaacctcccagtgccacagtaagcacagagtcaggcctcgaaaaataccagtcctttcgcctgtcccctctcacrtggtttgaatccaagaggctgtcataccaggctcccccattcagtatattttctttatgtttaaatagtttggattgacttctcttttcttttatttttc

SEQ ID NO: 39351 - DNA, 201 bp, Homo sapiens
tcttgaccatcttatgcctgaaataagggaagacattcttcttttttatctgccaacctcccagtgccacagtaagcacagagtcaggcctcgaaaaatascagtcctttcgcctgtcccctctcacatggtttgaatccaagaggctgtcataccaggctcccccattcagtatattttctttatgtttaaatagtttgg

SEQ ID NO: 39352 - DNA, 201 bp, Homo sapiens
tagagcagttgtgtgttgaagaaagagaaggtggagtgatactgaataccccgtaaaatcacacaatcagcacttaagaatgttcacacagttgttcacamacatattgatatcagaccttatagcagtcctattggctagatcagttattatgaatgtgttttatagagtaggaaacagagatgcgacgtgacttgccta

SEQ ID NO: 39353 - DNA, 201 bp, Homo sapiens
tttctgtccttaagcactcacaggtagcttaacagtaatgccttggattccttccttcaagagcgacagcaggaagcccagcttctctggtagcagagcasgggtcctcaaagcagaccgtgaggtcagaggagcactggagtcaggagtttccatctccaccctgctgagtaaactgtagttacccacacagaaaaggag

SEQ ID NO: 39354 - DNA, 201 bp, Homo sapiens
agttaaaaaggtgatctcactaaaagtaattagcataagacctgctggacctgtagaagtgactggatggtaatcaatagcaatatgattacacccatgcrgcaattataaattatttaaaacactacccctaggttactgactagttgcctttaaattaaattctctgtcgataattgatgcaaagaattaatgtgagaa

SEQ ID NO: 39355 - DNA, 201 bp, Homo sapiens
tataaaaggaagcatacagtgggcctcattctgacaaatttttagtaaatcacaggttgcctttcctaaatccctcaatatgatggctagtctgtttcatwgtgaataaaaagtgatcctggatgaatgaataaagtgaaattcagataatttttctcaaaactgaaattgtttacatcttcctttagttctcttttttct

SEQ ID NO: 39356 - DNA, 201 bp, Homo sapiens
cacctccctacagtccagtggtggcggtgggctgggcaggaaaaccataaccacctgcaaatgtcatgtggtttatatcacaccttcacttaacaccctcsccctaacaacctctacctggcaatcttcatttaactccaaactcaggacctcaatcctctgtttggcctgtgttccacgggacaggcatggggcacagat

SEQ ID NO: 39357 - DNA, 201 bp, Homo sapiens
ctactaaaaatacaaaaaattagccgggtgtggtggcgggcgcctgtagtcccagctactcgggaggctgaggcaggagagtggcgtgaacccgggaggcrgagcttgaagtgagccgagatcgcgccactgcactccagcctgggcgacagagcgagactccgtctcaagagaaaaaaaaaaaaaattataacatggaaa

SEQ ID NO: 39358 - DNA, 201 bp, Homo sapiens
gtaatgctgaatgattgtgaatgattgtgaatgtttgtttattcggggtactccctcaaatttcttatccagtggtgtctagaacatgttgggattttgtktgatagtttcttgagttggaaattgcgtttctttggcctcccatgtgggtatcaatgagttttacatggtttaaaggccagttatgtgatggatacttct

SEQ ID NO: 39359 - DNA, 201 bp, Homo sapiens
cctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatg

SEQ ID NO: 39360 - DNA, 201 bp, Homo sapiens
aagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttaca

SEQ ID NO: 39361 - DNA, 201 bp, Homo sapiens
gctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtc

SEQ ID NO: 39362 - DNA, 201 bp, Homo sapiens
gttctagaggctagaagtctgaaatcaaggtgttggtagggccatactccctttaaaatgtgtagggaaggacccttccttgcctctttcagcttctggtrgccctagatgttcattggcctgtggcagggtaattccagtctctgcctccatctgcacaagccattctccctgtatcttttcacatcatcttccctctat

SEQ ID NO: 39363 - DNA, 201 bp, Homo sapiens
tcagagaatctctaggatggaaatggggggatccatattgtagccccaggtgaggccatctggttgcatttgtgtcaagttggttgaaaactgcatggtgrgcgtaaaaatggtttgagtaaaatggagctgtgagaatttgaaggggtgcatgagaggtgcccgatacagtccaccccctgcaccatgctcaggtctctt

SEQ ID NO: 39364 - DNA, 201 bp, Homo sapiens
cttacctctttttagtttaattaaaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggag

SEQ ID NO: 39365 - DNA, 201 bp, Homo sapiens
ttcctcatctgtaaaatgggaaccatgacgtcagcatcacagagttgtgagaattcgacaaggtggaatgaaagcaactagtgtggtgtctgaccgcttgygttagtccatgaggaatttccttacgtattgttttgtgtctaggaccaagttcttattttcttcttatggatgacttcatatatatgccgccacagaggg

SEQ ID NO: 39366 - DNA, 201 bp, Homo sapiens
gcccctcttctcttagttgcctttagcctttgtttttattatgacaattggtatgaaatttttccttttcattacttcttttattcagagcacacctctgkcttatctcttcattctctgtttagtttcatattttactttaatttctgtacatcaatatctgccattatagtatttaagctcttggaaacatcaggcatt

SEQ ID NO: 39367 - DNA, 201 bp, Homo sapiens
tttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtg

SEQ ID NO: 39368 - DNA, 201 bp, Homo sapiens
atggtgctgatgtcttcacttcctgccaccttggcaacctttgtagttgctctctttttgccaggggaacaaattaagagagagaagagtgatagtgtctrcatgtggtctgctcactcagccagtattttccacagccagtctttccctagaccagcatctgagcgtgccttgtctatgggccacctatactattattta

SEQ ID NO: 39369 - DNA, 201 bp, Homo sapiens
tcaatgattttctttctggcttgtctacgccaaaatggttcttctgctcagttggtttctatagtgattttatggatataggcattttcttctcgaattaraagaactgacagtccaggcacggtggctcatgcctgtaatcccagcactttggtaggccgaggtaggtggatcacttgaggtcaggagtttgagataatc

SEQ ID NO: 39370 - DNA, 201 bp, Homo sapiens
taaatacagatagacaatatttgtacatgataggttggctcaccattaatcacttaagaagtaatagaatgatcaatgattttctttctggcttgtctacrccaaaatggttcttctgctcagttggtttctatagtgattttatggatataggcattttcttctcgaattagaagaactgacagtccaggcacggtggct

SEQ ID NO: 39371 - DNA, 201 bp, Homo sapiens
aagcattccctgtagtttttagcataactagtactggctcagtaagtatccactggggttcggaatacaactgccctgcctcttgagcagccatgcctgcytccgaggtggtgctgcatgctattcaggaggacagaccatggatgggaatcctgagccacaactccttagcctcatgacgttgggcagatgactgagctt

SEQ ID NO: 39372 - DNA, 201 bp, Homo sapiens
ctaaatcctaaattgaggcttactaggaaatgcactaggtgacaggctctagagaaatggctattaccaggttgctcaggctggagtgcagtagtgcaatytcagctcactgcaacctctgccttctgggttcaagcaattctcctgcctcagccttccaagcagctgggactacaggcaggcaccaccatacccacctaa

SEQ ID NO: 39373 - DNA, 201 bp, Homo sapiens
gcttcgatgaagcttgtgtccaccacagtttccagtgcttctgcacctgggtggtcagaaatgagtcctgtgagacacaggtgacaagatctccaaggagscagttcacgcttggatgactctggagctgtggtgacaatctaaatcctaaattgaggcttactaggaaatgcactaggtgacaggctctagagaaatggc

SEQ ID NO: 39374 - DNA, 201 bp, Homo sapiens
ggcttcgatgaagcttgtgtccaccacagtttccagtgcttctgcacctgggtggtcagaaatgagtcctgtgagacacaggtgacaagatctccaaggarccagttcacgcttggatgactctggagctgtggtgacaatctaaatcctaaattgaggcttactaggaaatgcactaggtgacaggctctagagaaatgg

SEQ ID NO: 39375 - DNA, 201 bp, Homo sapiens
aatgacaagaaaagtggagaagatgagacagacaaaactgcaactcatcttcatggcacactggtgagtgggggagtgcaagaagtttaggtgcaaaggamaatggagtgaacatcttggcttggttaacagaagaaaagaataccaacgccgtctattttcatatccctttctattttatgtacatatttatcaatatac

SEQ ID NO: 39376 - DNA, 201 bp, Homo sapiens
atttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggt

SEQ ID NO: 39377 - DNA, 201 bp, Homo sapiens
agactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaat

SEQ ID NO: 39378 - DNA, 201 bp, Homo sapiens
acaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagata

SEQ ID NO: 39379 - DNA, 201 bp, Homo sapiens
ttgatgtgccttctcatttaatataagtaattattttaaaggttattgtgattaacatgtattccttatggaaaatttagaaagcgaagaaaaataaaaayaagaataaaagatttaaaaaaaccccaattcttaccagttagaagtatactattaatatttagcatgtatgattgtaagcatgttttcccttctttcgtg

SEQ ID NO: 39380 - DNA, 201 bp, Homo sapiens
aatcccagctgctagggaggctgaggcaggagaatcacttcaacccggaaggcggaggtttcagtgagctgagatccagcctgggtgacagagcaagactycatctcaaagcgaaacaaaacaaatgagggtcctcatcagcgtgcctttgacactgtcctctggtcctggtgatctgaatacatcaccacagaactgcca

SEQ ID NO: 39381 - DNA, 201 bp, Homo sapiens
attaatacctctgtttaaggttcattttgaacgccttggtgaccctatgtttttttctttgttttttgttttgttttttttttttttgttttttttttttktttttttgagatgaagtcttcctctgttgcccaggctggagtgcagtggcgcattcttggctcactgcaaccttcgcctcccaggttgaagcaattcttc

SEQ ID NO: 39382 - DNA, 201 bp, Homo sapiens
agagcaagactccatctcaaagcgaaacaaaacaaatgagggtcctcatcagcgtgcctttgacactgtcctctggtcctggtgatctgaatacatcaccrcagaactgccagggtacgtgtttcctagcccatagcgagtcccagtgaaagcagagatgagaaagaaaggagggacacaaggtctgggtcctgagttcca

SEQ ID NO: 39383 - DNA, 201 bp, Homo sapiens
gtaatatttaagtattaatacctctgtttaaggttcattttgaacgccttggtgaccctatgtttttttctttgttttttgttttgttttttttttttttkttttttttttttgtttttttgagatgaagtcttcctctgttgcccaggctggagtgcagtggcgcattcttggctcactgcaaccttcgcctcccaggtt

SEQ ID NO: 39384 - DNA, 201 bp, Homo sapiens
tgctggattatctagtccctgaacagccatttatatttttgttacgcttgtggtttttaaatcatcctcatttccttgatcgcatttgcttctcctggctrgaatgtgtaggagacgggtcggggagactgtgcccatttgacaggtgtgaatgcgaacagaggctgcagctggttagaccagggctgtgcaaccctagag

SEQ ID NO: 39385 - DNA, 201 bp, Homo sapiens
gcttagatgaaatttaggcaaatggaatgccccaggccccaggaagactgtggcagcacattgtatgtaactgttggggatgttgcctgaaaccccccccytttttttaggcagctgcaaggattagaatgttgcctcctcagaaactaacactcttctctccttgacctttgtttaaccagctttctgaacctgaagaac

SEQ ID NO: 39386 - DNA, 201 bp, Homo sapiens
gcttgtggtttttaaatcatcctcatttccttgatcgcatttgcttctcctggctagaatgtgtaggagacgggtcggggagactgtgcccatttgacagrtgtgaatgcgaacagaggctgcagctggttagaccagggctgtgcaaccctagagccattgccttgaccacaaagccacagtctcctagtcctaatatta

SEQ ID NO: 39387 - DNA, 201 bp, Homo sapiens
acagcttagatgaaatttaggcaaatggaatgccccaggccccaggaagactgtggcagcacattgtatgtaactgttggggatgttgcctgaaacccccsccttttttttaggcagctgcaaggattagaatgttgcctcctcagaaactaacactcttctctccttgacctttgtttaaccagctttctgaacctgaag

SEQ ID NO: 39388 - DNA, 201 bp, Homo sapiens
ttaaatcatcctcatttccttgatcgcatttgcttctcctggctagaatgtgtaggagacgggtcggggagactgtgcccatttgacaggtgtgaatgcgracagaggctgcagctggttagaccagggctgtgcaaccctagagccattgccttgaccacaaagccacagtctcctagtcctaatattaagaggtaggag

SEQ ID NO: 39389 - DNA, 201 bp, Homo sapiens
ttgtggcagagatcatctagctcgcaaaactgtaaatatttactctttggcctttcccagaaaaaagtgccgactgctatgttagatactccagttcattsaaagtgatatcaccctaacattctctaaattagccacagcttagatgaaatttaggcaaatggaatgccccaggccccaggaagactgtggcagcacatt

SEQ ID NO: 39390 - DNA, 201 bp, Homo sapiens
ggagacgggtcggggagactgtgcccatttgacaggtgtgaatgcgaacagaggctgcagctggttagaccagggctgtgcaaccctagagccattgcctygaccacaaagccacagtctcctagtcctaatattaagaggtaggaggtagatagagattgtcccttaagccacattccattcttcatatttttgtaccca

SEQ ID NO: 39391 - DNA, 201 bp, Homo sapiens
tttatataattgtcattgaagtcaaaactgatggcgtaatatttaaaacaatggctggatccccaatctaagaagaatacattttgttgatcatattaagyactgttacagtgaatgcatggacccatacaattgtggaataattaagaaaaaaggacttaagggcttaaaaatgtctttttaacaatttaacaagttagc

SEQ ID NO: 39392 - DNA, 201 bp, Homo sapiens
gctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacct

SEQ ID NO: 39393 - DNA, 201 bp, Homo sapiens
ctgaaccacacttgttatctttcattttatgatgagaaccaccttaagaggtgtgaggtgacatctcactgtggtttcaatttgcattttcctgagaattwgtgacagtgagccccttttcatacacttggctatttgtatgttttctttggagaattgtctatttggttcctttgcttgtttttaaaatctgtggttttt

SEQ ID NO: 39394 - DNA, 201 bp, Homo sapiens
ctgtaccagtttggccatgttttgtgaatctataattagtttcaaataaaagttaacaaccagaagatcacgagctaaaccaataaagtgaattatggtcmgttgcagattcactgccagacctgggaggaaatctcaccttggcagatcgagtctcttgtcctcgcctaacaatcagcagttcacctctcgaaaaggggt

SEQ ID NO: 39395 - DNA, 201 bp, Homo sapiens
gcccatgttcctcgatccatggctccttttcggtcaccttccagccagcaacattgggctgactccttcaatggccatgtctctggttctttgtcttttgyctcctcctcttacttttaaggacccttgtcatttcattggtctcagctggatagctatcaagggtcactttaaggtcagctgactagcaaacctaattct

SEQ ID NO: 39396 - DNA, 201 bp, Homo sapiens
cccatgtctactaaaaatacaaaaaattagccgggagtggtggtgttcgcctgtagtcccagttactcaggaggctgagccaggagaatcgcttgaacctsggaggtggaggttgtagtgagccgagatcgtgccgttgcactccagcctgagtgacaagagcaacactccatctcaaaaaaaaaaaaaaaaaaaaaagga

SEQ ID NO: 39397 - DNA, 201 bp, Homo sapiens
gtggaatatgaagtagctcccatccttattccatcgcccatatgctaaaatgtagattgtattagttgagaaattttaccaaatatttacttatactgtgstattatttatactatttgtcaattccactatagtagatgcttaataaatatttgtgaatcagtaaatggatggatgaatgaatagtggcctacttctgtg

SEQ ID NO: 39398 - DNA, 201 bp, Homo sapiens
gtaaatgtggcagacaataaaatttccccaagcactttgatgatgtttgtgttaatacttcctgctcagagctgtagcccatcagattctagagctaaccraagagggaagacaacctgtcttctcccagtttccagcctgtatagacttaatcattttcaaggtttaaggttgtttttgtttattggttggggtggagag

SEQ ID NO: 39399 - DNA, 201 bp, Homo sapiens
tttggtgattgagtagaacttggtgccatattggctcaacatggaagatttctgtgatcacttattgatcagtcatgaataaggaatcgggatggcagtcrggagtgtgccaacacctctctcagtattctgggtctctctgcatgtagtgtttcttttgcagctcctagagataaattttttaatgtattacatgtgagt

SEQ ID NO: 39400 - DNA, 201 bp, Homo sapiens
tatagcacaagtgtcttcccctgttgtaacatagtgattattaatgtcaaatatcagctagataaaagctgtcaagtgatagaaagtccttatagctcatraactcttcaataactgggaatttataccgtttatagtttttttactgctaagaataatgttgcaatgaaacgtttgtatataatgctgtttagtcccctc

SEQ ID NO: 39401 - DNA, 201 bp, Homo sapiens
taagctgacccagtgaccttgctctagctcaccagggactgagcatacaccaaagtggccagagctagtggttgctgactctcaggatctttggccctgasagaacaacaaagactggcctattgaggcaggaagtcttaacttccttggccagcctgaaaggctgtctccaaccatgcggacacagcgcagtgaagcggt

SEQ ID NO: 39402 - DNA, 201 bp, Homo sapiens
acagcacatgtggagggaaagaccgcagaattctggcggggttataaatcatacagtcaaataatttccgtgcaattaatatcctcaaattaaaacatacstttttaaagaaagattttgcagacttttaagctgggcaactgtctgccttacaagatgcgtctggaaaccccagtgccatcctccttttttagtcttgta

SEQ ID NO: 39403 - DNA, 201 bp, Homo sapiens
agtgtcagcatcacctggtagcttgttagacatagaaattcttgggctttattccacacataatgaatcagaagcttatggggtggggcctgcagtctgasgtttattttttctaaaactttaagtttcagggtacatgtgtaagatgtgcaagtttgttacataggtaatcatctgccacggtggtttgctgcagagatc

SEQ ID NO: 39404 - DNA, 201 bp, Homo sapiens
cagtgataattatgaatctcataatggaaaacatcccgagcccgaacatcaatcagggaagataaacaatgggaaatgataggtgtacaaaagggaaaatrgcaacagcacatgtggagggaaagaccgcagaattctggcggggttataaatcatacagtcaaataatttccgtgcaattaatatcctcaaattaaaaca

SEQ ID NO: 39405 - DNA, 201 bp, Homo sapiens
acctctctgtgccttgatttctttcacgtcttgttctagttttgaagagcgattcttgtgtgaattcagggagaggaggcatgaggcatggtaaggccacygtacgtctgtggttgacaaattcagtaggcccacagtcaatgcaaaagtcctcttgcctctgcagcacagttacaatgaagaggagcgatggcatggcat

SEQ ID NO: 39406 - DNA, 201 bp, Homo sapiens
gtcactccatagagaggggtttgtggaaatcctttttttttttttttttttttttgcttctttctgtggatctgtttggaaatgtaacattttaaagcccytcttggctggaggattttttatggtaaacataaaacgttcattgaaacattaaacattttacagctgtttttcagcacataaattttcatagacatccac

SEQ ID NO: 39407 - DNA, 201 bp, Homo sapiens
aagaatgttcacacagttgttcacaaacatattgatatcagaccttatagcagtcctattggctagatcagttattatgaatgtgttttatagagtaggawacagagatgcgacgtgacttgcctaagaacacacagcagttctgaaactcaccctgtgctaatctgacctcgtgaagaaattgagcaaactaggctccag

SEQ ID NO: 39408 - DNA, 201 bp, Homo sapiens
aaaacgttcattgaaacattaaacattttacagctgtttttcagcacataaattttcatagacatccaccccctcactgccacaccccctcatagatttcytcttttcctcctccttctcctcctccctcttcctcctctttttccccccccttcaaatagttccaagaccagagttgagggtgggtgggtagagggctag

SEQ ID NO: 39409 - DNA, 201 bp, Homo sapiens
aagagaaggtggagtgatactgaataccccgtaaaatcacacaatcagcacttaagaatgttcacacagttgttcacaaacatattgatatcagaccttayagcagtcctattggctagatcagttattatgaatgtgttttatagagtaggaaacagagatgcgacgtgacttgcctaagaacacacagcagttctgaaa

SEQ ID NO: 39410 - DNA, 201 bp, Homo sapiens
ttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccata

SEQ ID NO: 39411 - DNA, 201 bp, Homo sapiens
aaactataatctttctctctgcctcagtttttccacctgtcagtggaggggcatgctcttggatgcctgagtttttcttagactcagcatcctgcagccgmaataaccatgcttcttagtggtcctcttgcgtagcagcctaagaaactccaagtccatctgcgccgaagagtattgaacttggccagagcacttgggatc

SEQ ID NO: 39412 - DNA, 201 bp, Homo sapiens
acccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgcta

SEQ ID NO: 39413 - DNA, 201 bp, Homo sapiens
taattatataaaaaaagcatggaaactgggcattttaattagcaagtacagccttgacacaaataaaggcatggctttggttatgcagtgcatttatttgrttttcttgaaataagaaaaaaagatatcttctccatcaccagagttgctgagtttgacagtgtgaatgagatgacctctaaggcctctacttatagatct

SEQ ID NO: 39414 - DNA, 201 bp, Homo sapiens
aacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgct

SEQ ID NO: 39415 - DNA, 201 bp, Homo sapiens
tgggcattttaattagcaagtacagccttgacacaaataaaggcatggctttggttatgcagtgcatttatttggttttcttgaaataagaaaaaaagatwtcttctccatcaccagagttgctgagtttgacagtgtgaatgagatgacctctaaggcctctacttatagatctgcacggttgggcctgggagctgtact

SEQ ID NO: 39416 - DNA, 201 bp, Homo sapiens
agggaggccaggcatggtggctcatgcctgtaatcccagcactttgggaggtcgaagtgggtggatcctgaggtcaagagatcgagaccattctggccaayatggtgaaactccgtctctactaaaaatataaaaatgagctgggtgtggtggcacgtgcctgtggtccctgctactcgggagggtaaggcgggagaatca

SEQ ID NO: 39417 - DNA, 201 bp, Homo sapiens
acagtctgtgctgtgtcctgcactgtccattatctgcaggggtggtactgctgtccccagggaagagaatgctgtccacaaagagccagccatttatactmttaaaagaatacacaggagttgaacaatgagaacacgtggacaacgggaggggggaacatcacacaccggggcctgtctgggggtagggggaaaggggag

SEQ ID NO: 39418 - DNA, 201 bp, Homo sapiens
tggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttc

SEQ ID NO: 39419 - DNA, 201 bp, Homo sapiens
tttcgagaaggcaatatagaaaatgcagtgggtagcccaggactcctggtccaggtaaagcaggccttgttgctattcccctggaccatgatattacatgytgggatgatggggtcttgtgatactgattaatttaaggctgcatgatgatgagggaggaacaaagatgttcttgagtcagtacctgccagagtggctgta

SEQ ID NO: 39420 - DNA, 201 bp, Homo sapiens
tgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaa

SEQ ID NO: 39421 - DNA, 201 bp, Homo sapiens
gtctcaagctgctgatttccgggagcaaagctgctgtgggacatgagactctttgaggcagaatacctctcatgcctggagagcattacaggctgcattastctgttttcactctgctgataaagacatacccaagactgtgcaatttacaaaagaaagaggtttaatgaactcacatttccccatgtctggggaggcctc

SEQ ID NO: 39422 - DNA, 201 bp, Homo sapiens
tcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcct

SEQ ID NO: 39423 - DNA, 201 bp, Homo sapiens
ggcctggtcacatcttctgacctcaagtagtttatagtccaaaaagacattggctctttgggatagaggcactttttgggggagagaaacatgaatgcaaytttttacatagagtatgaaactctgttccaaatctctcaaactcaggttctttgattcttaaggtatttttcactgccgagttgctgtcattgaaacaaa

SEQ ID NO: 39424 - DNA, 201 bp, Homo sapiens
gtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcc

SEQ ID NO: 39425 - DNA, 201 bp, Homo sapiens
tctctcaaactcaggttctttgattcttaaggtatttttcactgccgagttgctgtcattgaaacaaaatctgtcctggtcaccactgtatgcccagcacstagtacagtgccctgaacatattaggtactcattaaatacttgttccacgaagttgttatttggtattcacgagttttgtctcaattccttttgattctt

SEQ ID NO: 39426 - DNA, 201 bp, Homo sapiens
tgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagc

SEQ ID NO: 39427 - DNA, 201 bp, Homo sapiens
ctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctag

SEQ ID NO: 39428 - DNA, 201 bp, Homo sapiens
ctgggacaaggacgatggacaaagttatgggggtgctaaaaacctcagtaatgaagataaatgatattctaatctaatattttaaaaaatcgaggctaggygtggtggctcatgcctgtgattccagcattttgggaggccaaggtggacggatcaccagagttcaggagtttgagaccagcctggccaaaatggtgaaat

SEQ ID NO: 39429 - DNA, 201 bp, Homo sapiens
cagcctgggcaacacagcgtgactccatctcaaaacaaacaaacaaaacaaaacaaaaaaggtttaagaaatgttctagtaccttgaaaccaaaataggtrtcagatacttggctgttttgttttttcttcttagccattttgacctgtgagattttatgtgatgaaaacataagaatgtggtattacaccctgtgatttg

SEQ ID NO: 39430 - DNA, 201 bp, Homo sapiens
agttatgggggtgctaaaaacctcagtaatgaagataaatgatattctaatctaatattttaaaaaatcgaggctaggtgtggtggctcatgcctgtgatyccagcattttgggaggccaaggtggacggatcaccagagttcaggagtttgagaccagcctggccaaaatggtgaaatgccatctctactaaaaacacaa

SEQ ID NO: 39431 - DNA, 201 bp, Homo sapiens
ggtatcagatacttggctgttttgttttttcttcttagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaaacattcagtggctc

SEQ ID NO: 39432 - DNA, 201 bp, Homo sapiens
gtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaac

SEQ ID NO: 39433 - DNA, 201 bp, Homo sapiens
gtatgttggtacgttattgaaggtgatgctagctgctataacaaataagcacgcctgtgcacagttgctcaaagatagtagaagtttatttcttgtttatrtaagatccataatgactcttgccaattagcaggctgctctcttccaagtggtaacccagggactcaagctcttttcatcttgtggctcagccgtctgaca

SEQ ID NO: 39434 - DNA, 201 bp, Homo sapiens
cccagcctgggggagggtttgttaaagaactgtctgttttatcacatgaccacaagttaaaatgttgggcaatgtccctgaatgataccttttcattagtractcacatggacccataatctctgaatttaacatgcttttcaggaatgtgttcatattttccacctataaaacctgttttagtaatttactcccttgtaa

SEQ ID NO: 39435 - DNA, 201 bp, Homo sapiens
gatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcc

SEQ ID NO: 39436 - DNA, 201 bp, Homo sapiens
ttgtgcaaaatattctagtagtaaatagaggctttaaatccacacgttgataatggtcaaatcctcttaaaggggccagcaacaaaaatgactttaaaggkgaaatattccttcaatgttacaagcgcccatgagcatgttagtagagcagttgtgtgttgaagaaagagaaggtggagtgatactgaataccccgtaaaa

SEQ ID NO: 39437 - DNA, 201 bp, Homo sapiens
gtgaatccatgtcctgtggtggccctctcaggagggattgtgattaaagaatggacaacccaagggaatcatgtgtcatggtggagcatacaggccagcasgtgagttggggaggcgcctttacagaggaaaccttgagcttcttctgtgatattcattacagaacttcccccaaagacagatgacatccatttataatta

SEQ ID NO: 39438 - DNA, 201 bp, Homo sapiens
cttctaaggtgccgattctcagtgatagaatcttgagttgatacctccttgggtggcatggagcctatacctttgtagatcttgggaaacaacttctaaartaatcatagttgtatgtaatcgtagttacaacaatagttattttaggcacataacccaaaggttttcttacaaggaatctatgaaccttaagagtgaggg

SEQ ID NO: 39439 - DNA, 201 bp, Homo sapiens
atctcgtcgtaattttctcaaatacccttcctctttcctcacttttggtgataactacctgtgttgctcttgtcacttttgcctggatccactaactcacyacctaggtatctgcaacagttatccattgctgcctaacaaattaccccaaaatgtaagcacttagaatctcattgtctttgtgggtcaggaattagggag

SEQ ID NO: 39440 - DNA, 201 bp, Homo sapiens
ttctaaggtgccgattctcagtgatagaatcttgagttgatacctccttgggtggcatggagcctatacctttgtagatcttgggaaacaacttctaaagkaatcatagttgtatgtaatcgtagttacaacaatagttattttaggcacataacccaaaggttttcttacaaggaatctatgaaccttaagagtgagggc

SEQ ID NO: 39441 - DNA, 201 bp, Homo sapiens
ccatgcccgggtgcacaaagccagcatcagtgacctgcacaccaggaggcaggctgcatgatgattgggtgcaagtccttaggtgggtcactcagtctttsttttcttgagttttttcatctgtgaaagagtgatcataatactatttccattgagaagaagaaataatttatgtaaagcacaaagcataatccctggtat

SEQ ID NO: 39442 - DNA, 201 bp, Homo sapiens
ttgatacctccttgggtggcatggagcctatacctttgtagatcttgggaaacaacttctaaagtaatcatagttgtatgtaatcgtagttacaacaatarttattttaggcacataacccaaaggttttcttacaaggaatctatgaaccttaagagtgagggcttctgttaagagtaagggcttccctggagtggacat

SEQ ID NO: 39443 - DNA, 201 bp, Homo sapiens
gccccctgggagtcagagcgttccctccctccttgccactgtaaatgactatttctgtcgtttgcagagtgtccttttctttctcctacagccccatcctyaccctctatagccatcaggtcaggtgcgtcttcttcatttatttatcaaaagggccatagcaatcattgcaaacatgtttaggaggatttggaaaccatg

SEQ ID NO: 39444 - DNA, 201 bp, Homo sapiens
tgggctgttcaggtcgatttggccaagcaggacggcatcagcttgtattggagggaacatctgagcagctcagggccccctgggagtcagagcgttccctmcctccttgccactgtaaatgactatttctgtcgtttgcagagtgtccttttctttctcctacagccccatccttaccctctatagccatcaggtcaggtg

SEQ ID NO: 39445 - DNA, 201 bp, Homo sapiens
gacaggtacggccgtgcagctttctgggctgttcaggtcgatttggccaagcaggacggcatcagcttgtattggagggaacatctgagcagctcagggcyccctgggagtcagagcgttccctccctccttgccactgtaaatgactatttctgtcgtttgcagagtgtccttttctttctcctacagccccatccttac

SEQ ID NO: 39446 - DNA, 201 bp, Homo sapiens
tacccattaccagggaagcctccttcctcccagcagattcccagcatcttctttcacctctaggagatattttccaaggtcactaaattaagccttcagasaatcgaaaaattgaatctcagtacctctattttcctaacaaaatttctgcagcaccgattggggctgacaggtacggccgtgcagctttctgggctgttc

SEQ ID NO: 39447 - DNA, 201 bp, Homo sapiens
tgtctgtgtgtgtgtgtgtgtgtgtgtgtgtgtttgaataatactcctatgaacattgtaccaatatctattcagatctctgctttcgattcttctgcatrtatacctaggagtgaaattgctgcgtcgtttcgtatctgtgtgcttaaccttttgagaaactgccaaactgtcttcaacagcagccgcatcattttacat

SEQ ID NO: 39448 - DNA, 201 bp, Homo sapiens
tctctgaactaaggctgtatctaattacaaggcattgtatcggttctgatttattaaccatttacttggctttggagaaggcagcatttttagtagtactrttgagcctgcatgtagcttttccaggagggcagggtgcctggatatctgatcttacagttattactttgtgtcatatataattttgttttctccctgcaa

SEQ ID NO: 39449 - DNA, 201 bp, Homo sapiens
cttcaagacctggcttctgctccctgtcacagtggcaaagacaatgacaataaaagcacagcctccagagagaagagccttcgatggacctgggtgttaawccaggggccaggcaaaaactgggggatgcagaataggaggttgggctggaggtgagtgagaagaacggatacggttaggaccaacatttaggcaatatga

SEQ ID NO: 39450 - DNA, 201 bp, Homo sapiens
gtggattggtaagggacaggtggtgaagactgaaacagggtatccagttaggaagctaccacagtgatccaacccccagcttctgttgaggttgaagaacmtgcatgcccaacctaaatatatgttcaaaggtggttattactgtttgaggtgatgaaagagttttggagatagaagtgatggttgttcaacatcatgagt

SEQ ID NO: 39451 - DNA, 201 bp, Homo sapiens
tttcctgcccccacatgttaaagatggtgcaagggaaccagagagctttgatccctggtttctctggtcacaaacctgctctcctctccagaactccaggmtgcctttctgtgggggctaaatcaaatttagctgttcccccaactgcaaagtacataggcatcaagtgaaagggtaaatgcatgaaaacctgaatggctg

SEQ ID NO: 39452 - DNA, 201 bp, Homo sapiens
ccgtgaagtctagatctccctgctaacttacactgtgctcaaaacacacacacacacacacacacacacacacacacacacacacactggctgtcctcacygtcaactctagatctccctgctaacttacactgtgctcaaaaaacacacgcacgcacgcacgcatgcacgcacatacacacacacacacacacccatagg

SEQ ID NO: 39453 - DNA, 201 bp, Homo sapiens
agccctttcttgtttagtgttgtgtcttctgtgtcaacatctctggaacatagtcaatggcagtacccagtagaagccatatggatactttttctcaagtsttgaaataaattaatggtgtggccatggttctcgtacttcaggtccctgtgagcccctggggtcctacacaacttggggtaatgctatggtcacctgcat

SEQ ID NO: 39454 - DNA, 201 bp, Homo sapiens
ggactcgggtgcatacatggtttccaaacgcctttcctccagccctcccgactagtgtcttaaatctcaagctggcctctctggctccgctgtttttttttttttttttttttaatttaatttaactttaaattccgggatacatgtgcaggatgtgcaggtttgttacataagtaaacctgtgccatggtgacttgctgc

SEQ ID NO: 39455 - DNA, 201 bp, Homo sapiens
cctggggtcctacacaacttggggtaatgctatggtcacctgcatcccctcctctccagccctcacctggttttctcttctccttccaagaaaaaacaccyataccattcttaacatctctggaagctgggggtcaggagagggagatccataaagttcttgtcttccccgactcaagaagcttaagggtacattcactca

SEQ ID NO: 39456 - DNA, 201 bp, Homo sapiens
gcgtctcctcctttgccactcagccccagaggtgcttctgcttccctgcaggcttgccctggagcctggcgctagggccctggggctcccttgctcctgcktgccccctgcgcctgccttcctgctgcctggcctttctcccatctgctttcttcctgagtggcccctggccaggggactcgggtgcatacatggtttcca

SEQ ID NO: 39457 - DNA, 201 bp, Homo sapiens
tggtaccctgagcaattttaagttataaatatgagatcactgaaagtggagttggggaacacgttattatatagtattttcaccacacacaggatacagtmaatgacttcaagagcataggtaacagtaaaatgtagtaaaacaatttagaagtcatgagttttgagtacttagtactttttagtatgatttatttaatag

SEQ ID NO: 39458 - DNA, 201 bp, Homo sapiens
tgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtgtct

SEQ ID NO: 39459 - DNA, 201 bp, Homo sapiens
tgggattacaggtgtgagccaccgtgcccagctcagcattattatttttagtctacacacagtgaacttaaatctcctctagaaaagtcagaaggtctacstacaactttaagagttcagccaaaagagaccagtatctactaccgtggacaaccctatttaacatggaggagataagcagaaactgaaaagaggagcctg

SEQ ID NO: 39460 - DNA, 201 bp, Homo sapiens
ctgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtgtc

SEQ ID NO: 39461 - DNA, 201 bp, Homo sapiens
ggctattatgtgaagttaggaaatatttaaaactctgcctttctaaagaaacagggacacggtgcagaaaagttcatctggagttaggcttgtgtcttgcygtctctttaacggagagttcatgggcagggtacagtctgtgagaaggaatgaaaaccccagggtagatgctaacaaaaatcacttttaaaaaatgtatgg

SEQ ID NO: 39462 - DNA, 201 bp, Homo sapiens
cctgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtgt

SEQ ID NO: 39463 - DNA, 201 bp, Homo sapiens
tggtgtccatctgggttagcaaacacatgctcacacgtctgtgcttgctggatttttaagaacttaccagcatttaagattttcttatgaaactgattttwctcaccagggatagagtctcaaagttggaggtattttatgttgttttaaataatatcgtcatcacatgtcattttagaccccaaaagtccactccgaatc

SEQ ID NO: 39464 - DNA, 201 bp, Homo sapiens
tcctgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtg

SEQ ID NO: 39465 - DNA, 201 bp, Homo sapiens
tgtgtttttagtagagacggggtttcaccgtgttagccaggatggtctcgatctcctgacctcgtgatcctcccgcctcggcctctcaaagtgctgggatyacaggcgtgagctaccgctcccggcctttttttttttttttttttttttttttttttaaagacagggtctcgctccgtcgcccaaactggagtgccgtgg

SEQ ID NO: 39466 - DNA, 201 bp, Homo sapiens
agatctgcgaatatagaaagattaagagtttttttctgccttgttgggtcttctttctagcatgccagcaacatttttctcatcttttgaacattagggamtaacacccaatgccaccctataatctcgagacagaagtggaggatcctcttaagacaagaaatctttcaaagccaaataatgaattaatccaaagccact

SEQ ID NO: 39467 - DNA, 201 bp, Homo sapiens
tttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagcggcgcgatctcggctcactgcaacctccgcctcccgggttcacgccattct

SEQ ID NO: 39468 - DNA, 201 bp, Homo sapiens
tctaatattttaaaaaatcgaggctaggtgtggtggctcatgcctgtgattccagcattttgggaggccaaggtggacggatcaccagagttcaggagttygagaccagcctggccaaaatggtgaaatgccatctctactaaaaacacaaaaattagctgggtgtgtggtagtgtgtgcctgtagtcccagctactctgg

SEQ ID NO: 39469 - DNA, 201 bp, Homo sapiens
cactcagtgatgggagtcttccttatgaagctgtcccagctccatctctcaggactgaaatgtgggtaagaccatcacatttttcatcccccgccccccgsccccaacattgactgggcagatattcatacaatggcgattgttttgtctgcctggatggctttaacataataccatagactgggcaggttaaacagcaga

SEQ ID NO: 39470 - DNA, 201 bp, Homo sapiens
atttggaaacacggcacaagcaaaggcttgaaacgtgcttttatgttggtgcttgcccacttgctgtgctacgaacccttttacttctgggtgcgaacaarcccaggctagccttctgggcgatgagagacacaagaccatgtttccatattgccccagccaagagccaacctacagacgcaactgccttgctgacagcag

SEQ ID NO: 39471 - DNA, 201 bp, Homo sapiens
ttgaccaatgaggcatttggaaacacggcacaagcaaaggcttgaaacgtgcttttatgttggtgcttgcccacttgctgtgctacgaacccttttacttytgggtgcgaacaagcccaggctagccttctgggcgatgagagacacaagaccatgtttccatattgccccagccaagagccaacctacagacgcaactgc

SEQ ID NO: 39472 - DNA, 201 bp, Homo sapiens
tagtgatctgattcattaatatcccttgttattaagaactgtctgtatttgtgtcctggttggcagatattaagtccacagataccaataattaatatctwtggttgattgtaaaaatggccaccaattcttccctgtcccctgcatatgtacatccttgcactgtgaaattgtagatctcgccctccaaaggtgaagttc

SEQ ID NO: 39473 - DNA, 201 bp, Homo sapiens
gggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggaca

SEQ ID NO: 39474 - DNA, 201 bp, Homo sapiens
ggagtaggaggctgcagtaagctgagatcatgccactgcactccagcctgggttaacagagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatg

SEQ ID NO: 39475 - DNA, 201 bp, Homo sapiens
agggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaa

SEQ ID NO: 39476 - DNA, 201 bp, Homo sapiens
cctccgagttccactggctgcattctcatcagaacccagctaaaactcacgtctctcaaattccctaaataataaatccaaagttattgaagatattgggwtactaaaagttggcagtgagactggccccactcatttctttgtaacccctgtccctctttttattattgaagcttgggatgcacttggtaaggctaggca

SEQ ID NO: 39477 - DNA, 201 bp, Homo sapiens
tccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagt

SEQ ID NO: 39478 - DNA, 201 bp, Homo sapiens
cagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaaatcaaaattgatgcaaaaaatatgataacatttcaaaatttaaatcaagacaaattcaa

SEQ ID NO: 39479 - DNA, 201 bp, Homo sapiens
attgacagacccatgggtgttaagatccttcatggctactggggagaaatgacaggccttttgaaatcgtatcagtggttttccctgggatcactggaaakaatacccctgtttgacaagatatgacacatgctctgttttaattctgcatttgactaacagaaaagattggtgaagatcagactctgctttaaagttatt

SEQ ID NO: 39480 - DNA, 201 bp, Homo sapiens
aggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggcca

SEQ ID NO: 39481 - DNA, 201 bp, Homo sapiens
tttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttaaagtatacccatacccattgtacacatttggtattttttctttaaaaaaaaaa

SEQ ID NO: 39482 - DNA, 201 bp, Homo sapiens
gaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtt

SEQ ID NO: 39483 - DNA, 201 bp, Homo sapiens
aattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgcaattgcttaaaaatggaagttctgaaaataaataaaaagaaacatc

SEQ ID NO: 39484 - DNA, 201 bp, Homo sapiens
ctgtctgttttcttttctttcaaatgtttcacttaattccctgatataataaggcttccaaattcttggtgtttttctacaaccaagaccttgaacttttkcctctcaggatttctttcatgagaacccattttctggccatttggatatcattgatgagggaattgaagcatttccctattctttagagtttcattaaag

SEQ ID NO: 39485 - DNA, 201 bp, Homo sapiens
ttccagtaacaattgttgcataacaaaccacccccaaatttagtggcttaaaacaacaacatttattttgttcaggaatctgtagtttcagcagggctctsaggaacagcttgtctctgctccagcatcagctgaagcagcttgaaagccagggtctgagatcatctgaaggttgttcactcatgagtctgaggaatgatg

SEQ ID NO: 39486 - DNA, 201 bp, Homo sapiens
gctctcaggaacagcttgtctctgctccagcatcagctgaagcagcttgaaagccagggtctgagatcatctgaaggttgttcactcatgagtctgaggawtgatgctgactggtgggtgggacccttgctggagggtctattggctggaacacctacacattgtctccatgtaccctgagcttcctcacaatatggcggc

SEQ ID NO: 39487 - DNA, 201 bp, Homo sapiens
agtcaatttcatctaggagcattttatggcttatggaaagaaatattctcttagattgaagggcgccagcctgtaatgggcatcagctgattctcagaaaraagaaacaacgtactgttacataattggggcttctccaaagtggcctgaccaaactgtagagctgcttgtttgtctgatacggtagccattagccacatg

SEQ ID NO: 39488 - DNA, 201 bp, Homo sapiens
  misc_feature (1)...(201): n = A,T,C or G, or insertion/deletion polymorphism (see Tables 1-2)
tccattttaaagcgttattgaatccatactaacctgatcattacatatttactaattgatgattactaaaaatgtggacctttgtgaatttccgatgtcanagaagggtgttcttaactggaaaagtcagtagccaacattctgggaagtagaggcctcttcctcactgcttcattggtttaaaataaactccaacagaaa

SEQ ID NO: 39489 - DNA, 201 bp, Homo sapiens
cgtggtgtgtgatcttgaccactagcctaaactgctattttatgtccacccatcaacctctacggctgcccctcatttgaacacacaaaatatagttgtgyggcttggtggagccatctaaattccgttaggccatttgccaatgctgctattaggggcgaaatgtcatgcgcttgatctaaatgtacttaggagaattct

SEQ ID NO: 39490 - DNA, 201 bp, Homo sapiens
cacctggatctgttaaatggcagcttagctatgaaatatcatgttctgcccaatcacctaccctgcctcatatgatcagccggtatatttatgtggacacrtgcagccacacttgtttttaacatttgagaatgacagcgtattggcagttcatataagctatcaaatattacatgtcaactcagaaaacatccctaggaa

SEQ ID NO: 39491 - DNA, 201 bp, Homo sapiens
ctgttgtacactgtcccttcaataaaagttgctaacaccaccaccttgcccttgaattctttcctgggcaaagccaagaaccctgttggcctaagccgcarttctggggttcgcctgccctgcatcaccagcacagtggaaggccacaagctcacagcattttcatccgtaaacaaagcttggcaatatctctgatggtta

SEQ ID NO: 39492 - DNA, 201 bp, Homo sapiens
ggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttg

SEQ ID NO: 39493 - DNA, 201 bp, Homo sapiens
agggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgc

SEQ ID NO: 39494 - DNA, 201 bp, Homo sapiens
ggtgaaagcatgcaagctaggagttaagatctttaactcagggaagaccctgtctatggaagtgctgagctcttcagtgtcatcacagaaaagcatgagcscctccctggtacggagtcatcacatcccatagctgagcgacgtcggagctccacgatggggaggtgacacatagtcagttaattacataaagagaacttg

SEQ ID NO: 39495 - DNA, 201 bp, Homo sapiens
cttacaagttagattcacactccaggaatgtatctgttcccacatcccctgatgctgagcataccagagttaagggaggcaagcaaggcccctaacctccyaggttcatggaggtacccattctgcacttgttgaccttgagcttgaggactccataaatgtctgcccttggcattgcacgtgcctccctctgggctgacc

SEQ ID NO: 39496 - DNA, 201 bp, Homo sapiens
ttttcgttgcttacaagttagattcacactccaggaatgtatctgttcccacatcccctgatgctgagcataccagagttaagggaggcaagcaaggcccytaacctcccaggttcatggaggtacccattctgcacttgttgaccttgagcttgaggactccataaatgtctgcccttggcattgcacgtgcctccctct

SEQ ID NO: 39497 - DNA, 201 bp, Homo sapiens
tacgttgatctgtacagcaaaccaccatggcacacatttacctatgtaacaaacctacacatcctgcacattgtaccctggaacttaaaagttggtgaaaraaagaaggggccgggcatggtggctcacgcctgtaatcctaacattttgggaggtcgaggcaggcagattgcctgagctcaggagttgaataccagcctg

SEQ ID NO: 39498 - DNA, 201 bp, Homo sapiens
acattttttcctaaacaacatcaatgtcataacagttttgaagcacatatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatca

SEQ ID NO: 39499 - DNA, 201 bp, Homo sapiens
gccaaactgtgtgattctgtctgcagttgagaactgtaagaaaaagatcaagattaacattattattattggtgttacctcatgtctgtacctttttggasacgtgggtctgtttcccgagaaatcatttttcctcctccttgaaaatagtgaatttcaagtggttttaattttaactgcattatttgtttgctttatata

SEQ ID NO: 39500 - DNA, 201 bp, Homo sapiens
gaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctgggccttctgaga

SEQ ID NO: 39501 - DNA, 201 bp, Homo sapiens
ggttcatctgtagaatatggacagccctctacaaattgggaacaagggccaggacacgaaatatagtgacagcctctggcctgggagtctagacagtggtsaaaggcaggattcatggagttttccaagataagattcaagacccaaactatgaatgaaagccaggctgaggctggcaccaagtagaggcctccaataatg

SEQ ID NO: 39502 - DNA, 201 bp, Homo sapiens
gctcagagcccccacccccacccccctttaagtaacagtgacgcaaacgacctttatttagcagaaggtagctctgcgaatccgctgaatgtccgattgckatctcgctggaaagactgctgcttcagcaaggtttctttgctggtctgtggcaaggtccctgcttcattttcaaggtgtcctcacttggtgcctttgaag

SEQ ID NO: 39503 - DNA, 201 bp, Homo sapiens
gacctccatcattcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctga

SEQ ID NO: 39504 - DNA, 201 bp, Homo sapiens
aaggattattcctccccttttatcaagagccgtaagtccttggaaaatgcaaagagggggaaaaagaagaaaaacagcaacgagtttattggagagttaamacttaaatactccagtacattgagtgtgacatgcctgtgtaggagactgtctgtcccccaaataattgacaatttctctccatctaacaagaaaatatat

SEQ ID NO: 39505 - DNA, 201 bp, Homo sapiens
gcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctacatgtggtctgctcactcagccagtattttccacagccagtctttccc

SEQ ID NO: 39506 - DNA, 201 bp, Homo sapiens
caatatgatggctagtctgtttcatagtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatat

SEQ ID NO: 39507 - DNA, 201 bp, Homo sapiens
aatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagt

SEQ ID NO: 39508 - DNA, 201 bp, Homo sapiens
tcagtaatagtgttttaaaactccaggcctataataaagtaaaaagtgtgtctgataaaatgggtttttttccttgcttagtgaatgtcttctgtttctckctaaacattgtcacttgccaaaccatgttttctgtttcatactaattttctactggcagtgagaccagcggaatctaagaaattgcatacgaaattcaag

SEQ ID NO: 39509 - DNA, 201 bp, Homo sapiens
caggcctataataaagtaaaaagtgtgtctgataaaatgggtttttttccttgcttagtgaatgtcttctgtttctcgctaaacattgtcacttgccaaascatgttttctgtttcatactaattttctactggcagtgagaccagcggaatctaagaaattgcatacgaaattcaaggattggaaagaagaagaggaagt

SEQ ID NO: 39510 - DNA, 201 bp, Homo sapiens
accacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggt

SEQ ID NO: 39511 - DNA, 201 bp, Homo sapiens
gcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagg

SEQ ID NO: 39512 - DNA, 201 bp, Homo sapiens
tctctgtgagccctttgaggatggatgtgtgtccatcttgttaacagttggctccccagtaaccagtacagtgccagatacagagtagtaaccctacattstagcgtaggcaaatattctagtatttgccaaaactagaggatgaatgagtgatgggtaagagagttctcagaaaaatggatataaacaatattgtaaatc

SEQ ID NO: 39513 - DNA, 201 bp, Homo sapiens
gtttgctggctcatgcgtttcatgccttctctatggtaccatacaggcactttgtctcccagtggaatataagttctttgaggccaaggactgtgtcttaytctgtgttgcatccctttggcttcagcctcattgtcttgcgtttattaagcatttggaacatttcagctgaatgagtgaatgagtgaatgagtgaagcca

SEQ ID NO: 39514 - DNA, 201 bp, Homo sapiens
tttgaggccaaggactgtgtcttattctgtgttgcatccctttggcttcagcctcattgtcttgcgtttattaagcatttggaacatttcagctgaatgastgaatgagtgaatgagtgaagccatcagtcaaatcagaacactgctcacacatgcatcccaagtccagctgtcgaacgtctggaactgagcagtatggag

SEQ ID NO: 39515 - DNA, 201 bp, Homo sapiens
accatgtccccattgaacactgctctgtgctgagtctgcagaatatttaaataaggggttaatttataaagtgagctacgggaaagtttccaggattgtcrtgcgtgtgtctcataaatcggcacaaattgaatctaggtttctaggtttctgtgcccctcagctcctaagtaaaccaaaatttattgagaggtgtatagg

SEQ ID NO: 39516 - DNA, 201 bp, Homo sapiens
acttgcctaagaacacacagcagttctgaaactcaccctgtgctaatctgacctcgtgaagaaattgagcaaactaggctccagggagaaacgaaaacaayaacaacaaaaaatgtattgccaaaaaattgctagcagacatctagaaaaatgtcttcaacttcttttggtaggaaaagaggaaaaattcaaatctgaatt

SEQ ID NO: 39517 - DNA, 201 bp, Homo sapiens
gcaccactgctcgcattcccatgttggagttttccctttggggttcttatgccattttaaagactctgaaaacaggaagactttttctcttgggtattttwttttttttttcctctgcaagggatggggtcataagacattggtgaggttaggccttcctttgtctcccaggagcacacttgatagcaatgtagggtgaat

SEQ ID NO: 39518 - DNA, 201 bp, Homo sapiens
ccgaacatcaatcagggaagataaacaatgggaaatgataggtgtacaaaagggaaaatggcaacagcacatgtggagggaaagaccgcagaattctggcrgggttataaatcatacagtcaaataatttccgtgcaattaatatcctcaaattaaaacatacgtttttaaagaaagattttgcagacttttaagctgggc

SEQ ID NO: 39519 - DNA, 201 bp, Homo sapiens
ttttattttagataaaatgaaaagatgttactatgcaggtaactttatttattatttgcatgcagtttatcaaatagaattccttggttcagcaaaatgamacctttaagtcttttagcaccaaatgtttgaaattatcatgaaacacattctaatttggcagtgagttcaggagatgaagactgtcctttagttaacatc

SEQ ID NO: 39520 - DNA, 201 bp, Homo sapiens
tgttattttccttttgtatctagcctaacattgactatcttgtcatttcattttcctataaaatgcctccaccaaggctgaatctttgaattgatcactasaggccttttccctagtagtaacattataataaaactttgactcatgctcataactcgattttccaaaaagttttcctttacaggagaaaagaacagctgc

SEQ ID NO: 39521 - DNA, 201 bp, Homo sapiens
gggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtctttcctactcaaaatggtttttatggattctattcttatttgg

SEQ ID NO: 39522 - DNA, 201 bp, Homo sapiens
cttaggggttagaaggggatcaaggaaagtccgagagttggttgtgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagcc

SEQ ID NO: 39523 - DNA, 201 bp, Homo sapiens
atcgcagacacggaaaaaaggattattcctccccttttatcaagagccgtaagtccttggaaaatgcaaagagggggaaaaagaagaaaaacagcaacgartttattggagagttaacacttaaatactccagtacattgagtgtgacatgcctgtgtaggagactgtctgtcccccaaataattgacaatttctctccat

SEQ ID NO: 39524 - DNA, 201 bp, Homo sapiens
aggcagatgttgcagtgagccgagatcaggccactgcactccaacctgggtgacagagccagagtctgtctcaaaaaacgaaaaacaaaaaaaaccaaaaractaaatgtataaaaggtacccaggtgatgttgatgctacttgtcttggccaatgaaatgaaaagcctacaggccaggcatggtggctcatgcctgtgat

SEQ ID NO: 39525 - DNA, 201 bp, Homo sapiens
ggctggggcaggagaatcgcttgaacctgggaggcagatgttgcagtgagccgagatcaggccactgcactccaacctgggtgacagagccagagtctgtytcaaaaaacgaaaaacaaaaaaaaccaaaagactaaatgtataaaaggtacccaggtgatgttgatgctacttgtcttggccaatgaaatgaaaagccta

SEQ ID NO: 39526 - DNA, 201 bp, Homo sapiens
gctatttggaaggctggggcaggagaatcgcttgaacctgggaggcagatgttgcagtgagccgagatcaggccactgcactccaacctgggtgacagagycagagtctgtctcaaaaaacgaaaaacaaaaaaaaccaaaagactaaatgtataaaaggtacccaggtgatgttgatgctacttgtcttggccaatgaaa

SEQ ID NO: 39527 - DNA, 201 bp, Homo sapiens
aatttgccgggtgtagtggtgcacacctgtagtcccagctatttggaaggctggggcaggagaatcgcttgaacctgggaggcagatgttgcagtgagccragatcaggccactgcactccaacctgggtgacagagccagagtctgtctcaaaaaacgaaaaacaaaaaaaaccaaaagactaaatgtataaaaggtacc

SEQ ID NO: 39528 - DNA, 201 bp, Homo sapiens
gccaggagtttgagaccagccttgccaacatggtgaaactccatctctactaaaaatataaaaatttgccgggtgtagtggtgcacacctgtagtcccagytatttggaaggctggggcaggagaatcgcttgaacctgggaggcagatgttgcagtgagccgagatcaggccactgcactccaacctgggtgacagagcc

SEQ ID NO: 39529 - DNA, 201 bp, Homo sapiens
ccacttcctggaggactgtcagtgctagctaatgagactgtaaaagtggactatctgcccaggagacagtgaggaaggaaatcaggggtcacccttacagsgaagggctctttgcagagagagtgcctgatacgtagcagctggtacttctccatcttgaaactgtccttcctggttttgtctaatttgtcatcatgggat

SEQ ID NO: 39530 - DNA, 201 bp, Homo sapiens
ttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggt

SEQ ID NO: 39531 - DNA, 201 bp, Homo sapiens
acaagtcttccatgtgattctgagacagactcatgttcgtgtggttctggctctgcagaactgaggtgggccccaaaacttgcgtttctaaaaggtactasctgagcatgatgactcacatttgtaatcccaccactttgtgaggccgaggcgggtggatcgcttgaggccaggagtttgagaccagccttgccaacatgg

SEQ ID NO: 39532 - DNA, 201 bp, Homo sapiens
ctgcgggggcctaggccaaagatatgcccgagtagaaaatctgacaccagcttcccagttttctcttctgctctctttggctgcaacgcttttaccatggstaaaccattaggccggctctgcagggagggcaagaccacagcagctcagtatttcctgctcagggaaaaaggccaggtcttttgttggtggaaatccact

SEQ ID NO: 39533 - DNA, 201 bp, Homo sapiens
tctgccacggtggtttgctgcagagatcaacttatcacctggatatgaagcccagcgtccattagctgttgttgctgatgctcttcccaccacctgcaagycccagtgtgtgttatccgcctccaccgtgtgtccatgtgttctcatcatgcagctcccacttataaacgagagcatgcagtgtttggttttcagtttctg

SEQ ID NO: 39534 - DNA, 201 bp, Homo sapiens
cctaggcttggttacaaagggcaatgaagggtcttttctgtccttaagcactcacaggtagcttaacagtaatgccttggattccttccttcaagagcgayagcaggaagcccagcttctctggtagcagagcaggggtcctcaaagcagaccgtgaggtcagaggagcactggagtcaggagtttccatctccaccctgc

SEQ ID NO: 39535 - DNA, 201 bp, Homo sapiens
tcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctg

SEQ ID NO: 39536 - DNA, 201 bp, Homo sapiens
agatgtgcaagtttgttacataggtaatcatctgccacggtggtttgctgcagagatcaacttatcacctggatatgaagcccagcgtccattagctgttsttgctgatgctcttcccaccacctgcaagccccagtgtgtgttatccgcctccaccgtgtgtccatgtgttctcatcatgcagctcccacttataaacga

SEQ ID NO: 39537 - DNA, 201 bp, Homo sapiens
cttccatttgaaaggagctttaaacacctttggtggcagctaagagtgtcaaaatggagggatgtgtaggggacctagggcctgggtaacattgtcccagsccagggcctattgtgttgtgtgtgtctccactttccagcctttgggaacgcagagggggacctctgtaattggtaccagcatcccttccttgcagggtcc

SEQ ID NO: 39538 - DNA, 201 bp, Homo sapiens
aaactttaagtttcagggtacatgtgtaagatgtgcaagtttgttacataggtaatcatctgccacggtggtttgctgcagagatcaacttatcacctggrtatgaagcccagcgtccattagctgttgttgctgatgctcttcccaccacctgcaagccccagtgtgtgttatccgcctccaccgtgtgtccatgtgttc

SEQ ID NO: 39539 - DNA, 201 bp, Homo sapiens
ctggagtcatgtgtttgcttctggaagggaggcaagaggcattcaacctcctgttaatttggttgctccttcagatacgctcttcatggtacagccctgasctgcatcatttaaagaccaattgttaaggaccaatctgagggcctgtgcattagttaaaactccttatctggtcatagagggtggtgtggtttggacgcg

SEQ ID NO: 39540 - DNA, 201 bp, Homo sapiens
cgtccctccgcacctcactgttgggctgatcaatcccattcccactccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagac

SEQ ID NO: 39541 - DNA, 201 bp, Homo sapiens
agcccctggacctgcagtgtcagcatcacctggtagcttgttagacatagaaattcttgggctttattccacacataatgaatcagaagcttatggggtgrggcctgcagtctgacgtttattttttctaaaactttaagtttcagggtacatgtgtaagatgtgcaagtttgttacataggtaatcatctgccacggtgg

SEQ ID NO: 39542 - DNA, 201 bp, Homo sapiens
atcatctccgtccacatcaatgtcgtcatcgtccttatgaaaagccctgggcatcattttgcccttgagctggatgtccatgttggaaaaacagctagtgraaggcgtgcccaaatctcagaagttggcgtttccttgcagatatcattggtggccattggaggggaaaaagatgctttggaaaccaggacacagagaaaa

SEQ ID NO: 39543 - DNA, 201 bp, Homo sapiens
taactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaat

SEQ ID NO: 39544 - DNA, 201 bp, Homo sapiens
agtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaa

SEQ ID NO: 39545 - DNA, 201 bp, Homo sapiens
ttgccacttcctggaggactgtcagtgctagctaatgagactgtaaaagtggactatctgcccaggagacagtgaggaaggaaatcaggggtcacccttayagggaagggctctttgcagagagagtgcctgatacgtagcagctggtacttctccatcttgaaactgtccttcctggttttgtctaatttgtcatcatgg

SEQ ID NO: 39546 - DNA, 201 bp, Homo sapiens
atatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttt

SEQ ID NO: 39547 - DNA, 201 bp, Homo sapiens
tggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattgg

SEQ ID NO: 39548 - DNA, 201 bp, Homo sapiens
ctcagacagataagaagctggcccacccttgccacttcctggaggactgtcagtgctagctaatgagactgtaaaagtggactatctgcccaggagacagygaggaaggaaatcaggggtcacccttacagggaagggctctttgcagagagagtgcctgatacgtagcagctggtacttctccatcttgaaactgtcctt

SEQ ID NO: 39549 - DNA, 201 bp, Homo sapiens
gaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatgcctgtaaccgta

SEQ ID NO: 39550 - DNA, 201 bp, Homo sapiens
tttgagatcagtctgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtg

SEQ ID NO: 39551 - DNA, 201 bp, Homo sapiens
tctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctct

SEQ ID NO: 39552 - DNA, 201 bp, Homo sapiens
tccgttttgtgacttatttttaattattaagaataagtgtcataaagccaatactttctaacatgtgtatagtatgttatagttttcaaagtctttgacarttatacctagggagccaggacagtatttgtatcatcatttcattgttcctggaaaacaggttcagagaagttaagcgacttgcccaaaatagcacagcaa

SEQ ID NO: 39553 - DNA, 201 bp, Homo sapiens
aacctctctggcctcagtatctgtatctgtaatatggggaatcataaaagcacctacttgttaaggcatattaaatgcaacgctactttgaaggactcatrgtagttaacacccagtttggtaagtgttattattgaaggctgagaacagaacgacaaacaacaatcacaacaaaaggctggggaagattttcctggtggg

SEQ ID NO: 39554 - DNA, 201 bp, Homo sapiens
catccaccctcttggtactcaaagcttggtccatgaaccagcagcttcagcatctgctgagagcttgctggagatacagaatctcaggcctgactgacccsaggcctgctgagtctgaattttaaccagagtctcttggtgactcgtgtgtactttagaaggggaactgctcaccgcccccacttcccactgagtcgaata

SEQ ID NO: 39555 - DNA, 201 bp, Homo sapiens
ggggttggcgagagggtgttgcttttctaatgattcacattgtataaaaagcagacagtaggtctggcactgttggctcatgcctgtaatcccagtacttygggaggccaaggcaggtgaatcatgaggtcaagggttcaagaccagcctggccaacatggtgaaaccccttctctactaaaaatacaaaaaattagttgg

SEQ ID NO: 39556 - DNA, 201 bp, Homo sapiens
tgcccaggctggtctcgaactactgggctcaagcaggccacctgcctcagcctccagaattgagattacaggcgtgagccactgcgcctagccaggagtaytttttagtagcagtcctagatagcttcactatcatttcctgggaaagttttggaaaccccagcagagccttcatctttaactgtgtgaccttgggccatt

SEQ ID NO: 39557 - DNA, 201 bp, Homo sapiens
acccttctaaccagtgtttgaagtacgtaagacgttcatttccacttctaatgaggaattagaggaacggaattataaaggaattctggttataattgcadgtacttttagagacgatgtctaacagtgcaacccatagaaccaggctgcctggattcaaatcccagctctgctattactgagatctctatgagagctcag

SEQ ID NO: 39558 - DNA, 201 bp, Homo sapiens
tcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagaagactgaggaaaggcccccccccccccccaccaa

SEQ ID NO: 39559 - DNA, 201 bp, Homo sapiens
ttaaatgcaatagatgcagtaaagaaaagggttggcttaagagttgacttacaaagcttggtcctaacagctttttcctttatctgtttcaagagtcataygatatttgatctttcaaacttacgtatttcttccattatgtttagtattagtttcgttttctcaagatacatatttaacaactagcaaaatgttggaagc

SEQ ID NO: 39560 - DNA, 201 bp, Homo sapiens
ccccaagtagcccctggacctgcagtgtcagcatcacctggtagcttgttagacatagaaattcttgggctttattccacacataatgaatcagaagcttrtggggtggggcctgcagtctgacgtttattttttctaaaactttaagtttcagggtacatgtgtaagatgtgcaagtttgttacataggtaatcatctgc

SEQ ID NO: 39561 - DNA, 201 bp, Homo sapiens
atgttagttattattttaatattacagcatctgtggaaacagtgggtttatatttcagcgtcctgagaaacactcatcctgaacaacgggaacattggccrcatccgccattgtcaattttaaataaaagatatgatgactagttggtgagttgatcttgtaagacttttacagatacccagaacggctctacttcttcat

SEQ ID NO: 39562 - DNA, 201 bp, Homo sapiens
cgaagacagagaccagaggttccccaagtagcccctggacctgcagtgtcagcatcacctggtagcttgttagacatagaaattcttgggctttattccasacataatgaatcagaagcttatggggtggggcctgcagtctgacgtttattttttctaaaactttaagtttcagggtacatgtgtaagatgtgcaagttt

SEQ ID NO: 39563 - DNA, 201 bp, Homo sapiens
tcaccaaatcacacctgaacaagaggaagaaaattaaactcattgaggagataccatcttttttaaaaaaaaaaaaaaaaggcagcaaaatgtgagatggscgtttattatgagatacacgaagacagagaccagaggttccccaagtagcccctggacctgcagtgtcagcatcacctggtagcttgttagacatagaaa

SEQ ID NO: 39564 - DNA, 201 bp, Homo sapiens
aaaatagagtcagcagcatctaaagagttgttttactacctctggagctgagaggtgaacatagtcgtttttcaggaagccgtttctggctcagacagatmagaagctggcccacccttgccacttcctggaggactgtcagtgctagctaatgagactgtaaaagtggactatctgcccaggagacagtgaggaaggaaa

SEQ ID NO: 39565 - DNA, 201 bp, Homo sapiens
tgtttacctgtttatgataaaggatattacaaagagtacagatgaagcggtacatagggccaggcatgcggaggggatgtggagcttccataccccctccyggcatgcccctctccaggcaccacatgctcagcaatctggaagctctccaaaccctatcgtttaggtttttgttgttgttgttttgagatagggtctcgc

SEQ ID NO: 39566 - DNA, 201 bp, Homo sapiens
caaagaattaaaaccacccaccaggaaaatgggaaagtctcccctccacacacacacacacgcgcgcgcgcacacacacacacacacacacacacacacasaaaatcaccaaatcacacctgaacaagaggaagaaaattaaactcattgaggagataccatcttttttaaaaaaaaaaaaaaaaggcagcaaaatgtgag

SEQ ID NO: 39567 - DNA, 201 bp, Homo sapiens
taacccatatgggagaaatttccaaagaattaaaaccacccaccaggaaaatgggaaagtctcccctccacacacacacacacgcgcgcgcgcacacacayacacacacacacacacacacacaaaatcaccaaatcacacctgaacaagaggaagaaaattaaactcattgaggagataccatcttttttaaaaaaaaaa

SEQ ID NO: 39568 - DNA, 201 bp, Homo sapiens
gcttgtctcaacccctgagctcaggtgatccgcctgccttggcctgccaaagtgctgggattacagacatgagccaccaaacctggtcaattttctatggkgtgtgttacattttttaaaattttattttaatgtttatatagaaaaagttgccttatcaaccattataatcatggtatttagtgagtgtaatctgttctg

SEQ ID NO: 39569 - DNA, 201 bp, Homo sapiens
aatgtcaatattttaatgtactagtaagggaaaattctattaagacataattgtttggctttgtcagtttgtcaacttgaaaatagagtcagcagcatctraagagttgttttactacctctggagctgagaggtgaacatagtcgtttttcaggaagccgtttctggctcagacagataagaagctggcccacccttgcc

SEQ ID NO: 39570 - DNA, 201 bp, Homo sapiens
ccagagaattatttgactagttaaagcttaagaaacaccccagtggattatgagtgccttctagccaagaatgggtatttcctctgtgcaatctgagggcmcgggacactcctccagcggagtagcctgtgatttgtatgggctgcatgaattcctgcactaacaaggtaaaagaaggatgttaaagaaaacccgagatct

SEQ ID NO: 39571 - DNA, 201 bp, Homo sapiens
cgggtggggagggcagacaagttgctcatcctctctgcgcctcagtttcttcatctacaaaatgaagatgttggttatttctttattcaagggttgttgaraggatgaagtgctaaaaatgcttgaccagcattcacacaggcactaagacggtgagtactcactacttagcgctgtcaacatcatctccgtccacatcaa

SEQ ID NO: 39572 - DNA, 201 bp, Homo sapiens
ttttgataaatacctaggtgtgaaattattgactcttagtgtttaacttgtaagaatgctgccaaacagttgtctaaagtaattgtatcattttaaccccycgctagaagtgtgtaagagtttatgttgcttcacatcctcatcagcactttgtaatttcagtctttttaattatagcctttttgtgggtgagaaacgcta

SEQ ID NO: 39573 - DNA, 201 bp, Homo sapiens
agtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagacataattgt

SEQ ID NO: 39574 - DNA, 201 bp, Homo sapiens
ctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatg

SEQ ID NO: 39575 - DNA, 201 bp, Homo sapiens
cccaagccttttttgccatctctttttcccagaaagactggaaacttgcctaaagagacagaatcccagatcccagatggatctactattttagaatctcygcttccgcatttctaaaatccttcccagagaattatttgactagttaaagcttaagaaacaccccagtggattatgagtgccttctagccaagaatgggt

SEQ ID NO: 39576 - DNA, 201 bp, Homo sapiens
tgggcaagaagggaaggagaattgtgaaacatgcacaattagaagtcgtgcacctgggttcatatcctggctgggccacttactttctggcgggtggggarggcagacaagttgctcatcctctctgcgcctcagtttcttcatctacaaaatgaagatgttggttatttctttattcaagggttgttgagaggatgaagt

SEQ ID NO: 39577 - DNA, 201 bp, Homo sapiens
tagtgtttaacttgtaagaatgctgccaaacagttgtctaaagtaattgtatcattttaacccctcgctagaagtgtgtaagagtttatgttgcttcacakcctcatcagcactttgtaatttcagtctttttaattatagcctttttgtgggtgagaaacgctatctcttgctagttttattttgcattttcctagtgac

SEQ ID NO: 39578 - DNA, 201 bp, Homo sapiens
ttaggtttgggtgtcctgtgtttgtaccttgttttgtgcccacctacatcctgggttatgtctttccccaccccaagccttttttgccatctctttttccsagaaagactggaaacttgcctaaagagacagaatcccagatcccagatggatctactattttagaatctctgcttccgcatttctaaaatccttcccaga

SEQ ID NO: 39579 - DNA, 201 bp, Homo sapiens
ttgggcgattcagttttacctgtgtcctctctataccatagtttatgacaaggggttttctgtggctggtctccaaggcctcttccaatcttgacattctrtgatcctgtaagtctttgaataatggcccaggatgccaacaagaagtcaccaatgagagttcaggtgttctgttggaaatctttgtaaaatcacagagaa

SEQ ID NO: 39580 - DNA, 201 bp, Homo sapiens
cagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatatt

SEQ ID NO: 39581 - DNA, 201 bp, Homo sapiens
ttctatgcaactatatgtgggtgtatttttctgaacatgtcagtgaagtttaaatattcatctcacttctttcagtcaccctcaaaggggaatttaatttrcgacttcatttgtactttcaaacttcctcctggaaacagaagaaaataaaattagatttttgtaagctgagatgatatgcatgttcttattttcaataca

SEQ ID NO: 39582 - DNA, 201 bp, Homo sapiens
gtccaatttatctttttcatttgtttagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataa

SEQ ID NO: 39583 - DNA, 201 bp, Homo sapiens
actatttgttcaaagactaatcctcgcgctattcaatttccttggcatctttgtcaaaaatcagttgactatatatgtgtgggtgtatttctagactgttrtactccattgatctaattttttttcttatacttactgctcgattgcctggaagctaggtaataataaggattcaaactttgttctttatttcaagattgt

SEQ ID NO: 39584 - DNA, 201 bp, Homo sapiens
accgggtctggagtgcaacagaggcccctgaccttgtctctagctctctgtctgcatcttcagcgtggcttcactggtttctaagtctctggtgtcttttktcttttgcagccggcttgcaattgcctccttctaactctcaaaaggatgcatgggatgggttcagtgtagtcactgttgtgccttttggacaaggctttc

SEQ ID NO: 39585 - DNA, 201 bp, Homo sapiens
tttccttggcatctttgtcaaaaatcagttgactatatatgtgtgggtgtatttctagactgttgtactccattgatctaattttttttcttatacttacygctcgattgcctggaagctaggtaataataaggattcaaactttgttctttatttcaagattgtttgggttagtttagatactttccttttacatatata

SEQ ID NO: 39586 - DNA, 201 bp, Homo sapiens
ttggtattgaatctgttgatcaatttgaggaggatcaaaatcctgaaagtgttgagcgttaccatccatgagcatgcatctctccatttatttaaggcttstttatttataaacatttcagtgatatttgatgattttgaatgtggaggtcttatacttttttgttaaattaactcttacacatttgatttttttatgcta

SEQ ID NO: 39587 - DNA, 201 bp, Homo sapiens
gttttaggaagttgcatttaaaaaatcttggatacctgttttgtacatattatatatagcatcccgtgtgaatatgttaattcctttttatgagtttcggycttttttccctctcctatacatgattgctgttttatagctccagtttggtggaattaacatagatttcccacatggggaaggttttgggtgaggatttag

SEQ ID NO: 39588 - DNA, 201 bp, Homo sapiens
cttcttctccaatttttatggcttttgtttctttttcttgttttaatgcactggctatagcctgtaggacagtgttgaacagaggttttgagacagacatmattgctttattcaggacttctctattatatgtgatcctagttgtatgttttctgtacctatacttcattagattaaggagtttgaatttatttctagttt

SEQ ID NO: 39589 - DNA, 201 bp, Homo sapiens
cttgttttaatgcactggctatagcctgtaggacagtgttgaacagaggttttgagacagacatcattgctttattcaggacttctctattatatgtgatsctagttgtatgttttctgtacctatacttcattagattaaggagtttgaatttatttctagtttgctgagagttcttttataaatgtgttcatatatata

SEQ ID NO: 39590 - DNA, 201 bp, Homo sapiens
gcataatttaggcccctttcaggccactcttccccctgtgccccaggtgtgtttgctaccatacctccccaggggatagccctccaaacctgattggccamctagtctggtcttaaagtcccaaagggaggccatcacaaactactcagtatggagaagacctgaatcctaattttggcttaaccccaaacttgggcgatt

SEQ ID NO: 39591 - DNA, 201 bp, Homo sapiens
cattttactttgcataatttaggcccctttcaggccactcttccccctgtgccccaggtgtgtttgctaccatacctccccaggggatagccctccaaacytgattggccacctagtctggtcttaaagtcccaaagggaggccatcacaaactactcagtatggagaagacctgaatcctaattttggcttaaccccaaa

SEQ ID NO: 39592 - DNA, 201 bp, Homo sapiens
tgagttctccataaatgttagttattattttaatattacagcatctgtggaaacagtgggtttatatttcagcgtcctgagaaacactcatcctgaacaaygggaacattggccacatccgccattgtcaattttaaataaaagatatgatgactagttggtgagttgatcttgtaagacttttacagatacccagaacgg

SEQ ID NO: 39593 - DNA, 201 bp, Homo sapiens
tagaggatggatgggagcatgaagtgtcctccgtcatgttgctaatgttctgttgcttgttcaagctactgggtgtgttcagtttatgaaaattcatttartgacacatgtatgttttgtgaatttttttgcatgtatattttactctaacaaaaagttcatggacaaatacaaaatcatatctgacagttgttgagagaa

SEQ ID NO: 39594 - DNA, 201 bp, Homo sapiens
agttattattttaatattacagcatctgtggaaacagtgggtttatatttcagcgtcctgagaaacactcatcctgaacaacgggaacattggccacatcygccattgtcaattttaaataaaagatatgatgactagttggtgagttgatcttgtaagacttttacagatacccagaacggctctacttcttcatattcc

SEQ ID NO: 39595 - DNA, 201 bp, Homo sapiens
taggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgc

SEQ ID NO: 39596 - DNA, 201 bp, Homo sapiens
tgcaacttgtcaaacacttacatttgtgaataagaaaactggggtctatttggtggtttatttcagagatgttggatcaaatcagacatcagaaaagacamcagtaccaaacgaagatatctttgctgtatttgcagttttctctcttattaacatgaaaacaccttacatagatggaaacatctaaaggctattttttat

SEQ ID NO: 39597 - DNA, 201 bp, Homo sapiens
cctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagact

SEQ ID NO: 39598 - DNA, 201 bp, Homo sapiens
aatttcatcactccaaaaagaaatctcataacaattagcagttattttccatcgctacttcctccagtcccaaggcaatcagcagtctgctttctatctcyacctgtttgcctattctggacatttcatatgagtggagttagataatacatggccttttgtgactggctttcacttagcataatgttctagaggttcatt

SEQ ID NO: 39599 - DNA, 201 bp, Homo sapiens
caaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaag

SEQ ID NO: 39600 - DNA, 201 bp, Homo sapiens
tggtattggtacaatcagtcaggaagcatttttcctggggagaaacttacaagtccacgatcaaagccaacaagagacaaggtgttacatgactcattttyggtttaagaagtgacaggctgattctaagttgggttcaattattttgttaaagcgttttgcttatttgacttctcctgacctcggaaataattctaacca

SEQ ID NO: 39601 - DNA, 201 bp, Homo sapiens
tccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtat

SEQ ID NO: 39602 - DNA, 201 bp, Homo sapiens
acattatagaatattttcacggaaatatttcggatggaattttggctttaattctttctctttttttcctgttcttttccctctccccacaaccacttctstttcattttctgttttgctccttcttttcataagtagctggtagtcagtgttctctttttcttcctgtgagacaggatctccctctgttgcccaggctcg

SEQ ID NO: 39603 - DNA, 201 bp, Homo sapiens
ttcccccgtgactgctgcgggggcctaggccaaagatatgcccgagtagaaaatctgacaccagcttcccagttttctcttctgctctctttggctgcaasgcttttaccatggctaaaccattaggccggctctgcagggagggcaagaccacagcagctcagtatttcctgctcagggaaaaaggccaggtcttttgtt

SEQ ID NO: 39604 - DNA, 201 bp, Homo sapiens
aatgatgtaacctacttgaaagtgtcatataaattctgaggtgaagtggaggcattatggatgcattttattttgttttattttatttcatttattctttytttgaagagctatgggtcaagcagatctgcagcccacactcggctcactgatcacgtcccatacaatcttggcagatacttagctgaattccatcgattt

SEQ ID NO: 39605 - DNA, 201 bp, Homo sapiens
tgcgggggcctaggccaaagatatgcccgagtagaaaatctgacaccagcttcccagttttctcttctgctctctttggctgcaacgcttttaccatggcyaaaccattaggccggctctgcagggagggcaagaccacagcagctcagtatttcctgctcagggaaaaaggccaggtcttttgttggtggaaatccactt

SEQ ID NO: 39606 - DNA, 201 bp, Homo sapiens
cgaaagagcacagcttctggaagtgtggtatgtggtccctgagatgaagcagcagccacaggaacccatcattcctgctacccaaggcctccattgcctgrttttctgttgtcagaagagttcattttcaggtccttcaccagatattttagaagctcatcaaggaaaggacgtttgaagaaaaacaaataaacaaaaaca

SEQ ID NO: 39607 - DNA, 201 bp, Homo sapiens
caatggcctggacgcagctgaaaaaatccagaagagtgtaggacactggaaaagtagcagggtgtgcgattgcagggatgggaccagcagtaaaaggtagscctgccaagaccattaagcttcctgcaactccttctggatcccacaatttgaaggggaaatctttcccaccgcacatcactgtttggtggactaaatggc

SEQ ID NO: 39608 - DNA, 201 bp, Homo sapiens
tggggcaacgctaccaacattggtattccacagcattccaacgattctaaatactctcccagagtagggaggaaaaatcatccaaactacttggtaattgrattcaagagtgatggaccaaaaattattaatgcattcccttccgtccaccagccaaagaggattccatctttattctcctcccaaatgcaggctccatta

SEQ ID NO: 39609 - DNA, 201 bp, Homo sapiens
ttattatgcattgaccaccattcactttctgttggactgcttttggaaaaagaaccacaagtctctatttttaaaatagaggtacaatgataaaacaaaasaaaacaaaacaaaaaaacaacaaaaaaaaaacccacacaggtctcatcagccaagggatttaaaaatcaaatttaacttcaaaaaactgaagttgatata

SEQ ID NO: 39610 - DNA, 201 bp, Homo sapiens
gcatggtctcagatccacttctaaggtcagtgtgaaagggaaggcaaattcactttgagcaggggaggcatgatctggaagataaagcagctaggagtatrgactagggggctgatggaggggaacacctatcacaatatgtgttctcacaccaatgatatatattttccacacatttagattctccatgccactccttat

SEQ ID NO: 39611 - DNA, 201 bp, Homo sapiens
ggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagccga

SEQ ID NO: 39612 - DNA, 201 bp, Homo sapiens
gggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagccg

SEQ ID NO: 39613 - DNA, 201 bp, Homo sapiens
ggggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagcc

SEQ ID NO: 39614 - DNA, 201 bp, Homo sapiens
ggcaggcgaatcgcttgaacccgggaagcagaggttgtagtgagctgagatcatgccactgtactccagcctgggtgacagagcaagactgtctcaaaaargaataaaaatgaataaaaattatgtgattagagaggggaaaacaatcatttcttgtgcgctaatgccactcagcaggtgcttacactgtctggttcatcc

SEQ ID NO: 39615 - DNA, 201 bp, Homo sapiens
actctacttaaaattaaggcataaagtaggaaaatgtgtttcctctgtatagtcttattactttgcctgttaagttaactggttcctatttctgctggttygaagaggtccaggacatttaaatagctcttctagaaacaaattcttttccttacaagccctgccaggtcagtgggttcagtaaggaagaaggttttgtat

SEQ ID NO: 39616 - DNA, 201 bp, Homo sapiens
acccagtggaacgctctttctagtttggggcataaaataagataacactctgaattcctacaggaaatcttgtaactctacttaaaattaaggcataaagyaggaaaatgtgtttcctctgtatagtcttattactttgcctgttaagttaactggttcctatttctgctggttcgaagaggtccaggacatttaaatagc

SEQ ID NO: 39617 - DNA, 201 bp, Homo sapiens
ggtcaaggtagtgttcattaggtttctccactgcacacttagtctttccctctactttccacactgctgcctttggaggagtgttgctgtgcccagctcaygcttgtggagtggggatttaatgttctcactcttcgagggtagagtatctgcataaactacttggaattctacatggaatatttgtgtcttctcccccat

SEQ ID NO: 39618 - DNA, 201 bp, Homo sapiens
tctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgatt

SEQ ID NO: 39619 - DNA, 201 bp, Homo sapiens
gtctccttagcatcttcttggctgtgacagtttctcagaattgtctttgtgatgaccttgacagctttgaggagtgctggttgggtattctgtaggatgcycctgtgttgggatttttatgatgtttttctcatgagtttactggagttaatgaatttcagggaggaagaccccagaggtctgttttcatcacatcgtatc

SEQ ID NO: 39620 - DNA, 201 bp, Homo sapiens
gagatcgtgccactgtactccagcctgggtgacaagagtgaaactccatcttaaaaaaaaaaaaagtgaacccttgtagtttcttcctctgtttgacagayggaccctaagacggccccagtgataccccacctcctggtgtccaaggcctgatgtgatcacccttcccccaccttgaatgtaggtgggacatgggactta

SEQ ID NO: 39621 - DNA, 201 bp, Homo sapiens
ttttttttttttttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagag

SEQ ID NO: 39622 - DNA, 201 bp, Homo sapiens
atggctaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccc

SEQ ID NO: 39623 - DNA, 201 bp, Homo sapiens
gtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatgg

SEQ ID NO: 39624 - DNA, 201 bp, Homo sapiens
ctaaatactccctagaggtttcccattggccacttggggtacaccccttataaatgaagtggtggcctgcaatcagtcttattggttgcagaaagcaaccratcagaggctgaagtgaagttacaaatatcacactcctatgcaaacatctgattggttttggaaagcaaccaatcagaggctaaagtgaaattacagagt

SEQ ID NO: 39625 - DNA, 201 bp, Homo sapiens
ttataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatgg

SEQ ID NO: 39626 - DNA, 201 bp, Homo sapiens
tactcaaataagtctcccccaaaactcagggatagagatttttaaggagaatttagtgagaagggggtcagggaatggggagtattgattggtcaggtttragatggaatcagggagttgaagctggcctcttgcactgagtcagttcctgggtgggagccacaagaccatatgagtcaatttattgacctgggtggtgcc

SEQ ID NO: 39627 - DNA, 201 bp, Homo sapiens
catcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttat

SEQ ID NO: 39628 - DNA, 201 bp, Homo sapiens
ccatcccactaatatatttcttaccaggagtacatagtttgttctttaagcaaaaccatatgcatcgtattttaaatggaacagggaggttgttccatgcrtcaacttagtccaaatgtagagggtcaggaaaacaatgatatgagaaaagggccggttactgtctgggaatccataaatactgcttggcaaatggcacat

SEQ ID NO: 39629 - DNA, 201 bp, Homo sapiens
aagcaaaaccatatgcatcgtattttaaatggaacagggaggttgttccatgcgtcaacttagtccaaatgtagagggtcaggaaaacaatgatatgagaraagggccggttactgtctgggaatccataaatactgcttggcaaatggcacattgcatgcttattccttaggcatccgtttagcaaaataagatgtcaag

SEQ ID NO: 39630 - DNA, 201 bp, Homo sapiens
taactaccttgcttgcctatgggacatgttcccatttcagtgcatacttgacctttaccataaatcacatatttgtaaactgtaccctcctgctgttttaytgggcatggagaagcagtcttttctttttcttgatggcctgggttgaccagatcctgacttttgtggagacattaaagtgctagaaatgataatggtgaa

SEQ ID NO: 39631 - DNA, 201 bp, Homo sapiens
ttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactaaaagtacaaaaat

SEQ ID NO: 39632 - DNA, 201 bp, Homo sapiens
agggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggc

SEQ ID NO: 39633 - DNA, 201 bp, Homo sapiens
ttttagacaactggacacaggtttgtctttgaaattgtcctggtttttcttgatgttttagtgctcctggatgtccaatgtcattcttgggctagttgaargaaagttttggctacccagttgttagctgctgaagtttaactgtgcattctaagcacaccagtattttattacatcatacctgggcagcagataatttta

SEQ ID NO: 39634 - DNA, 201 bp, Homo sapiens
ttgaacccgggaggtggaggttgcagcgagtcaaggtcacgccagtgtactccagcctcggtgacagagcgagactccgtctcaaaaaaaaaaaaaaaaaraaaaagaaaaagaaaaaggtgtttggaagccatgtcccatgaattccaaatacaattgaggactctataaaggactataaaaaaagttgtaataaattat

SEQ ID NO: 39635 - DNA, 201 bp, Homo sapiens
agggattcgtaagcttaggactgatagagatttggcttttctgctgttggattgatagctccttgactgctgaagccattgcccatctgttcaactgttgkattcacgaggaggttagacccctgacccaaggcccaggtacctggctttcctcagttgggatcagaaggccacaaagttttcttatattttaagcatcaa

SEQ ID NO: 39636 - DNA, 201 bp, Homo sapiens
ttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctac

SEQ ID NO: 39637 - DNA, 201 bp, Homo sapiens
acctgtaatcccaacactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggtt

SEQ ID NO: 39638 - DNA, 201 bp, Homo sapiens
acctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgct

SEQ ID NO: 39639 - DNA, 201 bp, Homo sapiens
gatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggattatatccccagcactgtaatttagtgtggcagtcaggggaaaacaccttgtagaatttc

SEQ ID NO: 39640 - DNA, 201 bp, Homo sapiens
gctagcaacctaagggagcttgaaggtgattgaccatccccagtcaagcctctgatgagaccgcagccccactaggcaactagatttcagcatggtaagamcctggatggagaacccagctcagccatgcccagactcctatcctatggaagctttaagataataaatgtatgtggctttaagctgttaagcttttggtaa

SEQ ID NO: 39641 - DNA, 201 bp, Homo sapiens
attggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctt

SEQ ID NO: 39642 - DNA, 201 bp, Homo sapiens
catagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgct

SEQ ID NO: 39643 - DNA, 201 bp, Homo sapiens
agtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatg

SEQ ID NO: 39644 - DNA, 201 bp, Homo sapiens
tcacctgtcctttatcttggctggtccaattccataagaagtaaatgctgtgtgtctgcaattcaaaagacccctttcacgggaggctgggagatttttcyatctaaatagcttaattgttactctacagggcaatcataaatgtaaatcgacttaatatgacttgattgttagtaatgactgtgcctctaatgacgctgg

SEQ ID NO: 39645 - DNA, 201 bp, Homo sapiens
ttgctgttttttttttaacctccttgctaataatcaatgtgattcatttgtctttacaaaaacaaaccattcttttgttttgtttttttttcttcaacttytactttaatttcaggagtatatgtgcaggatgtgcaggttttttacacaggtacatgcgtgccatggtggtttgctacacagatcttcccattacctagg

SEQ ID NO: 39646 - DNA, 201 bp, Homo sapiens
ggtggtgggggtcggcggggggggggggggggtctcactatattgcccaggctggtcttgaactcctgggctcaagcaattctcctgccttggcctcccawagtgctgggattacagttgtgagccactacgcccaatccaatggtagcagatttaaacacaggtggatttggaaaaaaaatcttacgataggtttaatat

SEQ ID NO: 39647 - DNA, 201 bp, Homo sapiens
gacttcataataaataagatgctgacagttgaaacccccttgaccgttgcctgtttggtatgacacagaccttcttggacttttgtagcctatacatgagyagatatgaatcctcagccttctccaaaataaggttggggtcactaggaggccttcttggaaagatgtcttaaattaaggcaccagtagatggatcaaaaa

SEQ ID NO: 39648 - DNA, 201 bp, Homo sapiens
ggcggagcttgcagtgagcggagatcgtgacactgcactccggcctgggtgacagagcctgaatccctctcaaaaaaaaaaaaaaaagaaagaaaacaacyacaaccacattttgagataggccttccttggcaaactttgatttcgtttctgtatttgaggacaaaacacagtatggttgtttccctccctagactagat

SEQ ID NO: 39649 - DNA, 201 bp, Homo sapiens
ctctgagctctaatttcctcacagggccgcaggactgaggttaaggacctgctgtcactggtacagtggttgaagaaaaggtgaatgaaggaagggcctcrttttactccttgtctcacattcctttctgctacttctctttggctcaccaaaaggagacagaagtttgtgtccatggctgtgaactgccaaagagttgcc

SEQ ID NO: 39650 - DNA, 201 bp, Homo sapiens
cgtgaacccgggaggcggagcttgcagtgagcggagatcgtgacactgcactccggcctgggtgacagagcctgaatccctctcaaaaaaaaaaaaaaaaraaagaaaacaaccacaaccacattttgagataggccttccttggcaaactttgatttcgtttctgtatttgaggacaaaacacagtatggttgtttccct

SEQ ID NO: 39651 - DNA, 201 bp, Homo sapiens
gaatgggctgtcctctcctgctactttataaaagccaagtttttgcttctagctggtcgaaggtcctgtgggagctcacgtttttctcaatcactgatgaycatttgagacataatttggagaaggtttctatcaaatcctagttggactgcagtgaaatgttttcaaactagagaagcaccaaataggccatgataaaga

SEQ ID NO: 39652 - DNA, 201 bp, Homo sapiens; identical to SEQ ID NO: 8558

SEQ ID NO: 39653 - DNA, 201 bp, Homo sapiens
ctgcacaaagaatgggctgtcctctcctgctactttataaaagccaagtttttgcttctagctggtcgaaggtcctgtgggagctcacgtttttctcaatyactgatgaccatttgagacataatttggagaaggtttctatcaaatcctagttggactgcagtgaaatgttttcaaactagagaagcaccaaataggcca

SEQ ID NO: 39654 - DNA, 201 bp, Homo sapiens
cagagggattcgtaagcttaggactgatagagatttggcttttctgctgttggattgatagctccttgactgctgaagccattgcccatctgttcaactgktgtattcacgaggaggttagacccctgacccaaggcccaggtacctggctttcctcagttgggatcagaaggccacaaagttttcttatattttaagcat

SEQ ID NO: 39655 - DNA, 201 bp, Homo sapiens
ggaatagagaaaaggtggcttggctgtttggtttatgtcctaaaaccttatcgtaatgtgattctccttaacagagggattcgtaagcttaggactgataragatttggcttttctgctgttggattgatagctccttgactgctgaagccattgcccatctgttcaactgttgtattcacgaggaggttagacccctgac

SEQ ID NO: 39656 - DNA, 201 bp, Homo sapiens
ggaaatggaatagagaaaaggtggcttggctgtttggtttatgtcctaaaaccttatcgtaatgtgattctccttaacagagggattcgtaagcttaggamtgatagagatttggcttttctgctgttggattgatagctccttgactgctgaagccattgcccatctgttcaactgttgtattcacgaggaggttagacc

SEQ ID NO: 39657 - DNA, 201 bp, Homo sapiens
gccttaccccgctacagagaggccccaagagagaggcctcacaccctctggctccactgaaattcacttcacgtttccaacttggattaaactggcacgamagttcagtcaaatgtcaagtccattttgtcaagggagggaactcattcagaagatgaactagttggtgttacttagatgattaactacttggcattaggt

SEQ ID NO: 39658 - DNA, 201 bp, Homo sapiens
gagttgacatacggaaaacaagtaagagtaactttgtacaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagca

SEQ ID NO: 39659 - DNA, 201 bp, Homo sapiens
acagtgttatcagtcattgactcagaagatagtttcttaccgtttggggaaagtgcttgtctattcctctccaaagccattttaaaaaaaaaattgcaccrgttctcatcccatcatctgccttgatcaaacatttgcttattggaatcacttcgaaaaggaacttggtatcgttcacatgtgtttataactctcaaatct

SEQ ID NO: 39660 - DNA, 201 bp, Homo sapiens
ggtatggggtggggaaggggggggggataaagatattaatttggaagcatttgattgctccattattttatcatcttcccatggaaatgttttcataacgygttgttttttaattattattattattttttgagacagagtctcactgagtcgcccagggcggcggtgtgatctcggctcactgcaacctcagtctcccag

SEQ ID NO: 39661 - DNA, 201 bp, Homo sapiens
tgatcaaacatttgcttattggaatcacttcgaaaaggaacttggtatcgttcacatgtgtttataactctcaaatcttcttcttccaatttttaatcttsatcaccacagctttataacaggaagaacgctcaaagaagaaaaatagaagaagcctgaattttaatttgctatttcttcacacacaaaacaccccaagct

SEQ ID NO: 39662 - DNA, 201 bp, Homo sapiens
gagataagaaatggagcaagggaggggtttcatcccgccgtgttcatttgcttggctgtcctgaaattgcgaatacgcagttgttacctgctcccggtggraggggggggatatttatttggcatcttgcaattgataggagctgagtgattttagtaggtagtttaactccttaaaaacttccagtggtttcatattcta

SEQ ID NO: 39663 - DNA, 201 bp, Homo sapiens
tttgaactctaattagggaaagggaatttggaaccattgtcttctctgagtgtgcagacacgatgttatcattgtgtttacagaggtggtcagattcccakcacagtgtactcccgcacagataaccgtcccatcttgataaaacaatgctctcagccgaatcctaaacacgctgcacaaggaagaccttatgctgacagt

SEQ ID NO: 39664 - DNA, 201 bp, Homo sapiens
ttcccagtaggggccggcccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgcacatgctcagctccctcctgcaggctctgggttgcaggg

SEQ ID NO: 39665 - DNA, 201 bp, Homo sapiens
ctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaact

SEQ ID NO: 39666 - DNA, 201 bp, Homo sapiens
ctacttccttcttatatctggctatctgggagagaaaaaatttaatacaattgattactttttagaagagttaatttttacttattactgtggattttttkttttttaacagtcacaccgaggagaagactcagtgggaacatccaaaaactggaaaaagaaaacgagtggcaggaggtttgtatgttgttgtctaaggat

SEQ ID NO: 39667 - DNA, 201 bp, Homo sapiens
aaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactgcagacctcccaaagctcacgaactgag

SEQ ID NO: 39668 - DNA, 201 bp, Homo sapiens
ataaaatatctttggggtgtttaaggagaattattctttttacaagttctgattaatgacaccgcaaaaatgagaataatgagctaatatgtatctagtamttgctatgcacttatatgtatagaagcgtataatccacagcactccttctgaatacgttacgtaaatggaaccctcgcaacagtcttatccccattgtag

SEQ ID NO: 39669 - DNA, 201 bp, Homo sapiens
atccgtcgttccaaatatgagcactttctcttgtcttttctgagctacctattccaagaacacagaggagttgttattgtggttacttgtggtaagaagastacctttctgattggacccagggcagaaaaaagaactttcaggtggaaatacagtcgtggtgtcaggtagtgtgtaacttcgttaagttcagtcatagca

SEQ ID NO: 39670 - DNA, 201 bp, Homo sapiens
gttccaaatatgagcactttctcttgtcttttctgagctacctattccaagaacacagaggagttgttattgtggttacttgtggtaagaagagtaccttyctgattggacccagggcagaaaaaagaactttcaggtggaaatacagtcgtggtgtcaggtagtgtgtaacttcgttaagttcagtcatagcagccgctg

SEQ ID NO: 39671 - DNA, 201 bp, Homo sapiens
attcagcctgaaggcctacttgatgctgcaactgaaaaattgttagactagattttattttattttaattctttttgagacagggtcttagtctgtcaccyaggctgctggagtgcagtggtgcaatcatggctcactgcagtcttgaccaccctggctcaggtgatcctcccacctcagcctcccgggtagttagggcta

SEQ ID NO: 39672 - DNA, 201 bp, Homo sapiens
cccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcac

SEQ ID NO: 39673 - DNA, 201 bp, Homo sapiens
gtgagttagtgccatatatagcagtgttgtcagtaagatttctcactggcatctctgcttcccctcttgactctcttgaaatcccttcttcaggcagaagytggagtcatttctctaaaatagaaatctgatcttgccaccaccctacttgccactccctgcttaatcccttcactggctcaccatatcccttaggataaa

SEQ ID NO: 39674 - DNA, 201 bp, Homo sapiens
attgtatcagtcagcgtagactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaaga

SEQ ID NO: 39675 - DNA, 201 bp, Homo sapiens
gctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagagga

SEQ ID NO: 39676 - DNA, 201 bp, Homo sapiens
aaaccacacatggcctgctcacaaatcttatgataaaactctacccactgagaagcacaaggtgtgaggctattgatgaggagttgaaggtgacagagacygagaaagggctgcacacctttggcctaaagggtaatgagcaacacacaaggattgggagatgttcatggcaagaaaaattcagaagggacattgttgttt

SEQ ID NO: 39677 - DNA, 201 bp, Homo sapiens
ggcctattttttcctccttcttctccgtcttaagtcctgaaatgttttagtgacccagaatgaagcttatttttttaatcatacttccataaaatgtaacycctgggacttggaagagagagaccagccaagggttagcttgaaccctttatcactcccaaacacaggggcttatggtataagtgacacactgcagataga

SEQ ID NO: 39678 - DNA, 201 bp, Homo sapiens
acaggttgagggttcaagctgtccaatccctgctcatctgcagcacaccaaggaatgtggactaatgaaaaataaactgcatgcatgcagtgcccatcacrctgcctgcattttctaatcttcacaataactctgtgttgagaaatattcctgtctgtaatcccggcactttgggaggctgaagcgggcagatcacctgag

SEQ ID NO: 39679 - DNA, 201 bp, Homo sapiens
gctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggattt

SEQ ID NO: 39680 - DNA, 201 bp, Homo sapiens
cattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccact

SEQ ID NO: 39681 - DNA, 201 bp, Homo sapiens
atataattcaagttgagatttcggtggggcgcagccaaaccatatcagacacaaacattcaattcacagcattctaccccagccctccaaaattcatgttyttctgacatgctaaatacatttattacatccaaatatccccaaaatcttaactcattccggcatcagctgtaaagtctatgtctttttaatttttttaaa

SEQ ID NO: 39682 - DNA, 201 bp, Homo sapiens
gcagaaaggtgcctatcatgtcttcagtgtcagtgccctggtatggagctagctggccttccacaggttctggagttaatgctggagagaagtaggggtgkcagagcctaccctgtgttcctaggggggttcatctggagctagtccctgacccttaggtggaagatgcagctatgcccaaggttctgaagaccctgtaaa

SEQ ID NO: 39683 - DNA, 201 bp, Homo sapiens
atgtttacatggggctgtggaccattttgtatcattggaggagaagccagggcacttggcaggggtgttcatgatgataatcaggtggctgggtggagtcrccatttgtggcatcctcaaagacttgccaacatagacatttttggggagacagaaacacagaaataattctgcagtgctttaaagaatctgttaaaaatc

SEQ ID NO: 39684 - DNA, 201 bp, Homo sapiens
aggagagataagaaatggagcaagggaggggtttcatcccgccgtgttcatttgcttggctgtcctgaaattgcgaatacgcagttgttacctgctcccgktgggaggggggggatatttatttggcatcttgcaattgataggagctgagtgattttagtaggtagtttaactccttaaaaacttccagtggtttcatat

SEQ ID NO: 39685 - DNA, 201 bp, Homo sapiens
caccgctcccgacggcctctagatattttgagtgattcagcaaacctcctaaagttgaccccgtagctggggtcacagtcctctttctccttcttcccccyacttccttcttatatctggctatctgggagagaaaaaatttaatacaattgattactttttagaagagttaatttttacttattactgtggattttttgt

SEQ ID NO: 39686 - DNA, 201 bp, Homo sapiens
tttcctcccctgtaaaacgggttaatatcagcacttatcacatagtttttgagaaagctaaacgtgcttatctatagtggttattattactagaaagaatrtcgtggtgcccccaaacatggatttaacaagcattgatcaaatacctcctatgcccctacgaaccaggtactagaaatccactcctttcacttgcttttg

SEQ ID NO: 39687 - DNA, 201 bp, Homo sapiens
attggaaatggaatagagaaaaggtggcttggctgtttggtttatgtcctaaaaccttatcgtaatgtgattctccttaacagagggattcgtaagcttargactgatagagatttggcttttctgctgttggattgatagctccttgactgctgaagccattgcccatctgttcaactgttgtattcacgaggaggttag

SEQ ID NO: 39688 - DNA, 201 bp, Homo sapiens
gcaacttgggtcatgccactacagatcgacacccactaaatccttttaatttagtctagtgcaacaagtatttgtgtaagtgtcctctgccctggacaccrgtgaggtcaccgtgggaatggctgggcaggaacaaagccttttgtttccagctgagtttccttttctgaagattgcctgtcctagacaccagttctctgt

SEQ ID NO: 39689 - DNA, 201 bp, Homo sapiens
tttcggatttatattattgcttacttggcacatcttccattggaaatggaatagagaaaaggtggcttggctgtttggtttatgtcctaaaaccttatcgkaatgtgattctccttaacagagggattcgtaagcttaggactgatagagatttggcttttctgctgttggattgatagctccttgactgctgaagccatt

SEQ ID NO: 39690 - DNA, 201 bp, Homo sapiens
tccacctcctttgagcctctgccaaacacaactgatggtggctgactgcctggctgcaggaagttctgaataagtgacctctatttgttattatttgggtyccctttgtttatttttacactagctttgcactaggttaattttttcccacatggcttttcctgtttgtttctttgattgtttttaattaataattagttt

SEQ ID NO: 39691 - DNA, 201 bp, Homo sapiens
ttgtccttactctgacacccactgcaagtttgaggtggtcctcaaacccatcctcatggctgatatttgctagaaggacttgtggcacttagcagaagctrttgtatttacagttacagtttattacagggaaaggatacaggttaaaattagatcggggaagagacaaatggggcaaagtccaagacaagtaccagatgt

SEQ ID NO: 39692 - DNA, 201 bp, Homo sapiens
cctacttggacccaagactggcgtttactgtggatgataatccgaccaagccaaccacccggcaaagatacgacggcagcaccactgccatggaaattctscagggccgggatttcactggcaaagtggttgtggtcactggagctaattcaggaataggtaggctcttcacttagttatttatctttgggactgctataa

SEQ ID NO: 39693 - DNA, 201 bp, Homo sapiens
gactctttttttcaggaatatattctgcatatatttcagtgatttttttttttttttgagacagtctctcattctgtcgctcaggctggagtgcagtggcrtgaccttggctcactgcaatttctacctcccgggttcaagcaattctcgtgcctcagcctcctgagtcactgggattacaggcatgcacaacaacaccca

SEQ ID NO: 39694 - DNA, 201 bp, Homo sapiens
ttcattgctgtgggttcactgctttctcttttgggcagccatataaataaaagaaccacctacttggacccaagactggcgtttactgtggatgataatcygaccaagccaaccacccggcaaagatacgacggcagcaccactgccatggaaattctccagggccgggatttcactggcaaagtggttgtggtcactgga

SEQ ID NO: 39695 - DNA, 201 bp, Homo sapiens
tcaagagtctttctcttccttttgagcccagctctccctttgtgacccagcaacttccttccccgatgatggccaagccttgaggatgtgaaactgcccartgccccaatctggagtccaccatcctgggtctagctggggacatccttgaatcagcctctgggaatcactgaaccaacatgagtcacttgctactgtgag

SEQ ID NO: 39696 - DNA, 201 bp, Homo sapiens
taagcatatttatatatatatacacataaaacatatatgtacatattatcataatgcctacctgctcttgagaaagtagtgccgtatggctgggggtttckctcactggtttctatggctctcccctcccccactttttctaagaagtggtagtacctatctgactattttcttggctgcctgaagaggcctcaaaattag

SEQ ID NO: 39697 - DNA, 201 bp, Homo sapiens
tttttttttttttttgagacagtctctcattctgtcgctcaggctggagtgcagtggcatgaccttggctcactgcaatttctacctcccgggttcaagcrattctcgtgcctcagcctcctgagtcactgggattacaggcatgcacaacaacacccagctaatttttgtatttttagtagagacagggtttcaccatgt

SEQ ID NO: 39698 - DNA, 201 bp, Homo sapiens
ctgaaggaaaggattcgatgactatctttttttggcacaaatgtgatccttctggaggccagaagatagattcagtgggccccagttctttcaggtttaakgaataagcattttggtctatgaaaaatggggtttgcctaaagtataagattgtcttatatttataaatgcctgtgttcattgctgtgggttcactgcttt

SEQ ID NO: 39699 - DNA, 201 bp, Homo sapiens
tgaaaaaaaataaacaaaatacttctgcaacagcagcagcaagagctgccgcaatgaaagaagaaagaaaaggagggacaggatgaaggaaagaagcagtrttaacattctagtaatatttgcatctgaatgatatttatatggggttattgtcctccctttgtgtatgtttaaaattttcataataagcatatttatata

SEQ ID NO: 39700 - DNA, 201 bp, Homo sapiens
attggtaaaaacatatatcagagtccttttgactgtttagaaagtgttaatttactccacgattatccattcaacatttattagttggcttctgtgtgggwgagtaaccattaataccttgaataagtttataatctggtcattctgtagagcttcctatatgatgtcttctgtttaagtatttctgtaataccttataga

SEQ ID NO: 39701 - DNA, 201 bp, Homo sapiens
gtccttttgactgtttagaaagtgttaatttactccacgattatccattcaacatttattagttggcttctgtgtgggagagtaaccattaataccttgamtaagtttataatctggtcattctgtagagcttcctatatgatgtcttctgtttaagtatttctgtaataccttatagacatctcttttagactactagtg

SEQ ID NO: 39702 - DNA, 201 bp, Homo sapiens
gaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtg

SEQ ID NO: 39703 - DNA, 201 bp, Homo sapiens
tgagcccaggagtttgagaccagcctgggtaacatggcaaaaccttacctctcaaaaatttacaagcttagccaggcatggtggtgcccacttgtggtttyagctacctgggaggctaaagtgggaggatatcctgagcccaggaggtggagattgcagtgagccatgctcgtgccattgcatttcagcgtgggtgacagt

SEQ ID NO: 39704 - DNA, 201 bp, Homo sapiens
ctcgtgccattgcatttcagcgtgggtgacagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcag

SEQ ID NO: 39705 - DNA, 201 bp, Homo sapiens
gtttccaaggcttgtctaagttgtggcatgtgtcagtactttattcttttttatggctgcatagtattccactgcatggatataccacatcttgtttatcygttcatccattgatggacatttgggttgtttccgccttctaggtataatgacttgtgttgccataaacatttgtatacaagtttctgtgtggacatgttc

SEQ ID NO: 39706 - DNA, 201 bp, Homo sapiens
tggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttc

SEQ ID NO: 39707 - DNA, 201 bp, Homo sapiens
aaaaacccttgtatccttgttttgtttcgtttccctgcaaacattgttttagttgagatgaaattcacgtaatatacagttaaccattttaaagtgtacasttcagtggcatttagtgaactcagtgttatgccaccgtcacctctttttagtttcaaaactttgtcatcaccccagaaaagcatacacataaagtcatca

SEQ ID NO: 39708 - DNA, 201 bp, Homo sapiens
tttaatactgctttttattttatagaaaaatataaatcaatactttcatgtctgtttgacgtgtttgggagctacagcaattgaggcttgccagtgtctgratgccccaccactaccacgccacttagctcagagtttgtttttttccttccaccatgtgaaatgttgctggttaaccagttaaaacggggagatggccat

SEQ ID NO: 39709 - DNA, 201 bp, Homo sapiens
cccacaagagagaagtagacagagacctctggaagtttaaaaatatatatgttgggatttcatagatgaggtgagcaaaaaattggccgggaagaactatkaaggaggagatgatcagaaacattttcaaaatacctggaacaaacaaagaaccacatttcaagaaaaagacagagaaacaagactagcaaatagagtttt

SEQ ID NO: 39710 - DNA, 201 bp, Homo sapiens
ctcttttaaaaagttctaagttgctagccagtcggaacaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgct

SEQ ID NO: 39711 - DNA, 201 bp, Homo sapiens
cacgcccggctcaaatccttcttacttttcctcaagaactcacttcccacccaaacctttcctattgtggcagctgttatcttgtccagcacatgtgtccrcacttggtattaatagctccatcttaggaactatgaaagtgaggggggtggtggtaatttgcatgaactggtttgggccagttatggtctgttacatcct

SEQ ID NO: 39712 - DNA, 201 bp, Homo sapiens
agacagtaagaaaggtgacgtcaatctgagatgagagagagagcaaaacagttcttttgaccaccttgaccccgaccttgaaataaggtggaactaataamtcccgctttgtgctggagcaagttttggctgagtttctgtcacttgcaaccaaatcagtcctatccagtatacctagtgactctctggtctccaaaggct

SEQ ID NO: 39713 - DNA, 201 bp, Homo sapiens
gagacagggtgggcaccagttcctcaccgggtcctttctagttgcatgacctggggcaggtgactttatgtggctaagcctcagcttcctgacatatggcrggagtaataatatcccttgaagccaacaaaattcaataggcacatgccatgtacatgcctgtgttatgccgggaacttcttaacatttccagaatatgtg

SEQ ID NO: 39714 - DNA, 201 bp, Homo sapiens
aaagtgaacaggaacttaaagccagcagaggaaagctacctgcccttcactggtggtcagtgcatggattccagagacagggtgggcaccagttcctcacygggtcctttctagttgcatgacctggggcaggtgactttatgtggctaagcctcagcttcctgacatatggcaggagtaataatatcccttgaagccaac

SEQ ID NO: 39715 - DNA, 201 bp, Homo sapiens
gtaagaaaggtgacgtcaatctgagatgagagagagagcaaaacagttcttttgaccaccttgaccccgaccttgaaataaggtggaactaataaatcccsctttgtgctggagcaagttttggctgagtttctgtcacttgcaaccaaatcagtcctatccagtatacctagtgactctctggtctccaaaggctatgcc

SEQ ID NO: 39716 - DNA, 201 bp, Homo sapiens
ctactctatattatgtgggaaaaaaaaaaggagctggtggcagggggagagacttcaaattgagccagacctcaggcatgaagggaggggagagagggggraatgtggaggaagggggcgtttgtgcagtgggaagttggagaaagtacaaatgaaagcctctctgcagtgaacctcatgactgctttagagaggtgctta

SEQ ID NO: 39717 - DNA, 201 bp, Homo sapiens
attatagtgtctggcatacaataaatactttgtaatgttactggtgtcttcttaccgttattgtctcactggtgaccgtttgaaatgttgaagctttattrttacagataatggtggatatagtctcttccttgtttattttttgacagaatctttttttaaaaaagtttttatttgtttggtgagaatttacttgttaca

SEQ ID NO: 39718 - DNA, 201 bp, Homo sapiens
gaatacactgttacccctcaatcaacactacaattcatatatcagaatagcactttgttacttgtttctgagatagggctggctctgtcacccagactggwgtgcagtggcacgatcacagctcactatggcctcagccaccagggttcaagtgatccttccactcagcctcctgagtagttgggactacatgcctgcacc

SEQ ID NO: 39719 - DNA, 201 bp, Homo sapiens
gacctggcgtataattgtgggagggagaagccagtggagcagtcaggggactccctggctgtttctgtgtctggtcttatgggtctgggcactgaattcartcacaaaccctagcatgctcctttgctacctcaggggacaaagtcaagaaaataacactaggattgccaccctgctctctctctctctctcttttttttt

SEQ ID NO: 39720 - DNA, 201 bp, Homo sapiens
atatagatttgcctattctagacttttcatataaataaatcagatactgtgtggccctttgtgtctcgatccttacacttagcatcatgttttcaagggtyattcatgttgtagcatgtatcagtacttctttttttagggctgagtaatattccatttacggatatgccacatttcatctatgcattcagttcacggaca

SEQ ID NO: 39721 - DNA, 201 bp, Homo sapiens
ttccccttctgaagtgaatactgatttttcgttacagatatttgatgctttgggggcctgttaaaatagttgtaaatacactttctaaatagatgaaatgwaagaaattctgagaaggggtttctttgacttactggaaaaaaaaataataggaaagaaaatgtgatcagttggtatatttggctctctttcatcaacact

SEQ ID NO: 39722 - DNA, 201 bp, Homo sapiens
ctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttgg

SEQ ID NO: 39723 - DNA, 201 bp, Homo sapiens
ctccttctagaactagaacataagctctctgaagtcagggaccatgcctagaatcgccttccttttatttcccatcagccgaaactaactctgctgtgtcrcgctgtgttaggctgtgttggctgtgagtaagagaagtctcacccaactagctgaagcgaggtgggttggaggggggatgccttgtggaagtgacaactc

SEQ ID NO: 39724 - DNA, 201 bp, Homo sapiens
tttgcctccttctagaactagaacataagctctctgaagtcagggaccatgcctagaatcgccttccttttatttcccatcagccgaaactaactctgctrtgtcacgctgtgttaggctgtgttggctgtgagtaagagaagtctcacccaactagctgaagcgaggtgggttggaggggggatgccttgtggaagtgac

SEQ ID NO: 39725 - DNA, 201 bp, Homo sapiens
caggcagcttctactcatggtggaaagtgaaggggagccagcatgttcagagaacatatagggagaaagggagcaagagaggggaggggaggtgccagagmctttaaaagaaccaactctctgggaacaaatagagggagaacattaatctagccatgagggatccacccccgtaacctagactcctgtcatcagccacgg

SEQ ID NO: 39726 - DNA, 201 bp, Homo sapiens
ttagttatttatctttgggactgctataatgagatccacttagatctagctataatggaattttgtttagtggttctctgatttaaacatgacttttatcyttttcagatatcgtttcattaacatcactacctctttttaaatcctaatgttgtcatggaagcctgtgtaggggctgaccttgaagtctctgaaagctga

SEQ ID NO: 39727 - DNA, 201 bp, Homo sapiens
ttgcattgcatagttaaagttctttaaattcttctctaaaccccaaggctaagcaatatacaatctagttacaatggtctgcttgctgttaccagaatctrtcaagctctttcctatctaagggttttttccatgtactggtttctctcctgcgtggtcttgttctacccttgaggagggtaccacttcctcattgcttag

SEQ ID NO: 39728 - DNA, 201 bp, Homo sapiens
ctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaat

SEQ ID NO: 39729 - DNA, 201 bp, Homo sapiens
gaagcagtgtcacgcattttagaagaatgggtaagcgcttgactgttgttgttttttttaattgtcaaatacacatgccgggctaaccatatggagatttyagtggagtgtgtaaagtttattgctcttggaatcatgtctttatttttaaagtcatcttcactttgtttgtcttatgaatgaaagcatgagcaagtccat

SEQ ID NO: 39730 - DNA, 201 bp, Homo sapiens
atggattatccttggttgtagtgtttatgtccacatcacatggaatattttatttttcaggcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccg

SEQ ID NO: 39731 - DNA, 201 bp, Homo sapiens
acctttggtgtttggggcatgttgtcacctcattgccatctctgcctctgtcttctcaccaccatcttccttgtccatgtctctctatgtcttcaatgttsttcttataaggacaccagtccttggatttagagcccaccctaattcactgtaatcacatcttacctaagtccatctgcaaagaccctatttccaaataag

SEQ ID NO: 39732 - DNA, 201 bp, Homo sapiens
aatgtatgtgacttaatagcgtaatattttgtccattattttaaaacttgctttatttggtcaagacatacggaacacgtatagatcaaacaaaaattttkaaaaatgcttgcatactgctctgtgctgtggagtagccctaattaaatcaatcattcctctgtttatgggcattccatttcttttcaattttgatattat

SEQ ID NO: 39733 - DNA, 201 bp, Homo sapiens
aattgaagaggctattccaaggtcacatgacttttaagtggcagaaacaggggaattctgtctaacacaatccaatttatccatctcaagaaaagagataygccaaagagaatgattattaaattatcattaatgtgaactcttgtaattactctcataattttctttaggcttatcccattgggcattgctaagtattat

SEQ ID NO: 39734 - DNA, 201 bp, Homo sapiens
tctctggtataaacttgagtcttctctttggtccctgataaatatacatagaatgtatggatgtgagaaagttaaactgatgtctgtgtgtcttcatgtcrttaaactttgaatctacggacatgtctttttctttctggcatagtttggaggtcttcattttgtgattgaatacaaaacaccgagggctttaaggaggca

SEQ ID NO: 39735 - DNA, 201 bp, Homo sapiens
agaacaactccttgctttttcaccaagaatctagaatctagaattatctgagcgttcgcatcagataactaggaagaaatcagagtcattttctctctaargcaggctcgatgatacctgcacagaagcagaggtttcccaagcatgcatgttactgcagtacaagatttggcattctgcatgttggggttgtttagaaac

SEQ ID NO: 39736 - DNA, 201 bp, Homo sapiens
ttagtcatcagacatttagatttcaacatgctcctgttaagctctccttacagtgtgtgtggcactgtgcagttgaatgaaacatgccatggccagtggaracaggcttgggctgatggagagggcctacagggccaggccttgaaggggagggaaattgttagctacacgaccaagagacagaagagaggaaggagtttg

SEQ ID NO: 39737 - DNA, 201 bp, Homo sapiens
ttaggattcttagagaggttttgttaccctaggcatgattacttaaatcattggccattggtgattaagtcaatctccagcccctcctcttcccccaaggyggggaatgtgggggttatcaattattcacaactctctaattgtgaataataaaagactctcccctcacccacattgctcagaaaatttcaaaggtttttg

SEQ ID NO: 39738 - DNA, 201 bp, Homo sapiens
aaacactagttctgcaatttcccaacacctgccccctgccccttataaaagctcatggttccatgtgactttccactcctgcgtctctggccttggggcargtcagtccgtggatcacctcactgtcctagggatgctcttctggtccacactgtgcctaccttggatatggagttccacttgttcccttacctttcaccc

SEQ ID NO: 39739 - DNA, 201 bp, Homo sapiens
aaatcagccatcagccttattagagtggttgattttttttttaatctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaa

SEQ ID NO: 39740 - DNA, 201 bp, Homo sapiens
taagtgtgtaagcagggaacagaaagtactgtgatttaaaatatgttaatttttctactgtacagatgagagccagcttggagatgggctgtagctcaagyatcttacctacctctgatttcttaatgccacgttataaggctgctgcttatagctcttgaagtcactccaaaaacagatgagtgagaccctgttgctaaa

SEQ ID NO: 39741 - DNA, 201 bp, Homo sapiens
ccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgcta

SEQ ID NO: 39742 - DNA, 201 bp, Homo sapiens
agaaaggaagagtttcctgagtcacctttgggaggtaggaagggtttgacatgtaggctgggcatctgggaacgagtgagggattctgtgagccccatctyagtggaccactcaaggaaggtgggtaagccctgggtataagtgtgtaagcagggaacagaaagtactgtgatttaaaatatgttaatttttctactgtac

SEQ ID NO: 39743 - DNA, 201 bp, Homo sapiens
ccttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtga

SEQ ID NO: 39744 - DNA, 201 bp, Homo sapiens
tgtgtcattccgttgtgcctgtcgtcttgaccttgtaaaaggtcttgggtaagcatgcaagaagttttgaagagggagatacagctaatttgcagataaaragcaagggaagaattcctggagaaaggaagagtttcctgagtcacctttgggaggtaggaagggtttgacatgtaggctgggcatctgggaacgagtgag

SEQ ID NO: 39745 - DNA, 201 bp, Homo sapiens
ggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaa

SEQ ID NO: 39746 - DNA, 201 bp, Homo sapiens
acttgtgtcattccgttgtgcctgtcgtcttgaccttgtaaaaggtcttgggtaagcatgcaagaagttttgaagagggagatacagctaatttgcagatraagagcaagggaagaattcctggagaaaggaagagtttcctgagtcacctttgggaggtaggaagggtttgacatgtaggctgggcatctgggaacgagt

SEQ ID NO: 39747 - DNA, 201 bp, Homo sapiens
atattgcttctgatttttgttgttttgctatcatagcgttacctacctcacagagatgttttaggtcataagtatttttcatttaattttttttccccttmatttcctttttttccctcctaagctataaatatacagccttaaaaaaaacactcagaaatttaagtccaagaagcctgcttttcttgatacctttcaagt

SEQ ID NO: 39748 - DNA, 201 bp, Homo sapiens
aaattcagcatctcaaatgtacctttaatattgcttctgatttttgttgttttgctatcatagcgttacctacctcacagagatgttttaggtcataagtrtttttcatttaattttttttccccttaatttcctttttttccctcctaagctataaatatacagccttaaaaaaaacactcagaaatttaagtccaagaa

SEQ ID NO: 39749 - DNA, 201 bp, Homo sapiens
atggattatccttggttgtagtgtttatgtccacatcacgtggattcccgaaggagcatggattatccttggttgtagtgtttatgtccacatcacatggratattttatttttcaggcctcttcatgtgcttgtgtgcaacgcagcaacttttgctctaccctggagtctcaccaaagatggcctggagaccacctttca

SEQ ID NO: 39750 - DNA, 201 bp, Homo sapiens
catggtgggaatctagaagacggagaaagaatttctcattcccgaaggagcatggattatccttggttgtagtgtttatgtccacatcacgtggattcccraaggagcatggattatccttggttgtagtgtttatgtccacatcacatggaatattttatttttcaggcctcttcatgtgcttgtgtgcaacgcagcaac

SEQ ID NO: 39751 - DNA, 201 bp, Homo sapiens
tcctaataagcctctcatcctcagcaacggaggacagttgcccactcaaagccttgtgacattctagggtatcctatttctacatggtgggaatctagaaracggagaaagaatttctcattcccgaaggagcatggattatccttggttgtagtgtttatgtccacatcacgtggattcccgaaggagcatggattatcc

SEQ ID NO: 39752 - DNA, 201 bp, Homo sapiens
tggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccac

SEQ ID NO: 39753 - DNA, 201 bp, Homo sapiens
tttatgcatttagagctcccctcttgtgtttcagaaaggaggagttgttgttttcttttcacttgagtttaataaatgaaaaaggggaagggagagggaargaagaggaaaaagcacaaatgtgcttgtttttggatcagcccctgtactgggcacatggatgcagtcagtcctcagtgtaccccaggaaagaggaaactg

SEQ ID NO: 39754 - DNA, 201 bp, Homo sapiens
tcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttatacaatatttcttttgaaacgagg

SEQ ID NO: 39755 - DNA, 201 bp, Homo sapiens
ttgatcttggacttcccagcttccagaaccatgagcaataaatttctttttttcaaagctccccaggagtctctctcggtctgttctggctcaggaagctkccttatttgtaacaaacaaataaacaaaaaacaaaataaataaaagctacccagcttagattattttgtcataaaagccccaaaagactatgacaaatcc

SEQ ID NO: 39756 - DNA, 201 bp, Homo sapiens
aagaagaatatccatgaatctatgaggaggcgggactctggccagacattgaatttgctgcttccttgatcttggacttcccagcttccagaaccatgagmaataaatttctttttttcaaagctccccaggagtctctctcggtctgttctggctcaggaagctgccttatttgtaacaaacaaataaacaaaaaacaaa

SEQ ID NO: 39757 - DNA, 201 bp, Homo sapiens
agaagaggatgtagggcaggtagggctcagaaggacccatgccatatagcaaagttcttagtaacacaggctttgggttacagcaggctagattcaaatcytgctgtggtcagaatgtctgtgtcaccccagcattcatttgttaggagatggggtcttttgggagatgatttggacatgaagacagagcctgcataattg

SEQ ID NO: 39758 - DNA, 201 bp, Homo sapiens
gagttcaagacctcctcatctctacaaaaaataaaatatttgaaaaaaaaaagtgaaatttttgatatagaagaggatgtagggcaggtagggctcagaargacccatgccatatagcaaagttcttagtaacacaggctttgggttacagcaggctagattcaaatcctgctgtggtcagaatgtctgtgtcaccccagc

SEQ ID NO: 39759 - DNA, 201 bp, Homo sapiens
ttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaag

SEQ ID NO: 39760 - DNA, 201 bp, Homo sapiens
actcggtaaatttcaacttcatcatatatataataattatttttttttgagacagagccttgctgtgtcatccaggctggagtgcatggcctgatctctaytctctgcaacctccacctcccaggttcaaacaattctcatgcgtcagcctcctgagtagctgtgattacaggtgtgtgctaccacggccggctaattttt

SEQ ID NO: 39761 - DNA, 201 bp, Homo sapiens
gtgaaagaaatcaagacatgcaagcaaggataagtgctgtaaagataattcattcctgtttagagggctgaggacaggaagacgatgctgtatggctctasacagggttctgtgatgagtggcctgtggacagattcctgtccgaagaggtgcagggtgcaagggaggaggggacggcaagtatcaaggtcccgagtgagg

SEQ ID NO: 39762 - DNA, 201 bp, Homo sapiens
gcactcccatcccagcctcacaccaagctcccatctgggaagcagcagacacacataaaagcaaggaaacttcaaggacgctttttgttttcccctacttytaaaaaattgaggtgaaattcacataatataagattaaccatttcaaagtagacagttcaatagcagtacattcacaatggtgtgtaaataccgcatcta

SEQ ID NO: 39763 - DNA, 201 bp, Homo sapiens
cagcttctccatttcttttaaaaagccttgctgggagtttatttgctttggtattgaatctgttgatcaatttgaggaggatcaaaatcctgaaagtgttragcgttaccatccatgagcatgcatctctccatttatttaaggcttctttatttataaacatttcagtgatatttgatgattttgaatgtggaggtctta

SEQ ID NO: 39764 - DNA, 201 bp, Homo sapiens
tgttgagcatcgtctgttacctgaagagcagaaggatgataaaagtgaggaaactgaggcacaggcttgccccaggttacacagctagttatgatggaggstgggtcggaagccaagcgccccccagcccccaccccacaacaggtgtatgtggcctctggtttatccttctttccccctgctcaccacatggcttctcat

SEQ ID NO: 39765 - DNA, 201 bp, Homo sapiens
ccgggaagagcgcatcctaaatcagccattagatttgttcctcatttctttgctttacaaattgtttttctgtatagtattggattttcaataaataaagkatgatataaacaagtctgcaaaccagcaagaactatataagccacttgctcaagtcaataagcgcatgctcacaaaggaacgtaaagttctgaagttctt

SEQ ID NO: 39766 - DNA, 201 bp, Homo sapiens
tcttacacagtttgtaagtcttaaaactcagtatctactctagtagttgctccaaatgtgatgtcctcataaatcaccgagggatcttgttaaatttggaytctgattcagtaggtctaggtggggcccgagcttctttgtttccttttcttatttaatttttgtgggtacctagtaggtgtgtatgtacatatatatgta

SEQ ID NO: 39767 - DNA, 201 bp, Homo sapiens
acaaaaattagctgggcatagtgttgtgtgcctgtaggcctagttacttgggaggctgaggcgggagaatcgcttgaacccaggaggcggaggttgcagtsagccgagattataccactgcactccagcctggtgacagagtgagactccatcttaaaaaaaaaaaaaagtcttatattgattaaaagagacttaagacac

SEQ ID NO: 39768 - DNA, 201 bp, Homo sapiens
tctttcaatggaatatatttgacttcagggagaactcactcaaatgctgctgttactgtttttccctttgttggaagtgatggggttgtacttggaatgamtggcctagaaaaccctacaggtaccatttaagctccatagttcttctgtgtgtgtttcggatcccaggttccaaacctgcactaaaacttgttgctgcat

SEQ ID NO: 39769 - DNA, 201 bp, Homo sapiens
ttagtggcatgagaacagactaatacagtcagggatgctgcagaacatctccaaacacacaggactcccaccctctacttccaccccaccaacaaagaatsattcagcccaaaatggcagtagtgaccttgttgagaaatgctgttcaagccatacgtcaccattggaaggttgccaaactgtgctttgcacacacatgct

SEQ ID NO: 39770 - DNA, 201 bp, Homo sapiens
tttcattcccagacctctctccaaaagaggcagccatcattaaaagtttgttatggattcttccagaaacgttctatgcatttagcatcagttgcagatayggatagccttttcaaaaaatgcatgcaactgagactattggctatgttttgtttattacctactttttccatttaatagtatcttggagattatttggta

SEQ ID NO: 39771 - DNA, 201 bp, Homo sapiens
gtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtctt

SEQ ID NO: 39772 - DNA, 201 bp, Homo sapiens
tatatattttgaggtataaaaagtacgtgctcaaggtattggtcactcctcaatttgttttccttgaaacaaaatgaaggtataaatatttcagccgggcrcggtggctcacgcctgtaatcccagcactttgagaggccgaggcgggtggatcatgaggtcaggagatcgagaccatcctggctaacaaggtgaaacccc

SEQ ID NO: 39773 - DNA, 201 bp, Homo sapiens
atgttataggcagttctgaaggaaaggattcgatgactatctttttttggcacaaatgtgatccttctggaggccagaagatagattcagtgggccccagwtctttcaggtttaaggaataagcattttggtctatgaaaaatggggtttgcctaaagtataagattgtcttatatttataaatgcctgtgttcattgctg

SEQ ID NO: 39774 - DNA, 201 bp, Homo sapiens
gaccttgtatgcacacatgagaatttagagatctatatataccgcctggcctcttctttgtaagggtataacagcagtggttaacatgcatttttttttttaacagttagatttactcttcctttgcacagactaatagcacactgaggtaggatccagggacggctccttggcaagttgtactgctgtggcctagggagg

SEQ ID NO: 39775 - DNA, 201 bp, Homo sapiens
aacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattat

SEQ ID NO: 39776 - DNA, 201 bp, Homo sapiens
tgtggactgtagtttgctgacatccaggctagatccttaatatacaatgaagtagtaaaacacatgtaaaagtaaaaagcaggcgaaatagaataaaatasacatttgcacaccacagtatccaaaaaggttatgtactggggctaaagatttggcttggagtttcctggtagtcaaggcaaaaaagggaaacaaaactag

SEQ ID NO: 39777 - DNA, 201 bp, Homo sapiens
atagccttaaagtttctcctgctctttgcagatgaatgaaggggcgctttctggaatctttgtggctggggctgctgctctgcactgctgtggctcttttycacaaatgcttatggagctctaactgggggcaaggaactgtgctacggttgggaagagaggagtgggcaaaaggagacactggggcttctgtgactttag

SEQ ID NO: 39778 - DNA, 201 bp, Homo sapiens
taaattgaattattcccgctgccattcagttttactctgcacaaaatacagccaacatttttgcatttctttcttccttcctccttttcttctttctttcyttccttccttcctttctcccttcatctatctttgttccgcttttgtttgtttttttttagatcgctgcatgctgccgcgttgggttaaccatggtagcat

SEQ ID NO: 39779 - DNA, 201 bp, Homo sapiens
gagactgtaaaagtggactatctgcccaggagacagtgaggaaggaaatcaggggtcacccttacagggaagggctctttgcagagagagtgcctgatacrtagcagctggtacttctccatcttgaaactgtccttcctggttttgtctaatttgtcatcatgggattcttttgacttgtttctagattagggatcaaga

SEQ ID NO: 39780 - DNA, 201 bp, Homo sapiens
aaataatattaccggagaaacaatgagtaacatgtataggattttttttttttttttttgacggagtcttgctctgttgcccaggctccagtgcagtggcrtgatgttggctcactgcaactccgcatcctggtttcaagtggttcttctgcctcagccttccaattagcggggactaccagcgcatgtcaccatgcctgg

SEQ ID NO: 39781 - DNA, 201 bp, Homo sapiens
acccttccgacaatccttcatccttcccagacgtttcatcagccaagtgaaatttgcaattgtttcagtgattgaaattatgcttggagtgcaggtgtcayggatgaaacagcaatgccttgcggtgacaaattcagtgtagaaataattttagcaagcccagtgattggaaaacaatgactcaactttaagctatattga

SEQ ID NO: 39782 - DNA, 201 bp, Homo sapiens
aagtagctgggaccacaggtgcacaccaccacttccagctgattatttaaaaaaaattttgtagtgacagtgtcttgctgtgtttcccaggctgttcttgwactcctgggctcaactgatcttcccagcttggcctcccaaagtgctgggaatacaggtgtgagccactgtcccaggccagttttaactcacaatgatttc

SEQ ID NO: 39783 - DNA, 201 bp, Homo sapiens
tgcaaatgataccatcacgaaagtgtacagatgacctacagaatgggggaaatacttacaaattaaatattaaataagggatttgtatctagaataaagamcttttacaattcaataatgaaaactcatttaaaaaatgagcataagatctaaatagatattcctccaaatatgatacacaaattgccaatgaatacataa

SEQ ID NO: 39784 - DNA, 201 bp, Homo sapiens
cctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtcta

SEQ ID NO: 39785 - DNA, 201 bp, Homo sapiens
tgtttatgtaagatccataatgactcttgccaattagcaggctgctctcttccaagtggtaacccagggactcaagctcttttcatcttgtggctcagccrtctgacacatgtggcttccagcactgccctgctgttgtctgcacaaagctggtggaagaagtaggaatttgcaggaccatgtgtggagcattttaaggat

SEQ ID NO: 39786 - DNA, 201 bp, Homo sapiens
aagggaaggatggaaggaagagagggagagacggagggagatggaggatgacagggagatggagggaggcaaaaagaaaaagggagaaggaaagagaggaragaggggaagggaggaaggaaagaagagagagaaggaggaagagagggaaggaggcacagaggtagagaggcagggagataatggagatcctggccaaaa

SEQ ID NO: 39787 - DNA, 201 bp, Homo sapiens
atactctggggagaagaaaggatcagggtcgggtggggacatctgtgggcatattggggagggggccaggaagaagccaggaagggggcatgctgtcattygtgggttttgcaactttctgtggcatagaaggcatagaaggatctcttcatttaaaaggtcaggttggattttttttttttaacttcaacaccagttaac

SEQ ID NO: 39788 - DNA, 201 bp, Homo sapiens
acagagcctcccttctacctgctcttacccgggcaccacagttgatgagttattttttggaccatcagcaacacacccaatcattgtacatggaatacttyggggatgcttttttctatattgattttacttcattaaactgagctccagaggagcagaaactttggctaatacatcttggtcttagcttgtaatatctgt

SEQ ID NO: 39789 - DNA, 201 bp, Homo sapiens
cctgcccttccctaactggtttcctatgctgtcatgcccacctttgagtgttgccttcactttaaccttctgtgcatgctcacaaagtaattagcatgtaycctccattctgagttaatataaggccccagacccagccacatggggcaactttactgccttcaggtaggggaaccacccccaccacattccctctccact

SEQ ID NO: 39790 - DNA, 201 bp, Homo sapiens
ccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacag

SEQ ID NO: 39791 - DNA, 201 bp, Homo sapiens
tacaggcgcccgccaccatgcccggctaattttttgtattttttagtacagacggggtttcagcatgttggccaggctggtctcaaactcctgacctcacrtgatccacccgccttggcctcctaaagggttgggattacaggtgtcagctagtgcacctgaccctaggataatcttaattttaagtaactggtaactcat

SEQ ID NO: 39792 - DNA, 201 bp, Homo sapiens
ggttgtctcgaactcctgagcttaggcagtctgcccacctcagcttcccaaagtgctaggattataggcatgagccaccatgcccggcctaatctaatcarttcctttaaatctgaaactgtccgcctgattctggtttaccacaaccaccagagtcttaagtgtcccaatagccagggtctcatagactctgcttatggt

SEQ ID NO: 39793 - DNA, 201 bp, Homo sapiens
acctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacgg

SEQ ID NO: 39794 - DNA, 201 bp, Homo sapiens
gcagaatggaagggaaggatggaaggaagagagggagagacggagggagatggaggatgacagggagatggagggaggcaaaaagaaaaagggagaaggawagagaggaaagaggggaagggaggaaggaaagaagagagagaaggaggaagagagggaaggaggcacagaggtagagaggcagggagataatggagatcc

SEQ ID NO: 39795 - DNA, 201 bp, Homo sapiens
gtttcttgtgataggttcaattctcaggctccttctcattagagtctttctgtaaagaccattattatttctgttatatttcctgtggctgagctgagccrcacttggagatttgatccattttaactctctcattgccttcagagagttggtgattttggggggggcaccagtgtgagtcctttgatccttgaatgacaa

SEQ ID NO: 39796 - DNA, 201 bp, Homo sapiens
gaagcccagctagccatgtggagaggccttgtggagcgggaaatggccaacctccatccattggaagtcatcccatttgaggccctagatactgaaaatcrgaaagaagttacttcccattccccacctcaaggccctgtccaaactgaagattcatgggcagaataaacaattgctattttttaaaggtgtatgtttggg

SEQ ID NO: 39797 - DNA, 201 bp, Homo sapiens
gacatgaaaggggcctttctcctgctgtcatcctgaacctctgtctttcaaatttggatgtgtcgggggccacaggacactactgtgcatttgcctgtgayttgccattgggttggagtacttctcctgagtttctgcagtgttctaggtatggtcttaggccctggaataagacagtgtaggaaacacagaaggtgcctg

SEQ ID NO: 39798 - DNA, 201 bp, Homo sapiens
tttttgaagaatggcgctctttaaaaaaacataagggaactttttttttcaaacactgtaatgagggtattcaagtctgcaggcaaaacagagctgtttgraaagacattagcctcgaaaccgcactgtgccagaatagatacagctacgtcaaaatgccgcatttattttgccattacttttcactgactaaaaccattt

SEQ ID NO: 39799 - DNA, 201 bp, Homo sapiens
tgtcacttggttgttctcggtttcaggacccacgtcttttgtctctgtaatgaatgtgttcagaggtctctgcacagagaagctggctgttaggaaaactwtttcttctttccgagacaggctgcaaaatgcttgttactattttgtgtattcctggcaggatttgtattcttagttttattactaatgataataacagtt

SEQ ID NO: 39800 - DNA, 201 bp, Homo sapiens
tgttgattaattaaaggacccaagagctaaaagggagaagtagctgcatgcttgccacttagtaatattttgataagtatttttgggatgaatgcaatgaygcatgaatgaatgaatgaatgaataacataggctacagtattttgtcttcttggttagggaccttgagtaaactgaggagtctgaggggaatgccatgga

SEQ ID NO: 39801 - DNA, 201 bp, Homo sapiens
gaattttctcctttgtcttgtctatttattccttaatggtatcttttgaaaagcagaagttataaatactgatagtgtccaatttatctttttcatttgtktagtgctttcttgttctaagaacctttaccaatcaccaggtcacaaaaatattttcctatgttttcttctagacactccataacttcaatctttacattc

SEQ ID NO: 39802 - DNA, 201 bp, Homo sapiens
tcatctctataaaaaatttacatgaaaaaaaataaacaaaatacttctgcaacagcagcagcaagagctgccgcaatgaaagaagaaagaaaaggagggasaggatgaaggaaagaagcagtgttaacattctagtaatatttgcatctgaatgatatttatatggggttattgtcctccctttgtgtatgtttaaaattt

SEQ ID NO: 39803 - DNA, 201 bp, Homo sapiens
atggctaaccaatggtctcatccgtcagccacactgcctgtctcagcatgggccctgtgtggaccattccatctcaatttgtttctgattcttgtcaattmaataagaacagctgaaaagtaaaataataaatatatacataaaaacaatggggggagtaataatgataatagatacaattttttggtctttataatcccc

SEQ ID NO: 39804 - DNA, 201 bp, Homo sapiens
attcggctccactcactctccattgtctgcatgcctaattcttcctggttgtgagacaagcagttggacctagctgagctaaggagcagaaagactgtatsacagggaacttgtgtaacagcttgatctcctgtcctacgtagctatctattggtaagaagttgaaggaacttgtgtcattccgttgtgcctgtcgtcttg

SEQ ID NO: 39805 - DNA, 201 bp, Homo sapiens
ataaatgtggaaaacaatgtatatgtgttttttatctctcaatgattggtgggtaccatatccccaaagtagaatgagcatttgagaaaacaggaaatatyctcttttaggcaccatctctgtcaaggctgatgctgggctttttatatattttctctaattcttgtggctgtcaaacaaggtgggcattatcattccctt

SEQ ID NO: 39806 - DNA, 201 bp, Homo sapiens
agtggtggcctacttacagtgcatcgcccactctgatttagatgagcaagagctgctgagttgtagatttctagtttctaaacaacaataagtcttgcccscagatagcctcttagcagagccaaaagccagcagagagaagactcagcatttgctttggagtaagtttgtgtgtgtatgtttatctcccttttactcatg

SEQ ID NO: 39807 - DNA, 201 bp, Homo sapiens
ggagtggtggcctacttacagtgcatcgcccactctgatttagatgagcaagagctgctgagttgtagatttctagtttctaaacaacaataagtcttgcycccagatagcctcttagcagagccaaaagccagcagagagaagactcagcatttgctttggagtaagtttgtgtgtgtatgtttatctcccttttactca

SEQ ID NO: 39808 - DNA, 201 bp, Homo sapiens
tagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccga

SEQ ID NO: 39809 - DNA, 201 bp, Homo sapiens
aagcagaatggaagggaaggatggaaggaagagagggagagacggagggagatggaggatgacagggagatggagggaggcaaaaagaaaaagggagaagkaaagagaggaaagaggggaagggaggaaggaaagaagagagagaaggaggaagagagggaaggaggcacagaggtagagaggcagggagataatggagat

SEQ ID NO: 39810 - DNA, 201 bp, Homo sapiens
gaaaaaataaagttttaaggctctagaattggagtgactcagctttacttgaaaaatcccagaatagtaggaccatcatttagaagtttcgagacgataayattagggaaaaataacagcaaatgttacttgatagacactaaactctggggcatatgagatgacccaggctggaaaaccactggcttacataaaggtatt

SEQ ID NO: 39811 - DNA, 201 bp, Homo sapiens
tggcctgttggccatggtcctgggcgcaaagagcagaaaaggacgagacggggactgaacagacttgcttagttcctgacattcaaggaagaactttaacrtccatccacggagcctcaaaggctaaaaataatcatccctttcaatagttcctgttgtgaggaccattaacaaattataagagaaagcattcctcacttg

SEQ ID NO: 39812 - DNA, 201 bp, Homo sapiens
gtgacggtcctttcaaatttaaaggaatagctgatggtcactggccacccaagctgatactgattttatatgttgatgtttctcattttatttgctctttscttgaatatttattcaggacattctctaccagacatattgagtaagggcaacagaaacaatacataagtatcttataaatgtggaaaacaatgtatatgt

SEQ ID NO: 39813 - DNA, 201 bp, Homo sapiens
gtatgtactgatgttctggaattcactataagaagttgcaaatggtgcatgaaatgaaaaattcctggtggtctccaggggacacagccggtgctgtgctscactctgggtaactgttttggattattttctctattccaactgaaataaaaaaaaattaattaaatgtggctaggttatcttgacagcagaatccattcc

SEQ ID NO: 39814 - DNA, 201 bp, Homo sapiens
gtccccaggaagccagaacacagggcagtaaagtgctgaatgcaaagggcaggagaaaaatggaaacaaccagaactgtaacaccaaggaatgagacctgyatgtcagatatcatgcccattgcactaagtgccattggggcacaattatcaaatggatgcattttccctagaaaaccatcttggagagcatgtggatgta

SEQ ID NO: 39815 - DNA, 201 bp, Homo sapiens
tgttgagaagctaattcttgtcagcctaaaaacttgaatatacatttgaataaatcagcggtgctacaccgtggcagcctgctgaaaatccccaaggaagrttatatttttagttgagctacttgtcactgcactgtgtttttaatattgtgagtcctttcttgtcttcatttttgaagaatctattgcataccttgtcat

SEQ ID NO: 39816 - DNA, 201 bp, Homo sapiens
aaattagttatctctgccctttgggaggctgaggcaggtggatcacttgaggtcaggagtttgaacctagcctgggcaacatggtgaaaccccgtctgtascaaacatacaaaaattagctgggtgtggtggcgtgcctgtaatcccagctattggggaggctgaggcaggagaatcactcgaacccgggaggtggaggtt

SEQ ID NO: 39817 - DNA, 201 bp, Homo sapiens
aagtacaaggaaggggatgagtggctggctggctagatggatagaaagatggaacaggtaagtataaggaaggggataggtggctggctggctagatggayggaaggggtggaaggggatgcaagaggtaagtacaaggaaggggatgggtggctggctggctagatggatagaaggttggaagacaggaaggatggaacg

SEQ ID NO: 39818 - DNA, 201 bp, Homo sapiens
caaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaatt

SEQ ID NO: 39819 - DNA, 201 bp, Homo sapiens
ttttacttcattaaactgagctccagaggagcagaaactttggctaatacatcttggtcttagcttgtaatatctgtgctacaacttattaagatggtgaygctggcaaattccttaatctttctaattcttaatttcatcagcaaagatgggaaaggatactaacaccactctgggttgttgagaggattcaataactga

SEQ ID NO: 39820 - DNA, 201 bp, Homo sapiens
cctgctcttacccgggcaccacagttgatgagttattttttggaccatcagcaacacacccaatcattgtacatggaatacttcggggatgcttttttctrtattgattttacttcattaaactgagctccagaggagcagaaactttggctaatacatcttggtcttagcttgtaatatctgtgctacaacttattaaga

SEQ ID NO: 39821 - DNA, 201 bp, Homo sapiens
tgggagatgagttaagaggttttattcttatacatgcggaagaattatgccttcttgagccatgctcaggagatgtcagccttttccattgtctccccgcycccaccgccagccctgcttaaattatcccctctttttaaacagaatatcctaatcttgcaagtggcatatcatgttccttcttttttaagagagaaggag

SEQ ID NO: 39822 - DNA, 201 bp, Homo sapiens
tggcgtgatcactctcaagtgcaaacccagccctgacactgtcctgtttggcaatgtcctgctatctgacctgcaaatagctacacttcctgctgtggccsacccaggcctctgggatctgatcccttctcccatgtcacctgtggccatgtcttccccaacccaggcttctctgctccgctgcttatgttctggatcctg

SEQ ID NO: 39823 - DNA, 201 bp, Homo sapiens
attatgccttcttgagccatgctcaggagatgtcagccttttccattgtctccccgcccccaccgccagccctgcttaaattatcccctctttttaaacaraatatcctaatcttgcaagtggcatatcatgttccttcttttttaagagagaaggagaaattcctgcagatcatcagggactgaggctaactgaaacttt

SEQ ID NO: 39824 - DNA, 201 bp, Homo sapiens
cagactaagaaattaagaacctcaaccaagttcatgctagctggtacgcagtaaggctagaacttcgtccaaaatctcttcttctgttgagctcagcttgyatagtagcttggagaatcagaaagatctgtctcatttgggaaatataccatgtaaaaaacattgtttctaaaggagatttgtcccatgagtaaaatagat

SEQ ID NO: 39825 - DNA, 201 bp, Homo sapiens
tgagaagttttccattccaaaccctttttaggagcggcctggaaactggagtcaactgtcaaatatgtccttatggccacaaagtatgctcatggattctsttttacaggcttagcataatattttataaaacatatttttaaagaaagtgtaattttcccccaaaagcaagggttttccaatgccatataatttactaag

SEQ ID NO: 39826 - DNA, 201 bp, Homo sapiens
caactaagtgctgtttcaataacgaagatactgaagcgctaattggagtatggaaccatataatgatgataataattgctaatatttatcagctatttatyatgtgtcatgtacagctaagcacttacataccatcccattttatccttataatgactctaagagtgggttaaaaaatggcagaagaatggcagtgtttaa

SEQ ID NO: 39827 - DNA, 201 bp, Homo sapiens
gcacctactctgtgccaaagcactattgtaggctgtggagatagggagctgaagtactgaaagcgttacagtcaagggccagaaaaccattgttcaagcarttggcgtatggcttgatctgtgtttattacaaagcgatacttttccttctaagtactgctttacctgcatcctgcaaattttggtatgttgtattttcat

SEQ ID NO: 39828 - DNA, 201 bp, Homo sapiens
ggtagaagaaaagatttatgtaaattagttctctcagtagctatctaggagagagataatcctagctttcttcaagggacagaaccaggaccaatggacaraatctgcaaggaggcagcatttaactgattagaattgtcgggggtggggttggcgagagggtgttgcttttctaatgattcacattgtataaaaagcaga

SEQ ID NO: 39829 - DNA, 201 bp, Homo sapiens
aaatgtcatgtggtttatatcacaccttcacttaacaccctccccctaacaacctctacctggcaatcttcatttaactccaaactcaggacctcaatccyctgtttggcctgtgttccacgggacaggcatggggcacagatgtctgttatatataagggacaaatctctgggttggtcactcctggattccccagcccg

SEQ ID NO: 39830 - DNA, 201 bp, Homo sapiens
ataagcatgatttatgatttgattggaacattgtattttatggttgcagagcacacgtatcatcctatctgcttctgacacccagtaagcagctctggctwttataattttgatgaaagaagtttcccaacagtatttcggtgtgcatgctcacacaccagccctggtcgtcagtgaacagattcttccaggtcttcattg

SEQ ID NO: 39831 - DNA, 201 bp, Homo sapiens
gggtctggagatgtcacccttagctgtttttcacaatgagaggttgttttatcataaataaatcaataaatggcagattatacaccggagttactgagaawtataaaaaaaaaaaaagcccacattttaaagggaatttggtatttttaacaaagcatcagggggccgggagcagtagctcacgcctgtaatgccagcact

SEQ ID NO: 39832 - DNA, 201 bp, Homo sapiens
tcttcagcctagaatactcctcctccactcttaatttctacccatcctgcaaaactcagtctgaacagcacacgtcaaggaagcagttttggtctctcagrttatatgaagctctccaatatgttctttcagaacagccagtgcctagaatactgcctgactcgtagtagcactccttatgtgttgaatgagtaaatgaag

SEQ ID NO: 39833 - DNA, 201 bp, Homo sapiens
caaattgtcccgttgtctcttggctggtcttgccagctggcacacagcttcctctgaccaccctgctaggtacaaatcccacatgaaaagtctcaatcacstggctcaaactcatagttttcaggtggcataagccatggcattttcacctcctttcctggttgtttccagaaagggatgatagccccagtgcagtggctc

SEQ ID NO: 39834 - DNA, 201 bp, Homo sapiens
acccaatccgctcatattcttgcatttgctgcagcaaaacctgacctctctttgtgttacctgagtcttgacgaagaagactgaggaaaggcccccccccscccccaccaaattgtcccgttgtctcttggctggtcttgccagctggcacacagcttcctctgaccaccctgctaggtacaaatcccacatgaaaagtct

SEQ ID NO: 39835 - DNA, 201 bp, Homo sapiens
tcttttcacattttgttttgtgcttgcttatttattgaaatctggaccacaaataacttacatgtttgtcaaggccagatttcaggacctaaccaacaccygacaggcatcttagaaagtggagggtgtaagttataaagagagattacttccaacacgtttctttaaagcctgctggctaaattaggtgggaccttcttt

SEQ ID NO: 39836 - DNA, 201 bp, Homo sapiens
atacatatatatatgtatataactttgcatattttaattgctgtctggaatcctccttcagatggaatgagaaatcatctctgggttagttctgtccctgraggtgagggccagacaacacatcaaaactgactttttattttttttcaaagttgttaagactatctaagattcagatctccctaatactgttcctagtta

SEQ ID NO: 39837 - DNA, 201 bp, Homo sapiens
tatatatatatagatatatatagatatatgtatatatacatatatatatgtatataactttgcatattttaattgctgtctggaatcctccttcagatggratgagaaatcatctctgggttagttctgtccctgaaggtgagggccagacaacacatcaaaactgactttttattttttttcaaagttgttaagactatc

SEQ ID NO: 39838 - DNA, 201 bp, Homo sapiens
tatatatatatatatagatatatatagatatatgtatatatacatatatatatgtatataactttgcatattttaattgctgtctggaatcctccttcagmtggaatgagaaatcatctctgggttagttctgtccctgaaggtgagggccagacaacacatcaaaactgactttttattttttttcaaagttgttaagac

SEQ ID NO: 39839 - DNA, 201 bp, Homo sapiens
cagaaagcctagctccccagcttctcctgaatctacgtttttctattttgtctgaactagccaaggtctctggagtttgctgttatattgcttcagagaamttagtgacattgaaaggctgttgtcttttttagtgtacttttggttgttaggagaaatttacaaggccatttttttctcccgtctctgcagttcaggaga

SEQ ID NO: 39840 - DNA, 201 bp, Homo sapiens
gcagaaagcctagctccccagcttctcctgaatctacgtttttctattttgtctgaactagccaaggtctctggagtttgctgttatattgcttcagagamattagtgacattgaaaggctgttgtcttttttagtgtacttttggttgttaggagaaatttacaaggccatttttttctcccgtctctgcagttcaggag

SEQ ID NO: 39841 - DNA, 201 bp, Homo sapiens
ccaccagccttggcctcccaaagtgctgggattacaggcattagccaccacacccggcccaaattttcttataaagtcaaatgggagatacttgtttgcargaaatagttcttttggttcttacttttccataaggattgagtctcaaaatgtctggtagcatccactgcattttgtaggggacaataacaaagaagatgc

SEQ ID NO: 39842 - DNA, 201 bp, Homo sapiens
caaagaatcagatagtaaatatttttgctcttatcagccagacagtctctgcggcaaccattcaagcattgttgaatacattgttgagtgttacatgagaytattgtaatataaaagtagcctgggacaacacataaataactgggtgtggctgtgtcctaataaaactttatttacaaagaacaggaagtggcttggatt

SEQ ID NO: 39843 - DNA, 201 bp, Homo sapiens
ccatattaaaagtcatcactgccaagacataaatgaaaatgtgttcgaattaaccacaccaatgttcacaaaataaacatttttgatttcccaacagaatmctaggtttaactatcactatcatctttcatgaaatcaaagtcatatatgtaaattgaacacaactttcccttccatagagagtaaaaaccacgctttgga

SEQ ID NO: 39844 - DNA, 201 bp, Homo sapiens
atggaaatggatgatcatggcagtgttgcaataaaactttacaaaacagacaatgggccagattggccaggggccatagtatgctacccctgggcaacaamctgtatgccctggagtagtgtaaagaacgtgggtgttgggggtcaactgacgcttccagctctaccacttactggctgtgtggctttgggcaaactactg

SEQ ID NO: 39845 - DNA, 201 bp, Homo sapiens
atatatatacgtatatatatgcgtatatatatacgtatatatgcgtatatatatacgtatatatgcgtatatatatacgtatatatacgtatatatgcgtrtatatatacgtatatatacgtatatatatatgtgtgtatatatatatataaaaatatatttaaataatgttaaggctagagtagaatgacatcatgggaa

SEQ ID NO: 39846 - DNA, 201 bp, Homo sapiens
cttcttgtaaggggccagagagtgaatatttgagaattttcagactattaagatctctgttgcaactgcttgcttttgccgtggtagcctgaaagcagccrtagatagtatggaaatggatgatcatggcagtgttgcaataaaactttacaaaacagacaatgggccagattggccaggggccatagtatgctacccctg

SEQ ID NO: 39847 - DNA, 201 bp, Homo sapiens
cccttagcctttctttcagcctgtgaggaagcaaaacttttactcttcaggcatcacctcacgcgtcttttctgcctgggaggcactttttccagttttcytggcgaaatagtcatcttttaagttctctgacaacccctctctgagcatctaatcccaatcagaattccctcctaatgtaaactctcattatatctttta

SEQ ID NO: 39848 - DNA, 201 bp, Homo sapiens
cttcccaaaaacatcaaagtatgaccgtaaagggcagaggtaggtaaacttcttgtaaggggccagagagtgaatatttgagaattttcagactattaagwtctctgttgcaactgcttgcttttgccgtggtagcctgaaagcagccgtagatagtatggaaatggatgatcatggcagtgttgcaataaaactttacaa

SEQ ID NO: 39849 - DNA, 201 bp, Homo sapiens
tcttctccctctccgttaaaatgcaacttaattggtaaagtttagttgactagagatttcatttatttatttatttatttatttatttatttatttgtttrtttgtttgtttgagatgagtcttgctcttttgcccaagctggagtgcagtggcatgatctcggctcactgcagcctctgcctcccgtgtccaagtgattc

SEQ ID NO: 39850 - DNA, 201 bp, Homo sapiens
ctgaaatagatcatacactctcttcccaaaaacatcaaagtatgaccgtaaagggcagaggtaggtaaacttcttgtaaggggccagagagtgaatatttragaattttcagactattaagatctctgttgcaactgcttgcttttgccgtggtagcctgaaagcagccgtagatagtatggaaatggatgatcatggcag

SEQ ID NO: 39851 - DNA, 201 bp, Homo sapiens
ccctagctcggttttaagaataatgttttagccaacatatctgcattactcttggctcaatatgagaaatccatttttggtttgcctaacagaagatcatsttgctttgcttctctacacagtatgaaaacccaaagaaaagaaaaacagaggcagttttttgctctaatgaatgctctaaatctagctcttaattatgat

SEQ ID NO: 39852 - DNA, 201 bp, Homo sapiens
gattctgttattctccactaagttttctgggtggtcagcccaggaagcctcagcctgcttccagatagttctcctcagagttagcggtagcagcggtcgtyggccagtgtgtctcgggtcaaattattttgggcattactggaaagttccaaaccaaagcctgtggtaagttccacccaaactggcttgtgagggatattt

SEQ ID NO: 39853 - DNA, 201 bp, Homo sapiens
cattctgtctttatagtttgaacttttccttttcatagtctgtaaatattcatcatctcagagccttttgaattgcaatggcttttagtcaaaactgagcrcaatgtgccatttgaataataagaacctcattaaagtgaggcaaaagtaattcttttccttttgtacaagccaattaagtgtctttacaattaaaacaaa

SEQ ID NO: 39854 - DNA, 201 bp, Homo sapiens
tgtggacttgaatcactatccccaggagcctagtaacccacagcttgtggattagtctgttgaactacttgatggcttgtgacccctttttcccttagagktatatgttctgattttcttcttattgatagtggcagctctgtgctttattttgaagggaagcaggggaaccaaaagaaaacttagcagttgtaagttact

SEQ ID NO: 39855 - DNA, 201 bp, Homo sapiens
tggcaacctttggtgtttggggcatgttgtcacctcattgccatctctgcctctgtcttctcaccaccatcttccttgtccatgtctctctatgtcttcartgttcttcttataaggacaccagtccttggatttagagcccaccctaattcactgtaatcacatcttacctaagtccatctgcaaagaccctatttccaa

SEQ ID NO: 39856 - DNA, 201 bp, Homo sapiens
ccaggcctgttggaatgtctgccagtttcaacccacggggatagggtgagatgaacattgattgagcctttacatcggagacactataacaaatgctttgygtacatcagctctttcaaattaatacaattctactagaggggacactattagtatccccaatttacagatgaaaaaaatgagggacagagaggttagatg

SEQ ID NO: 39857 - DNA, 201 bp, Homo sapiens
agaaaaaaaaaaaaaaaaacaactaccaggcctgttggaatgtctgccagtttcaacccacggggatagggtgagatgaacattgattgagcctttacatyggagacactataacaaatgctttgtgtacatcagctctttcaaattaatacaattctactagaggggacactattagtatccccaatttacagatgaaaa

SEQ ID NO: 39858 - DNA, 201 bp, Homo sapiens
tattgagtacttagtatgtgctggttgcagagccaagtcttttttttttttttttttttcctccttttttgagagagagagtctcactctgtcacccagamtggattgcagtggcacaatctcaactgactgcaacctgcacctctcaggttcaagcaattatcaggcctcaacgtcctgagaagctgggactacaggcat

SEQ ID NO: 39859 - DNA, 201 bp, Homo sapiens
gagaggggacaggaggtgactagatttggaaggaaaattagaaaacttttggccgggcatggtggctcatgcctgtaatcccagcacttttgggtcagttkagtctaacataggggtgtccaaacttttggcttccctgggccacattggaagaaaaagaattgtctttggctgcacataatatacaattgttgatgagct

SEQ ID NO: 39860 - DNA, 201 bp, Homo sapiens
cctgggcgacagaggaagactctgtctcaaaataaacaaacaaataaataaataaaaattgtttaaacctgccaactacaataactttttcagtctctttytccctttcccaccttcccaaaagggtgggaaatttttaaagtaaagtaataaacaaataagttttgggttgggcgggagattagttagagacaggatctg

SEQ ID NO: 39861 - DNA, 201 bp, Homo sapiens
gctacatttaatctttatggtagcctcatgaacaggctcttatttagttcagtggttcttgatcaggagtgatattgcctgccagggaatgcatgtcaatrtctggagacatctggggttgtcagttcaggagggtagaggataggggggaaaaggtgctactggcatctagtgggcaaaggccagggatagtgctaagga

SEQ ID NO: 39862 - DNA, 201 bp, Homo sapiens
acacttgccattctcaatggacaaagggagtggggagtgtgggggtgtgctttggggttagtctctgggttttcgaaacttagcattctcagattcccagscaactggtttcacatgacaagtaaatgagcaacctggaagatgagtggcgtttccacacacagggaagcagatagttccattaggtgacagtgtgtgcac

SEQ ID NO: 39863 - DNA, 201 bp, Homo sapiens
cgggaagtggaggttgcagtgagccgagatcttgccattgttctccagcctgggcgacaagagtgaaactccatctcaaaaaaaaaaaaaaaaaaaaaaaraattatgtcatttcgttgtcacagcgtcagcagaataaatcttagatcaagatgggattactgcgccactcccttcttcccagtctgtggtttagcacgg

SEQ ID NO: 39864 - DNA, 201 bp, Homo sapiens
acggagggagatggaggatgacagggagatggagggaggcaaaaagaaaaagggagaaggaaagagaggaaagaggggaagggaggaaggaaagaagagakagaaggaggaagagagggaaggaggcacagaggtagagaggcagggagataatggagatcctggccaaaagttaatgctccgtttctagtagtccacaga

SEQ ID NO: 39865 - DNA, 201 bp, Homo sapiens
cagtcacagaaatgaggtagctgtagccaaggatgatggcatagcacattcgtttcttaggcgtgccacgtactaggtggcttcagtcagcagaactgtaytttcccacagttttggaggctcaaatttgcaagtcgaggtttcggcaaggccatcctctctctgaaaactctatgggggcgtcctctttgcctcttcccg

SEQ ID NO: 39866 - DNA, 201 bp, Homo sapiens
tgcaggaatatatattcccaccaactttatacaagataatacaaatataatagtatgaataaatatgctaatttgatagaaaatattttaatatttactastagtgtagttggacgtgttaaatattgcaatggttatttgtaatctacctttataaaatttctaatgtctgccactgtttctgttagactcttaagaaga

SEQ ID NO: 39867 - DNA, 201 bp, Homo sapiens
tgtagtggcacaatcccggctcactgcaacctccgcgcctccccagttcaagcaattctcctgcctcagcctcccaagtagctgggattacaagcactggmcaccaaacccagctaatttatatatttttagtagaagcggggtttcaacatgttggccaggctggtctcaaactcctgacctcaggtgatccacctgcct

SEQ ID NO: 39868 - DNA, 201 bp, Homo sapiens
gcttggaaacaggattacttggtgaaataatgtgaatctttcaattctcatgatacatgttttcaacttaatatccagggtgcaggaatatatattcccaycaactttatacaagataatacaaatataatagtatgaataaatatgctaatttgatagaaaatattttaatatttactactagtgtagttggacgtgtta

SEQ ID NO: 39869 - DNA, 201 bp, Homo sapiens
cagcctagaatactcctcctccactcttaatttctacccatcctgcaaaactcagtctgaacagcacacgtcaaggaagcagttttggtctctcagattayatgaagctctccaatatgttctttcagaacagccagtgcctagaatactgcctgactcgtagtagcactccttatgtgttgaatgagtaaatgaagagtc

SEQ ID NO: 39870 - DNA, 201 bp, Homo sapiens
ctgctttttacagtcatgtgctgacaattctaaacattatcaatgataaaatacttctccctcatgatattaactgtgcaatttttgctgcccctgctacrtacatgctttattgcttggaaacaggattacttggtgaaataatgtgaatctttcaattctcatgatacatgttttcaacttaatatccagggtgcagga

SEQ ID NO: 39871 - DNA, 201 bp, Homo sapiens
tgcactttctaaatggcctacttaaaccttgaggtaggtccttcagtttcccataaattaataacacatctatgaatatttcccagccagtcttagaagcsccagtctattccaataccaggattgtaaacacagggaatagatgaagcaagctgcttctttcaaatgctcttccaatatgaagcaaaatattattgatct

SEQ ID NO: 39872 - DNA, 201 bp, Homo sapiens
taaataatgtttgttggccaggcgtggtggctcatgcctgtaaccccagcactctggaaggctgagtcagaacgattgcttgagctgaattgttcaagacygccctgggcagcacagtgagaccccgtatctacaaaaaataaacaaacttagccaggtgcggaggcattcacctgtattcctagctactcaggaagctga

SEQ ID NO: 39873 - DNA, 201 bp, Homo sapiens
cgctggtgtttaggtgggcttgagaaaagtgctgactttgtgaacgaggaggagggaaagggtccagagcagtaaagagcctgtaaataaattcataccarcttcagccccatgctttcgtttgggattcctcatccaaccctgacggcttccctgcgggacatatttccccctcttacagataggaaaccttgcccaatg

SEQ ID NO: 39874 - DNA, 201 bp, Homo sapiens
cgtcgcagatgttatttttttgaagagggtgtaggccaagaaaggggtgggagaaacgagcaaggtgttgatagaaccccttagtgtcctcctcataccasagacactctcttcccccacttacttggccaatttttttttttttttttttttttttttggtggagtctcgttctgtctcccaggctggagtgcaatggtg

SEQ ID NO: 39875 - DNA, 201 bp, Homo sapiens
taatcccctcatgcactggctttgcgaatttctttttcagcctgggtttgaaagcaaagtggtagtgactttttcctgatagctgctgaaaaggttccacrgtatttggaccgctgcctgcttctaccctggagcacaaaagatccaggcgtagaaattggttctaacaatatccttttagagaacaccaaggggatgtga

SEQ ID NO: 39876 - DNA, 201 bp, Homo sapiens
tccccaggctaagcacagtcacagaaatgaggtagctgtagccaaggatgatggcatagcacattcgtttcttaggcgtgccacgtactaggtggcttcastcagcagaactgtattttcccacagttttggaggctcaaatttgcaagtcgaggtttcggcaaggccatcctctctctgaaaactctatgggggcgtcct

SEQ ID NO: 39877 - DNA, 201 bp, Homo sapiens
aatggcatctatgatcttagatttagtaaaacgcagtatcttcttccccagctgaaatagcgaaagggtctcttcaggctcctgggataaaaaccaggatscttcatgtgtctgagcaggcttcccaccatttgactgctgctcctttgtccagacacatttaacaccatctccctgcaccccttcactgggctccgaagc

SEQ ID NO: 39878 - DNA, 201 bp, Homo sapiens
ccctggaagatggatcttgccttgtggatgtttttctaccgtgacagaagatagaaaggatgaaatagaaagagtgtgagtgaattctgcacccacccccvccccccagcttccccacctgtaaaatgatttgctcaaagtttgcaaagaatggaggcatattcaaagtgctcagcactgggccggacccatgggtatgaa

SEQ ID NO: 39879 - DNA, 201 bp, Homo sapiens
tctgctttttacagtcatgtgctgacaattctaaacattatcaatgataaaatacttctccctcatgatattaactgtgcaatttttgctgcccctgctayatacatgctttattgcttggaaacaggattacttggtgaaataatgtgaatctttcaattctcatgatacatgttttcaacttaatatccagggtgcagg

SEQ ID NO: 39880 - DNA, 201 bp, Homo sapiens
ctggctaaaacttgatctgctttttacagtcatgtgctgacaattctaaacattatcaatgataaaatacttctccctcatgatattaactgtgcaatttytgctgcccctgctacatacatgctttattgcttggaaacaggattacttggtgaaataatgtgaatctttcaattctcatgatacatgttttcaacttaa

SEQ ID NO: 39881 - DNA, 201 bp, Homo sapiens
ttttaagatgtgggacttaatcacatttgcgaagaccctttttccaaataaggtcgcattcacagatccctaccattcaactcactatggaagcaatgggrtgggaggtaccattcaactcacagattcctaccattcaacccactataaagcagtggcatatgaaaaggatgggaggttgctatgggaatggtctgcccc

SEQ ID NO: 39882 - DNA, 201 bp, Homo sapiens
gatctcattttaagatgtgggacttaatcacatttgcgaagaccctttttccaaataaggtcgcattcacagatccctaccattcaactcactatggaagsaatgggatgggaggtaccattcaactcacagattcctaccattcaacccactataaagcagtggcatatgaaaaggatgggaggttgctatgggaatggt

SEQ ID NO: 39883 - DNA, 201 bp, Homo sapiens
tccttctccccttctgttttgtaaggataggcctgtcattggatttaaggcccaccttaatccaagatgatctcattttaagatgtgggacttaatcacayttgcgaagaccctttttccaaataaggtcgcattcacagatccctaccattcaactcactatggaagcaatgggatgggaggtaccattcaactcacaga

SEQ ID NO: 39884 - DNA, 201 bp, Homo sapiens
gggtgttccttctccccttctgttttgtaaggataggcctgtcattggatttaaggcccaccttaatccaagatgatctcattttaagatgtgggacttamtcacatttgcgaagaccctttttccaaataaggtcgcattcacagatccctaccattcaactcactatggaagcaatgggatgggaggtaccattcaact

SEQ ID NO: 39885 - DNA, 201 bp, Homo sapiens
ggcttttatcttagtcagtctaatctctgcctctgtctttccatctccttctctgtgggtgttccttctccccttctgttttgtaaggataggcctgtcaytggatttaaggcccaccttaatccaagatgatctcattttaagatgtgggacttaatcacatttgcgaagaccctttttccaaataaggtcgcattcaca

SEQ ID NO: 39886 - DNA, 201 bp, Homo sapiens
aacatctgaaatcaagtggtttgcagcgttggctccttctggaggctggaaggagcatctgttccatgcctttctcctagcttcccatgactgccagccayccttggaatttcttggcttttatcttagtcagtctaatctctgcctctgtctttccatctccttctctgtgggtgttccttctccccttctgttttgtaa

SEQ ID NO: 39887 - DNA, 201 bp, Homo sapiens
aaacatctgaaatcaagtggtttgcagcgttggctccttctggaggctggaaggagcatctgttccatgcctttctcctagcttcccatgactgccagccrcccttggaatttcttggcttttatcttagtcagtctaatctctgcctctgtctttccatctccttctctgtgggtgttccttctccccttctgttttgta

SEQ ID NO: 39888 - DNA, 201 bp, Homo sapiens
caccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcc

SEQ ID NO: 39889 - DNA, 201 bp, Homo sapiens
taaatattttaatgtttgtcgtttgtttgcaaccttgtaattttttcctgtgcagcaattttaactttctatattcaaatatactctgaatgcacagtgartttggcagaataccatttaagtcttgtattttccaaagctagtcaacgtccaactgccaatgttgcctgaacaggaaatatttatacctgaaagcgtcca

SEQ ID NO: 39890 - DNA, 201 bp, Homo sapiens
gtttggggcatgttgtcacctcattgccatctctgcctctgtcttctcaccaccatcttccttgtccatgtctctctatgtcttcaatgttcttcttatarggacaccagtccttggatttagagcccaccctaattcactgtaatcacatcttacctaagtccatctgcaaagaccctatttccaaataaggtcacattc

SEQ ID NO: 39891 - DNA, 201 bp, Homo sapiens
tgaatatgtttcttctttgcctcttgaggactaaccagccgggtttagattatttcctccccgtgtcgctttcctgcccccacatgttaaagatggtgcamgggaaccagagagctttgatccctggtttctctggtcacaaacctgctctcctctccagaactccaggctgcctttctgtgggggctaaatcaaatttag

SEQ ID NO: 39892 - DNA, 201 bp, Homo sapiens
attcaacccacaataagagcacagtggtgaggtttgaggggtggtatgaggtcacagtcacagccacccctctcaccagctgtgtgacaattctggatttmcttagctgtcctctgcctccatctccctttctctgtaagtggaagtggtattcattgatcacacactacatgccggacaccaagctattacattttttga

SEQ ID NO: 39893 - DNA, 201 bp, Homo sapiens
cttctcctgtgttcctttcctgtctgcctcaaatctccctctacctttctgctatgaagacacttgtttttggatttagggtcttcctggctgatctcatstcaagatccgtaacttaattacatctgcaaagacctgattcccaataagcttgccttcacaagttgcagggatttggatatggaactgcctttttggagg

SEQ ID NO: 39894 - DNA, 201 bp, Homo sapiens
atatcactccaatccctgcctctgcagccacatggccttctcctcttctcctgtgttcctttcctgtctgcctcaaatctccctctacctttctgctatgwagacacttgtttttggatttagggtcttcctggctgatctcatgtcaagatccgtaacttaattacatctgcaaagacctgattcccaataagcttgcct

SEQ ID NO: 39895 - DNA, 201 bp, Homo sapiens
gaccagtctggccaacatggtgaaaccctgtctctactaaaaatacaaagattagcctggcgtgccctgtaatcacagctacttgggaggctgaggcaggwgaatcgcttgaacccgggaggtggaggttgcagtgagccaagatcgtgccattgcactccagcctgggcaaaaagagtaaaactcagtctcaaaacaaca

SEQ ID NO: 39896 - DNA, 201 bp, Homo sapiens
ctaagaagcctctgcctgaccacgtgagcatcatggaacccaaagatgaggtagtgcccaccactcccatctcagaacagaagggtgggaagccagagccrcctgctatgccccagccagtccccatagcataacgggctgtccttggcagttgtattcggagtctggatgttgctttgtaaagacatttaataaaatatt

SEQ ID NO: 39897 - DNA, 201 bp, Homo sapiens
taggtagctaacaattgaattgactatgtcaggtagacttatttttcgagttgtgctggttaactgcaatccaagtttaggaagcaaactaccaatttcayttaatagaatgagctaaccaaggcacatggtgactactgtccctcaagaccgctgaactaccacttccagcacctgctcagattattcattacaatgaag

SEQ ID NO: 39898 - DNA, 201 bp, Homo sapiens
gtaattcctaaacaagagtcatttgtaaattagggaggaagagctaaaaaagattcctagcaagaaacatcataaaggggcttgataaagccaaaaaactraaagaaaaaaaaaaaggaattagaaacagagaaaagaggcttcgtgttgtttgtaaatttgtgaataaatctgttaaagaaatattggattcatattcaa

SEQ ID NO: 39899 - DNA, 201 bp, Homo sapiens
ttaggtggtttttattgggattagtggatgaacttaggattagtgtggcccttccttgagatataatgacaaccttggtgaaagcaagaccacagggcctrtcttcagggaagtgccttgcattttaataccaaccatgccacgtgtatgtgtttcctgggcctgccataacaaattatcgcaaactgggtagattgagaa

SEQ ID NO: 39900 - DNA, 201 bp, Homo sapiens
catctaaatagtgcattgtctgttttcactcaggactttaaaaatagttctagtactaattgtatttttattctaatactgctattccttttactggtacytctgcatcttaaaaaaacaaaacaaaacaacgaaaacttggcatgttggctcacttggtgaatgaaagcatatactgttcagttgtttattcttcagcaa

SEQ ID NO: 39901 - DNA, 201 bp, Homo sapiens
tgggtccacatcagctccacattgcagactgaccccctggaccctcacgtctcaggatccctatctccctgtcagtgctttgtcacccaaagtcaccgcarctcctcttgagtgctttcaagatcagaccgaggggtcctagttcaagctaattcctacctgtgcgatcactagccaagtactgaacctctctgaacttca

SEQ ID NO: 39902 - DNA, 201 bp, Homo sapiens
catttccatgagtagagttggccattgcccactaagaaaatttaggtggtttttattgggattagtggatgaacttaggattagtgtggcccttccttgaratataatgacaaccttggtgaaagcaagaccacagggcctatcttcagggaagtgccttgcattttaataccaaccatgccacgtgtatgtgtttcctgg

SEQ ID NO: 39903 - DNA, 201 bp, Homo sapiens
tctgcttatggctcaggatacttctttttttggccgtgtatgcgtcattgattttgtaacattatcagccattctgtctttaaatattgcttttcttagtstatttcacttgttttggaactcagattacatgtatgtgtaagagcctgggagaatgtgtttcatatgtctcttttgtgctttgttttattgtgttatttt

SEQ ID NO: 39904 - DNA, 201 bp, Homo sapiens
cactgctaagttttgatgccaaagagccaaatttgcagtaccagaatgtcctttccatgtgtgacccaaagttttggctactgaagacgttgcatgccctmcaacagtggaagtggtgccctgaatacgccagaaataatcgtggagtcaacgaagatctgggagtattgtttggagacatctcagtattcctaattcatt

SEQ ID NO: 39905 - DNA, 201 bp, Homo sapiens
tgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctcagtggcttgtcataggtgtcaaagacaggagtccaatgtaaggactt

SEQ ID NO: 39906 - DNA, 201 bp, Homo sapiens
cgctttgtttctgttccaaaggcaattgtaaagggtaagaaaatggagttgtctattgcagcttttaaaagtagactagcaacgggtaatgcattgcttarataaaggaagatgtaagaaccagagtgtaatttcacaagacacagagacagatggcttacccgtaactacagtcaggaattctctaaaggagagagggtg

SEQ ID NO: 39907 - DNA, 201 bp, Homo sapiens
ttatatgcctgttccatatgagaacattatgcatatggtgtgatttggtcattccggatggctaaagtgtgagcatacccgtatctcagatttacagaggwgaaaacagaggctcagactggttatgtatatttctctaagtcccccagctattgtttgttgtaggttgggtaccccaggaagtagattctgcaactgaga

SEQ ID NO: 39908 - DNA, 201 bp, Homo sapiens
attatatgcctgttccatatgagaacattatgcatatggtgtgatttggtcattccggatggctaaagtgtgagcatacccgtatctcagatttacagagragaaaacagaggctcagactggttatgtatatttctctaagtcccccagctattgtttgttgtaggttgggtaccccaggaagtagattctgcaactgag

SEQ ID NO: 39909 - DNA, 201 bp, Homo sapiens
gcacctctcaggttcaagcaattatcaggcctcaacgtcctgagaagctgggactacaggcatgtaccaccacactcagctaatatttgtatttttagtaraggcggggttttgccatgttgtccaggctggtcttgaacacctgacctcaggtgatctgcctgcctcagcctcccaaagtgctgggattacaggggtgac

SEQ ID NO: 39910 - DNA, 201 bp, Homo sapiens
tgagaatcacaggcgtttttgaggctcatggctataatcccagcacttggggaggccgaggcaggtggatcacctgaagtcaggacatcaagaccagcctrgccagtgtggcaaaaccccacctctactaaaaatacaaaaaaaaattagctgaacctggtggttcacgcctgtaattgcagctactcaggaggctgaggc

SEQ ID NO: 39911 - DNA, 201 bp, Homo sapiens
ctttgtttcatgtcagatccgtatcccactgcaattctgtgttactgtaggagatttggggttggcatgccagagtgaaaacgcgaaagaaaataaacagrcagcactgaggaattatacacttgagcttggcatttttcttaacgcagggctattttaggtgcactgcgcatgttggaggtgcccttgcaggtataggta

SEQ ID NO: 39912 - DNA, 201 bp, Homo sapiens
gtaaatgtgatggcagaactgcctcggaattgccactgtgggtactctgcatgtggggtagccctgttttgcaaggagcagcacctctgctcctgttgtayactgtcccttcaataaaagttgctaacaccaccaccttgcccttgaattctttcctgggcaaagccaagaaccctgttggcctaagccgcagttctgggg

SEQ ID NO: 39913 - DNA, 201 bp, Homo sapiens
cccaatctctccaaaaagtttaaaaatcggctgggcatggtggtacatgcctgtagtcctagctactcaggagactgaggcaggaggatcacttgagcctsgtaggtcgaggctgcagtgaactaagatgccacaggactatagcctgggcagttttgagtgctgcctctaccatgtaactagcttgccagtcaagtcatt

SEQ ID NO: 39914 - DNA, 201 bp, Homo sapiens
acaactaatgtgacatggcagtgtataagacattacagccaaggccttctggttgaagttggggaactgtgggcgttgtccccactagtcctgtcatctgmccttgcaaaaccacccttgggctctctcgcgtgcggtctgtgcaccagctacctttgtgctccccacattcttccacctggcctggaagctgaccatagt

SEQ ID NO: 39915 - DNA, 201 bp, Homo sapiens
gacatgagggctcaccccctcatctccaccgcagcagctctctgataaatgtagctctctgataaatgattctgttcctagtggtgtattcacagagtcartggataaggtggctggctttgcatttgagaagtatttgctttgtccaacagacaccagatgagtaacaatggaagtaggcagggtttgaagaggtatgtg

SEQ ID NO: 39916 - DNA, 201 bp, Homo sapiens
aaacaaaaaggaggataccaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcact

SEQ ID NO: 39917 - DNA, 201 bp, Homo sapiens
gcattcagacatttagaaaatattgcaggcagagctggggattccgtggccagagcatatttggtgaaccgaggacgcatcaaagagcttctctggtgttyagtaacttgcactgtatttcagaggtttataaagggaagggacaggaaagcagtgtgccagtaagacaactcctcttctcgtctggattttagaggaatg

SEQ ID NO: 39918 - DNA, 201 bp, Homo sapiens
ttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctggg

SEQ ID NO: 39919 - DNA, 201 bp, Homo sapiens
cagcgcaagatccaaaaagacaagtgctcagtcattttgtcataatgccagaagagacagtaatgctgtgtggactatgcattcagacatttagaaaataytgcaggcagagctggggattccgtggccagagcatatttggtgaaccgaggacgcatcaaagagcttctctggtgttcagtaacttgcactgtatttcag

SEQ ID NO: 39920 - DNA, 201 bp, Homo sapiens
actaggtagggtaaataataggtcttagatataggtgcaaataattttcaaatatgggtaaatgctattgggatgtgtaaagtagaaatccattttaaagygttattgaatccatactaacctgatcattacatatttactaattgatgattactaaaaatgtggacctttgtgaatttccgatgtcatagaagggtgttc

SEQ ID NO: 39921 - DNA, 201 bp, Homo sapiens
aagagcagtcattcacccctttggactatggatccctttgcaacccaggaacaactactgtatggccacttcaaacctgtatatgctgcaagtattttatwctaggtagggtaaataataggtcttagatataggtgcaaataattttcaaatatgggtaaatgctattgggatgtgtaaagtagaaatccattttaaagc

SEQ ID NO: 39922 - DNA, 201 bp, Homo sapiens
tcttttaacccctctgaatatgctcctcctgtgatacccatagggaccctgaacctctagtcctcaagagcagtcattcacccctttggactatggatccstttgcaacccaggaacaactactgtatggccacttcaaacctgtatatgctgcaagtattttatactaggtagggtaaataataggtcttagatataggt

SEQ ID NO: 39923 - DNA, 201 bp, Homo sapiens
gtactttaaaatcgagtgtggctgtgtttgtcagtcgtggtttgtgttctttgatttgttctgcatgttcttcttttggagaggatgtgtcactttgccartcttggtccttgctgttgtctggtggagggaaacaagcctgccaggccggctcatctgacccctggtggcagggagtggaggtgcactcaggatgctctt

SEQ ID NO: 39924 - DNA, 201 bp, Homo sapiens
caataaaaataaaaagctgtgtgggaagtcagaacttggttgcttcatgtcatatttcctatttttaagatttacagatattaacgactccttgggaaaastggacttcagtcgcctctctccaacaaaaaacgactattgggcgatgctggcttataacaggtccaagctctgcaacatcctcttctccaacgagctgca

SEQ ID NO: 39925 - DNA, 201 bp, Homo sapiens
ctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgc

SEQ ID NO: 39926 - DNA, 201 bp, Homo sapiens
gaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgc

SEQ ID NO: 39927 - DNA, 201 bp, Homo sapiens
aaggcccagatttagttctcattgtaggaaaaagggccagaataccttgcccatttttgccttgggaagtgagctcaatgaaatacatcttcatatgcccrttttacagaagcagcaactgagggctgttgtactgaggcttgcaatggccacctcaacttttaggtctctgaggcagcaatgggacccttgccggggcct

SEQ ID NO: 39928 - DNA, 201 bp, Homo sapiens
tcaaccccactcctcaatttttggcacccatgttattccacctcaagatcatgtcctcttttaacccctctgaatatgctcctcctgtgatacccataggkaccctgaacctctagtcctcaagagcagtcattcacccctttggactatggatccctttgcaacccaggaacaactactgtatggccacttcaaacctgt

SEQ ID NO: 39929 - DNA, 201 bp, Homo sapiens
atttaaactgaaatgaattaaagttgtataacatttgtaaaaatcacttcttcggtttcattaactagcctcatttcaagtgctcagtagctacatgtacstaacacattggacagcacggttacagaacgttttcatttcatcggacagtttaactgctttggagactggttctcctttttctttttccatgttcactcc

SEQ ID NO: 39930 - DNA, 201 bp, Homo sapiens
tgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacga

SEQ ID NO: 39931 - DNA, 201 bp, Homo sapiens
gtctgatacggtagccattagccacatgtggctatttaaactgaaatgaattaaagttgtataacatttgtaaaaatcacttcttcggtttcattaactarcctcatttcaagtgctcagtagctacatgtacctaacacattggacagcacggttacagaacgttttcatttcatcggacagtttaactgctttggagac

SEQ ID NO: 39932 - DNA, 201 bp, Homo sapiens
aaactggagtacttacccaccagatcctcatctgtcgttggttgaggactgctctcaggacattcacatccaggcacttctggtccacaccttggtacaayatttgcaatattagggacatgctaatacaattattcattgtatatgttaattcaaattaaatggaatgtcctatattttatagggcaaacttaggcttac

SEQ ID NO: 39933 - DNA, 201 bp, Homo sapiens
gggcgccagcctgtaatgggcatcagctgattctcagaaagaagaaacaacgtactgttacataattggggcttctccaaagtggcctgaccaaactgtaragctgcttgtttgtctgatacggtagccattagccacatgtggctatttaaactgaaatgaattaaagttgtataacatttgtaaaaatcacttcttcgg

SEQ ID NO: 39934 - DNA, 201 bp, Homo sapiens
gacccaccccaaccaggtttgcagtgagaggaaatagaccccacctcttctggaagagaatgtgggactggacatactgccatggccacttttgaaagatrcagtctgccacataagcaaacagttcgtgtcctgcagtgggatattgggaaaagaatggtatttggcaaggggtcaggaaacctgcttttgaatcctacc

SEQ ID NO: 39935 - DNA, 201 bp, Homo sapiens
agccatgacagtattacgggttttaaaagccacccaagtaatctaaatttcctccaaactaacaattcctgaaagattgaaatattgctaccaatgtgtayggatggtttccattgatatttgggaagtttccatttgtatttgggaagctttgcatgagcaaaatgcccctttctcctgatatttgcaacccatcttaaa

SEQ ID NO: 39936 - DNA, 201 bp, Homo sapiens
tgtagccatgacagtattacgggttttaaaagccacccaagtaatctaaatttcctccaaactaacaattcctgaaagattgaaatattgctaccaatgtstacggatggtttccattgatatttgggaagtttccatttgtatttgggaagctttgcatgagcaaaatgcccctttctcctgatatttgcaacccatctt

SEQ ID NO: 39937 - DNA, 201 bp, Homo sapiens
ccccacattaacaatttctctccttaactttgtttctgaatgaagttatccacagagttttaaagtgagtggtgagttgtggatacctcttccgagcaggwgcacccccatcctgccattgtccctctccttagtgtatatggattgatgacatttcagtttcagacaaagggacatttcattttttttaggagattaaag

SEQ ID NO: 39938 - DNA, 201 bp, Homo sapiens
aataggaagattcgtccagtctcaaggaactatgataagtagcaaacaatatcccagaaaaatctccagtcaaaaatccactggaggccaggtgcgttagstcatgcctgtaatcccaacactttgggaggtcgaggcaggaggatctcttgaggctaggagctcgagaacagtctgggcaacatagcaagtctctgtctc

SEQ ID NO: 39939 - DNA, 201 bp, Homo sapiens
tattcctgagcttccatgtgcttatttgaaaaataggaagattcgtccagtctcaaggaactatgataagtagcaaacaatatcccagaaaaatctccagkcaaaaatccactggaggccaggtgcgttagctcatgcctgtaatcccaacactttgggaggtcgaggcaggaggatctcttgaggctaggagctcgagaa

SEQ ID NO: 39940 - DNA, 201 bp, Homo sapiens
cctgatctctactctctgcaacctccacctcccaggttcaaacaattctcatgcgtcagcctcctgagtagctgtgattacaggtgtgtgctaccacggcmggctaatttttttgtattttattagagacggggttttgccatgttggccaagctgatctggaactcatgtgctcgagcaatccacccacctcggcctccc

SEQ ID NO: 39941 - DNA, 201 bp, Homo sapiens
ttggactgcttttggaaaaagaaccacaagtctctatttttaaaatagaggtacaatgataaaacaaaacaaaacaaaacaaaaaaacaacaaaaaaaaaacccacacaggtctcatcagccaagggatttaaaaatcaaatttaacttcaaaaaactgaagttgatatagcaggatcttggagatgcagtttcttcactt

SEQ ID NO: 39942 - DNA, 201 bp, Homo sapiens
gcctgggaataggatggcaggtcgtgggaccagcattttaattacctaaagggaacttattgattttagtccagaacacggtggggaggagttcatattcwtttttttttttgagtctggattttagaataaattcactgtgtacatagctattccatctttaaaaacctttgtgaatgttaatatacagcctttataaat

SEQ ID NO: 39943 - DNA, 201 bp, Homo sapiens
cgatctcggctcattgcaagctccgcctcccgggttcatgccattcttctgcctcagcctcccgagtagctgggactacaggcgcctgccactacacctgkctaatttttttgtagttttagtagggatggggtttcaccgtgttagccaggatggtctagatctcctgacctggtgatccgcctgtcttggcctcccaaa

SEQ ID NO: 39944 - DNA, 201 bp, Homo sapiens
tcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcctgc

SEQ ID NO: 39945 - DNA, 201 bp, Homo sapiens
ttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcctg

SEQ ID NO: 39946 - DNA, 201 bp, Homo sapiens
cttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcct

SEQ ID NO: 39947 - DNA, 201 bp, Homo sapiens
gccaaattgaagggtaaactgagttcaccaggcaaactgaggaagggtactcaggctgaaggatcatgggaggggaggagcgtgagttcctcttaagtgartataaaccagggggtaggaaacaacatgagatgaggctggcgagagagaaggatgctaggtgaggtgctgtggtgcgccagagactgcggaagtggcttt

SEQ ID NO: 39948 - DNA, 201 bp, Homo sapiens
aaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgtt

SEQ ID NO: 39949 - DNA, 201 bp, Homo sapiens
ggccccctgcatctcaaagccagcaacagaaactctcttgtgcatggagtcccctcctgctttgaatctctctgactttccttgactttgatgtctaggtytggatttcaagggctcagaaactctctcatgcatgtagttccctcctgctttgaatctctctgactttccttgattttgatgtctaggtctggatttcaa

SEQ ID NO: 39950 - DNA, 201 bp, Homo sapiens
acttttggccccctgcatctcaaagccagcaacagaaactctcttgtgcatggagtcccctcctgctttgaatctctctgactttccttgactttgatgtytaggtctggatttcaagggctcagaaactctctcatgcatgtagttccctcctgctttgaatctctctgactttccttgattttgatgtctaggtctgga

SEQ ID NO: 39951 - DNA, 201 bp, Homo sapiens
gatcacttgagctcaggaattcgagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctggg

SEQ ID NO: 39952 - DNA, 201 bp, Homo sapiens
aatatatggctttttcctattggaaaaaattagtcgtgtgaactttattcttcaagaaaaagtagtttttatctgccttggaaatgtcaaaaggattcacragtttcacaagtgatgatctgggttgattgctaggaactgtttttagttagtttttttttttttttttttttttcagacggagtcttgctctgttgccca

SEQ ID NO: 39953 - DNA, 201 bp, Homo sapiens
cctaaggtcccagccacctatggttctttggacctgtgattttcgctgaccccgaatgactggaggaactgctgcctgcatccccaacccagccctccttrtcagtcacgtagaaagcagttattgtttccaagttccctgcccttgttaaatgtcagctttgagtgaaaatgttcctaattttactcagagtgcaaagaa

SEQ ID NO: 39954 - DNA, 201 bp, Homo sapiens
tttttgttcccccatgggatagtaggtaaattaatggaggaagggagtcaactaaacaatttatttgagcaattaatggaggaagggagtcaactaaacartttattagggctttatgtaaagccctagggttagttggttggttggttttgttttgttttgttcctttttttttttgccaggggatgctgtggttgaatt

SEQ ID NO: 39955 - DNA, 201 bp, Homo sapiens
ggtaggctgggctatgctatgatgttcaatacattaggtgtattaaatgcatttttgacttatattttcaacttactatgggtttagacggtaaccccatwgtaagttgaggagcctctgtgtacatatatgtgtgtatttgtagtatatgatttatgtaataatgatcctactctatctgctactttttttttttttttt

SEQ ID NO: 39956 - DNA, 201 bp, Homo sapiens
cgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttg

SEQ ID NO: 39957 - DNA, 201 bp, Homo sapiens
gcatcttgggaagtctgtaagtaatgggagttggaggcttaacactgatctttgagctggcgatttttccagccaactcattttggacgttggtgcttaascatatcctgttttcgagggtggtgttggtggtggaggaggtgatggtgatgatattgataatgacagcaagaatgtcttacatttatagagtgttcaaaa

SEQ ID NO: 39958 - DNA, 201 bp, Homo sapiens
cactttattggtgatatggtttggctgtgtccccacccaaatctcatcttgaattgtagctcccataattcccatatgttgtgggagggaccgggtgggasaatattgaatcatgggggtggttcccccatactgttcttggggtagtgaatgaatctcatgagatctgatggttttataagggggaaacacctttcactt

SEQ ID NO: 39959 - DNA, 201 bp, Homo sapiens
ttgaattataggaattctatatatattttggatacattctttttttttcatatgtactgtgaattttctcctttgtcttgtctatttattccttaatggtrtcttttgaaaagcagaagttataaatactgatagtgtccaatttatctttttcatttgtttagtgctttcttgttctaagaacctttaccaatcaccagg

SEQ ID NO: 39960 - DNA, 201 bp, Homo sapiens
acatcaaacctggcttcttagtccactgctgagtcttcccaattctgaaaaaaaggattcagggtataatttctcacacagatttctgggacagtgctttyttggagcaccacgcctcactaatggaacactcatgtataattctggcttttgaatttttatttttttattaacatacacagtcagcattgggtgtggctc

SEQ ID NO: 39961 - DNA, 201 bp, Homo sapiens
caaatcatatggtcgtgctccagggtgaggaagtatgtcccacttacagactgaaaaggtgctgcaagtctgcacggcagagggcatggataaggggttcrtaaaaacttagggccatttaatacaaatttgtcacatcacactggcttggattgattttgattcattgctctgtcgcccaaacagaattataattatttt

SEQ ID NO: 39962 - DNA, 201 bp, Homo sapiens
aaaagttggagagtgaaatctcaagcaagccaaaaagtgatagatgagttaaaaaaaaaaaaaaaaaaaaagttgcctggcttggtgcagtggctcatgcmtgtactcccagcactttgggaggctgaggtgggcggatcatctgaggtgaggagtttgagaccacactggccaacatgttgaaacccgctctctactaaa

SEQ ID NO: 39963 - DNA, 201 bp, Homo sapiens
cagaaaaaaacaggcagaaacataaaaagctcggagatggcttcctattgcttcttcattctgggccagagcaaatcatatggtcgtgctccagggtgagsaagtatgtcccacttacagactgaaaaggtgctgcaagtctgcacggcagagggcatggataaggggttcgtaaaaacttagggccatttaatacaaatt

SEQ ID NO: 39964 - DNA, 201 bp, Homo sapiens
ttgctctgctcatctttctcacgagtctggcaatggggctgggaatgggctgatctaggctggacttggctggagtaacccagccccaccttggatctctstcctctacttcccacatgtatccttttcatggttaaaggtagaaacagaaaaaaacaggcagaaacataaaaagctcggagatggcttcctattgcttct

SEQ ID NO: 39965 - DNA, 201 bp, Homo sapiens
ggtgaccttggctaagctcccctgcattgctctgctcatctttctcacgagtctggcaatggggctgggaatgggctgatctaggctggacttggctggartaacccagccccaccttggatctctctcctctacttcccacatgtatccttttcatggttaaaggtagaaacagaaaaaaacaggcagaaacataaaaag

SEQ ID NO: 39966 - DNA, 201 bp, Homo sapiens
tttttctccacccaggagccctcaggccgctggtgagtgaagttcttacccattagggattattaatatactagataagagtacagtctctggagctaggyttgtgactttgaacaaattattttatctctctgagctcagtctcctcatctacaaagggggaattgataataggaattgtcgcaaagagctgttttaaag

SEQ ID NO: 39967 - DNA, 201 bp, Homo sapiens
aggtcagtcagtggccatcactactctaaacgtaagaccctgtgatgactgacacttactaggtttctcatttatttatttttctctgcaggacacagctrtgtgttccaaagatggtcttaaacctataggagtataacaccatggctagttcagaaaaccttattccaacttccaaacttagaagatactgggaagtaa

SEQ ID NO: 39968 - DNA, 201 bp, Homo sapiens
gcttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcc

SEQ ID NO: 39969 - DNA, 201 bp, Homo sapiens
tgcttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctc

SEQ ID NO: 39970 - DNA, 201 bp, Homo sapiens
catgttgcctaggctggtctcgatctcctgggctctagcaatcctcccacctcggcctcccaaagtgttgggattacaggcgtgagctaccgtgcccggcsttacgtttcagcatctttcaatccatctaatacgcagtgccagggaaggtttgtgaaaacatttgaatcacagagtcacaaacagtgagaatagctgcag

SEQ ID NO: 39971 - DNA, 201 bp, Homo sapiens
cgatggtagtttctgtttttggagtctctgtaggtctcagactcacagtctgtacttcttgttttgggggctaattaagtggacagtttcagtgttggtasctcatttaagccataaacatgcagaccatgtggaatcccattagtcaaaccttagcagagtgccttgatgagtacctccttttctttctgaattctatta

SEQ ID NO: 39972 - DNA, 201 bp, Homo sapiens
tgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatat

SEQ ID NO: 39973 - DNA, 201 bp, Homo sapiens
tgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggct

SEQ ID NO: 39974 - DNA, 201 bp, Homo sapiens
aacttttgtagttgctgctggtctctttggaaggcaagtgctaatttacccacagttgaaacctgacacacacacgcgcgtgcacacacacagacacacastctctctctctttctctgtctctctctctttctctgtctctcataaggaactaaatcctgcgttttctcaccagagggctaatgacacactgcttagtca

SEQ ID NO: 39975 - DNA, 201 bp, Homo sapiens
tcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgtt

SEQ ID NO: 39976 - DNA, 201 bp, Homo sapiens
gacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtg

SEQ ID NO: 39977 - DNA, 201 bp, Homo sapiens
gaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaattt

SEQ ID NO: 39978 - DNA, 201 bp, Homo sapiens
cctgagtagatgggactacaggcatgtgtcaccatgccaggctaatgtttaaaaatttttcttagaggtagagcctcactttgctgcctaggctgatctaraactcctggcttcaagtgatcctcctgccttgagctcccgaagcgctgggaccaatagagatttctctgagaattaggtcccccactattaataaggtca

SEQ ID NO: 39979 - DNA, 201 bp, Homo sapiens
tgcagactgtataggcttctgcctctcgggaggcctcaggaaacttacagttatggcagaaggtgaaggggaagcaggtaatgtcttcacatggctggcastggaggaagagagaaagtagggaggtggtagatgcttttaaacaaacagatctcaggagaactctttcacaagacagcactagggggatggtgattagaa

SEQ ID NO: 39980 - DNA, 201 bp, Homo sapiens
tcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatg

SEQ ID NO: 39981 - DNA, 201 bp, Homo sapiens
acgagacactcattccgaaggcgggtgtgtatgtgcaaactgtataatttttttcttcttttctatctgctagcaaagtgggtaagttgacccatgacatsgtccactggagggaccacatttgtgactctagcaattaagcctcccttctcatctgtggataaaactgacctcccagtgtgctggagtcaaacatattca

SEQ ID NO: 39982 - DNA, 201 bp, Homo sapiens
atgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgt

SEQ ID NO: 39983 - DNA, 201 bp, Homo sapiens
tgcaattccctctcagtttacatcaaaatcagctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctct

SEQ ID NO: 39984 - DNA, 201 bp, Homo sapiens
cattgacccacttatgtgtagtcccctagtgaaatgacaagaatccccagagctgggaaaacatttccatgcaattccctctcagtttacatcaaaatcakctcgtcacccttgagattgaagctcgcactctgtaagctctgaataaatattaaccatctcctgaaccctgaaggagacattttctggggagcagtgatt

SEQ ID NO: 39985 - DNA, 201 bp, Homo sapiens
caggaaggtaaaatttggaggtgcaggcagagtcaaggtcatgcctgaggcccaaccttcctgttgaagctggtgtttgattcaagctgtggctgagaacrtgcagctcatctggagggtagagttgcaagacatgggttcaggtctgagccaagccagaaactggagaaagcgtggcttctcaagactaggaatacctag

SEQ ID NO: 39986 - DNA, 201 bp, Homo sapiens
acaaggcagtagaggttggacgagacactcattccgaaggcgggtgtgtatgtgcaaactgtataatttttttcttcttttctatctgctagcaaagtggrtaagttgacccatgacatggtccactggagggaccacatttgtgactctagcaattaagcctcccttctcatctgtggataaaactgacctcccagtgtg

SEQ ID NO: 39987 - DNA, 201 bp, Homo sapiens
ttatttaggaggggaatttggggacattgacccacttatgtgtagtcccctagtgaaatgacaagaatccccagagctgggaaaacatttccatgcaattmcctctcagtttacatcaaaatcagctcgtcacccttgagattgaagctcgcactctgtaagctctgaataaatattaaccatctcctgaaccctgaagga

SEQ ID NO: 39988 - DNA, 201 bp, Homo sapiens
ttcccatcaacaactcttgtgcccacgagggactggcctcctcagtgccacacagagcctcccctgagtagatttgtgtcattttcaaacaaagcatcctsgctgcagtgttggattttgtaggatggtgaccgtttacagaaacctctggtccgtgagccaatttggagaaaattgaatcattctctgtgcctttcggct

SEQ ID NO: 39989 - DNA, 201 bp, Homo sapiens
cagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctag

SEQ ID NO: 39990 - DNA, 201 bp, Homo sapiens
aatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgc

SEQ ID NO: 39991 - DNA, 201 bp, Homo sapiens
cttctggtagaggcgttgaacactagggtgagggctttgctctgacttcaggaagcaggtgagaggccctgaaatttccacgtaagattcggggccgggcrcggtggctcatacttataatcccagcactttgggaggctgaggcgggtggaccacctgaggtcaggagttcgagaccagcctggccaacatggtgaaacc

SEQ ID NO: 39992 - DNA, 201 bp, Homo sapiens
attttcatttttattaagaagtaaggcaaaaacaaaataagacatatgtcagaacttcacttatccttctttgctgaattgtataatggttttaaaatacyaaaaaatatttcttcaatttttttctgctactcataatgtagcatctgtagagcgacacacttttgaatttgagttaatatttcctttttattttatttt

SEQ ID NO: 39993 - DNA, 201 bp, Homo sapiens
attgttgctcatagcaaaggtttgttgagtttactacggatataacacttgttcttttttaaaataacttttaaaaacgcaagtgttgaattatctgcatkgtgcctttagggcatacacatctgcttacaatattttttgagctttcagaaaacttaagatatggttgagggatgcaggaaggaacaggacaagaaccca

SEQ ID NO: 39994 - DNA, 201 bp, Homo sapiens
gacatgaatattggttgatattttcatttttattaagaagtaaggcaaaaacaaaataagacatatgtcagaacttcacttatccttctttgctgaattgkataatggttttaaaataccaaaaaatatttcttcaatttttttctgctactcataatgtagcatctgtagagcgacacacttttgaatttgagttaatat

SEQ ID NO: 39995 - DNA, 201 bp, Homo sapiens
gcacagtgtcttgaacacggtaaacaacttacctaggtctgatctcatttgatattgttgctcatagcaaaggtttgttgagtttactacggatataacasttgttcttttttaaaataacttttaaaaacgcaagtgttgaattatctgcattgtgcctttagggcatacacatctgcttacaatattttttgagctttc

SEQ ID NO: 39996 - DNA, 201 bp, Homo sapiens
caaagtttctagcacagtgtcttgaacacggtaaacaacttacctaggtctgatctcatttgatattgttgctcatagcaaaggtttgttgagtttactayggatataacacttgttcttttttaaaataacttttaaaaacgcaagtgttgaattatctgcattgtgcctttagggcatacacatctgcttacaatattt

SEQ ID NO: 39997 - DNA, 201 bp, Homo sapiens
atgctgctatggtttgattcctggctttccaacattacctttgataaccaagacaagtggcagtctaagcctcagtttcctcatctgcaaaatgggtgcamttctagtacctccttcctaaggctgtgaggattcaatgaggtactgcttgcaaagtttctagcacagtgtcttgaacacggtaaacaacttacctaggtc

SEQ ID NO: 39998 - DNA, 201 bp, Homo sapiens
gcctcctcctccaggcttacttggaagcattctgtcctcttgttggaagggaaattggtatggtagggaggtgcttcttctgggagtgggtttgtaaaatyaagactgttttcatccaaaccagttacctgtttgtctagaacctgtgttctctgctttctgcctcttgtgttgacatttctcctttggccttcatctgtt

SEQ ID NO: 39999 - DNA, 201 bp, Homo sapiens
ctgggatacatgttgggcctctgcccagatcatgcttggagtggcaccagctgggtaggacatgtgaaatatttgctcagagagatccagaagtgttgatvtgagtaggatcagctggtgctccaggataaaaatcgtgtcaccacttttgccgaaaagtcactgtgtttctcctgtactcagcaggttacagggtgccat

SEQ ID NO: 40000 - DNA, 201 bp, Homo sapiens
ggagaggtgcgatttccctccacataatcttcagttagtgatctctgtaagagaatgtttttcaaaaggctaatagagaagtaatgagatcagaaggaggycaacccggccttctccgtttggcagcttgattaatttatttctccttcttggagattgctgcaaggggcttttgtcaccctgtgtttttcatgggactgt

SEQ ID NO: 40001 - DNA, 201 bp, Homo sapiens
gctgggatacatgttgggcctctgcccagatcatgcttggagtggcaccagctgggtaggacatgtgaaatatttgctcagagagatccagaagtgttgakctgagtaggatcagctggtgctccaggataaaaatcgtgtcaccacttttgccgaaaagtcactgtgtttctcctgtactcagcaggttacagggtgcca

SEQ ID NO: 40002 - DNA, 201 bp, Homo sapiens
ttgtgggctgggatacatgttgggcctctgcccagatcatgcttggagtggcaccagctgggtaggacatgtgaaatatttgctcagagagatccagaagkgttgatctgagtaggatcagctggtgctccaggataaaaatcgtgtcaccacttttgccgaaaagtcactgtgtttctcctgtactcagcaggttacagg

SEQ ID NO: 40003 - DNA, 201 bp, Homo sapiens
tgagctgaagaagccccactctccctctgccccacatctattgtgggctgggatacatgttgggcctctgcccagatcatgcttggagtggcaccagctgsgtaggacatgtgaaatatttgctcagagagatccagaagtgttgatctgagtaggatcagctggtgctccaggataaaaatcgtgtcaccacttttgccg

SEQ ID NO: 40004 - DNA, 201 bp, Homo sapiens
ggaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaatt

SEQ ID NO: 40005 - DNA, 201 bp, Homo sapiens
aggaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaat

SEQ ID NO: 40006 - DNA, 201 bp, Homo sapiens
caggaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaa

SEQ ID NO: 40007 - DNA, 201 bp, Homo sapiens
ctgaggcaggagaatcacttgaacccaggaggcggaggttgcagtgagcccagatcgcaccactgcactccagcctgggtgacagagcgagactccatctmaaacaaacaaacaaacaaacaaacaaactaagaacaacaacgaaaaaactcccatgtattatctatggattgactgtaaaatatgagaagcaataaatat

SEQ ID NO: 40008 - DNA, 201 bp, Homo sapiens
cgaacatacatgttgaaaatttcaaaagggaaaaaagaaaagaaaggcacatctgagtcaggaaaacattaactagtcttatttctgagaatcaaaccggkggtcttttcagtgatcagtcaccccattaaccacacatgaatggcacaagtaggaaatgcctgctcagagtccctggaagaggtatccagatttatggct

SEQ ID NO: 40009 - DNA, 201 bp, Homo sapiens
aacccagtaggcggaggttgcagtgagccgagatcgcaccactgcactccagcctaggtgacagagtgagactccgtctcaaaaaaaaaaaaaaaaaaaaagaaagaaaacaaaaacaaataggacccatatccctggattgttgaggaaatacgtgaacatatgtggcacacattatagtgtctggcatacaataaatac

SEQ ID NO: 40010 - DNA, 201 bp, Homo sapiens
ggggaaacctgttggtcccctcataaaacagttaacaggaagcccaaggcatctttcagtgccatttttggctgatgtttggaatggttccatcaatcacygctgttcatgtatagctggtttttatgtcagttaaaccatcttccatcaagttggtgaagcagagtcagggaacaagatgaatagcaaaacgtcttctgt

SEQ ID NO: 40011 - DNA, 201 bp, Homo sapiens
tatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaa

SEQ ID NO: 40012 - DNA, 201 bp, Homo sapiens
ccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagca

SEQ ID NO: 40013 - DNA, 201 bp, Homo sapiens
attcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctgg

SEQ ID NO: 40014 - DNA, 201 bp, Homo sapiens
cagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcc

SEQ ID NO: 40015 - DNA, 201 bp, Homo sapiens
cttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaaatgaatcaa

SEQ ID NO: 40016 - DNA, 201 bp, Homo sapiens
acaagtcacagggcttatctccattgttctgaacgatctgtagctaaacaaaaagataaaagctattaatattattaatagttgtagattaccgggaagarcgcatcctaaatcagccattagatttgttcctcatttctttgctttacaaattgtttttctgtatagtattggattttcaataaataaagtatgatataa

SEQ ID NO: 40017 - DNA, 201 bp, Homo sapiens
atgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggtgtccagcgaatgcct

SEQ ID NO: 40018 - DNA, 201 bp, Homo sapiens
tcttacccattagggattattaatatactagataagagtacagtctctggagctaggcttgtgactttgaacaaattattttatctctctgagctcagtcycctcatctacaaagggggaattgataataggaattgtcgcaaagagctgttttaaagattaaatgagataatagatataaagcacttagaagagagtttg

SEQ ID NO: 40019 - DNA, 201 bp, Homo sapiens
cttttgtgaccctgatgagattacaggtcctcagtctcctcattgtatctgaagactaaagaatcagaaatttgtgactccacttagtttttctccacccmggagccctcaggccgctggtgagtgaagttcttacccattagggattattaatatactagataagagtacagtctctggagctaggcttgtgactttgaa

SEQ ID NO: 40020 - DNA, 201 bp, Homo sapiens
aatctaggagaaaggtagagctctcttatgctggggcaacgctaccaacattggtattccacagcattccaacgattctaaatactctcccagagtagggmggaaaaatcatccaaactacttggtaattgaattcaagagtgatggaccaaaaattattaatgcattcccttccgtccaccagccaaagaggattccatc

SEQ ID NO: 40021 - DNA, 201 bp, Homo sapiens
ctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggaggaaaaatcatccaaactacttggtaattgaattc

SEQ ID NO: 40022 - DNA, 201 bp, Homo sapiens
ttgaagacatttactatttctatggtttgtttagcaacagcctggctgaatagttcttcaaaaaataggaacatgatgctcatatctggccactgtatatrctttggagggaacttgaagactaggtggctgcagccactcagaatcttgttgaatatttaacatttttttgtgaatgtatcaactaagaagactatcaat

SEQ ID NO: 40023 - DNA, 201 bp, Homo sapiens
catgcaatgttcacaggtctttacatgtaaaaacaaccctgtaaaataaataacattattctcttcattctccaagtaagctgaggcagaggattccagcrcaagcaatttggttccaaaacctgcccttttaacctctaccagattttggtgaactctctgtctttggaagggtaggtggcggctgcggggagaaataga

SEQ ID NO: 40024 - DNA, 201 bp, Homo sapiens
gacttgtatctcttaatgagtttaactacatttaaccatgtatgtgtcagtcctactatgcaccttacagctcactaaccctgtttaataatgtatgttgytacatttaatctttatggtagcctcatgaacaggctcttatttagttcagtggttcttgatcaggagtgatattgcctgccagggaatgcatgtcaatgt

SEQ ID NO: 40025 - DNA, 201 bp, Homo sapiens
gtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagaggattccagcacaag

SEQ ID NO: 40026 - DNA, 201 bp, Homo sapiens
ccgccaccacacccagctaatttttgtatttttagtatatacggggtttcaccatgttggccaggctggtctcgaactcttgacctcaggtgatctgccckccttggcctcccaaagtgctgggattataggcgtgagccactgcacctggccagtagtagacttttgatagggtttttttttctcaaggtgtaggtttgg

SEQ ID NO: 40027 - DNA, 201 bp, Homo sapiens
cacatcttctgacctcaagtagtttatagtccaaaaagacattggctctttgggatagaggcactttttgggggagagaaacatgaatgcaactttttacrtagagtatgaaactctgttccaaatctctcaaactcaggttctttgattcttaaggtatttttcactgccgagttgctgtcattgaaacaaaatctgtcc

SEQ ID NO: 40028 - DNA, 201 bp, Homo sapiens
gaatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatga

SEQ ID NO: 40029 - DNA, 201 bp, Homo sapiens
aaaagattagtttgaaaggaagggacttgggctcttgaattagacctatgttagtttatagggaggccttcctgaaatgtgttgtcaggcttgctcctgtstgatggctggcactggttttatgctttccaattattctttgcacatcgttatttattattactgttattattatttgacatggagtcttgatctgttacc

SEQ ID NO: 40030 - DNA, 201 bp, Homo sapiens
gagtcgaatagacattaagtgagccttccttatgtgctcagcctgtggtgaggctgcaaagacaatacgacccagcccctgtaatgcaaaattcagagcayagggcagcacactgctgccatgagtcgaggtgacacagtactaacagtgggcacagggggctcggggcacagaggaggggtgcttcccagggagactgcc

SEQ ID NO: 40031 - DNA, 201 bp, Homo sapiens
ttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcac

SEQ ID NO: 40032 - DNA, 201 bp, Homo sapiens
tacaggcacgagctgccacgcctcacctcttgttttcaataccattgataagttgtggtcttcagggacttgtgggcattttcaagttaaatatccaacaktcgtgatttagggcatgaagagctcactcatcaagatgtatgtaattcagattttctgagtgtttaattcggcgtctttggtcacaaggaacagagtttt

SEQ ID NO: 40033 - DNA, 201 bp, Homo sapiens
cagctgtgtcttaagactgtgccctttcatccaccctcttggtactcaaagcttggtccatgaaccagcagcttcagcatctgctgagagcttgctggagrtacagaatctcaggcctgactgacccgaggcctgctgagtctgaattttaaccagagtctcttggtgactcgtgtgtactttagaaggggaactgctcac

SEQ ID NO: 40034 - DNA, 201 bp, Homo sapiens
aagatgcgatttgggtggggacagagccaaaccatattacaggctaatgactgagcgggggctgtttcttgttgtgttcttataagaactattgcattttstttttcttccaaatatagttaatggcctcatcttttctggactaggtttgtagtagaccataagcaaaagagttcagaaagcacggcctccaagaagtcg

SEQ ID NO: 40035 - DNA, 201 bp, Homo sapiens
tctttggagctcacagccaagtcctacagtcagcatcagacggcttgtctcaagctgctgatttccgggagcaaagctgctgtgggacatgagactctttsaggcagaatacctctcatgcctggagagcattacaggctgcattagtctgttttcactctgctgataaagacatacccaagactgtgcaatttacaaaag

SEQ ID NO: 40036 - DNA, 201 bp, Homo sapiens
gtgtctcccctccaagaacaggtacttgcccttgtctttggagctcacagccaagtcctacagtcagcatcagacggcttgtctcaagctgctgatttccrggagcaaagctgctgtgggacatgagactctttgaggcagaatacctctcatgcctggagagcattacaggctgcattagtctgttttcactctgctgat

SEQ ID NO: 40037 - DNA, 201 bp, Homo sapiens
caaatgcagaggcttaagacagcacaaatgtcttatcttacagttctgaaggtttcgctccagagtgagttttatggagtgaaaatcaaaatgttggcagkccttaggggagagtccattcctttcatcttccagtctctagaggctgctggcatttttcagctcacggccacagcactctaatctctgctttcactatcc

SEQ ID NO: 40038 - DNA, 201 bp, Homo sapiens
attaccacagattggaagcaggcttcccccaagtgtgtttccctttgtaatgccagtgtcgtaacgccactatctatacttttcaacacaattccaagtgytacctctgcatggcagaaactgtcaaccgtggatggtttctttttagcttgtccttcccgttctacagcatggaggttaagagctctggctttggttcca

SEQ ID NO: 40039 - DNA, 201 bp, Homo sapiens
tggtgattctcagttcttggtagccatgtctcagcatagtcttctcggacacctaatactactgacctgtataatcgatagggtattgcagacatcagagyatgtgacttacgaggctagaccataaaaatattgaggcttctgccttactgatgtggatcattcactctaggaaaagccagctgccatgttgggaggata

SEQ ID NO: 40040 - DNA, 201 bp, Homo sapiens
ttcattggttactgacgctgtgtactgattgggtaaattctagcatttttacactcctttgtttcaccctgtttgttcattcattcttccgttaaactacmattaagcaactaccatatctaattttaaggtggtggacaaagaatcaaacctaagttggggaatgtggcctctggtgattctcagttcttggtagccatg

SEQ ID NO: 40041 - DNA, 201 bp, Homo sapiens
ggaatttattttaaattacagctttttctattggaagcattcatttatgttggattattgttccctgagtgaaatttcactgatgctgtataattaaatayagatttttttagagatagtatatattttagatgtataagtggataaactggaggtatggaaggtctttatttaaggagaataaatagcccaccccatcaa

SEQ ID NO: 40042 - DNA, 201 bp, Homo sapiens
atgttagggctagcaggtaaacccagctgcaccccagagcaggtgtatacatgagtgctagtgggtaaatccagcagacgtccggactgtgcttgagggtrtcatcgagagagagaaggttgatccgaagttagtaaaggctttaaaaattaaaaggcctgagatgatggtagggttttggaggtaagtataaaaaccttc

SEQ ID NO: 40043 - DNA, 201 bp, Homo sapiens
cgagatatggggtatacatgagtgctattgggcaaatccagctgcacaggagagtaaggggcatatgttagggctagtgggtaaacccagctgcacctgagagtaggggtatatgttagggcttgtgggtaaatccagttgcacctggcagttggggcatatgttagggctagtgggtaaacccagccgcaccggagagtt

SEQ ID NO: 40044 - DNA, 201 bp, Homo sapiens
ccttgaacctgggaggcagaggttgcagtgagccaaggtggtgccactgcattccagcctgggcgacagagcgagattccgtctcaaaaaaaaaaaaaaaagtaatcattttagaattgctttctcttcgggatggtttacctcgtgtttagtctgtaaacgcggataaccgagagctggtcaaatgtttacatggggctg

SEQ ID NO: 40045 - DNA, 201 bp, Homo sapiens
aggccactgcactccaatctgggtgacagagcaagactctgtctcaaaaataatagtaataataataataataataataataataataataataataagaatctgactaaggttattaaccattaaggtatgctgtgctaaggagcagggggccccttccatccgtagagggcagaaaggtgcctatcatgtcttcagtgt

SEQ ID NO: 40046 - DNA, 201 bp, Homo sapiens
caggccactgcactccaatctgggtgacagagcaagactctgtctcaaaaataatagtaataataataataataataataataataataataataataagaatctgactaaggttattaaccattaaggtatgctgtgctaaggagcagggggccccttccatccgtagagggcagaaaggtgcctatcatgtcttcagtg

SEQ ID NO: 40047 - DNA, 201 bp, Homo sapiens
tcaggccactgcactccaatctgggtgacagagcaagactctgtctcaaaaataatagtaataataataataataataataataataataataataataakaatctgactaaggttattaaccattaaggtatgctgtgctaaggagcagggggccccttccatccgtagagggcagaaaggtgcctatcatgtcttcagt

SEQ ID NO: 40048 - DNA, 201 bp, Homo sapiens
agatcaggccactgcactccaatctgggtgacagagcaagactctgtctcaaaaataatagtaataataataataataataataataataataataataakaagaatctgactaaggttattaaccattaaggtatgctgtgctaaggagcagggggccccttccatccgtagagggcagaaaggtgcctatcatgtcttc

SEQ ID NO: 40049 - DNA, 201 bp, Homo sapiens
acctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacag

SEQ ID NO: 40050 - DNA, 201 bp, Homo sapiens
gacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattaca

SEQ ID NO: 40051 - DNA, 201 bp, Homo sapiens
tatatatacacacacacatatatatatacacacacatatatatacacatatatacacatatatatacacacatatatatatacacacacacatatatatayacacacatatatatacacacacatatatatatatacatatacacacacacacacacacacacacacacacacacatatattttttttttcttttagatgg

SEQ ID NO: 40052 - DNA, 201 bp, Homo sapiens
ctctcatttcccaggatggagtgcagtggtgcaatctcctccgcctcccagtttaagccattctcctgcctcagcctcctgagtagctgggattacaggckcccgccaccatgcccggctaattttttgtattttttagtacagacggggtttcagcatgttggccaggctggtctcaaactcctgacctcacgtgatcca

SEQ ID NO: 40053 - DNA, 201 bp, Homo sapiens
ttttctagtcttagatattatctgtaggtttttcaataagaaggaaatttagcttccttctactttggtgccccatgatgatgtgcatcttttttatttcygcatcatatccatatagtgatatcatgtataatgatgtttaagaagacagttttttttgtttaaattgttataaataagtaagtgtatgcaccactatgc

SEQ ID NO: 40054 - DNA, 201 bp, Homo sapiens
tactgcctctggctaatagggatctttgacacatacgctttttctccctttccagctggccctgttgcttaaagtggcagaagtagatgtcatgttggcasacagttttgttcactgtcaaaactgggtttatctaatgtgtatttgaaacaaacaaaaaaaaatcaataaaatgagcagctttgggagccagggtgaagg

SEQ ID NO: 40055 - DNA, 201 bp, Homo sapiens
cctgagagtggtttagcatttatggagccctgctttgtgctaatgagtttatatgccctgtcttctttaatcttcaccacaactttatgtaataagtagtstccaataaatttaatcacataattacttaaatggcctggcgagccgccttacctagctggccaggaattccaggagtcaggcttcctgatctaaatctgt

SEQ ID NO: 40056 - DNA, 201 bp, Homo sapiens
ggtcctcaaaatagaaggtcagagagtagacttttaaaagtcttgcactgtttacaagtcagatgctttttggcagagtgactctcagctccctccaacartcccttcttgtcgttcagtagtagatagactctatcagggaaaaataggagaaataaaataagacagcatatggaaggcattgctgaaagtctttttcac

SEQ ID NO: 40057 - DNA, 201 bp, Homo sapiens
ggaaagtctttcactcatttctatctgcagtatttactgggcatttttccacgccaagccctggggatacagagttaaataaaatagaagcttaatccagrcatgctggctgtaaagttcacctttcggctcctttctgccattcttattagggtcttgccccatcttggcagcaagcctgctttaccattggagacctca

SEQ ID NO: 40058 - DNA, 201 bp, Homo sapiens
cttgattagttcttcctgttggtggactgattgattacatttgaatctttcagcaagcttttggctgagctgggcatcttccccgccttcctccacctctsccttcaaaagcctgaatttccaaggctttctgccatgagtacttagctttgaaaaacatgagcatatttttcattcttcttgccggcctctccctgtgtc

SEQ ID NO: 40059 - DNA, 201 bp, Homo sapiens
ctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcct

SEQ ID NO: 40060 - DNA, 201 bp, Homo sapiens
aagaaatggagatctcaagaggtaaaaaaaactgactataggagccaagactagtttagagtggagtttgaatatgaacatgcctctgtctgtgaaagccmgtgtcccttcagccaggatctttcctggaagaactcagtattaaggcacttgattagttcttcctgttggtggactgattgattacatttgaatctttca

SEQ ID NO: 40061 - DNA, 201 bp, Homo sapiens
ctttctaatgcagaaggtgtagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagt

SEQ ID NO: 40062 - DNA, 201 bp, Homo sapiens
aggattcggtgtctaccctcaagaagcatcatttagagaagaaattagaaaagtaagtgaggcagaacaggatctggaggcagggaatctaaggctgattsacgttgactttgtataattaaatcaaaaggaaaacaccaactttccacaactaagttataaaaggaccagaggctactccctctgcaacccctccccact

SEQ ID NO: 40063 - DNA, 201 bp, Homo sapiens
gatgctggtcaggcgcggtggctcacgcctgtaatcccagcattttgggaggccaaggtgggcagattacttgaggtcaggagatcgagatcagccgggcyaacctggtgagatcccatctctactaataatacaaaaaatagctggcgtggtggcgcatgtctgtaattacagttactcgggaggctgaggcaggagaat

SEQ ID NO: 40064 - DNA, 201 bp, Homo sapiens
gccatgggtctcctaagtgggatacaccacgatgatccactggggcagtggccagcaaagtccctgtccagccagccactcgtttttatcaataaattttyactgaaacacagtcatgcctgttaggttaggaactgcctagcgccacttcacactgcagtaggagagtgagtagttgtgacagagaccatttatcccaca

SEQ ID NO: 40065 - DNA, 201 bp, Homo sapiens
ggcagctgcccacttccagaaagctagaggttctaattatgtcttcctgaaaaacagttcaattaggtaaagtgacattttttaagcccttgtgtgtgtcygactcataaaagttcagaaggttgttactgagaggagactgcagtcattttaagatttcagtagctgctggagttgagtagataatttttcccctttcta

SEQ ID NO: 40066 - DNA, 201 bp, Homo sapiens
tgactttaacattattttcagatagggagcactcagtaccaaccattatattaggctcatgggctcaacattttgctgtgcttttcatagatactgacacytgtgttttcattttgttgttgttgttgttttccctgccgggaaactgccgcatcctgtgttttcatggcatgatattaaggaacgatgggtaggatgctg

SEQ ID NO: 40067 - DNA, 201 bp, Homo sapiens
cttaacttctttaaacctcagtttcttcatctgtaaaatgcacatcataatatctctattcagagatacaggtggttctattaaacacatcaactctgtgkatataaagtcttaacccattgtggaataaattaagtgctcaattaaatgttagctgctgctattaataacaacaataataatattttcttcacgcatgaa

SEQ ID NO: 40068 - DNA, 201 bp, Homo sapiens
cactcacatatatatttctgtttgcggctcacacagacataaatatatatatatatatacaaacgtacatttctgcttgtagcttgcacatatatatatayacacacacacatacatgtagacacacacatttatacatatacatgtcaacacatacacatacatatttctgcttatggctcaggatacttctttttttgg

SEQ ID NO: 40069 - DNA, 201 bp, Homo sapiens
tacagatacacactcacatatatatttctgtttgcggctcacacagacataaatatatatatatatatacaaacgtacatttctgcttgtagcttgcacayatatatatacacacacacacatacatgtagacacacacatttatacatatacatgtcaacacatacacatacatatttctgcttatggctcaggatactt

SEQ ID NO: 40070 - DNA, 201 bp, Homo sapiens
atacagatacacactcacatatatatttctgtttgcggctcacacagacataaatatatatatatatatacaaacgtacatttctgcttgtagcttgcacmtatatatatacacacacacacatacatgtagacacacacatttatacatatacatgtcaacacatacacatacatatttctgcttatggctcaggatact

SEQ ID NO: 40071 - DNA, 201 bp, Homo sapiens
acaaaaagcagctttcgtttgcttaaaatttttgttctctgcctttatttttcaaaaatattttcactaggtatagaattctaagatgaaagttttatttkttttcagctgtggcttccatcattttcctgagaggtataactatcagtcttgtagctactggtctctaactacttctaaaactatctgcagtttttagca

SEQ ID NO: 40072 - DNA, 201 bp, Homo sapiens
tctggtaataaaaagtcctttgccgtgggttattttgtcaagtgagatagcaggacttaacaggtttgtttgggaaaataaaatttgatagaaaaacggcrtgcttttcccccacagatttcttggtagcatcattcaaaactacagtgagcagtatctttgcaggattttaatatttattcattattataaaggaaggaa

SEQ ID NO: 40073 - DNA, 201 bp, Homo sapiens
tcttgggacaaatgtgtgacaggtgaggaaaacaacataggaaaggagacagaagtgaagagaagatgtggtctcaaatgaagtctggcttcaggtttatycttggggggctctggaataaaaatcacacctcaaacttgacccgcttgaggccagaaggccgggctgtggtaccttcgtgtcggacagtcataggctatc

SEQ ID NO: 40074 - DNA, 201 bp, Homo sapiens
agacagcagacagttcctctccctgctgctggcctcttcatcttctcctggcgtcaccacggccaccgtgatgcctggctcaagtactagttctatgtcartgatggtaccaatggactctaactttagaatgttgttgactgaaggcccctgccccctgccttgctttaggtggaggatctggtcaaggctttgtgaatc

SEQ ID NO: 40075 - DNA, 201 bp, Homo sapiens
tgtttaaatgctcaaacttggtatggaactgcacagactatacggctgctctccactcaagaatacaaattgaacattgactttcctcattttttatccarttttgctttccagagacccagatatggcttcattttttaaatgaaattttgcaggtcattagctcataatgattaaatgattctggttattagcataaaa

SEQ ID NO: 40076 - DNA, 201 bp, Homo sapiens
caagtcaactttttgtgtctgcaggcatgggcctgccctgtacatgaggagacagcagacagttcctctccctgctgctggcctcttcatcttctcctggmgtcaccacggccaccgtgatgcctggctcaagtactagttctatgtcaatgatggtaccaatggactctaactttagaatgttgttgactgaaggcccct

SEQ ID NO: 40077 - DNA, 201 bp, Homo sapiens
cccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccagttttgctttccagagacccagatatggcttcattttttaaatgaaattt

SEQ ID NO: 40078 - DNA, 201 bp, Homo sapiens
agcctctgttctttcttgtttccctttgttaattcctttttcctttcattccttcttatctatccctttcttaccttctttatttcctcgtttatttgggytttttcggttgtgaagatcagtaccttgaaattcagaatagatggcatgaagcacttcagctttgcattcaagtactcatgtgtatgatcaagcatcgtc

SEQ ID NO: 40079 - DNA, 201 bp, Homo sapiens
gaaatacaaaaattagctgggtttggtgacaaacgcatgtaatcccagctgctagggaggctgaggcaggagaatcacttcaacccggaaggcggaggttkcagtgagctgagatccagcctgggtgacagagcaagactccatctcaaagcgaaacaaaacaaatgagggtcctcatcagcgtgcctttgacactgtcct

SEQ ID NO: 40080 - DNA, 201 bp, Homo sapiens
ggaaaagctcattttccagtttttccccctccagctgtaggggatatattttcgttaattcctgtgaccatatggcagcatggttaggatcttgggcttcyaaatcagacagttgtaaacttaaactccaattctgccacttattgtgtcactttggacaagttacttcacctctccaagcctcagtttccctgactataa

SEQ ID NO: 40081 - DNA, 201 bp, Homo sapiens
ccaatgtgcttttcctttttcctgagagcagccctctacatcttccgtggtgtaagttgccttattccagcacgtggcatcgccagtcccagtgcccttgrcagaccatgcagaatgcatccatggaatatgaaaaatgaggcccagtggggcacagtggctcacacctataatgccagcactttgggaggccaaggtggg

SEQ ID NO: 40082 - DNA, 201 bp, Homo sapiens
gtgagccacggttggccagctcccaaacaccatgacatacaacttgcaggaaaagctcattttccagtttttccccctccagctgtaggggatatattttygttaattcctgtgaccatatggcagcatggttaggatcttgggcttctaaatcagacagttgtaaacttaaactccaattctgccacttattgtgtcact

SEQ ID NO: 40083 - DNA, 201 bp, Homo sapiens
tctgcacagtgctgagcttttgtgtttttggtcatcccaatgtgcttttcctttttcctgagagcagccctctacatcttccgtggtgtaagttgccttaytccagcacgtggcatcgccagtcccagtgcccttggcagaccatgcagaatgcatccatggaatatgaaaaatgaggcccagtggggcacagtggctcac

SEQ ID NO: 40084 - DNA, 201 bp, Homo sapiens
cccttatcagagatcaattggccataaatgtaagtatttctttctggactctgaattatatcccattgatctgtatgcctgtccttatgccattgccacaytgttttggttactgtactctgtgtaagttttgaaatttggaattgtgaattctccaactttgttcttcattttcaagattgttttgggtattctgggtcc

SEQ ID NO: 40085 - DNA, 201 bp, Homo sapiens
tctattaaatggtctttgcacccttatcagagatcaattggccataaatgtaagtatttctttctggactctgaattatatcccattgatctgtatgcctrtccttatgccattgccacactgttttggttactgtactctgtgtaagttttgaaatttggaattgtgaattctccaactttgttcttcattttcaagatt

SEQ ID NO: 40086 - DNA, 201 bp, Homo sapiens
tctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattca

SEQ ID NO: 40087 - DNA, 201 bp, Homo sapiens
tgtgaacctctcccttaggagaagaacttttctttggcaaacaccataggaacggagaccttaacaaaagaattaggactctcttgtcctgttttaatctsaaagctgtccctgcgctggtgcggctggcccacttgtgcctttgtgaatttgcagagaagaggctgggcgtggggggacacatgactaatccgccctttc

SEQ ID NO: 40088 - DNA, 201 bp, Homo sapiens
gataggaccttggcatctcgtgcgaagcccctctgcctggagtcctgcctctgtgacacttgcttactgtgtgacctgggtcaactcatacctactgttcstcagttttctcatctgtaaaatggggattccagtggttattatgagaattaaatatgacgatacataaatagcacctggaaaagtgtttaggaaaccttg

SEQ ID NO: 40089 - DNA, 201 bp, Homo sapiens
atgagaattccactcctttgggagtattggcatatgttaaaatacaaatatatctgtatttttctcacttttattagaagagtgcaagtttgttcaaaacmactgctggattatctagtccctgaacagccatttatatttttgttacgcttgtggtttttaaatcatcctcatttccttgatcgcatttgcttctcctgg

SEQ ID NO: 40090 - DNA, 201 bp, Homo sapiens
tatcttttggtggtccaagaggacttgagtgtaccttgtaaatacaggattttgtttttaattagattgattcacagagaaccaaacctaaggaatcacawcattcattcatttgttcatttaataaatttgtaggttgaagcatttaccaagtgctggcaatagaaagaagtcccgggtgtgctttgtcagtttagtcgg

SEQ ID NO: 40091 - DNA, 201 bp, Homo sapiens
cataaccacatctactttgtgtctctatagatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttt

SEQ ID NO: 40092 - DNA, 201 bp, Homo sapiens
accatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgcttttagcatgctttcaaggttcatccatg

SEQ ID NO: 40093 - DNA, 201 bp, Homo sapiens
tctctgttagatacagtgtatctctgttagatacagagcattctgttagatacagagaatctctggtagatacaaagtattctgctattctgatcttcctkttagaagatcagatttacagaagtctacatttgctctcaagggaccttcagtctgtttggagcaatctctttattaatttatttattcagtaaattttat

SEQ ID NO: 40094 - DNA, 201 bp, Homo sapiens
tgtcgggccatttgttttttaacgaattgccctttcatcttatatgcatgactattggatatgtatcgattactaattgattgcttgcctcatgtgctatmatttaattttcaaaatgtcccttagaagttaatttataaagtgtctattactttaagtacctgttcaatcctgtgatcaagaggaaattcacagagaaag

SEQ ID NO: 40095 - DNA, 201 bp, Homo sapiens
agaatgaggtatgtggtactcgtgagcaggattttcaatgcctggctggttgttacttatccatttagtccgagcttcagggaaagaacatgacaccggcstccagcagagcctgctcttggtccactgtttatcctggtgaccttaggcaagtcatttaatttccttgagttttggtgtaagtattgatggagcagacca

SEQ ID NO: 40096 - DNA, 201 bp, Homo sapiens
agcaggattttcaatgcctggctggttgttacttatccatttagtccgagcttcagggaaagaacatgacaccggcctccagcagagcctgctcttggtcyactgtttatcctggtgaccttaggcaagtcatttaatttccttgagttttggtgtaagtattgatggagcagaccatcaataactgttcttatgtctatt

SEQ ID NO: 40097 - DNA, 201 bp, Homo sapiens
tgtgtgtgtgtatgtgtgtgtgcgtgttatatgaagtcttgctagaatgcataaacaaacaaaaaaaatatcatactctcagatcctggatactgtggtcrcctggacttcaaaagccttttgtccgtatgtatttacataatgtattctccatgtttggttttcattaaacccatgagtttaataataaagtgtttggaa

SEQ ID NO: 40098 - DNA, 201 bp, Homo sapiens
gtgttatatgaagtcttgctagaatgcataaacaaacaaaaaaaatatcatactctcagatcctggatactgtggtcgcctggacttcaaaagccttttgyccgtatgtatttacataatgtattctccatgtttggttttcattaaacccatgagtttaataataaagtgtttggaactatgcttttccctaccactttt

SEQ ID NO: 40099 - DNA, 201 bp, Homo sapiens
aaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagttttctagcagttctcttttttaagagcctca

SEQ ID NO: 40100 - DNA, 201 bp, Homo sapiens
taatgaccctctcctggcctcaattaactgaggccaggagagggtcattagcaaactgtcctttgctaaatgggactaatgggaagaatagtgtctgccawataaggtggttgaaggattggatgagactgacatttcatttgcatttagtgaatacttgttgaatgactgaatgaatggttgatgtacagaaacatgaac

SEQ ID NO: 40101 - DNA, 201 bp, Homo sapiens
ttggtgagaaaggaaatttttgctccaataaactgggtagctcagtccaggagagaaatgtactggactcagacttggaggacagagctttgtgaccctcstaggcaatgtaatgaccctctcctggcctcaattaactgaggccaggagagggtcattagcaaactgtcctttgctaaatgggactaatgggaagaatag

SEQ ID NO: 40102 - DNA, 201 bp, Homo sapiens
gagcagaagaactcactgaaaagtcctggcaaggttccacggcacctgtgatgcttccatcacacatatttgctgagtacccgctgttcataggtcagtcrctatgcaaggcactgaggtgacaaagacaagcagaatgacagttaaatgtaacatgggctttgtggtcaattagttctgggttcgttcccaggtcctatc

SEQ ID NO: 40103 - DNA, 201 bp, Homo sapiens
tagccccattttgcaaatgaagaggctgaggctcagaaatttaaaattgcttcatgtcgcacagttcagtgtaaagttgcaatgcaaactaagatgtttcygttgcttataatcttaactataataatcataaaccatgttctgttgctcagaacccttgtacttataatataaaacaatctttttaaccaagattcttcg

SEQ ID NO: 40104 - DNA, 201 bp, Homo sapiens
agaaactatattgccgagaaagagaaatgtaaattccgctggataaattagcgtttgcggttacttctctctttgttgcttaagcagaggagaaacagaartcatagcaaagagagaggtagctgcaaaagctaatttatccaaaagaatttacatttttctctcttggcactatagggggcatgtttactctcctgatgt

SEQ ID NO: 40105 - DNA, 201 bp, Homo sapiens
ttttttgccctctgatcttgtgagttccttaacattggggatcagtggtttttctcttacatgaaatgacaatgacactttatagggtttctgtagagaayaccttagaattagttaatgtgtttcataaagcacatggcgtggtacccagccaagagtaacactctgaagtgctcctccttacctggacattacagcatc

SEQ ID NO: 40106 - DNA, 201 bp, Homo sapiens
gctcgctgcatcctcttcacgagagctgatggtaggactgtagaagagtcacaaaacatcacatgacaacgccagtccctctgataatcctgcaagagccmgcccagttttgctgacagcacagtctgctgtttaattattgtgtgttcaatgacttacctctttttagtttaattaaaattatttctcagattaagagcc

SEQ ID NO: 40107 - DNA, 201 bp, Homo sapiens
agaaaggaatacactttggctttacaaaactgcttattttcaaatttttaaatggggacaaaaacgaatatgctatattatatacttttatttatataatwtttttttcagcaactttttctcttttgaaaatgcaagagcctgaaaaacattgtgaatatacttgtaacattgcaaagctatttcaccagagtaaagata

SEQ ID NO: 40108 - DNA, 201 bp, Homo sapiens
agtgggccccagttctttcaggtttaaggaataagcattttggtctatgaaaaatggggtttgcctaaagtataagattgtcttatatttataaatgcctstgttcattgctgtgggttcactgctttctcttttgggcagccatataaataaaagaaccacctacttggacccaagactggcgtttactgtggatgataa

SEQ ID NO: 40109 - DNA, 201 bp, Homo sapiens
ttatagctacatttacatgaattacataaaagcccaaaaccttctcaagaagccttttttgagatctaaggatacatggcaatagttattgtatgttacarcgtatgttataggcagttctgaaggaaaggattcgatgactatctttttttggcacaaatgtgatccttctggaggccagaagatagattcagtgggccc

SEQ ID NO: 40110 - DNA, 201 bp, Homo sapiens
tacctcttgtagcacctggctgtttcccttttgaaataattgtatgttttcctggataccttattacctggtgacacgtgtttctagttattgacctatgwttttaattataactttgggtggtggtctgaaatgaaatgttaagtttgacgcaaaaataggactagtttgtgtaactgatttgttcagaataacagctta

SEQ ID NO: 40111 - DNA, 201 bp, Homo sapiens
gttcacatcttatcatctagatgttgctgattaaataatataactttctgggttggcatgagtaggtgaacttttaggaaacgcagcctacccttcgaatrcctcttgtagcacctggctgtttcccttttgaaataattgtatgttttcctggataccttattacctggtgacacgtgtttctagttattgacctatgtt

SEQ ID NO: 40112 - DNA, 201 bp, Homo sapiens
gacattagtcctataaccacaaggaaatgagttctgctagcaacctaagggagcttgaaggtgattgaccatccccagtcaagcctctgatgagaccgcasccccactaggcaactagatttcagcatggtaagaccctggatggagaacccagctcagccatgcccagactcctatcctatggaagctttaagataataa

SEQ ID NO: 40113 - DNA, 201 bp, Homo sapiens
tgcgtggtggagctatgtactaactggggggtcttgaggaagcccattagtctccctgagcctcagtttagtagaagtaggaatcgtcattaaggcgcctmatttatgaagttactctgagctctataagagataagcatacagaaaactttggacagtgccttgcacacagtcagtaatcaatgcatattcatcatgatg

SEQ ID NO: 40114 - DNA, 201 bp, Homo sapiens
gatttatactatggatcagcagcctaaaccctgcaaactgggtcccccatctaagagtctgcagtgaaacgcgagccgacttgatgtgtctcagagtgatsattcttgcccttggcggttgatgctagactgttgcagcttcaaatataatgtattttagtgctatacgacagccataagtattggcctgtgtccactggt

SEQ ID NO: 40115 - DNA, 201 bp, Homo sapiens
agaacggatacggttaggaccaacatttaggcaatatgaccgtgtacaggattctaccaccatcgtcaccatcagtgttactgttccctgccatctgcctrtggggtgtctaccatctaaagttcagcactgcactgggcatttttaaattatcattagtatataattatatataataataatttaatttataactatatc

SEQ ID NO: 40116 - DNA, 201 bp, Homo sapiens
attgacccagcagtgttcattttcccataaggtggtgctggatagggataggatgtcgccccttgttcaccccttggcaataatctgtttgattcactccwaatgctgcttctgatctccatctatttcaggggatgaccagtctgaataaaaccaatgagcttaatctacttgtggaatgttatagccggaagggattca

SEQ ID NO: 40117 - DNA, 201 bp, Homo sapiens
tgcttgaacctgggaggcagaggctgcagtgagtcgagatcacaccactgcactccagcctgggcgacagagtgaaactctgtctcggaaaaaaaaaaaaaagagtttaattcatgcagagctggctgtgtgggagaccagagttttattattactcaaataagtctcccccaaaactcagggatagagatttttaaggag

SEQ ID NO: 40118 - DNA, 201 bp, Homo sapiens
atagagaatcttctggagtctaaatactccctagaggtttcccattggccacttggggtacaccccttataaatgaagtggtggcctgcaatcagtcttaytggttgcagaaagcaaccaatcagaggctgaagtgaagttacaaatatcacactcctatgcaaacatctgattggttttggaaagcaaccaatcagaggc

SEQ ID NO: 40119 - DNA, 201 bp, Homo sapiens
aaatatttattttgagagcaagcacgggggtttatgtgatggctccacagagcagtgaaaagactcccgccctactgctcgcaacctcagatgtccctggscactagcccatctgtatgtctttaaaaaaaataaattaaatttttaaaaacatgactttctggccaggcgcagtggctcatgcctataaccctgcactta

SEQ ID NO: 40120 - DNA, 201 bp, Homo sapiens
ggttccacggcacctgtgatgcttccatcacacatatttgctgagtacccgctgttcataggtcagtcgctatgcaaggcactgaggtgacaaagacaagsagaatgacagttaaatgtaacatgggctttgtggtcaattagttctgggttcgttcccaggtcctatcactaactagtacccttatgaacctggacatgt

SEQ ID NO: 40121 - DNA, 201 bp, Homo sapiens
aaccatttcacaaatatttattttgagagcaagcacgggggtttatgtgatggctccacagagcagtgaaaagactcccgccctactgctcgcaacctcaratgtccctgggcactagcccatctgtatgtctttaaaaaaaataaattaaatttttaaaaacatgactttctggccaggcgcagtggctcatgcctataa

SEQ ID NO: 40122 - DNA, 201 bp, Homo sapiens
ccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaag

SEQ ID NO: 40123 - DNA, 201 bp, Homo sapiens
gactcatttaaccatttcacaaatatttattttgagagcaagcacgggggtttatgtgatggctccacagagcagtgaaaagactcccgccctactgctcscaacctcagatgtccctgggcactagcccatctgtatgtctttaaaaaaaataaattaaatttttaaaaacatgactttctggccaggcgcagtggctca

SEQ ID NO: 40124 - DNA, 201 bp, Homo sapiens
ggaaatgaacaggacggaagaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttg

SEQ ID NO: 40125 - DNA, 201 bp, Homo sapiens
ctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagct

SEQ ID NO: 40126 - DNA, 201 bp, Homo sapiens
atgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttgtactgacc

SEQ ID NO: 40127 - DNA, 201 bp, Homo sapiens
ggggtagctctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctat

SEQ ID NO: 40128 - DNA, 201 bp, Homo sapiens
tccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgctcttgcaaaccttgaagtgggccctg

SEQ ID NO: 40129 - DNA, 201 bp, Homo sapiens
cctggataagaacatgctgcgtcagagagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgacca

SEQ ID NO: 40130 - DNA, 201 bp, Homo sapiens
gtaattagatgccctttagatgctcttagttaaagaccatgcaaaaaggatgaaatcttttgatcatgttcttcacaatattagaggtaaaacatgaactsaacgcttttaggaagaaacaactggattgcgttttctattttattgacagaaactagatggggaggccagggtgtgttttattattgcacacatacgtaa

SEQ ID NO: 40131 - DNA, 201 bp, Homo sapiens
caagcgctggaattgctgacctccctgaaagagaagcctgcagctgcggcctctggggtgaattccccccatgggaggacctggtggagttaaaacagackatatccacatcacagagagctggcccattgctcagggcctgggaagtggtagggagggaccttcccagaagagagatgactcaggctggtcccaagcccc

SEQ ID NO: 40132 - DNA, 201 bp, Homo sapiens
cctttctcagcattccacaagttacttcgtccttcctttgttctcctctgcctttgcctcttttttctttttttattttaattttttttttttaattatastttaagttttagggtacatgtgcacgttgtgcaggttagttacatatgtatacatgtgccatgctggtgcgctgcacccactaactcgtcatctagcatt

SEQ ID NO: 40133 - DNA, 201 bp, Homo sapiens
ggcaggccaaggcgggtggatcacctaaggtcaggagttcgagaccagcctgaccaacttggcaaaacccagtgtctactaaaaatacaaaaattagctgrgcatggtgtcacatgcatgtagtcccagctactcaggaggctgaggcaggagaactgctcgaacccaggaggctgaggttatgttgagccaagattgtgc

SEQ ID NO: 40134 - DNA, 201 bp, Homo sapiens
tcggatagattctatctctaaaaactacagattctatctctaaaaacttaagtcaagggattttgaagcagttgtttgatttatgtatgtgaacctctccsttaggagaagaacttttctttggcaaacaccataggaacggagaccttaacaaaagaattaggactctcttgtcctgttttaatctcaaagctgtccctg

SEQ ID NO: 40135 - DNA, 201 bp, Homo sapiens
aatgagcctacacagaatgtcgcatgcagatcaatgagccaaatgttagcaggggactgggcatttgaagatttaaaaaaatgaaaaattgcactgtgacrttgctggttcctattagcaaaataacagacagtgttatcagtcattgactcagaagatagtttcttaccgtttggggaaagtgcttgtctattcctctcc

SEQ ID NO: 40136 - DNA, 201 bp, Homo sapiens
gttattatacttttatgactattcattttgatgtaggccttttaaaatcaattcctccctgttattacaatgctgctttatggtatttgtgatatatcatrtgaatatacttgagggtcatgagaagttcatatgtgtgtgtgtagtgtgggccccagactttcgccacactgctggctaaagtggccatgtttttgtacg

SEQ ID NO: 40137 - DNA, 201 bp, Homo sapiens
aacagagcccccatatgttttaactgctcattggaaactgactaggtcacatactcctcctccttccctgtactggtagtttttcttttattttttttttwaatttcttccattttctttcctttttacagcaaatttgtagttatggtggagcaaagggcagttttcactcctcttccctaaaactgtagtttaactaaa

SEQ ID NO: 40138 - DNA, 201 bp, Homo sapiens
actattattctttaaaaccgttataccatgcatcatggtaacatcttttttactgagagttctgcattagcacacttgttcacccaagtttgtgatagttkataggactgcctggtgtattaagtagaaatgctcaactttgctgtcctatttttttgatcatatccaaaaagtgtcagtgtttgaatatagttttattgc

SEQ ID NO: 40139 - DNA, 201 bp, Homo sapiens
tatatttttaaaataaatttgtaatcatgtatacagtagtccccccttatccgtggtgtttcagtttttttttttttgagtcagagtattactctgttgcscaggctggagtacagtggcgtgatctcagctcactgcaacctttgtctcccagggcctggtgattctcatgtctcagcctcctgagtagctgggattaca

SEQ ID NO: 40140 - DNA, 201 bp, Homo sapiens
tggagatggttgtcttcttttttattccatgaaacaaattgattaatgtgtcgagggagcaaggtggtacttatacctacccagcctgcttgtgtgtgtckcaaggtggagagaggctgtggaaacaatagagagaatagcatggaaggccacgttgcaattaaacaagattgggaaagaagacgggactaaaatcatgcc

SEQ ID NO: 40141 - DNA, 201 bp, Homo sapiens
gttaactggttcctatttctgctggttcgaagaggtccaggacatttaaatagctcttctagaaacaaattcttttccttacaagccctgccaggtcagtkggttcagtaaggaagaaggttttgtattttgacaattccttcatctgttaatttagtcagacgaggaaggaaacgagaaaagttattcctatttcatcca

SEQ ID NO: 40142 - DNA, 201 bp, Homo sapiens
agtaacattataataaaactttgactcatgctcataactcgattttccaaaaagttttcctttacaggagaaaagaacagctgctgtttataggagcatamattgtttttggttattttgaagaacaagttggcatttttgaccgaaattaaacacatgccttttgatcaagcaattccattctgtaccagaaaatacaga

SEQ ID NO: 40143 - DNA, 201 bp, Homo sapiens
actagaggccttttccctagtagtaacattataataaaactttgactcatgctcataactcgattttccaaaaagttttcctttacaggagaaaagaacakctgctgtttataggagcatacattgtttttggttattttgaagaacaagttggcatttttgaccgaaattaaacacatgccttttgatcaagcaattcca

SEQ ID NO: 40144 - DNA, 201 bp, Homo sapiens
tgctagacatgcccttagcgagcagctcatgagagcagattttgcctgtttcttccaaaatctggattcagtgacatcgtgttggtagcttgaaactgacygtggtgagaatatttacaccatggaaattggcaaatgctactaataaggatgattgttttagttttcattttgtaattttcagagttggtttaccaatat

SEQ ID NO: 40145 - DNA, 201 bp, Homo sapiens
tttcaccatgttggtcaggctggtcttgaacttctgacctcgtgatttgcctgcctcagcctcccaaagtgctgagattacaggcgtgagccgccatgccygcccttatttttatatatcttccataacctttctatctctttctttctctttctctgtttctgtgtgtgtctgtgtctgataataaaatacattaaattt

SEQ ID NO: 40146 - DNA, 201 bp, Homo sapiens
tacctcgccctatgtgtcttttcatctctgtccttagtactgtcctttataataaagcagtaagtggtagcaagtgttttcctgagttctgtcatctgctscagcaaattaatcaaacccaaagagggggttatgggaacttccacctgaagcccctcagccagacattctgaagtctctgacttgctattggtgtctggg

SEQ ID NO: 40147 - DNA, 201 bp, Homo sapiens
ggagatccatttggatagtcttgaacacagaactgaccggaactgacttactctttgaaaagatcgctctggctgctgtgttgagtggattggtaagggayaggtggtgaagactgaaacagggtatccagttaggaagctaccacagtgatccaacccccagcttctgttgaggttgaagaacctgcatgcccaacctaa

SEQ ID NO: 40148 - DNA, 201 bp, Homo sapiens
tctcatgggcttgccttattttttcagggcatgctctgtctccatcccttggctctgctttccttacattggtcttcttgggcatccgtcttccattccayagtgtagcaagccagaagctgggggaaacatggtgcgtgcctgtaatctcagctactcgagaggctgaggcaggagaatcacttgaacccaggagatgga

SEQ ID NO: 40149 - DNA, 201 bp, Homo sapiens
ttaaacaattactgtatctgatttttcatttttcattttttttttttctggaagaaagagcagatctggataaagtcagtatacaatgtggtctttggtgmcagacccaagttcaagaccaaggtgtatgcatgggtttgttcaagttgtctacccttattatcccctcagtgaaacatgattaaccatgcttaccttgaa

SEQ ID NO: 40150 - DNA, 201 bp, Homo sapiens
tgctctcccgagccttctctcctctctggaacccatggctaataggggacaggagagagcggaagcagaaagaataagagatatgaaagccagccgggcayagtggctcacgcctgtaatcctagcactttgggaggccgaggcaggcagatcacttgaggtcaggagttcgagaccagcctggccaacatggtgaaaccc

SEQ ID NO: 40151 - DNA, 201 bp, Homo sapiens
tgctgtcctggttttcacactgaaagttccgtatcctaataagcctctcatcctcagcaacggaggacagttgcccactcaaagccttgtgacattctagrgtatcctatttctacatggtgggaatctagaagacggagaaagaatttctcattcccgaaggagcatggattatccttggttgtagtgtttatgtccaca

SEQ ID NO: 40152 - DNA, 201 bp, Homo sapiens
taagactggaatgtgggtgtgtgcactcctcatgttccggtttctgtgatcattcaggcatgcacaggtatcctgatgggtagccaggtcattaggcccaragtcggcagtgtagcatggcaagagaagtcattgcatctccaaactgtgcctaaattgcctgtaatgggttctttgcaacttgcagaaccagatcttacc

SEQ ID NO: 40153 - DNA, 201 bp, Homo sapiens
ggcgggtggatcacctaaggtcaggagttcgagaccagcctgaccaacttggcaaaacccagtgtctactaaaaatacaaaaattagctgggcatggtgtyacatgcatgtagtcccagctactcaggaggctgaggcaggagaactgctcgaacccaggaggctgaggttatgttgagccaagattgtgccactgtactc

SEQ ID NO: 40154 - DNA, 201 bp, Homo sapiens
tgactaagactggaatgtgggtgtgtgcactcctcatgttccggtttctgtgatcattcaggcatgcacaggtatcctgatgggtagccaggtcattaggmccagagtcggcagtgtagcatggcaagagaagtcattgcatctccaaactgtgcctaaattgcctgtaatgggttctttgcaacttgcagaaccagatct

SEQ ID NO: 40155 - DNA, 201 bp, Homo sapiens
atgttgacataacagttctgaagaccaaggtggtggaataggttaggttaggatacgtcggaggagccagtgtgaactgctcctttaagacatgaattagyccattttcatgctgctgataaagacatacccgagactgggcaatttacaaaagaaagaagtttattggacttacagttccatgtggctggggaggcctca

SEQ ID NO: 40156 - DNA, 201 bp, Homo sapiens
ccgtgtcattgtggtctcctcagagtcccatcggtgggtttgaattgcatatttgttcacttatcccctttctcataccagctaatattcccccaaggctstcattctgaaaataattttcattagtcctgcttgagacatgtgggtggactcagcttggctcacttaatttttccaggtcttttttgttcgcctgtgatt

SEQ ID NO: 40157 - DNA, 201 bp, Homo sapiens
agaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaa

SEQ ID NO: 40158 - DNA, 201 bp, Homo sapiens; identical to SEQ ID NO: 8544

SEQ ID NO: 40159 - DNA, 201 bp, Homo sapiens
ccggggccgggcacggtggctcatgctggtaatcccagcactttcggaggcctaggtgggcagatcacaaggtcaggagatggagaccatcctggctaacrtggtgaaaccccgtctctactaaaaatagaaaaagaaattagcctgacatggtggcacatccctgtaatcccagctactcgggaggctgaggcaggagaa

SEQ ID NO: 40160 - DNA, 201 bp, Homo sapiens
ctctactaaaaatacaaaaattagctgggtgtggtggcacgcgcctgtaatcccagttgctggggagactgagacacgagaatcgcttgaatccctgcggkggaggttctagtgagcagaggttgcagattgcaccgctgcactccagcccgggtgacagagtgagactctgtctcagtcagtcaatcagtcaatcaatca

SEQ ID NO: 40161 - DNA, 201 bp, Homo sapiens
aagtttgggaacctctggcttaatcattatttatccacttctctgttgttggatgttagattgcttctagttcatatgtaattttataattttagttgacrtgtcattatggattcttgggcataaacgtttatatgaattttgaatattaggaaataatcttggaagctatattagttttctaaagctattataacaaat

SEQ ID NO: 40162 - DNA, 201 bp, Homo sapiens
tcgcagctggtgggtgtacacactgctgtttaccttggcgaggcctttcaccaagtccatggtaagagaacagcttctggcgccgcaaacaccttgggtcytagagaaacctgcacacttgtgtctccacctttttacctcttgcgggcatgagtctggtctcagtaataacattgtccagcccatcataaagggctcttg

SEQ ID NO: 40163 - DNA, 201 bp, Homo sapiens
taatcccagcactttcggaggcctaggtgggcagatcacaaggtcaggagatggagaccatcctggctaacgtggtgaaaccccgtctctactaaaaatasaaaaagaaattagcctgacatggtggcacatccctgtaatcccagctactcgggaggctgaggcaggagaatggcgtgaacccaggaggcggatcttgca

SEQ ID NO: 40164 - DNA, 201 bp, Homo sapiens
gggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccatggacagaaatagagaaggcaagatgagaa

SEQ ID NO: 40165 - DNA, 201 bp, Homo sapiens
gaataaataggtacataagtgcttgctagcaagcagctgaggcaacctattaaaactcatgccagtggtaaagttaagctgctttctggtaagaatttcasaattccaggacgtctcaaatttctggctggtacaccctgggtaaggtccacaggctggatgggttttggaacatgtcttgattgtactttttcctcttgg

SEQ ID NO: 40166 - DNA, 201 bp, Homo sapiens
tgaggcaacctattaaaactcatgccagtggtaaagttaagctgctttctggtaagaatttcagaattccaggacgtctcaaatttctggctggtacaccytgggtaaggtccacaggctggatgggttttggaacatgtcttgattgtactttttcctcttggtttggaaagcaacgtaccctaggtaaggagagatttc

SEQ ID NO: 40167 - DNA, 201 bp, Homo sapiens
caacctattaaaactcatgccagtggtaaagttaagctgctttctggtaagaatttcagaattccaggacgtctcaaatttctggctggtacaccctgggyaaggtccacaggctggatgggttttggaacatgtcttgattgtactttttcctcttggtttggaaagcaacgtaccctaggtaaggagagatttctgaca

SEQ ID NO: 40168 - DNA, 201 bp, Homo sapiens
gcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagc

SEQ ID NO: 40169 - DNA, 201 bp, Homo sapiens
ggggtggggttggcgagagggtgttgcttttctaatgattcacattgtataaaaagcagacagtaggtctggcactgttggctcatgcctgtaatcccagyactttgggaggccaaggcaggtgaatcatgaggtcaagggttcaagaccagcctggccaacatggtgaaaccccttctctactaaaaatacaaaaaatta

SEQ ID NO: 40170 - DNA, 201 bp, Homo sapiens
taaatgtctctgggtttaatgcaactttactaaggaatgaaagtccgataagaatccatatcttttgaaagaagattttttaaattccttatttttccttyctgcatggtcataaaacacactggggacagcccaccctgagaagtcaccaggcatctgcctgccttcagtagcaatcacccaactgctgtagaccgtaat

SEQ ID NO: 40171 - DNA, 201 bp, Homo sapiens
ttttggaaaccccagcagagccttcatctttaactgtgtgaccttgggccattgaaataacgtttaatcttggttttttcacctgtaaaatgggttgataygagggtcagttcaggcactgtgcgtaaagcacatagcaccgtgtctagtaggtactctctgttccttaactgtcgttccttgattgctcttaagatacga

SEQ ID NO: 40172 - DNA, 201 bp, Homo sapiens
gtgctggccttttcactcaagttctctgatgtaactgcccacagtaatcctgtaaggtatggctaatcatttccattttatagattaggaaaccaaggtcmaaagtggtgaattgatttgaccaaaatcacagacccaggaatttcctcagccaagagcctacagcagctgtgtcttaagactgtgccctttcatccaccc

SEQ ID NO: 40173 - DNA, 201 bp, Homo sapiens
gcggtgggctgggcaggaaaaccataaccacctgcaaatgtcatgtggtttatatcacaccttcacttaacaccctccccctaacaacctctacctggcartcttcatttaactccaaactcaggacctcaatcctctgtttggcctgtgttccacgggacaggcatggggcacagatgtctgttatatataagggacaaa

SEQ ID NO: 40174 - DNA, 201 bp, Homo sapiens
gtgcagtgaggatgaatcaacaagtaaatatcatgagaatttcttagattgaagaaatattactcctatttggtgtcaactctgtgctggccttttcactsaagttctctgatgtaactgcccacagtaatcctgtaaggtatggctaatcatttccattttatagattaggaaaccaaggtccaaagtggtgaattgatt

SEQ ID NO: 40175 - DNA, 201 bp, Homo sapiens
atcaggtcacttggcaaccaagctgatgaggatagcagtttcttttgttcttttaaaacatatataaaattatttttatcaaacatgacagatcaaaagcyttctggaaaggagagatggtaactaatttaggcagtgtcttttgctttcacatggtgtacccagtactattaatatgaatttatcacatggaaacaaact

SEQ ID NO: 40176 - DNA, 201 bp, Homo sapiens
tggattggtgattttgactaagactggaatgtgggtgtgtgcactcctcatgttccggtttctgtgatcattcaggcatgcacaggtatcctgatgggtarccaggtcattaggcccagagtcggcagtgtagcatggcaagagaagtcattgcatctccaaactgtgcctaaattgcctgtaatgggttctttgcaactt

SEQ ID NO: 40177 - DNA, 201 bp, Homo sapiens
gtcagctggtgggtgatctccactgaactcctattcagaggctcagtttctctgcaggacagaaatgagaggcacaaaatttcatagctgtcttgcccctyctgtggtctgtaagaatgggaccaggactcctagttgtgaacccgaaaggatttccattaggatcaggaagtgtgagttggcttagaaaaagtaaagaaa

SEQ ID NO: 40178 - DNA, 201 bp, Homo sapiens
gtgcttgttaactttgcactctatagccaagtgcgatgatcagaaaatacatacattgaagacaccagaaaatagtgtatggattggtgattttgactaaractggaatgtgggtgtgtgcactcctcatgttccggtttctgtgatcattcaggcatgcacaggtatcctgatgggtagccaggtcattaggcccagagt

SEQ ID NO: 40179 - DNA, 201 bp, Homo sapiens
caggaaggcccttccactgaagctacaactggagctaagcagatggataagccaaaaccacctccgttgctgtggccccatctccaccacaaggaagctgragaagggaccccagaaccggaagacaaaaaacttccttcacacactcccttgctaagaggagaagccccaaagaagctggatatggcccttccctcacat

SEQ ID NO: 40180 - DNA, 201 bp, Homo sapiens
taaagtgatagagaggggctggcgaggagagcagtctaatttcaggaaagtcagaaaagtctttaaggaaactgaaggctgagctgccagggccagccacrtgggtactggagagtgggaggcccagtcacggggaatgctggcttagcacaactgaaaaatacaaaggtagaatatgaagtgtaatgacatggtttagat

SEQ ID NO: 40181 - DNA, 201 bp, Homo sapiens
gctgtttaccttggcgaggcctttcaccaagtccatggtaagagaacagcttctggcgccgcaaacaccttgggtcctagagaaacctgcacacttgtgtstccacctttttacctcttgcgggcatgagtctggtctcagtaataacattgtccagcccatcataaagggctcttgaacacattttcatcaactttaggt

SEQ ID NO: 40182 - DNA, 201 bp, Homo sapiens
gcagtctaatttcaggaaagtcagaaaagtctttaaggaaactgaaggctgagctgccagggccagccacatgggtactggagagtgggaggcccagtcasggggaatgctggcttagcacaactgaaaaatacaaaggtagaatatgaagtgtaatgacatggtttagattgaaatctgatgtggatggaaaggttttgt

SEQ ID NO: 40183 - DNA, 201 bp, Homo sapiens
tgggaagtcagaacttggttgcttcatgtcatatttcctatttttaagatttacagatattaacgactccttgggaaaactggacttcagtcgcctctctscaacaaaaaacgactattgggcgatgctggcttataacaggtccaagctctgcaacatcctcttctccaacgagctgcaccgtcgcctctccccacgcgg

SEQ ID NO: 40184 - DNA, 201 bp, Homo sapiens
taatgacatggtttagattgaaatctgatgtggatggaaaggttttgtggcctttcagcccaaggtttgaaaaagaaatggaatttctaaatggagtgggyagccacaggagggctttagacaggaccgtggccccgctggattttctgcccattgacttgggctcgaagtcacgtccatgttgctattacagatgcctcc

SEQ ID NO: 40185 - DNA, 201 bp, Homo sapiens
aaagctgtgtgggaagtcagaacttggttgcttcatgtcatatttcctatttttaagatttacagatattaacgactccttgggaaaactggacttcagtygcctctctccaacaaaaaacgactattgggcgatgctggcttataacaggtccaagctctgcaacatcctcttctccaacgagctgcaccgtcgcctctc

SEQ ID NO: 40186 - DNA, 201 bp, Homo sapiens
atgtggatggaaaggttttgtggcctttcagcccaaggtttgaaaaagaaatggaatttctaaatggagtgggcagccacaggagggctttagacaggacmgtggccccgctggattttctgcccattgacttgggctcgaagtcacgtccatgttgctattacagatgcctcccagaacagtttatataatcgtcaacgt

SEQ ID NO: 40187 - DNA, 201 bp, Homo sapiens
acaggaccgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgc

SEQ ID NO: 40188 - DNA, 201 bp, Homo sapiens
gctagacacagaattgggtgttgggctttaaagatggatgaaaggcagtacctggtctagagaggctgctacctggatggtgtgtttgccatcctcagtartgtgtgtcccttacagatgatgcccagtgactctacaattgctgggatactttttagaattttctttttgtgcattacttttgattcttggttctttctt

SEQ ID NO: 40189 - DNA, 201 bp, Homo sapiens
ttaaagatggatgaaaggcagtacctggtctagagaggctgctacctggatggtgtgtttgccatcctcagtagtgtgtgtcccttacagatgatgcccartgactctacaattgctgggatactttttagaattttctttttgtgcattacttttgattcttggttctttctttggcattagctcaccagtggcaaatat

SEQ ID NO: 40190 - DNA, 201 bp, Homo sapiens
gacataggtctggcgatctttttggcatagacgtgtggacgttgtttttgacatttgtacatgcttttgctcaagttgaaggcccaagtttacccaattcractgcccccacccagatagaatattcatggttagaccataaactacataactggaaattttaaatctatttttatatgcatacaaaaactgcaggcctga

SEQ ID NO: 40191 - DNA, 201 bp, Homo sapiens
ataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagat

SEQ ID NO: 40192 - DNA, 201 bp, Homo sapiens
gcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtaga

SEQ ID NO: 40193 - DNA, 201 bp, Homo sapiens
gccactgcactccagcctggatgatagagcgagaccatgtctcaaaataatgataataattgtagtagtagtagtggtggtggtggtggtggtagtagtastagtgaatgccctgactttggggtttgcagtaagctaggattaagtgcttcacagtgaggcacagtggggagctactctgaggatgaattgcctagtaaa

SEQ ID NO: 40194 - DNA, 201 bp, Homo sapiens
tggaagccccagtaatatcatttaattcgaaagcttttttctatgatgaattattcaggcagtgtttaccaaaattgtcattgatcagtacagacccagasagcatgtacaacagcgcctgtgctgggcctgctaggagtcgatattttctggctcaaagaagttccaaaagaattcaaagccagtgtgtctctttctctg

SEQ ID NO: 40195 - DNA, 201 bp, Homo sapiens
tcctcttacagttttggttctttccatgagaaagtatttttaatagcaaagtaatgaacaagaaagtattaataagacccaaataataatataaactactmctttactaatggtcattatgtgccatgccctgctctaaacacttgccatgtagtcactaatttaatcctcacaagaattctgtaatgtagtgtagtttcc

SEQ ID NO: 40196 - DNA, 201 bp, Homo sapiens
gtttctcataacatttgtgtgtgtgtgggtgggtgggtgtgtgtgaaaggtaggatcacctctctgtgcctcagtctccccatcatccttcggtggtagawcaatgctatctgatgaggccttttttgggatcacccactccaacatgcatgtcctttctctgtcccctcctggtgcctgtattagtctgttctcacattg

SEQ ID NO: 40197 - DNA, 201 bp, Homo sapiens
tatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatg

SEQ ID NO: 40198 - DNA, 201 bp, Homo sapiens
acacttacatttaaatacaggcctttcccatttcacagtgtttctagctcccctttccaatacatctctctctctctttctctctctctctctctctctcwcacacacacacacacacacacacacacacagccaaatcagacaccaacataaactgtagagttaacattctttttccaccctcacactttttttagctcc

SEQ ID NO: 40199 - DNA, 201 bp, Homo sapiens
cctcccgagtagctgggactacaggccaacgccacggcacctggctaatttttgtatttttagtagagccggggtttcaccatgttggccagggtggtctygaactcctgacctcaaatgattccctgcctccacctcccaaagtgctgggattataggtgtgggccactgtgcccggccaggaagatggtcatgttttac

SEQ ID NO: 40200 - DNA, 201 bp, Homo sapiens
tctttggagaagaggcccacgttcttttcagattctgatttctccgtgatataaatagttttttaggtgatcacttgtttttaatgtacctacctatctawacctttctctctctctctctctctctgtgtgtatgtgtgtgtgtgtataaaattacatatccagtatgaaacctaaaaataagattttggggcctgtgaa

SEQ ID NO: 40201 - DNA, 201 bp, Homo sapiens
gagcaatgattccagaagtttataataattggaaagtgtattagtcgattctcacactgctataaagacattcctgagactgggcaatttataaagaaggraggtttagttggctcgtggttctgcagactgtataggcttctgcctctcgggaggcctcaggaaacttacagttatggcagaaggtgaaggggaagcagg

SEQ ID NO: 40202 - DNA, 201 bp, Homo sapiens
ggccttcctgaaatgtgttgtcaggcttgctcctgtgtgatggctggcactggttttatgctttccaattattctttgcacatcgttatttattattactrttattattatttgacatggagtcttgatctgttaccaggctgcagtgcagtggcatgatctcggctcaccacaacttcagactcccagggttaagcgatt

SEQ ID NO: 40203 - DNA, 201 bp, Homo sapiens
gctgatctgcatagcacttcgcaatgaagctgtgctctagaaacataccacgatctactggactttcttaaataaggtggttgttcaggaaattcctccarttaattttactttaattccccctacaagaatgccgagacacctctgcctattttctctttctgtgtttgttgtttcttttgtttttgttttcgagactga

SEQ ID NO: 40204 - DNA, 201 bp, Homo sapiens
aggatagtttcccttcctggaagattgagatgaaataaagctttaggagttggtatcgcacgcaggcattaaatggattgtgaagagggactttgttcccsctcagtcttgtctctgcctccgtaaaggagtaagttaaaaaagaaagtttctttttttaaaaaaaagccttactgctcaataaatccctgtggaaaaaaa

SEQ ID NO: 40205 - DNA, 201 bp, Homo sapiens
tgaaggacgctattttaatggggtgatttttttcttctcactacattcttgctcactccccactttttatgtccggtggccataggctggtgagaacttgrttttgaacagttgaaggtctgctgttagggacgtgctaatctagggaattgtactgaactcgtgggagcatgttagtatcagatgtgtgccttgtccgtc

SEQ ID NO: 40206 - DNA, 201 bp, Homo sapiens
gtcctccctccttggcctcccaatctgctgagattacaggaccctgctgatgtcttaatcttagccccttcagatcccagttggtcttctgactccagagstataaaagaataaatgtgtgttatttcaagccgtgaatttcttattaatgtgtcacatagcaatggaaaaataaacgttctatgccatttttatcacatg

SEQ ID NO: 40207 - DNA, 201 bp, Homo sapiens
tagaaacttggacagaggaaaatgaaaatgttctattaattccactagcatgagataatcactcttaatattttgttgcatgttcttttctttcttctgartgatagcatttttttcaacaaattgggctcgtaatatataggcacatagatatataattaaaaaaacaagaatttctcatgtcattaaacattgcttgaa

SEQ ID NO: 40208 - DNA, 201 bp, Homo sapiens
aggctggtctcaaactcctgagttcaagtgatctgccttgcttggcttcccaaagtgctgcgattacaggcatctgccaccgtgcccagctatagagcttyatttatttatttatttatttatttatttatttatttatgagacaaggtctcactctgtctcccaggctggagtgtagtggcatgacctcggcttactgca

SEQ ID NO: 40209 - DNA, 201 bp, Homo sapiens
accctctgattcaggctcagcaggagcgggagaggatgcataggactacatgttttctgggccaggactggaagcagcatatctcagatccaacctctttmccttggcaaaaattcaggatgtgcaggacgaggaggaaaatgggagtagtgactatttagccagtctttgccacatcccggttcatatctcactccgtca

SEQ ID NO: 40210 - DNA, 201 bp, Homo sapiens
aaggagaagaaaatgaagaaaaatttagaaacttggacagaggaaaatgaaaatgttctattaattccactagcatgagataatcactcttaatattttgktgcatgttcttttctttcttctgagtgatagcatttttttcaacaaattgggctcgtaatatataggcacatagatatataattaaaaaaacaagaattt

SEQ ID NO: 40211 - DNA, 201 bp, Homo sapiens
ttcttgttctcgtatcactcagactaagcagttgatgtaacagataacccccaaatttcagtgatttcacatttaatctgtaaaaaatgaggatttgtttrtagccccaaagacagtctagtttggattatttgaggacctagacttcacctgcacagtggtttcaccatccatccccccatggcctccatggtaccctct

SEQ ID NO: 40212 - DNA, 201 bp, Homo sapiens
ctcactaataggtgggaattgaacaatgagaacacttggacacaggaaggggaacatcacacaccggggcctgtcgtggggtggggggaggggagaaggawagcattaggagatatatctaatgtaaatgacgagttaatgggtgcagcacaccgacatggcacatgtatacttatgtaacaaagctgcacattgtgcaca

SEQ ID NO: 40213 - DNA, 201 bp, Homo sapiens
aaaaccaaacactgcatgttctcactaataggtgggaattgaacaatgagaacacttggacacaggaaggggaacatcacacaccggggcctgtcgtgggstggggggaggggagaaggatagcattaggagatatatctaatgtaaatgacgagttaatgggtgcagcacaccgacatggcacatgtatacttatgtaac

SEQ ID NO: 40214 - DNA, 201 bp, Homo sapiens
cctgtagataatacagtcccattctctggggaaacagatacctccgccagggtcctgatctgaatatgatttggggtgatggaacagaaacacccgaggastgtcgttggggaacaggaaacctgtctgtagtcctggctctgtctccaattggctacgagggcttgtgtgtactctagttctctttccgtgacactgcat

SEQ ID NO: 40215 - DNA, 201 bp, Homo sapiens
tgggaggccaaggcgggtgcatcacttgagcccaggagtttgagaccagcctgagcaacatggtgaaaccccatctctacaaagaatacaaacattagacrcttttcaaaagaagacatttatgcagccaacagacacatgaaaaaatgctcatcatcactggccctcagagacatgcaaatcaaaaccacaatgagatac

SEQ ID NO: 40216 - DNA, 201 bp, Homo sapiens
tccaggaggtcaaggctgcagtgaactgtgatcacgccactgcactgcagcctgggcaacagtgcgaaaccctgtatcaaaaaaaaaaaaaaaaaaaaaargaaacacaacttaccaaaccaagaaacttacagagaacatgattagaagctagcatctgtttttaccctaccctcttcccctatgacccaccaccacgca

SEQ ID NO: 40217 - DNA, 201 bp, Homo sapiens
aggcatttttctgttgactgtgcatgaagccacatagtaataaacagtttccatatccaagcagctaaggcttgtgccttgcaagttaagtggaacatcasgatctatatctcagttttccttatgtttccccagttggcacatcatggccaacaagagagtagggatcattaaggagtttattttcatctttattttatc

SEQ ID NO: 40218 - DNA, 201 bp, Homo sapiens
ctcgcacctgtaatcccagtgctttgggaggccaaggtgggagaattacttgaggccaggagtttggggctagccgaggcaacacatagagacaccgtctstcaaaaaaatttaaagaaacttagccggggccgggcacggtggctcatgctggtaatcccagcactttcggaggcctaggtgggcagatcacaaggtcag

SEQ ID NO: 40219 - DNA, 201 bp, Homo sapiens
ctttttctgactagctgattctgctgctgctggatttattcattcttctccctcacaattttggctcgcacatgcttcctttttagctcatgaccgtgcarttcaactcaacctcatggcatctttttatcagctgtccctgctgcaacaggcttagagttggtttcccaattccctagcgcagaaatccactggcatgag

SEQ ID NO: 40220 - DNA, 201 bp, Homo sapiens
atttgttatttttctcttcccccccttagctgtatccctgcatttattacagcgcaggtgcatcttgcttttgagtgctaactgagatgaaaggagtgagraaacgctctcttcttcttgcaggggagggctggcaaattcagtgaatgcagagtcggctgggagcctttcggctggaaagctcttcctctgatgagctgt

SEQ ID NO: 40221 - DNA, 201 bp, Homo sapiens
aaagtcaagatgttgacataacagttctgaagaccaaggtggtggaataggttaggttaggatacgtcggaggagccagtgtgaactgctcctttaagacrtgaattagcccattttcatgctgctgataaagacatacccgagactgggcaatttacaaaagaaagaagtttattggacttacagttccatgtggctggg

SEQ ID NO: 40222 - DNA, 201 bp, Homo sapiens
ggctgcatagtattccatggtgtatatgtgccagccatcccgttactgggtgtatacccaaaggactataaatctttctgctataaagacacatgcacacrtatgtttattgcggcattattcacaatagcaaagacttggaaccaacccaaatgtccaacagtggtagactggattaagaaaatgtggcctttgcctctt

SEQ ID NO: 40223 - DNA, 201 bp, Homo sapiens
ggcgttctctttttctgactagctgattctgctgctgctggatttattcattcttctccctcacaattttggctcgcacatgcttcctttttagctcatgrccgtgcaattcaactcaacctcatggcatctttttatcagctgtccctgctgcaacaggcttagagttggtttcccaattccctagcgcagaaatccact

SEQ ID NO: 40224 - DNA, 201 bp, Homo sapiens
gtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaaaatat

SEQ ID NO: 40225 - DNA, 201 bp, Homo sapiens
aggagactctttgaacacttttttaaaaggcaagatgttggcctggcgtggtggctcacgcctgtaatcccagcactttggcaggccaaggcgggtggatsacctaaggtcaggagttcgagaccagcctgaccaacttggcaaaacccagtgtctactaaaaatacaaaaattagctgggcatggtgtcacatgcatgta

SEQ ID NO: 40226 - DNA, 201 bp, Homo sapiens
aatcataatgtctcaaattacttactcaataaaatgtgggtttgtctattattagtgattattagggttataatgcagcatggaaatttggagcaaattawctatacatgcaagctgttgggctcaagtgcagttaatcatacgcatacagtgccagtgggcagaaggttttgcaagaatagcttcaggaagactttgtgg

SEQ ID NO: 40227 - DNA, 201 bp, Homo sapiens
taattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgcc

SEQ ID NO: 40228 - DNA, 201 bp, Homo sapiens
caaatcgaaagcatcagttgctacccctgagcaccatctcccataggagactctttgaacacttttttaaaaggcaagatgttggcctggcgtggtggctsacgcctgtaatcccagcactttggcaggccaaggcgggtggatcacctaaggtcaggagttcgagaccagcctgaccaacttggcaaaacccagtgtcta

SEQ ID NO: 40229 - DNA, 201 bp, Homo sapiens
ctcaaaaaaaaaaaaaaagccagattctccacctaccagtggtggggccccttgggtaacttgttttcactccctcagaacctcagtttcctttcctatayaacgcaagccataaggttaacccctcctcgtggtgatgttaagatgaaacaggaaggtgaggggcttaacacatttccgtgttcccataagctttcagga

SEQ ID NO: 40230 - DNA, 201 bp, Homo sapiens
taacacctgcctccgtggtttgtcaggacatttagaaatgcagacttgctcaagacctggatctcaggtggtaggttggtccacagacagtggcaccactmgctattatttatttgttgtcactgtttgggacccctgttgctgtctcaccaaagaacttcttgtctcccttttagaagtttccagagcgtcttcctgatg

SEQ ID NO: 40231 - DNA, 201 bp, Homo sapiens
tcactagtaaaatttggccagacacggtggctcatgcctataatcctagcacgttgggaggctgaggtgggtggagcacctgaggtgaggagttcgagacyagcctggtcaacatggtgaaaccccatctgtactgtaaatacaaaaaattagctgggcatggtggcaggcacttgtaatcccagctacttgggaggctga

SEQ ID NO: 40232 - DNA, 201 bp, Homo sapiens
ataggaaggttatcctgggtgattagcatggatcagagttctcacaggagcccttcaaagcagaaggggaaggtggacaagagaatcggagagatgtggcrgagggtaggcagagagattgcaagcagggaaggatttcacgtactgccactggctttgaagatggagggggcacatggctagaaatatgggcggccctca

SEQ ID NO: 40233 - DNA, 201 bp, Homo sapiens
agcacaacacatcccatccttctggataatctcttctaccctccctttccagataaaagttgactctcataattgtaactctcccctactttatcagcatstacatctttcagcctctaccacattgaattggaattatatgtctgttttatgtaccatgctgtgaactccttgaagataggagctgtcttatcttcaagg

SEQ ID NO: 40234 - DNA, 201 bp, Homo sapiens
aaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccgttgtagattctgacatg

SEQ ID NO: 40235 - DNA, 201 bp, Homo sapiens
atatactgcacatgtttttgtttttgtattttggttcaaaaagagagtatgatctcacttttcccttcttgataggttgtagattccatgtctaatccatscttttccaatattccctcctaatctttcagttgaattatggtctttagctcaaatgcatgacatgatgtgtgtgcctttggagtggggcggtattagtca

SEQ ID NO: 40236 - DNA, 201 bp, Homo sapiens
ttaacaggtttatttcttcatcagatattaattccagagggtttcacccattataaaatggacataaagcctggggtggtgatggtgctgcctctgtaacyaggctcagctgtgtgtcttcgtgagcctccttgtggaccctcaaatgtgggaaggagataggggcaggaggaattggggaaataggaaccttagaaaccc

SEQ ID NO: 40237 - DNA, 201 bp, Homo sapiens
tctgttaaacataagctttcaaggtgagttgtgcagaggcaagtctgcttgtttcatcaagctgacgtttatacttctgagtaagtagggggatccggagmgtcttcttgtcactcaaacagtttccgtacgtcagtttcacacctctgttctgcatgtctctgttgggaaggatgctgatgtctgggatttgaaatagag

SEQ ID NO: 40238 - DNA, 201 bp, Homo sapiens
gaatggtgggtggtaggtgggtacatagatggatgtatggatgggtgggttggtgggtgcatggatgggtgagtaaggggggataaatgaaaggcttgttyttctgaagggactctttacaaagagtctttgatcttccagcttcacgtgcaagagaatccccaaggtgagcttgttaaaataagcatattctgggtatca

SEQ ID NO: 40239 - DNA, 201 bp, Homo sapiens
tcctctctctcaaggaaataagatattcatttgcaagtaaataatgcagcagtcttggatttgtatcagatcaactttgaatgaaagcctgcctttctgcstttatttttgcttatctctcctgcttctgcttcctgttttgttaaataagggcaatgacggcaactattttaaattgctataaagttttagctagacagc

SEQ ID NO: 40240 - DNA, 201 bp, Homo sapiens
tggctaatcatttccattttatagattaggaaaccaaggtccaaagtggtgaattgatttgaccaaaatcacagacccaggaatttcctcagccaagagcmtacagcagctgtgtcttaagactgtgccctttcatccaccctcttggtactcaaagcttggtccatgaaccagcagcttcagcatctgctgagagcttgc

SEQ ID NO: 40241 - DNA, 201 bp, Homo sapiens
taactgtctcttgcgatcccctcctgcacaactgtggcgttctctttttctgactagctgattctgctgctgctggatttattcattcttctccctcacarttttggctcgcacatgcttcctttttagctcatgaccgtgcaattcaactcaacctcatggcatctttttatcagctgtccctgctgcaacaggcttaga

SEQ ID NO: 40242 - DNA, 201 bp, Homo sapiens
aagactccgtctcaaaaaaaaaaaaaaaaaaaaaaaaaaaagtgccatgtatattttgattacaaaaaatttcatgcggtgttactttctttttattggtrgagggtctttatgttttatttttttgagacagaatctgctccatcactcaggctggagggcagtggcaggatcgtagctcactgtaacctcgaattccta

SEQ ID NO: 40243 - DNA, 201 bp, Homo sapiens
tgatttttttttttgtatttaagttttctagcagttctcttttttaagagcctcaagtgtccaataaaaagcaaatacttgaattttcagtttctatatastgcatattttttctcctgcttgccttatttttataacagtgatttataaagacattactaaagaataggaaagaaggattttgaagaggaactgctatat

SEQ ID NO: 40244 - DNA, 201 bp, Homo sapiens
ttttggctgaagatgatcactttagctgaaaccagttcaggttcaaactcagacattggtgctattttcatatatctgaaatgttctgaaaagattactgrcgatcaacatgctgaactgacatttcacagatatgcagatttattcatctctgttcaaggtatgccttttccaatcataatagccatgtagaggacatta

SEQ ID NO: 40245 - DNA, 201 bp, Homo sapiens
ctgtgtgacaattctggatttccttagctgtcctctgcctccatctccctttctctgtaagtggaagtggtattcattgatcacacactacatgccggacwccaagctattacattttttgaatatgtttcttctttgcctcttgaggactaaccagccgggtttagattatttcctccccgtgtcgctttcctgccccca

SEQ ID NO: 40246 - DNA, 201 bp, Homo sapiens
tggctgacagagggagactctatctcaaaaaaaaataataaaaataataaaaaaaaaattacatgaaaaatagagacaaagtctcgctttgttgcctaggstggtcttgaactcctgggttcacgtgatcctcctgcctcggcttcccaaagtgctgggattacaggcacgagctgccacgcctcacctcttgttttcaat

SEQ ID NO: 40247 - DNA, 201 bp, Homo sapiens
ctttaaatctaaattggagagaaggaaggtaattaaggcataattatcagacttaatcaagcacttatttattgagcttacttggtgcctgggcttgtatsttttgtttctgatttttagtttcgtttcattgctccagcgtgggggaatttgcctgtgtatccttgaataaatgtctttctttggaaggcagattaagta

SEQ ID NO: 40248 - DNA, 201 bp, Homo sapiens
gagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaa

SEQ ID NO: 40249 - DNA, 201 bp, Homo sapiens
cagggctctgcccattagaatctctagggacagaccgaggtttgagagttcctgctcctgatctcaggggaatcctgaattacaggtgttaacctgattakccccagcccagctcttcgttaattacctgaagtgaatgggacagtttccaatactcagcacaaaggcgtgcgcagtgactctgtggcgtactatctattt

SEQ ID NO: 40250 - DNA, 201 bp, Homo sapiens
gtttcagctacctgggaggctaaagtgggaggatatcctgagcccaggaggtggagattgcagtgagccatgctcgtgccattgcatttcagcgtgggtgwcagtgagaccctatctcaaaaaaaaaaaaaaaagttcctaagaaaataaagcctggcccatgcaatttgaatgtaactgtctataatttctcttggttac

SEQ ID NO: 40251 - DNA, 201 bp, Homo sapiens
gacattgtttgataaaacagacccagtcactggtgtcagggagtttatataaaagtatacacgtatctgtgcaaatgtgtgcatttaaggcccgccgagcmtgagctgatatgcatgtcttaactttgctgtttctctaaggggatggaaggattggctaccctgagctttctagacttgttattttttttttttttaaga

SEQ ID NO: 40252 - DNA, 201 bp, Homo sapiens
gagaccagcctgggtaacatggcaaaaccttacctctcaaaaatttacaagcttagccaggcatggtggtgcccacttgtggtttcagctacctgggaggytaaagtgggaggatatcctgagcccaggaggtggagattgcagtgagccatgctcgtgccattgcatttcagcgtgggtgacagtgagaccctatctcaa

SEQ ID NO: 40253 - DNA, 201 bp, Homo sapiens
ttttcttttttgagacagggtctcgctgtgttgcccatgctggagtgcagtggtgcgatcacagctttctgcagcattgaccttgtgggctcaagcaatcstcctgcctcagcctcccaagtagcttagaaccacaggcatataccaccatacctggacatgtttttaactttaatttttatttttgtagagatgaggtct

SEQ ID NO: 40254 - DNA, 201 bp, Homo sapiens
tgaggaaaataacccctcaactgcccggatgataaacacagagttctaaaatggcaacaaagggagatccacccttctcagttattgtttgaaaggacagytctcaggcaaaatatgtccacgaagttccatggaataattaccttccttggtgttaaaaaatgccctcacatttcaaacatgtcctgctttaagttccca

SEQ ID NO: 40255 - DNA, 201 bp, Homo sapiens
acacatcttgtctattatgccagctgcaactcaaatcaaaggcactgttgctttggtacccgcatttaaggagggaataccccaaaaaacttaaacttgtstggctttgcaatggtggtggagtcccaagatgacacagtaggcaagatttgattactttggttatgcaaatttcccctagatcttctattaatgacagta

SEQ ID NO: 40256 - DNA, 201 bp, Homo sapiens
aaagagagtatgatctcacttttcccttcttgataggttgtagattccatgtctaatccatgcttttccaatattccctcctaatctttcagttgaattayggtctttagctcaaatgcatgacatgatgtgtgtgcctttggagtggggcggtattagtcagtcgatggttatttccttgaggagaaaggaaaggagaag

SEQ ID NO: 40257 - DNA, 201 bp, Homo sapiens
gagtaaccattaataccttgaataagtttataatctggtcattctgtagagcttcctatatgatgtcttctgtttaagtatttctgtaataccttatagayatctcttttagactactagtgattgttggtgtcaacatatgtgtgaaaatgcatatatcctttattaggctctagcacacagtgtgctctcaatgtttgt

SEQ ID NO: 40258 - DNA, 201 bp, Homo sapiens
gttagtgcatattcttggctcaagcaggataagacactagtaaccatgaacctgtatatcaaaaagcgtgactagagtttcatagttaaacatgtgctgawatccacagtggacaccagagagggtcatggaatctgggaatggatgacttgtcccatgatgataatatctgtgttcctacggctgggcccggtggctcac

SEQ ID NO: 40259 - DNA, 201 bp, Homo sapiens
ctttcagttgaattatggtctttagctcaaatgcatgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaagggggttttttgccttgtcagc

SEQ ID NO: 40260 - DNA, 201 bp, Homo sapiens
tgtatttttagtagagacggggtttctccatgttggtcaggctggtctcaaactgccaacctcaggtgatctgcgtaactcggcctcccaaagcactgggrttacaggcttgagccactgtgcccggccatctttctttttcttcctctccttctaccttgcccaccatggcttaatttcaccagaatatcatcattatca

SEQ ID NO: 40261 - DNA, 201 bp, Homo sapiens
tgaaataatgactagttaattactataaattctaagtgctccatctctgacaattaaaaattgtcttacagctttttatttatttatttattttttttagwtctttccaaattatattaagtgcagcatctggggaaagaagaatgggaatggaaggagtgtgtttaaaatgtgggtggttttgtcaattcctattgggaa

SEQ ID NO: 40262 - DNA, 201 bp, Homo sapiens
ccttagcagacatcatttctctgtttaatctgtctacttgctaattgtctcactgccctccccctccccactggagagtgaatgaaggcttaaggttttgyctgccttggtctctcctgggtcctgagtaccagtggccttacgtggcatttggtagattacatgcttaatgaaaagtgagtgaatgggctgggtgtggtg

SEQ ID NO: 40263 - DNA, 201 bp, Homo sapiens
gtaggacaatgagaagaggccagatgaggacagaatttttattttccattgccagtaacaaacacagccctaacttgcttagaccaaagatggggattgaytggcaactgggaagcctaagggtggatctggcgtggctggatctaagtgattaaatggcgcggtcataattctatttctctgcatctctcagctgtactt

SEQ ID NO: 40264 - DNA, 201 bp, Homo sapiens
cgagtagctgggattgcagggatgtgccaccatgccaggctaattttgtatttttagtagagacggggtttctccatgttggtcaggctggtctcaaactsccaacctcaggtgatctgcgtaactcggcctcccaaagcactgggattacaggcttgagccactgtgcccggccatctttctttttcttcctctccttct

SEQ ID NO: 40265 - DNA, 201 bp, Homo sapiens
attcttgcaaatgtttttggtttctctgtctactcattacgtacactctgccagaggttgaaaactcaatgttgagatcacatacatcctgaaaacactgkttaaataaaattttggcctgcatcctgtttttgaaaacttgcaatggcttgccaacgttttcaagttgagaagtttcacaaaaaaaattcggatttccag

SEQ ID NO: 40266 - DNA, 201 bp, Homo sapiens
aatttttattttccattgccagtaacaaacacagccctaacttgcttagaccaaagatggggattgattggcaactgggaagcctaagggtggatctggcrtggctggatctaagtgattaaatggcgcggtcataattctatttctctgcatctctcagctgtacttccatctctgtaaacttcatttgcagacatggcc

SEQ ID NO: 40267 - DNA, 201 bp, Homo sapiens
gctccatcaatacccatcccaggagacagtggcagtcttgatgtcaatcttgttttaggatcattgccagtggaattcaggactgcggttctacccggtaycggggaaccaggtgagggggttaagaggcctgggcccatggaaggggtgagagagagccacatacttacagttgtgaagggggccagccaggatggtggc

SEQ ID NO: 40268 - DNA, 201 bp, Homo sapiens
atccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagcc

SEQ ID NO: 40269 - DNA, 201 bp, Homo sapiens
ctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagag

SEQ ID NO: 40270 - DNA, 201 bp, Homo sapiens
tattgaattttggcccacaggaaaaggaaactttgctgttagggtcagctggaggagagactgcaggggtcagagatcagggccatatgctagagctgcartgtgggtgctcaaatgatgttcagtgcatcttcacagatggacctccacatgtccctcatgccctaaaatagatattctccacagctgcacatacaacaa

SEQ ID NO: 40271 - DNA, 201 bp, Homo sapiens
tttgcttttaaatgcccgtgttgatttcttaatattttcaacttcctcttctgaagccagttccccccgaccatcagtcatgagtccgttcttttaacctygttcaggtggcgtggggcggtgtgtttggtggggagtgatgggtgcttgcctggaagtgcgagcaattgatcagctgatgaggggtatttattatctgtc

SEQ ID NO: 40272 - DNA, 201 bp, Homo sapiens
aacttcctcttctgaagccagttccccccgaccatcagtcatgagtccgttcttttaaccttgttcaggtggcgtggggcggtgtgtttggtggggagtgmtgggtgcttgcctggaagtgcgagcaattgatcagctgatgaggggtatttattatctgtccctgactcccgagagaggaaataaatccttggaccccag

SEQ ID NO: 40273 - DNA, 201 bp, Homo sapiens
caagaatttatcccttctgttgatgcaattaaagctaatggatctcatatatatatatatatatatatatatatatatatatatatatatatatatatatwtatataaatatattttatatttaaaaatatttatattttatatatttttatatatttatgcaagtatatatctaaatatataaaatatatataaatatat

SEQ ID NO: 40274 - DNA, 201 bp, Homo sapiens
cttggcagcctactctcctctctcgaagctccatgcccaccttgctgttgcaccccccaccccaaggaaagccttcccacctttggaagctgcattaattmttccaggccacaagggggccgttgagttactggttcactgcactggctggcaggaaagagttttaatgcaggctccaaaggtgcttaatttcctgtggtc

SEQ ID NO: 40275 - DNA, 201 bp, Homo sapiens
tttaggaattccattcacagtaaattttatgcgtggtgaaaggttatggaatgggtttccatgccatgtctccccctgtcccacaaatctcagctggcctkcaaaggttccactgtggatttttgccagccagccacgctgatgtagacagaatatttcggatttatattattgcttacttggcacatcttccattggaaa

SEQ ID NO: 40276 - DNA, 201 bp, Homo sapiens
gcccaggctggagtgcaatggcgcaatgttggtccacctcaacctctgcctcttgggttcaagtgattctcctgcctcagccttgcgagtagctgggattrcagggatgtgccaccatgccaggctaattttgtatttttagtagagacggggtttctccatgttggtcaggctggtctcaaactgccaacctcaggtgat

SEQ ID NO: 40277 - DNA, 201 bp, Homo sapiens
gacaagtaccagatgtgaagcttctattgtcctctacccatgacatcaggacagaatacttttctactatctatgtgtggcagtatgcatggaatattgtsagacagagaaactcacctgagcctctgtgttcagagtatttattgggtcttcgttgcgtaggtgtgattgggtgattgcccacatatttgatctcagcct

SEQ ID NO: 40278 - DNA, 201 bp, Homo sapiens
cttgattcatgtcttggaaacactcctttgtctttcagagaaagtaaagagtgatggagacagagagagaaagtgtgacctactttttattatcagcaccrtttcatctgcaaaacacgacttttctcttcttgttacgctgagcatgaaaataaaatgttttccaaaagacctggctttggctgttgtgaggaaggccag

SEQ ID NO: 40279 - DNA, 201 bp, Homo sapiens
caggctgcaaaatgcttgttactattttgtgtattcctggcaggatttgtattcttagttttattactaatgataataacagttaatgttgaaatcagctycatcctgaaagcactgcatccattatcttattctagtctcaggccctggaggaattttctctcactatacccatttcagaaattccagaattaatgctcg

SEQ ID NO: 40280 - DNA, 201 bp, Homo sapiens
cagtgtttacagaccccaaagcttgctgtcccctgggcaggtgcatgagggggtcccaggcaatcaggctcttctcaaacctgaattatacccggcctcarggtataggggtcaggcagctgtttgacaggattcttgcaaatgtttttggtttctctgtctactcattacgtacactctgccagaggttgaaaactcaat

SEQ ID NO: 40281 - DNA, 201 bp, Homo sapiens
ttagctgccagagagcagggacctcatctgtcctgtccactcatgtcttcagcacttagaacagtacctggcatataggatgagcttcagaaatatttgcmggtgagtgaatgagggagtgaatgaatgagggatttgcagcttgaacgctgtactttgaaacagttccagattcatgaaatttctttttaatgcagaaga

SEQ ID NO: 40282 - DNA, 201 bp, Homo sapiens
gtattgttccatttttgagtattactttaatacattattgataagttaatttagaagtatcaagtgaaaggggaagaaaaacagttttgaataaaaacggwgtttcctctggactattttgccaaatgcatttttattggtagaacgtaagcaaatttaaaaaagcaacaaaagcagtttttatgaatacctagcgtactt

SEQ ID NO: 40283 - DNA, 201 bp, Homo sapiens
cttctcaacctgacctgtaaaaacctgtcttgcaaaaccctcacggctctttcccctgcagtcttgatgtgaacaagcatgatgatgttggaagccatacrcaagctggatagagccagggtccctgagttcaccacccagagcaaagtcacttgtcgatcagaaatacagaactagttttggacttgatgtgagaaatct

SEQ ID NO: 40284 - DNA, 201 bp, Homo sapiens
atttattttgagagcaagcacgggggtttatgtgatggctccacagagcagtgaaaagactcccgccctactgctcgcaacctcagatgtccctgggcacwagcccatctgtatgtctttaaaaaaaataaattaaatttttaaaaacatgactttctggccaggcgcagtggctcatgcctataaccctgcacttagaga

SEQ ID NO: 40285 - DNA, 201 bp, Homo sapiens
cattgccctccattcagatcttgtcacttaggccttggtagcatgagctattaacagccctccatatttactatttttttttttttttttaactctgggasttcctgttgcagaaattggatcacttacctaaaaagctccccacccccacctttggtgactggtgggtttcatcaccaggaaagcacattgttccaactc

SEQ ID NO: 40286 - DNA, 201 bp, Homo sapiens
gctcaatttagcctttccatcatgtttacatatttcaaaataatgtgttgtgcacaatatatatgtgcaatttttgtcaattaaaaataaattaaaaaaawtaaaaaatggctttcccacagcctgtcgacttccatccccatgtgtggctctccccagggcctcccttcttgttctccccagttgcagacctcagacagg

SEQ ID NO: 40287 - DNA, 201 bp, Homo sapiens
tatgctagagctgcaatgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagag

SEQ ID NO: 40288 - DNA, 201 bp, Homo sapiens
gatgctgtatgagtcttttctcatactactgagaaagacatacccaagactgagtaatttataaaggaaagaggtttaatggactcacaattccacatggyggtggaggtgtcaccattatggcagaaggcaaacaaggagcaaagtcacatcttacatggtggcaggcaagagaacttgtgcaggggaactcccctttat

SEQ ID NO: 40289 - DNA, 201 bp, Homo sapiens
cagtgtggtgtttcatgttagcagagtgtatcaggatcttttgttttttttttttaaattaaggatgctgtatgagtcttttctcatactactgagaaagwcatacccaagactgagtaatttataaaggaaagaggtttaatggactcacaattccacatggcggtggaggtgtcaccattatggcagaaggcaaacaag

SEQ ID NO: 40290 - DNA, 201 bp, Homo sapiens
agctagtcgggaggcagaggcaggagaactgcttgaacctgggaggcagaggctgcagtgagtcgagatcacaccactgcactccagcctgggcgacagastgaaactctgtctcggaaaaaaaaaaaaaagagtttaattcatgcagagctggctgtgtgggagaccagagttttattattactcaaataagtctccccc

SEQ ID NO: 40291 - DNA, 201 bp, Homo sapiens
aaccatacacatccagtagaaaccgaactttacattttgagtttcgatttttttttttcacctgggctagtaatacgtggtaggatactctctcacaatgytaggccacagcagcgagctgcagctcccagtgatcacaagggcaaagaatcgatattctaccaggcacggtgttgcctgataaccttgcccagctgtagg

SEQ ID NO: 40292 - DNA, 201 bp, Homo sapiens
atgcctggcctctggccttcttttcactttagaaaaaaacaaaaaacaaaaaacaaaaaaaaacacaaaaaaaacttttttttttagaactgttttagttkgggagccaaaattgagcagaaagtacagagagttcccgtatacctccggcagagccctggctcactatctacatccccactagatccatgtatttgttta

SEQ ID NO: 40293 - DNA, 201 bp, Homo sapiens
gggggcctggaaggggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgttcttaatcattaccttcacctggaggga

SEQ ID NO: 40294 - DNA, 201 bp, Homo sapiens
atcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtagggg

SEQ ID NO: 40295 - DNA, 201 bp, Homo sapiens
gattccagcattttgggaggccaaggtggacggatcaccagagttcaggagtttgagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcag

SEQ ID NO: 40296 - DNA, 201 bp, Homo sapiens
gaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatt

SEQ ID NO: 40297 - DNA, 201 bp, Homo sapiens
tctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaaca

SEQ ID NO: 40298 - DNA, 201 bp, Homo sapiens
ctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgac

SEQ ID NO: 40299 - DNA, 201 bp, Homo sapiens
gctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcaga

SEQ ID NO: 40300 - DNA, 201 bp, Homo sapiens
attcataactcagtcacgttactgaggtatgtctcttcggatagattctatctctaaaaactacagattctatctctaaaaacttaagtcaagggattttsaagcagttgtttgatttatgtatgtgaacctctcccttaggagaagaacttttctttggcaaacaccataggaacggagaccttaacaaaagaattagga

SEQ ID NO: 40301 - DNA, 201 bp, Homo sapiens
tctgagggcctgtgcattagttaaaactccttatctggtcatagagggtggtgtggtttggacgcgttccccttgtctgtgcaattcccaacagaggcaastgcgcatttgagacaggttgagggttcaagctgtccaatccctgctcatctgcagcacaccaaggaatgtggactaatgaaaaataaactgcatgcatgc

SEQ ID NO: 40302 - DNA, 201 bp, Homo sapiens
accccatctctattaaaaatacataaattagtcgggcatggtggcatgtgcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaag

SEQ ID NO: 40303 - DNA, 201 bp, Homo sapiens
aaagtactctctatggagaggttttatggttctgaaataatttaaaaacacactttactacaatccatagcaggtagttttgccaatttgggaagttatgktgccttgcagtttccaaagtaagctgaacagtgttttttaacagtgctgcccctctctcccactagaaatgcgagtccatccttttaccaagtgtggtac

SEQ ID NO: 40304 - DNA, 201 bp, Homo sapiens
tgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaa

SEQ ID NO: 40305 - DNA, 201 bp, Homo sapiens
tgcacatcgttatttattattactgttattattatttgacatggagtcttgatctgttaccaggctgcagtgcagtggcatgatctcggctcaccacaacytcagactcccagggttaagcgattctcctgcctcagccttccaagtagctgggaccacaggcgcttgccaccacacctggctaatttttgtatttttagt

SEQ ID NO: 40306 - DNA, 201 bp, Homo sapiens
acacaggactcccaccctctacttccaccccaccaacaaagaatgattcagcccaaaatggcagtagtgaccttgttgagaaatgctgttcaagccatacrtcaccattggaaggttgccaaactgtgctttgcacacacatgctgtctgcacgccttgtatttttctctttgcttagtcctgctcatgctctctaaacac

SEQ ID NO: 40307 - DNA, 201 bp, Homo sapiens
aggaggctgggatcagtgcacagctttgcaggctttgggaaggaatttcgagtttatctcatttgtccaggtatttggatgaagccctggcatactaaccstatgaaagtttatagttcccaaattgcaggataacaaggctctgtaatcttcatttcctcaaagttttacaccaggattctatggccaagtgtgtggcag

SEQ ID NO: 40308 - DNA, 201 bp, Homo sapiens
acatatattgagcattgaccaggtgcccaatattttaatgtcccatgggtgtgcatcaggtacgctgtggaaggacagatgtcattccttaaaggggctgsactgaattagaccaggggttctcaaagtggggtccctggaccggcagcatcaccatcacctggaaacttgttagagatgcagatcttgggccccgcccca

SEQ ID NO: 40309 - DNA, 201 bp, Homo sapiens
taattttttattttttgtagaaatggggtctcaccatattgaccaggccggactcaaactccgagatgcacgtgaatctccagctgtggccccttccaaartgctgggattagatgcatgagccacctggcccagccagaatccttccattaataaaaggatggaccatgaactcccttttatgatatgagccgatcaaat

SEQ ID NO: 40310 - DNA, 201 bp, Homo sapiens
ggggtactgataccagagttcatttgaagtcattggaaaccaaggcatattttcttaaagagacaactgtttttggtgaataggccatgttgtttatagtwaaaacaaacatgaatattctgtaatagaagatatcgtttgcatggtgttttaaagctaaaacttgagttattaaacacccttctctccctggggatgcct

SEQ ID NO: 40311 - DNA, 201 bp, Homo sapiens
agtgaccacataatttatcatccacactggcacctttttgagagaggatggggagcaggtaattatgctgggacaataggcgtatgtcaagatatctggtyaccctatctatgatctgtcacacttagtactttctaaaattctcgggcctttgcaccttctttttatcaacgcttagttctatgttactgaatatttctt

SEQ ID NO: 40312 - DNA, 201 bp, Homo sapiens
aaagcaaaaccactcagaggtactttcaatttcccatctgccctgcagaaaaggtaaggggttgcaaaagagtagcccctcctccttttgttacttaggcrtggaaagttaagggtttcctttcagtttggttctaagaagtcagagtgaaatggctttagattccctgcctgcagattctattccccagcctcactttga

SEQ ID NO: 40313 - DNA, 201 bp, Homo sapiens
ggctaaagtgaaattacagagttgctcttttatgcaaacgaagactccgcctccagtcagtatgattggttgtgggcagcaacccatcagaggctgaagtraagttacaaagttacactcctatgcaaacgtctgattggttgcaaaaagcaaaaccactcagaggtactttcaatttcccatctgccctgcagaaaaggt

SEQ ID NO: 40314 - DNA, 201 bp, Homo sapiens
gggagtgtggttgtacttcaacctggaactgtctaactcctaaggttttattaatatctagtccatttctctcaatctaatagtaaatggaagagaagcamcaacttttgttttccaattccttttgaacatttgaaaggttttctgaaaggacttaaagaaaccatagcttccttaccagttcccaaagcttcagtcctt

SEQ ID NO: 40315 - DNA, 201 bp, Homo sapiens
cctgccatggtctcccaaagtgctgggattacaggcgtgagccactgcgcctagcgaggtagtcagtgttctaaacactggtgtacaatccaagtctgtcrctgcccaggatagaggagggatgacgtgaattcacacgggcctctcctacaaatctgagtgtacatcaagtgaggggcgtccctccgcacctcactgttg

SEQ ID NO: 40316 - DNA, 201 bp, Homo sapiens
tatgtctttatcagcagcgtgaaaacggactaatacagtgaggaaatccatgtgttaggaagggagtgtggttgtacttcaacctggaactgtctaactcytaaggttttattaatatctagtccatttctctcaatctaatagtaaatggaagagaagcaacaacttttgttttccaattccttttgaacatttgaaagg

SEQ ID NO: 40317 - DNA, 201 bp, Homo sapiens
aatttaaaaacacactttactacaatccatagcaggtagttttgccaatttgggaagttatggtgccttgcagtttccaaagtaagctgaacagtgttttytaacagtgctgcccctctctcccactagaaatgcgagtccatccttttaccaagtgtggtacgacaaaggtttctctggttttcttttggtattctcaga

SEQ ID NO: 40318 - DNA, 201 bp, Homo sapiens
cacataagaattttctaagcagaggttccaatttggatatttcgtggccttcaggttatttgtaaccagtacacaaaccacaaagtcataatcagatagaktttctttccagcctgtctttcctctttggttgctttgtaaatctattactcatcagatcatatgtttggcaaatgccacttttcattttgaatcaatgga

SEQ ID NO: 40319 - DNA, 201 bp, Homo sapiens
ccaggacaggtgccctcctcagcggagacaactgtccccctccatcctgcaggagttttgcagccatccttccagccactgcttctctaccggggcaaatyttcccccaagggataattgataatgtctgaggcatttttaattgtcacaacttggggaaggggcaagggattgagggagagtgctcctggcatctggtgg

SEQ ID NO: 40320 - DNA, 201 bp, Homo sapiens
tggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccaaagggtgag

SEQ ID NO: 40321 - DNA, 201 bp, Homo sapiens
gaaattgtctctaccttcaaggttctcacagtctggagggaacagagagccatcagggacaataggtccctgtgccatcagctactgggatgtatgacttyccagtagaggtacacagcacttgttccaaaaggagcctatgtagctttgggagttctctatttagtcaccttattttttttgtcttcttgttaaactagc

SEQ ID NO: 40322 - DNA, 201 bp, Homo sapiens
ataatttacataatttatgttctataaaattagcatattttaaatatacagttctctggattttgaaaaatgtatacgtgtacataatcatggatccaccmccccagttaagatatagaacattccagggccaggttcagtggatcatgcttgtaatcgcagcatgttgggaggctgaggagggtggaccacttgaggcca

SEQ ID NO: 40323 - DNA, 201 bp, Homo sapiens
aaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgca

SEQ ID NO: 40324 - DNA, 201 bp, Homo sapiens
atagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaat

SEQ ID NO: 40325 - DNA, 201 bp, Homo sapiens
ttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatctta

SEQ ID NO: 40326 - DNA, 201 bp, Homo sapiens
gttttttccattttaagatacagaaagtgggccttaaaggtgctactgacttgctgatatgctttggctgtgtccccacccaaatcttaacttgaatcgtrtctcccagaattcccacgtgttgtgggagggacccagggagaggtaattgaatcatgggggctggtgtttcccatgttattcttatgaaagtgaataagt

SEQ ID NO: 40327 - DNA, 201 bp, Homo sapiens
tggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatggg

SEQ ID NO: 40328 - DNA, 201 bp, Homo sapiens
ggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctt

SEQ ID NO: 40329 - DNA, 201 bp, Homo sapiens
actatgtaaaaccaaacaaattattagctttcttactgtgtgtttgcatttgctgtgcccagggaaatgggaagtgcattgaggaagaggccccaagacawggagaagtcactccaactttccgggaacaccttttgctgtgccatgtgcatggaaggagaggaatgaatgactgttgaagccagatggccttgctcattg

SEQ ID NO: 40330 - DNA, 201 bp, Homo sapiens
tcatagtttaagtcatcaggtggtgactggaggagccagaaggtccctttgggcctgtcctctcaccagcatcaactgcaccaaaaagatctcattctgaktatcagggatgaacccccccactgggtgatcaggcaaactacatgcattttaaaaaactatatcctgctgggtgcagtgcctcatgcctgcaatcccagc

SEQ ID NO: 40331 - DNA, 201 bp, Homo sapiens
agctttcttactgtgtgtttgcatttgctgtgcccagggaaatgggaagtgcattgaggaagaggccccaagacaaggagaagtcactccaactttccggraacaccttttgctgtgccatgtgcatggaaggagaggaatgaatgactgttgaagccagatggccttgctcattgattctctcctttcccgccctctcaa

SEQ ID NO: 40332 - DNA, 201 bp, Homo sapiens
ttcttactgtgtgtttgcatttgctgtgcccagggaaatgggaagtgcattgaggaagaggccccaagacaaggagaagtcactccaactttccgggaacmccttttgctgtgccatgtgcatggaaggagaggaatgaatgactgttgaagccagatggccttgctcattgattctctcctttcccgccctctcaagcca

SEQ ID NO: 40333 - DNA, 201 bp, Homo sapiens
tgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattg

SEQ ID NO: 40334 - DNA, 201 bp, Homo sapiens
taaagtcccactgggtgtagattattcacagatgtatacacagtggctcactccaggtaggatgtgatcagtgcttttagaaatacagaaagtcctattgrtttaaaaaaaatttttttttgtaatgaattgagttttaaagctagcactgtacaataaaagggtgaatttcactatgaattatgacaaacacagtcatag

SEQ ID NO: 40335 - DNA, 201 bp, Homo sapiens
aggtggagcttgcagtgagccgagattgcaccactgcactccagcctgggcaggagacagagtaagactccatctcagaaaaaaaaaaaaagaattaataycaattttccacaaactcttttaaaaaaacagaagaggaggaaacactttccatctgacactgtgaagccactattactctgacaacagaggcagacaaag

SEQ ID NO: 40336 - DNA, 201 bp, Homo sapiens
gcttcagtgatatattgtgaaacatggctattcaacgtcctgtagaccaaatgccataagaaaaatagcattgattcaaacgtatccatccagatacctaraaaagttttacttcttaccacatcttgagtctgggcaaacacgcacttcctatggacattgattactgtctactgtagagataacatttgcacatacaga

SEQ ID NO: 40337 - DNA, 201 bp, Homo sapiens
ttggcgaggatggtctcagtctcctgacctcgtgatccgcctgccttggccttccaaagtgctgggatatacattttttttttttttttgagagatggagygtcactctgttgccgaggctggagtgtagtggcgcaatctcggctcactgcaacctcctcctccggggttcaagcgattctcctgcctcagcctccccag

SEQ ID NO: 40338 - DNA, 201 bp, Homo sapiens
ttcaagcgattcccctgccttagcctcctgagtagctgggactacaggcatgtgctaccacacccagctaattttttgtattttagtagagatggtttcascatgttggcgaggatggtctcagtctcctgacctcgtgatccgcctgccttggccttccaaagtgctgggatatacattttttttttttttttgagagat

SEQ ID NO: 40339 - DNA, 201 bp, Homo sapiens
ttattgctaccaattttaagaaatcctttataggactatttgtgaaattgattttgtgaggatgatgatataatttccattacattacagcatataaatayaaatatatatatatatatatatatatatatatatatatatatatatatatatattttattatttttttttgagacggagtcttgctctgtcaccaggctg

SEQ ID NO: 40340 - DNA, 201 bp, Homo sapiens
gacataatttacataatttatgttctataaaattagcatattttaaatatacagttctctggattttgaaaaatgtatacgtgtacataatcatggatccmccaccccagttaagatatagaacattccagggccaggttcagtggatcatgcttgtaatcgcagcatgttgggaggctgaggagggtggaccacttgagg

SEQ ID NO: 40341 - DNA, 201 bp, Homo sapiens
attattattattattattattatattttgagacagggtcttgctttcttgcccaggaaggagtgcaatagtgtagtcatggctcactgcagccttgacctyctgggctcaagcaatcctcccacctcagcctcctgaatagctggagctacaggcaagtgtactgtggcaattgttaatgttcacttttatttccatagtt

SEQ ID NO: 40342 - DNA, 201 bp, Homo sapiens
acctctcctcggccttgcaaagtgctgggattataggtaccccgcctggctgatactttccttagttgttttcagtgtaataacctgtcttcagtctactytttgtccttttctctcctttcctccctgaatactcaagcttccagtgcacagatttctccaaccctgaatgtgactgataccaacaccatactagctctt

SEQ ID NO: 40343 - DNA, 201 bp, Homo sapiens
tattgtgtctgtgatgtatttgagtaccaggtatccctgattaccatagagtaatgtcttttattgaggcttttattattattattattattattattatwatattttgagacagggtcttgctttcttgcccaggaaggagtgcaatagtgtagtcatggctcactgcagccttgacctcctgggctcaagcaatcctcc

SEQ ID NO: 40344 - DNA, 201 bp, Homo sapiens
ttccaagtagctggttttgcaggcatgcaccaccacacccagctagtttttctatttttagtagaggcggagtttcaccaagttggccaggttgttctcaractactgacctctcctcggccttgcaaagtgctgggattataggtaccccgcctggctgatactttccttagttgttttcagtgtaataacctgtcttca

SEQ ID NO: 40345 - DNA, 201 bp, Homo sapiens
gtcctgttgatggcatcccacaactttctaacctctgttgtagagttttgttagccacgatttggaccaacctgcagttaggccaagggctgctgatccarttggattaaggaactctgctgtttgagcatgttggcttcattcattggtatctcctacgccaagtcctaggcttggttacaaagggcaatgaagggtctt

SEQ ID NO: 40346 - DNA, 201 bp, Homo sapiens
gagattcttgtgcctcagccttccaagtagctggttttgcaggcatgcaccaccacacccagctagtttttctatttttagtagaggcggagtttcaccawgttggccaggttgttctcaaactactgacctctcctcggccttgcaaagtgctgggattataggtaccccgcctggctgatactttccttagttgttttc

SEQ ID NO: 40347 - DNA, 201 bp, Homo sapiens
ttgaataacaatatgtaatttcaggtttaggattgttgatctgtaaatctcagcctagtgctttcaactcctggctttctcctaagttcaccctcctcccytccctcctttctgtaaggactctaaacgattgcgcttcattaagttatttttataatgagttcctgttaccagggaatacagagttaaaaaggtgatctc

SEQ ID NO: 40348 - DNA, 201 bp, Homo sapiens
ttaagaagatctttgtccctcccccaccccccgccccgatttatactatggatcagcagcctaaaccctgcaaactgggtcccccatctaagagtctgcartgaaacgcgagccgacttgatgtgtctcagagtgatcattcttgcccttggcggttgatgctagactgttgcagcttcaaatataatgtattttagtgct

SEQ ID NO: 40349 - DNA, 201 bp, Homo sapiens
taagtaaaattttattaaaatacagctccactcattcatttatatattgttcatatctaattattttcacactgcaatggtgcatagtcaaatgctttctwtctggctttttaagaagatctttgtccctcccccaccccccgccccgatttatactatggatcagcagcctaaaccctgcaaactgggtcccccatctaa

SEQ ID NO: 40350 - DNA, 201 bp, Homo sapiens
acctctttttcttcccggtctcaggttatgtctttatcagcagtgtgaaaatggactaatacagtgaattggtaccagtagagtggggcattgctgaaaasatatctgaaaatgtggaagtgactttggaactgggtaacaggaagaagttagaaccgttgggaggtctcagaagaagacaggaaaatgtgggaaagtttg

SEQ ID NO: 40351 - DNA, 201 bp, Homo sapiens
caagaagatgtctctctttgaattcaactcagaggtcagcttcactgcctgccctgtggagtcgactctgtgtcccacccttcaggaatacggcttaatartaagatgataaggattcgtaccagggattggcaaatgacagtcattttctgtttccttaagtaaaattttattaaaatacagctccactcattcatttat

SEQ ID NO: 40352 - DNA, 201 bp, Homo sapiens
cctcccggattcaagagattcttgtgcctcagccttccaagtagctggttttgcaggcatgcaccaccacacccagctagtttttctatttttagtagagrcggagtttcaccaagttggccaggttgttctcaaactactgacctctcctcggccttgcaaagtgctgggattataggtaccccgcctggctgatacttt

SEQ ID NO: 40353 - DNA, 201 bp, Homo sapiens
cggtctcaggttatgtctttatcagcagtgtgaaaatggactaatacagtgaattggtaccagtagagtggggcattgctgaaaacatatctgaaaatgtsgaagtgactttggaactgggtaacaggaagaagttagaaccgttgggaggtctcagaagaagacaggaaaatgtgggaaagtttggagcttcctagagac

SEQ ID NO: 40354 - DNA, 201 bp, Homo sapiens
tgttttccttaaactctgtgcacatgaatatttgtggtatatggcttaattgtaagcgatcaggcatcaatggctttttatgaggcaaaatctactttctrcatttgcgtgtgccattattatagattgctgatgtttgccaatggatattcttggaagtcgtcttctggtttaaatgcagttaagtatttaaaaataata

SEQ ID NO: 40355 - DNA, 201 bp, Homo sapiens
ggtggctcatgcctataatcctagcacgttgggaggctgaggtgggtggagcacctgaggtgaggagttcgagaccagcctggtcaacatggtgaaacccyatctgtactgtaaatacaaaaaattagctgggcatggtggcaggcacttgtaatcccagctacttgggaggctgaggcaggagaatcacttgaacccgga

SEQ ID NO: 40356 - DNA, 201 bp, Homo sapiens
taatgaggacttaaatgtgtccctgctgaccgagccagaacttatttttatgttgccactaggagtcttctgagatgctcttgtggctggatgtagaatcsctttgctcatctctagacacagactagacaacgaaatacattcccctaaaatagcccagggttagttctatgacctttgtcactgttggtacagttctaa

SEQ ID NO: 40357 - DNA, 201 bp, Homo sapiens
gagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagcaacct

SEQ ID NO: 40358 - DNA, 201 bp, Homo sapiens
tctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgggggggt

SEQ ID NO: 40359 - DNA, 201 bp, Homo sapiens
tgtgtgtgtgtggtgtgtgtgtgtgtgtgtgtgtgtgtgtgtgtgtgtgtgtgtgtgtgtgtgtgtgtgtatacctagtctagggctaggtttgggaactrttttctcccgtaagttaaactgaactagactgtatgtcaaaaaagagtctcaatgtcaacttaatccattgtcatgactgtaaaatgctatttcattata

SEQ ID NO: 40360 - DNA, 201 bp, Homo sapiens
tctctagcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacagga

SEQ ID NO: 40361 - DNA, 201 bp, Homo sapiens
cccctggctgtccaccagcccctttgtgatagtctcatagtcttatttgtcttttggcttgtatcccacctgttcactttttaccatagctaacctttctmagtggtcaggtgggactcatggagattttccgttctttggagactagcagcgactgcagattactcatcagctgtctccttgagtccacaatgccgggcg

SEQ ID NO: 40362 - DNA, 201 bp, Homo sapiens
caagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgca

SEQ ID NO: 40363 - DNA, 201 bp, Homo sapiens
cttttttccactttcaaatgtataacaaaatagaactttatatttccagatggactgcctggaacccggggagtggctcagctaccaggccccagtggccsttgtcttgttatttcctccattagagacctggcgtataattgtgggagggagaagccagtggagcagtcaggggactccctggctgtttctgtgtctggt

SEQ ID NO: 40364 - DNA, 201 bp, Homo sapiens
ggacccggttggctctgcaaaccgcatttccttggctgaacgccagaggagagaaatgatccggcaagaagacacaccattccccgtcagccccttcccgwcccttgcacccctggatcttctgctgagtatcggattggtctgcgtccaagagctcctcgcttggccagcaggggctgcctggagaaggggaggacaggc

SEQ ID NO: 40365 - DNA, 201 bp, Homo sapiens
actttatatttccagatggactgcctggaacccggggagtggctcagctaccaggccccagtggcccttgtcttgttatttcctccattagagacctggcrtataattgtgggagggagaagccagtggagcagtcaggggactccctggctgtttctgtgtctggtcttatgggtctgggcactgaattcagtcacaaac

SEQ ID NO: 40366 - DNA, 201 bp, Homo sapiens
aaggaccctatgttatatgatttcatttacatgaaataccccaaagaggcaaatctgcagaaacagaaagtagagtggttgccaggggctggggatggggygtggatggaggcatttgggattaacagctaaagatagcaggattccttctaaagcaataaaaatgttgtaaagttgattgtggaaattctttcacaactc

SEQ ID NO: 40367 - DNA, 201 bp, Homo sapiens
ggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcct

SEQ ID NO: 40368 - DNA, 201 bp, Homo sapiens
aaatattttgagaactctgaaataatgcacaccagaaacgtccagctgaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcga

SEQ ID NO: 40369 - DNA, 201 bp, Homo sapiens
gaatgactaacattttctgagggtgtctcacgtgaaagtaaatcgctcatgtttgttctttttaaaagatgcccttcgtattgtgtatcttgcagtcttgstttctcaaacttaagccaactatatcgtcatttttgcaaaatcactgcgtcagtttactattatttaatgtttattgctaccaattttaagaaatccttt

SEQ ID NO: 40370 - DNA, 201 bp, Homo sapiens
atatcctcttttaggcaccatctctgtcaaggctgatgctgggctttttatatattttctctaattcttgtggctgtcaaacaaggtgggcattatcattscctttataggggacacagctgtggctcagaggggtttattcactttcctgagggccacacacataatgagaggcagacacaggtgacgaagtgagttttc

SEQ ID NO: 40371 - DNA, 201 bp, Homo sapiens
tagtattgctttatgcctacgaaatataatgttaatttgtagcaatgctaatgtgttttcaggaaggctctttgtttattgcctttattttccccacttascaagtgggtaaaatgctttgagggttgcattttatgtattcaggaggcccaggtattattttaatagaagcactattgacaaataccagtcatcccccct

SEQ ID NO: 40372 - DNA, 201 bp, Homo sapiens
ctgccaccacctattaaagcccactccctgcattaaaactgtataaagtgtatttaaataaactctctttgcatgatgtgaatgaaatcgtcatctggtamttaaaactattctataaagttattaaaaaattaatgttcccttcccatgatttttctgcagaatttatgcatccatgatactgcagaagttcataaataa

SEQ ID NO: 40373 - DNA, 201 bp, Homo sapiens
aaatgcatgagatgttttattttttgagtgacttgaccacgtgcttaagcacattccccaaacaatttttttcttattgtttgtaagttgtaagttgtaarttcacctctgccaccacctattaaagcccactccctgcattaaaactgtataaagtgtatttaaataaactctctttgcatgatgtgaatgaaatcgtca

SEQ ID NO: 40374 - DNA, 201 bp, Homo sapiens
tctctaggcaaaacagaggaaagagtcgtcattggcaagggagatgtacaaaatgcatgagatgttttattttttgagtgacttgaccacgtgcttaagcrcattccccaaacaatttttttcttattgtttgtaagttgtaagttgtaaattcacctctgccaccacctattaaagcccactccctgcattaaaactgta

SEQ ID NO: 40375 - DNA, 201 bp, Homo sapiens
tagaggttcatttatgttattgcaaaaatcagtacttcatttctttttatggctgaaaaaaattccattatgtagatgtgccatatttgtttatctggttstcagtcggatatttctgttgttcctactttttggctactgtaaaagatgctgctatgaacattattgtgattattataccttatttgtaaacatcatggg

SEQ ID NO: 40376 - DNA, 201 bp, Homo sapiens
ttctcctgcctcagcctactgagtagctgggattacaggtgtgcgccaccacgcttggctaatttttgtatttttagtagacacggggtttcaccatgttrgttaagctggtctcaaactcctgacctctagatccgcctgcctctgtaatcccaaagtgctgggattacaggcgtgagcccctatgcccagccaaaattc

SEQ ID NO: 40377 - DNA, 201 bp, Homo sapiens
ctggagtgtgatggtgtgatcttggctcactgcaacctctgcctcctgggttcaagtgattctcctgcctcagcctactgagtagctgggattacaggtgwgcgccaccacgcttggctaatttttgtatttttagtagacacggggtttcaccatgttggttaagctggtctcaaactcctgacctctagatccgcctgc

SEQ ID NO: 40378 - DNA, 201 bp, Homo sapiens
tgacctgcagtgagaccacccacgcagacatcaatgcagcaaatccccggcgtcagggtttcaacatttggttactctcagagaactctcgatttatatamgacttggaaaaagggtttgagtttctgtggtttacaattatatttcccaacttggcccatgaatccagcttggtttttctcctcttagcatcctaaccac

SEQ ID NO: 40379 - DNA, 201 bp, Homo sapiens
ttaaggaggagaaatttgagttttcatattgtcagtctcaaaccttttctgaaattggaagtgatgaagtgacagtctggctatatgtgtgtgtgtgtggkgtgtgtgtgtgtgtgtgtgtgtgtgtgtgtgtgtgtgtgtgtgtgtgtgtgtgtgtatacctagtctagggctaggtttgggaactattttctcccgtaa

SEQ ID NO: 40380 - DNA, 201 bp, Homo sapiens
tttaaggaggagaaatttgagttttcatattgtcagtctcaaaccttttctgaaattggaagtgatgaagtgacagtctggctatatgtgtgtgtgtgtgktgtgtgtgtgtgtgtgtgtgtgtgtgtgtgtgtgtgtgtgtgtgtgtgtgtgtgtgtatacctagtctagggctaggtttgggaactattttctcccgta

SEQ ID NO: 40381 - DNA, 201 bp, Homo sapiens
agatgtctagaatttcatctcacatctaaactgttttaagacacttggtacacattgatatgtattgtccaattgctttccagaaactatataaaatattmcaaagaaaaacatatatatatatatatatgtaaaatatatatatgaagggagaaataaatgtaaatgaaaagaaaaacatatagagaaagaatatgtcta

SEQ ID NO: 40382 - DNA, 201 bp, Homo sapiens
tgtatcctatgtgattatagttacaatgagttcactaaaaagcaaactattcctattagaagtcagggtagaggatggatgggagcatgaagtgtcctccrtcatgttgctaatgttctgttgcttgttcaagctactgggtgtgttcagtttatgaaaattcatttagtgacacatgtatgttttgtgaatttttttgca

SEQ ID NO: 40383 - DNA, 201 bp, Homo sapiens
ctaaattcaacaatgtggatttatcttacagagatgatgttgagagaaaggaggaagatacagaggaatgtatcctatgtgattatagttacaatgagttsactaaaaagcaaactattcctattagaagtcagggtagaggatggatgggagcatgaagtgtcctccgtcatgttgctaatgttctgttgcttgttcaag

SEQ ID NO: 40384 - DNA, 201 bp, Homo sapiens
ctgaatcattattcatgattactcaagacatctggtaaaccacccagatatctatcagtggtggaatggataaataagttgtaataaatccacacaagagsagactactcaccaacaagaatgaatgacttagaactaaattcaacaatgtggatttatcttacagagatgatgttgagagaaaggaggaagatacagagg

SEQ ID NO: 40385 - DNA, 201 bp, Homo sapiens
ctacaagtggagcgtgatttcatctttcatcaagagaagcagcttttcctcctcttgtatccgttttcttccttttctaactatcaaggtcatgcggtatstgccattttgcatattcttgctttgcttcatgttttccttaaactctgtgcacatgaatatttgtggtatatggcttaattgtaagcgatcaggcatcaa

SEQ ID NO: 40386 - DNA, 201 bp, Homo sapiens
gcccgggagacggaggttgcagcgagccgagatcacaccactacattccagcctgggtgacagagcaagagtccatttacaaaacaaaaacaaagaactgmcaataaatagttttctccgttttgtgacttatttttaattattaagaataagtgtcataaagccaatactttctaacatgtgtatagtatgttatagttt

SEQ ID NO: 40387 - DNA, 201 bp, Homo sapiens
ctgtgtcacctcagcatttaatttacttccgtcacaaaactacttgaagttgtcccaggctagttggtcctattaattacaacctagagggattctattartaaactaatggattacagtacctaaatggaagccagcagatgactttggaaggactgatccgcaagggccttctgtgtgaagattaaatgaagcttcctt

SEQ ID NO: 40388 - DNA, 201 bp, Homo sapiens
catgtagaggttggcaaaggggacaggagactgtgggatgattagtatattcttatttggcctgggagggaaaaaaaatctttcatttccaacaatattcwttctctgtgtcacctcagcatttaatttacttccgtcacaaaactacttgaagttgtcccaggctagttggtcctattaattacaacctagagggattct

SEQ ID NO: 40389 - DNA, 201 bp, Homo sapiens
tcacggctcactgcaacctttgcctcctgggcgcaagtgatcctcctacctcagcctcccaagggagctgggaccacaggggcacaccaccatgcctgccyaatttttgttgttgttgtattttttggtacagatgggattttgccatgttgcccaggctggtctcaaaactcctgggctcaagcgattcacgtgcctcag

SEQ ID NO: 40390 - DNA, 201 bp, Homo sapiens
cctttgggagaagatggtttcaaagaacttactgtatcaaatggaaagacaatgtgttttcccaacatgggagtatgtttctaagttgggatcagttcacrattcagagaaatgctctgccttcttgtctatgatatcagatcaggtcagacgtaggtataagaccctgactcctgttttccaagcacttttttttttcat

SEQ ID NO: 40391 - DNA, 201 bp, Homo sapiens
atgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtat

SEQ ID NO: 40392 - DNA, 201 bp, Homo sapiens
tcttttgctcactattgtacttcagggcctagaggaaggcttagcacgtggaagacaatatttattggaggaatgaatctagaaatatccttggatgtatratgtccaactcactctaccacacagcaacataggtagttttatatacattttatagctaagcccagcagcccaaaaagctaaatgacttcagcgcccaca

SEQ ID NO: 40393 - DNA, 201 bp, Homo sapiens
taaaggcttactgggtatcagggctgctttcctttataatcttttacccgtcttatgggggatgaacagaaacacactttagtgctagaaaagctgggccyaaaagaccagtctcctgtcccatacttggacatttattgttctttttgggcaaggtgaaaacttgaaaccaaaagtctgttgagtttggaagacttgact

SEQ ID NO: 40394 - DNA, 201 bp, Homo sapiens
ccgatatttaatattatcaattgctggttcctgtaaatttgcatttatggatcacattataaaagcaattactcttatggattgttcatgcagaaatgcaytatgatgataatatacttttaaaagtatatttatttccagaattcaatttgtaagaggtttgagggaaaaataatactgagttttgagtgtttctgattt

SEQ ID NO: 40395 - DNA, 201 bp, Homo sapiens
tattatcaattgctggttcctgtaaatttgcatttatggatcacattataaaagcaattactcttatggattgttcatgcagaaatgcactatgatgatamtatacttttaaaagtatatttatttccagaattcaatttgtaagaggtttgagggaaaaataatactgagttttgagtgtttctgattttaaaaatgtgt

SEQ ID NO: 40396 - DNA, 201 bp, Homo sapiens
cttttcaagtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtc

SEQ ID NO: 40397 - DNA, 201 bp, Homo sapiens
ggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacgtcttggaatcaaccttacagggaacacttggtcgaaa

SEQ ID NO: 40398 - DNA, 201 bp, Homo sapiens
cctttgtatgtaaatgtctcatatacccctctaagaacgggagcgaatagtattttccaaacttacgtcaccacttaccatccacctgcatactttacacrtcttggaatcaaccttacagggaacacttggtcgaaaaacagtgttttctaaatttatattacagttcccactccccccgcccccacttgtatcactttg

SEQ ID NO: 40399 - DNA, 201 bp, Homo sapiens
tccacctgcatactttacacgtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgt

SEQ ID NO: 40400 - DNA, 201 bp, Homo sapiens
gggattacctggaaagggtggggcaattttggggggtcaagaaaatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgac

SEQ ID NO: 40401 - DNA, 201 bp, Homo sapiens
gatcacctgaagtcaggacatcaagaccagcctggccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagc

SEQ ID NO: 40402 - DNA, 201 bp, Homo sapiens
gtcctacaactggtgagctgtgagctgtaaattgcggaactaatttttatactgccaatctgaggccttttctgacctcatcgctgccactgtaaaatgarttctagccccagaccatgacatgcctactagcttagctctaaccaaaaagatttattatcccaagagttgtgaaaatgtggaagaactagaactgtcatt

SEQ ID NO: 40403 - DNA, 201 bp, Homo sapiens
cgcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatactattccatagctgactattttctgaaatgattttgttactt

SEQ ID NO: 40404 - DNA, 201 bp, Homo sapiens
gctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaac

SEQ ID NO: 40405 - DNA, 201 bp, Homo sapiens
tttgacctgcagtgagaccacccacgcagacatcaatgcagcaaatccccggcgtcagggtttcaacatttggttactctcagagaactctcgatttatayaagacttggaaaaagggtttgagtttctgtggtttacaattatatttcccaacttggcccatgaatccagcttggtttttctcctcttagcatcctaacc

SEQ ID NO: 40406 - DNA, 201 bp, Homo sapiens
tacctttgtagatcttgggaaacaacttctaaagtaatcatagttgtatgtaatcgtagttacaacaatagttattttaggcacataacccaaaggttttmttacaaggaatctatgaaccttaagagtgagggcttctgttaagagtaagggcttccctggagtggacatggatcatgggactgagccagcttggcattg

SEQ ID NO: 40407 - DNA, 201 bp, Homo sapiens
ggctggctagatggatggaaggggtggaaggggatgcaagaggtaagtacaaggaaggggatgggtggctggctggctagatggatagaaggttggaagasaggaaggatggaacggaagaagagggaagaacaaaaatggaaacacatagtactgttaggtgaactgaacttctaaggtgccgattctcagtgatagaat

SEQ ID NO: 40408 - DNA, 201 bp, Homo sapiens
aatatctgtgctacaacttattaagatggtgacgctggcaaattccttaatctttctaattcttaatttcatcagcaaagatgggaaaggatactaacacmactctgggttgttgagaggattcaataactgaatatttataaagcgtagtacctgatacttaataaaaaagtgaattttaacctgtgtcatcattgtcat

SEQ ID NO: 40409 - DNA, 201 bp, Homo sapiens
gcctagtgggacaattagaaaggtcagttcaaggttggaggagatgcttctttcagccaattttcctttttctcaggatcacctcaggtgatccgcccacytcaacctcccaaactgctgggattataggcgtgagccaccgctcctggcctttcagccaattttctatcaccaaagggaaatcgttttgctggaatatgt

SEQ ID NO: 40410 - DNA, 201 bp, Homo sapiens
gttcatgctagctggtacgcagtaaggctagaacttcgtccaaaatctcttcttctgttgagctcagcttgcatagtagcttggagaatcagaaagatctrtctcatttgggaaatataccatgtaaaaaacattgtttctaaaggagatttgtcccatgagtaaaatagatgatggacagccactgcctagtgggacaat

SEQ ID NO: 40411 - DNA, 201 bp, Homo sapiens
gagattggaaataaagcttatgccttctctcatatctcctgtaccttatttctttcttacagtagttgtgatgcttagcagttttttgataactttttatratgccaaccttcaaaaacctgcccctggtggagagaataattattacatcaattaggggtcacttagcatgacatttgtcggaaaaaaaaaagttagtga

SEQ ID NO: 40412 - DNA, 201 bp, Homo sapiens
aggacacagattcacaggggtgaactaactggccatgagtcaggtaaggaaaataacatggctgagctacagtttctctaagaagttggttctgtccattycagggagcttatgtaagacagaaggtattgtgcagtagccttgaagtcaggtgaccctttgggggtgtgtgtgtgtttgcttctttatattagctttttt

SEQ ID NO: 40413 - DNA, 201 bp, Homo sapiens
atgcctataatcccagcgcttttgggaggccaaggtgagaggattgcttaagcccagaaacgtgagaccagcctgggcaacgtagtgagacgctgtctctrtattacaaaattttttaaaaaacggtttgtaggtccttaagtccctgataaaatagagaactgaattgcaatcctggaacttaaaaagttggtgacgaca

SEQ ID NO: 40414 - DNA, 201 bp, Homo sapiens
cagggctcccaccgattgtacattatggtgagttggataactatttcattatatattacaacgtaataataatagaaataaagtgcacaataaatgtcatstgcttgaatcgtcccaaagccacccccactcctttgagtctatggaaaaattgtcttccagaaaaccacttgctggtgccaaaaaaatttggaaacctct

SEQ ID NO: 40415 - DNA, 201 bp, Homo sapiens
gacttaaagacatgttggcaatgggtagtggacaaaaattgaaacaccttcaactgtgtctgtgaccagaagatttttttctttttttttttttttttttktttggctgactgtcatgacttagtaaggccatcacaggttgccagaacatctactcaactgttccaagcataacctcctacacaggccttctacatagga

SEQ ID NO: 40416 - DNA, 201 bp, Homo sapiens
tctccactacagattctgatggcaagtgacttaaagacatgttggcaatgggtagtggacaaaaattgaaacaccttcaactgtgtctgtgaccagaagawttttttctttttttttttttttttttttttggctgactgtcatgacttagtaaggccatcacaggttgccagaacatctactcaactgttccaagcataa

SEQ ID NO: 40417 - DNA, 201 bp, Homo sapiens
cccttcccatgatttttctgcagaatttatgcatccatgatactgcagaagttcataaataatggcttgtattgctgctttagtattgctttatgcctacraaatataatgttaatttgtagcaatgctaatgtgttttcaggaaggctctttgtttattgcctttattttccccacttaccaagtgggtaaaatgctttg

SEQ ID NO: 40418 - DNA, 201 bp, Homo sapiens
ttgtagctcctgtgaagattcaggaattttttttttcttctatttgcaagctttagtcctaggcatggaaaaagaactttgaagaaaacctgagagatatsagtgtaaaacaagagaatgattccctctggggtgctggtagtgggggcttaatttcctaaaggcttactgggtatcagggctgctttcctttataatctt

SEQ ID NO: 40419 - DNA, 201 bp, Homo sapiens
ctccagtggactttgattcacatcatggctctttctcttccttgctgaggcttttgacaatttcaaatgctccctgaacctcagtttcctttgccacaaartagcaatacaaatttataattccttagattgctgtgagaatgaattgaggcaaggtaggtaaagtgcaaggaattgtgtgtggccggccaggtgcagtgt

SEQ ID NO: 40420 - DNA, 201 bp, Homo sapiens
tgatttccttaaaagaagtacgtcaggtgaagggcagatagaggtcaacaccatagataaatctttacactccagtggactttgattcacatcatggctcyttctcttccttgctgaggcttttgacaatttcaaatgctccctgaacctcagtttcctttgccacaaaatagcaatacaaatttataattccttagattg

SEQ ID NO: 40421 - DNA, 201 bp, Homo sapiens
gccaccgcgcctggctttcaaattccattttttaaagttaatgctttaatatgttaaacacccttattaacatattacatatgttaatatgtaaaataaaytccgtacattttaaagtgctaaaggttgtatgtttgtgcgatggatatgtttaagagaatgatttaggatgcgatcagttttttttccttgacttactct

SEQ ID NO: 40422 - DNA, 201 bp, Homo sapiens
tcctgacctcaagtgatccacccatcttggcctcccaaagtgctgggattacaggcgtgagccaccgcgcctggctttcaaattccattttttaaagttartgctttaatatgttaaacacccttattaacatattacatatgttaatatgtaaaataaactccgtacattttaaagtgctaaaggttgtatgtttgtgcg

SEQ ID NO: 40423 - DNA, 201 bp, Homo sapiens
tttgtatttttagtagagttggggttttaccatgttggccaggctggtcttgaactcctgacctcaagtgatccacccatcttggcctcccaaagtgctgkgattacaggcgtgagccaccgcgcctggctttcaaattccattttttaaagttaatgctttaatatgttaaacacccttattaacatattacatatgtta

SEQ ID NO: 40424 - DNA, 201 bp, Homo sapiens
attcatcaggaattattttataaatttttgatgttggatatctgaagataatacagaatggagcccttttttactttacagattttttttttttttgagasagaatcttgctctgttgcccaggctggagtgcagtggtgcagtcatggttcactgcagcctcgatctcctggggctcaagccatcctcccacctcagcct

SEQ ID NO: 40425 - DNA, 201 bp, Homo sapiens
gccttagataaatagcattttcacgagtaaactttttagttctcaaaagaaaaattgtaacaattttctagccgcatattagcattatgcacaaacacatraacttttggctggaattgtggaatatgaagtagctcccatccttattccatcgcccatatgctaaaatgtagattgtattagttgagaaattttaccaaa

SEQ ID NO: 40426 - DNA, 201 bp, Homo sapiens
tactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatg

SEQ ID NO: 40427 - DNA, 201 bp, Homo sapiens
agtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcaccgc

SEQ ID NO: 40428 - DNA, 201 bp, Homo sapiens
caaatggtgcatgaaatgaaaaattcctggtggtctccaggggacacagccggtgctgtgctccactctgggtaactgttttggattattttctctattcyaactgaaataaaaaaaaattaattaaatgtggctaggttatcttgacagcagaatccattcccagttaattattattttaatacttgatggtgtctgtca

SEQ ID NO: 40429 - DNA, 201 bp, Homo sapiens
tgttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagat

SEQ ID NO: 40430 - DNA, 201 bp, Homo sapiens
acgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggt

SEQ ID NO: 40431 - DNA, 201 bp, Homo sapiens
gaaaaaaacttgcttgtttactgtcttctgagctgatttctcacctactggcaagtggataggtctactttttgtttagctgtttttctaatttaatcttrtacatgagacagctatagatggatgtatagtctttgaagtggggccagttggctccgtctattagctgtgtggcttttgtgcaggtgacttgtggccccc

SEQ ID NO: 40432 - DNA, 201 bp, Homo sapiens
tttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgctcagtgggtatctgttgaacc

SEQ ID NO: 40433 - DNA, 201 bp, Homo sapiens
caacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcagg

SEQ ID NO: 40434 - DNA, 201 bp, Homo sapiens
agcaggagataaaaaggcatcagttccattccatatccaagtctgagtccaagggcaggagaagctgatgtctcagcttgaagtcaggcatagagaggcarttctttctcactcagccttttattttattcaggccttcaacagattgtatgaagccacccacactgggaagggcagtctgctttactcatagtactaatc

SEQ ID NO: 40435 - DNA, 201 bp, Homo sapiens
tcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcactatctgggctcactgcaacctgtgcctcccggattcaagag

SEQ ID NO: 40436 - DNA, 201 bp, Homo sapiens
ttgcatactgacctttctgctcttttatgctgcctgctctctaatattgtccaaaaaccttctctaaagaaagtacacaaatggagagagggggaattggrcatgccattgggagaacaaatttatttagatatctttggctgtgttgacagaagctgcccaattatacccaatatacaaattttaaatgcatattagtca

SEQ ID NO: 40437 - DNA, 201 bp, Homo sapiens
ctctcctcggccttgcaaagtgctgggattataggtaccccgcctggctgatactttccttagttgttttcagtgtaataacctgtcttcagtctactctwtgtccttttctctcctttcctccctgaatactcaagcttccagtgcacagatttctccaaccctgaatgtgactgataccaacaccatactagctcttcc

SEQ ID NO: 40438 - DNA, 201 bp, Homo sapiens
tttgctctgttacgtgaggacacatcacttgcacctcagtgtgagtttgaaagtgttttctctggagaataattctgaagaaataggccctccagatatcrgtagtgacaggggtatcagtaatgttgattactaagttcttgccacaggtagaagccatgctactgcacaagtttcatacttgaagagtggacatctgac

SEQ ID NO: 40439 - DNA, 201 bp, Homo sapiens
acctcatatactcatggtaacggcttccggcatccaatgaccttgccattgcggaggtcaatttcatgtgtgtgtgcacacatgggtgcgtatatgttacmgagggaaacttgcctgtttgaagcaggtgtcgtggaaacaacatgggctttagagccagacatggaatcctttcttatgattaatgcagctaaatttccc

SEQ ID NO: 40440 - DNA, 201 bp, Homo sapiens
agttatatcacaaccagaacacacaatgaccagcaggcttctctttttttgtttgatttcactcctgaaaagtgggctttctgtgagagttggacagactscatgctgcccctgcctcccgggccttccttcccaagcagggatgagctctcctctgcatgtaacaagcaaggtgattcagcaagaagactgctggtctct

SEQ ID NO: 40441 - DNA, 201 bp, Homo sapiens
gtccatgacctctaggccacaaaccaatagcggagccgtggcctgttataaattgggtggcatggcagggagtgagtggtgggcaagcataggaagctgcrtctgtgcttagagccgctctctgtcactctcattagtgcctcaggtcctccccctgtcagatcagcaacagcattagtctcataggaccgtgatccctat

SEQ ID NO: 40442 - DNA, 201 bp, Homo sapiens
tcccccaggctacagtgcagttgcgtgatattagctcactgcagcctcaaacttctaggctgaagtgatcctcccacctcaacgtcctgagtagggagggsactacaggcgcatgcctccacatctgactaattactaaatttttaaaaatttttttagacactgagtctcaccgtcttgccctggctggtctcaaactcc

SEQ ID NO: 40443 - DNA, 201 bp, Homo sapiens
aaaacaacataaaacaagaaacatttctgttgtgcctcctcttttcctccctccctctttctcatagttaatttgtttgaatcaggattcaaataaggtckatgcatttttaatctataggttttgtctcctttttttttttttccttaaaaaaatttcttttaatgcaacagatttaagggaccagggtgttctctagag

SEQ ID NO: 40444 - DNA, 201 bp, Homo sapiens
tgttcaaaatgctctaatccctaaattttccagtctaggttattatacttttatgactattcattttgatgtaggccttttaaaatcaattcctccctgtwattacaatgctgctttatggtatttgtgatatatcatgtgaatatacttgagggtcatgagaagttcatatgtgtgtgtgtagtgtgggccccagacttt

SEQ ID NO: 40445 - DNA, 201 bp, Homo sapiens
tggggtgggcagaggttgcagtgagccgagatcatgcctgggggacagtgagactctgtctcaaacaaattactccaaaatttagtggctaaaaaacaacrtaaaacaagaaacatttctgttgtgcctcctcttttcctccctccctctttctcatagttaatttgtttgaatcaggattcaaataaggtcgatgcattt

SEQ ID NO: 40446 - DNA, 201 bp, Homo sapiens
tatttatgggaaaaatagtattagggcaattgcggtcaaacacattcgtctgttcgttcaattacagcagtaaggatggaagtctaaagagagtttctacrtgatcttatttatcctgcatttataaatacacaaattcttgtacaattaactcagtttttcactcctttcttgcttgcaacttgtcaggtcgttccctcc

SEQ ID NO: 40447 - DNA, 201 bp, Homo sapiens
actcctgacctcaagtgatctctccaccttggcctcccaaactgctggaattacaggcgtgagccaccctgcccgaccctttcattttaaatgtgatagaracagactcagagaatgtgagtgactttcgcagggtcacttagcaggttggtgacgggcatggggtttcactccagtctgcctcttgttcttttcctcata

SEQ ID NO: 40448 - DNA, 201 bp, Homo sapiens
aggctagtcaactcctgacctcaagtgatctctccaccttggcctcccaaactgctggaattacaggcgtgagccaccctgcccgaccctttcattttaamtgtgatagaaacagactcagagaatgtgagtgactttcgcagggtcacttagcaggttggtgacgggcatggggtttcactccagtctgcctcttgttct

SEQ ID NO: 40449 - DNA, 201 bp, Homo sapiens
gtttcaccatgttggccaggctagtcaactcctgacctcaagtgatctctccaccttggcctcccaaactgctggaattacaggcgtgagccaccctgccygaccctttcattttaaatgtgatagaaacagactcagagaatgtgagtgactttcgcagggtcacttagcaggttggtgacgggcatggggtttcactcc

SEQ ID NO: 40450 - DNA, 201 bp, Homo sapiens
actatactgtgtttcattttagtttattttttatttattttttgagacagggtctcgctgtgttgcccaggctgaagtgcagtggtgcaatctctgttcawtgcaacctctggccttgggttcaagcgattctcatgcctcatcctccagagtagctgggattacaggtgcaggttaccacacacagctaatttttgtatt

SEQ ID NO: 40451 - DNA, 201 bp, Homo sapiens
ccaccctttgccagaactatcaagaggcacctcaacaggctgcaacactagcattcaagacatttgttcgctgatttgcttcgtcattcatttatccaccsgttccttcacttcacacacatttcaggagcacctctaaagccccagacattcttctgggctctgagaagagagtggtggccctggaagccacagtaaccg

SEQ ID NO: 40452 - DNA, 201 bp, Homo sapiens
gtgcactccagcccgggtgacaagagcaaaactctgtctcaaaaaaaaaaaaaaaaaattgactcaggctcttgctggagtatgtcagtgtcccaagtcaytgaggtctacattagagtcagtcttagtgagagttgcaacatcgcctaagcgcagaccccaagctggcttgtaggaacagtgagataacatcccccagcc

SEQ ID NO: 40453 - DNA, 201 bp, Homo sapiens
gtgtggcttgtaccttatattcactctatctaatcttcactctaaccatagaaggcaatactattatgctcattcataattaaggcaattgaagcccagayccttccagtagctttcctgaagtcaagttgccagtgcattggacatactaggctgtagttccagggcagcctggctctggtgtctttgctgcaatgacaa

SEQ ID NO: 40454 - DNA, 201 bp, Homo sapiens
agctgagactgaaccagtgcactccagcccgggtgacaagagcaaaactctgtctcaaaaaaaaaaaaaaaaaattgactcaggctcttgctggagtatgycagtgtcccaagtcattgaggtctacattagagtcagtcttagtgagagttgcaacatcgcctaagcgcagaccccaagctggcttgtaggaacagtgag

SEQ ID NO: 40455 - DNA, 201 bp, Homo sapiens
gttctgttcgttgtaagatattgagtagcatccctgacctctgccccctggatgccagttcactttccaacaagttgcaacaagcagaaatgtctgtagayattagcagatgtctgctagcagttagaatggcctctggttgagaatcagagcagactctgctcacactgggctatcagggtatagttctctccctcccaa

SEQ ID NO: 40456 - DNA, 201 bp, Homo sapiens
aatatatatatatatatatatatatatatatgaaaaaaaggacaaacgatttcagttgcacaactataatcgatgaagtggctccttgatgttctcggggyaatctgagacactggggagaaccctccacctttgcagagaagcaggatgaaggggcctaaaatgagttcaactgatttcaactttgtttcccagcataaa

SEQ ID NO: 40457 - DNA, 201 bp, Homo sapiens
cagggacagcgtgtagggtttgcatgatttgtggggccgtttcatgtttgcacggtttggcttggcttgggactctgccagtggtcactgcagtttaacaractccccccgggtgtgaaggaaagcgagataaatgcaggaaaaaggatacattttgaaatctggaaattttacataacaggcatcagatttgaagaatgt

SEQ ID NO: 40458 - DNA, 201 bp, Homo sapiens
cggctggccaatatctactagttttgaaattaaaaaaaaaaaaaaaaaaatatatatatatatatatatatatatatatgaaaaaaaggacaaacgatttyagttgcacaactataatcgatgaagtggctccttgatgttctcggggcaatctgagacactggggagaaccctccacctttgcagagaagcaggatgaag

SEQ ID NO: 40459 - DNA, 201 bp, Homo sapiens
acctcagcctcccaaagtgctgggattacaggtgtgagccaccacggctggccaatatctactagttttgaaattaaaaaaaaaaaaaaaaaaatatatawatatatatatatatatatatatgaaaaaaaggacaaacgatttcagttgcacaactataatcgatgaagtggctccttgatgttctcggggcaatctgag

SEQ ID NO: 40460 - DNA, 201 bp, Homo sapiens
tccatcaacatgtcctttttatttttttgagatagtgtcttacttcatcacccattctgtagtgcagggcacaatcacagctcactgcagcctcaaacttytaggcttaagtgattctcccatctcagcctcctcagttgctgggaccactggcatgtgtcaccacatctggctaattttttgaacttttttgtagttggg

SEQ ID NO: 40461 - DNA, 201 bp, Homo sapiens
tgccttttgatcaagcaattccattctgtaccagaaaatacagaaatatttgaatgaatgtgccaggacacccaattagaagaatgaatgcttttttagcrttattttgtgtgcatacatatttatttagttatttgacctattacattctaaattgatattaataaagaggtatttgagttacagtttttccaaagtttt

SEQ ID NO: 40462 - DNA, 201 bp, Homo sapiens
aataatttatctcacatatgcaaagagttttggctaagggaaaagaaaaatgtgaacctcctaatagaaaaatgggcaaagataatgaacaagaaattcaytgaaaagaattggcaaacatgaaaaaattctcaactttatttttaatcataaaaatggaaattgaacaatgagatactgtttttcaccatgacattggca

SEQ ID NO: 40463 - DNA, 201 bp, Homo sapiens
ggacttactgtattgcctccagtttctctccatttctcaggattggtagcagaaatgggaaacctgatacctagggcaagagaattgcctgaataacagtrtgtggacttgaatcactatccccaggagcctagtaacccacagcttgtggattagtctgttgaactacttgatggcttgtgacccctttttcccttagag

SEQ ID NO: 40464 - DNA, 201 bp, Homo sapiens
catagaaaaggtacagttaaaatatggtattacaatcttctgggatcaccattgcatatgtggttcattgttgatcaaaatgtcattatgcagtgtgtgayagtgcttaaataatttatctcacatatgcaaagagttttggctaagggaaaagaaaaatgtgaacctcctaatagaaaaatgggcaaagataatgaacaa

SEQ ID NO: 40465 - DNA, 201 bp, Homo sapiens
tggctctgtcataaggaatcttggcccattgtcactctcattgatgacaacccccgcccccaccactaccaccttaactactgaggggatgtcctctggcycagaaggaatgcattggctctagttgaaggggttgctggtttgtaaatagcatccccacagtcagcagacacagagaatgccatggggccactcatcaga

SEQ ID NO: 40466 - DNA, 201 bp, Homo sapiens
gcgcatttgagacaggttgagggttcaagctgtccaatccctgctcatctgcagcacaccaaggaatgtggactaatgaaaaataaactgcatgcatgcartgcccatcacactgcctgcattttctaatcttcacaataactctgtgttgagaaatattcctgtctgtaatcccggcactttgggaggctgaagcgggca

SEQ ID NO: 40467 - DNA, 201 bp, Homo sapiens
aataattagggaaagtttccttcagacaggggaagacaaatatgagtatccagggaggatgtttctggcagagggatcagcataggaaaggagttcagggwtgaaaagagtcagtctggtccctagaaataatttttttggtgcataaagggccagaacagaatgacagaggaaaatgataaggatttaggcagggactgc

SEQ ID NO: 40468 - DNA, 201 bp, Homo sapiens
tgttctgcttctggataggccttaggaaacttccaatcatggcgaagaggaagcaggcaaatcttagcaggagcaggaggacgaatagggggaggtgataygctcttgtaaacaagcagatcttaggcatactggatcacgagacagcactagggggatggcactaagctgtttttaaccagccccatgatccaatcacct

SEQ ID NO: 40469 - DNA, 201 bp, Homo sapiens
gggagcaggggaggaaccatctgaggtgtttttttttttttttttagatttctcattgctgagaacagttccagctctgctgaccaaaggctgagtgtccytttattagtctgagcccctagagagaccaaagaggcaaccctcgagccaactgacagccagctgtggggttggaccctgtttttcatacagtgagcactc

SEQ ID NO: 40470 - DNA, 201 bp, Homo sapiens
gaaacacattctaatttggcagtgagttcaggagatgaagactgtcctttagttaacatcaatagctttctaaaatatgtagccagttaatattttacttytgcctatgcatccctcaaattgtaacacccctggaacataaaaattcctctattgagattaacacctaacgatacctgtatttgctaatttgtttctttt

SEQ ID NO: 40471 - DNA, 201 bp, Homo sapiens
aagatgctatagggataaataactgctgtggggcaaggactgaaatggttgttgttttgagatggcttttatcattgggccagtgacgacccattcagccstatcagtgaagagtgaagcactgcactctttaaggatagggctgaatggtttatcacccattcagcggtgaccaccacatcttatgcattgtgatgatca

SEQ ID NO: 40472 - DNA, 201 bp, Homo sapiens
tctctaacatgcacatggccagaaaaatagcttggacattctgttcaaccctccacatcaactggtcagtttagtctttaaaaggtgataggcctgttgtsgtggctcacgcctgtaatcccagcactttgggaggctgaggcaggtggatcacttgagccccggagttgaagaccagcctgggcaacacggtgaaactaa

SEQ ID NO: 40473 - DNA, 201 bp, Homo sapiens
taaaagagaatttcctccagatacaatggaggccacgttcaacacagccatctagtgtacctgggcttcttccacctccagccactgtaccgacgtgttcstttatttcacccacatagtgatgatgcttccaacacagcataacaaagagctgctgctttgtgctgctagatttgccaaaagtctgtgccagggattctt

SEQ ID NO: 40474 - DNA, 201 bp, Homo sapiens
gaaaattatagatgcttcagaagatatttgctatcactattaaatgaaaacaagcatgtcatcagtgcttattatttttgttgcttttatgatcaataaayacatgcaaattagagctttttaaatgagattctggaaataagtttttccgtatgtgtaagggaggggtagatacactgccatccaatcagcatcaatggg

SEQ ID NO: 40475 - DNA, 201 bp, Homo sapiens
gtttgactaagagagaaaagaatcactagtcaatgaaagcaactgtgtccccatgcattttccagtgaagatgcgatcacccattgccaccgttaccattrcttaaataatattagaggaattagtgttatgaagtcccacatatgatattgatgaattattaaaccagttgagttagatttctattgtagttcagtgaat

SEQ ID NO: 40476 - DNA, 201 bp, Homo sapiens
ctgttcttcaagaatccccctgcgtccccccgccctgccccctgcccaaaaaaaaggaaatccagggctttgctagggatcatttttggtgtggttctgtrttttaaaatgtggaatcatctccaaaagtgtttgtttattaaaagcaaagtgataaaatgtgtcaagtcagtgaagagactctcaaactcccctttcctg

SEQ ID NO: 40477 - DNA, 201 bp, Homo sapiens
cagggatagagtctcaaagttggaggtattttatgttgttttaaataatatcgtcatcacatgtcattttagaccccaaaagtccactccgaatctctgcktatggaattgaggaggggtgaggctgtcagaagccgagggacttggccaaggtcacatggctttggacggcccccctgaaccttggagctcatgttctgt

SEQ ID NO: 40478 - DNA, 201 bp, Homo sapiens
tgaaggttgatgctggatggttgatttgaaggttaggaatggcaaactcagcctctgttcttcaagaatccccctgcgtccccccgccctgccccctgccyaaaaaaaaggaaatccagggctttgctagggatcatttttggtgtggttctgtattttaaaatgtggaatcatctccaaaagtgtttgtttattaaaagc

SEQ ID NO: 40479 - DNA, 201 bp, Homo sapiens
aattagctgcgcgtggtggcgcgtgcctgtagtcctagctactcaagaggctgacatgggaggattgattgagcccaagaggtcaagacggtagtgattcrtggtcacaccactgccctcaaccctgggtgacagggtgagaccctgtctctaaaaacaaaagcaaagtctactaaaaattcactggagctatgagaaatc

SEQ ID NO: 40480 - DNA, 201 bp, Homo sapiens
atttattttcaatttctagtttaactgcctcacagtaaaaaagtgtactttttgtgatggcaggaatttgaagtatgttgaaactgcctttgtgatctggstcatggttaacttcaataacgtatgaaaagaatccatatttttatgtgtagtgttctgtagctcttttagttggtttatactcttttaatggtctgttga

SEQ ID NO: 40481 - DNA, 201 bp, Homo sapiens
aaaaattagctgcgcgtggtggcgcgtgcctgtagtcctagctactcaagaggctgacatgggaggattgattgagcccaagaggtcaagacggtagtgaktcgtggtcacaccactgccctcaaccctgggtgacagggtgagaccctgtctctaaaaacaaaagcaaagtctactaaaaattcactggagctatgagaa

SEQ ID NO: 40482 - DNA, 201 bp, Homo sapiens
acacaaaacccagcgtggtgattttggcagccttgccatgcatctctaacatgcacatggccagaaaaatagcttggacattctgttcaaccctccacatsaactggtcagtttagtctttaaaaggtgataggcctgttgtggtggctcacgcctgtaatcccagcactttgggaggctgaggcaggtggatcacttgag

SEQ ID NO: 40483 - DNA, 201 bp, Homo sapiens
gggattacaggcacatgccaccacacccagctttttgtatttttaatagagacaggatttcactatgttggccaggctggtctcgaactcctgacttcagrtggtctatccaccttggcctccccaaattctgggattacaggcatgagccaccgtgcccagccgtgtctgaccattttatcaggaaaagcaaaagctttt

SEQ ID NO: 40484 - DNA, 201 bp, Homo sapiens
tttgcattttcttgagagaatgtacaggcaagaataaaagtaactagaagagacattgttgttattgagaagtatgaagttaaaattcccaatgtccaggmctgtcttaaaattaggtaaacactgcagaaactatctttgaggaatttaattttgtcttgtggataaaagtgaaggataaagaggagaaataacaattat

SEQ ID NO: 40485 - DNA, 201 bp, Homo sapiens
tcctgcacacttaaccatgattatccctactttgcaaattacaaggttgcagtgcagagagcctaagacactttctcaacttgagcaagtaggagatccasaatttgaacccaaatctctctgaatccaaaacgactttttgttactttgcacacttcagtcataggaatttcagtgtggatttctgtattggttatgtat

SEQ ID NO: 40486 - DNA, 201 bp, Homo sapiens
ttggccagaagctatgaacagttgccacagctgggctgaagagttacctgtgagccttccaggggtgtaagccaagagaaagacagttcaccaaatctatygattaatagaaatcatccagcagcagtgccactgtaagatgttcaatacgtagcacctttctgtcccttctcctctagccagttgggacaggattagcaa

SEQ ID NO: 40487 - DNA, 201 bp, Homo sapiens
tatttctgggctcagcttttgactcagtctcattccccagaaataatccctgttaacatttcggtttgtgttatggaagtgttttctcttctatgaattasctaatgcccataccatacatatgcctgcatttgtacactcttaagccaaataacatcgtactgtgtattattctctagtagcctgctttttattgaactt

SEQ ID NO: 40488 - DNA, 201 bp, Homo sapiens
tcccactagacggtgagggactttatctgtctcattcaccactttgtccaacctaggacagtgtccgacacatagagatgctcaataaatcttggctgagkcaatacgtttcaaaatacaaggtgactccaaatataaaacaattttttattttcaaatgaagtggacctcccctaaattttgtgcccagtttataaactt

SEQ ID NO: 40489 - DNA, 201 bp, Homo sapiens
gtattgcacgtttgtgtttgtttattttccatctttcccactagacggtgagggactttatctgtctcattcaccactttgtccaacctaggacagtgtcmgacacatagagatgctcaataaatcttggctgagtcaatacgtttcaaaatacaaggtgactccaaatataaaacaattttttattttcaaatgaagtgg

SEQ ID NO: 40490 - DNA, 201 bp, Homo sapiens
acagggtaatgatgaggttgaaccaccagttctcaatgccatacatgagattcccaaaatagacgggagttacacagagacctttttttttttaacctccwctgagattttttttaacctcctctgagattctgtatttccttaatgagccgaaaaatctatttagcccagtttttatccttgcagataagttagtacgct

SEQ ID NO: 40491 - DNA, 201 bp, Homo sapiens
aagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaacagcttgtttgtggtt

SEQ ID NO: 40492 - DNA, 201 bp, Homo sapiens
tttgcctagggctgaccctgaagcagaaagcaaagcctagatcagtctgctctcctcctaccaacagggtaatgatgaggttgaaccaccagttctcaatsccatacatgagattcccaaaatagacgggagttacacagagacctttttttttttaacctcctctgagattttttttaacctcctctgagattctgtatt

SEQ ID NO: 40493 - DNA, 201 bp, Homo sapiens
atgttgcccagctcagtctcaaagtcctgggctcaagcgattctcccgcctcagcttccctaagtgttgggattacagacttgagccactgcatctagccmcaactgagttcattattctgagctttctttgggatgttatttaactctcagtttcttcttctataagatggaaataataacaactaaaggctaggatttg

SEQ ID NO: 40494 - DNA, 201 bp, Homo sapiens
aatgaggaagtgagcaaatcacactcatcgaggagcaaaataattcattccctctccgtggctcagcatggatgcaaataatgtatcattaagtaagtccmcaaaacaaagacagccagcataactgttgcatcaaatatttagccagagccaaaagcaatttattatgttttttaaaataagtttgatttactaaccttc

SEQ ID NO: 40495 - DNA, 201 bp, Homo sapiens
attttaatagttactctactctcctgatagccactaaagggggaattggatattgtctatcaattggttggtctctgaactaaggctgtatctaattacawggcattgtatcggttctgatttattaaccatttacttggctttggagaaggcagcatttttagtagtactgttgagcctgcatgtagcttttccaggagg

SEQ ID NO: 40496 - DNA, 201 bp, Homo sapiens
tgctaagatgcgaatgcccagctcaggggatgagattactgtcagctttgcctaagctttgggcattagcaccctccatatgcaacaaacccacaaatgamatgttttgactctttgacacagaatggttggaaatcacttccttggccagagcaggggtccggtgtaaaggaggaaataaaaataaaaaagcataaatga

SEQ ID NO: 40497 - DNA, 201 bp, Homo sapiens
tagacacagttcatgaagaacttactatgtgtccagtagataaatataccacaagcattatcttctttaatcatctcacaatcttatgaaggagatactartattttgcttgcaaagatgagggaagtgagtttccgaagttgctaagtgcgtaaaggaggtggtggtgtcagaatgttatcctgctcagatggttgcatg

SEQ ID NO: 40498 - DNA, 201 bp, Homo sapiens
aatttctttcagaagtcagtactggacattcccttatttcaccttgagctacacatcccatagtcagcttagccctgtccctggtgcgggggagcaggackgttgcctgtatcccttagtcattgccgcaggcttgctgcatcacaaaccaccattagacctcagtggcccgcagcaataaacattcgattctcgccatct

SEQ ID NO: 40499 - DNA, 201 bp, Homo sapiens
tctacaagaagtaaaaaaaatcatctcacacctgtagccgcagctactcaggaggctgaggcagtagattcatttgagcccaggaggcggaggttgcagtsaaccaagatcacgccactgcacaccagccgggggtgacagagtgagaccctatctcaaataaaaataaaaatagaatacaaggggggataaagatagact

SEQ ID NO: 40500 - DNA, 201 bp, Homo sapiens
atccctgggagtttggtgaattaatcacccagcatccaaatagctaaccggtagcagagctgggattcaaactcagttaggctgacttctgtgcctgtttycttgcctaagcggtggacgcattgagtaggagaaggccagttattcctctttgtcactgatacaactggggacctgttgccggagatgtggagctgtgca

SEQ ID NO: 40501 - DNA, 201 bp, Homo sapiens
attaatgcactggacagagctggcagacgtgtgggacacccagctattctctggaagggaagggggatataagagacacactataaaggtgaatggtaatyggcatctccccttcaaggggaccaggaggatctgagctgactgggtgcctttgtggaagtgtgttttgaactgagattagagagatcagcaatgtatctc

SEQ ID NO: 40502 - DNA, 201 bp, Homo sapiens
ctgtctttgtgatgttatcataaccttgatttttgagggatagaattgggcataatcagagaaaacgtggtctgggacacatttgtgggctattctatgcyaaacatttccatatcattaatgttcaacacagctttgtggtgttggagataggattatcattgttaggatggttattatcaatactagctgtgattattg

SEQ ID NO: 40503 - DNA, 201 bp, Homo sapiens
gaaagaaatgtaaatcaagtgactgttgatggacgcttggaagaattcttatttatttatttttttggacaggctttcactctgtcagccaggctggagtkcaagtggcccaatcatggcttactgcagactcaacctcctgggtgcaagtaatcctcccacctcagcctcctgtgtagtggagaccataggcatgttcca

SEQ ID NO: 40504 - DNA, 201 bp, Homo sapiens
atcaaccacttggtcccttcaatctgtaaccttcctgcaacactgtctttgtgatgttatcataaccttgatttttgagggatagaattgggcataatcasagaaaacgtggtctgggacacatttgtgggctattctatgctaaacatttccatatcattaatgttcaacacagctttgtggtgttggagataggattat

SEQ ID NO: 40505 - DNA, 201 bp, Homo sapiens
cagccgggggtgacagagtgagaccctatctcaaataaaaataaaaatagaatacaaggggggataaagatagacttaaaatacgctctctagaaaaaagwaagaaatatggaaagaaatctaatttagaaaaatgcacgcacccacaggcacgcttcacaggactggcaggtggagaggatgtttgttaacagggctggc

SEQ ID NO: 40506 - DNA, 201 bp, Homo sapiens
cctgtagtcccagctactcgggaggctgagaccgaagaattacttgatgaaacatggcagacgacatagaccagcagcaaactaccaacactgtggaggaycccctggatcttaggctcagcccagaggagcgaatttgtgtgaaaatgagaaacgaccgagagcttcgaggcagattacatacttatgatcaacatttaa

SEQ ID NO: 40507 - DNA, 201 bp, Homo sapiens
aagaacattttgtgaatgtttaaatatcctaagacccactaaggaagtttgtggcaatatttgctcaaagacagtatatataataaatactttagactggytaagagaatggctctgaatgtctacctagctatcacatttagaaacgccccttgccttccttccaggactttcttccttaatcaggattgacttaactgt

SEQ ID NO: 40508 - DNA, 201 bp, Homo sapiens
gaatacattttatttatttatataaatacattatatttattcacataaacacattttatttatataaataaatccatttttatttatttatataagtaaakaaattttcctataaataatctttctgattgacagatagcgaccttcctgctatgtccttacatgacagaggaagagatcatctttcttcagcctcttctg

SEQ ID NO: 40509 - DNA, 201 bp, Homo sapiens
tgctggtttttgatgatgtattgaaaacttgtataaactggcaattacaactggaaaacatttctagtttagaagagacccttatttttcatatgcttagraatatccagcaagccacttttaaaggctttttatcacattttattcttaagctttctgaattccttattatattttgcctgataaatagttggattttgt

SEQ ID NO: 40510 - DNA, 201 bp, Homo sapiens
cagcattgggtgtggctctggggattcattctagtgggcaagtctcatatttctcaacctcaggtttttcatctgtaaatggggacaatactgacatctasctaatgtccttgaggatggaatgagatattgagtataaagtatctagtagagtggctagcgtatagtgagtacccaataaatgcaatagatgttggcttt

SEQ ID NO: 40511 - DNA, 201 bp, Homo sapiens
tctactctaaatatttaacattcacggatggcatggatcctgactaagcggagcagatgctggctctatattgcacatagctcctgaatatcagccctgcktggctatgcatgtgttttttgttagtttttgagacagagtctcggtctcttgcccaggctggaatgcagtggcacgatgttggctcactgcaaaccctgc

SEQ ID NO: 40512 - DNA, 201 bp, Homo sapiens
cctggcatactgcaaatatctatggttgataaattaatgttatcatcatcacgtaagcatcttgggaagtctgtaagtaatgggagttggaggcttaacastgatctttgagctggcgatttttccagccaactcattttggacgttggtgcttaagcatatcctgttttcgagggtggtgttggtggtggaggaggtgat

SEQ ID NO: 40513 - DNA, 201 bp, Homo sapiens
gcaggaatgttcaggaagcaggctgcctctgtttctactctaaatatttaacattcacggatggcatggatcctgactaagcggagcagatgctggctctrtattgcacatagctcctgaatatcagccctgcttggctatgcatgtgttttttgttagtttttgagacagagtctcggtctcttgcccaggctggaatgc

SEQ ID NO: 40514 - DNA, 201 bp, Homo sapiens
agatcgcgccactgcactgcagcctgggcgacagtgaaacttttgtctcaaaaacaacaacaacaacaacaacaaacaaacaagaaacaaaaaatacataraagaggccttctcttcacaagtttttcttattgttttttgtttttttaagggaggaaatttctttcagaagtcagtactggacattcccttatttcacct

SEQ ID NO: 40515 - DNA, 201 bp, Homo sapiens
ggtagaaaactgggatgcccgactgcattggtttagccagaactgtggccatgaaaccttgcctggcccccagggatggggtgaggggggatatcatataygctttaggtggggcagaggggtggtctgcccctgtgcaggcaggaatgttcaggaagcaggctgcctctgtttctactctaaatatttaacattcacgga

SEQ ID NO: 40516 - DNA, 201 bp, Homo sapiens
accactatgccatgtagcatatcaagattatttttctttcctgcaccttattttttccctggagttaatactcatctttttttagaaatttgctgagtttktgatgtacctatcattcaacctcaaactttcatgtgattgtctaaatctcagttccttttattagaaaaaaaaaaaaaaacaactcccctggagcctttg

SEQ ID NO: 40517 - DNA, 201 bp, Homo sapiens
acggcagtctcaggtttatgtattaggaagcattcagcaggcaggagcagccgatctgagactggcatgggcagtggagacatcattcatctcctgaaacrtaatttggaggagactgttccagggctggctgagtgactccttgatgtcagcactttgccctgtcgtggtcttggcctttctcttgtgttccccagatgg

SEQ ID NO: 40518 - DNA, 201 bp, Homo sapiens
  misc_feature (1)...(201): n = A,T,C or G, or insertion/deletion polymorphism (see Tables 1-2)
cttccacttacctatctttaggcttctttataaaatgttcatttaatctgatctctataagaaattctgtatccttaaacaacatgtgcctttctctttasacagagcgattacccccttgctatgttttattagcagctagcaagtgctgnnnnnnnnnnnnnnnnnnnnataccaccacacctggctaattttttttgt

SEQ ID NO: 40519 - DNA, 201 bp, Homo sapiens
  misc_feature (1)...(201): n = A,T,C or G, or insertion/deletion polymorphism (see Tables 1-2)
ctatgacaggcttccacttacctatctttaggcttctttataaaatgttcatttaatctgatctctataagaaattctgtatccttaaacaacatgtgccyttctctttagacagagcgattacccccttgctatgttttattagcagctagcaagtgctgnnnnnnnnnnnnnnnnnnnnataccaccacacctggctaa

SEQ ID NO: 40520 - DNA, 201 bp, Homo sapiens
ttattagctctgctatcagagtgatgctgtggctggagaagatggagacccatgtgttcaggctgtgagcataggcagatcctttctaatgcagaaggtgyagacacagggcacagaactgccaactgtggctgctgacacctgtctgactttgactgggttagtgacaaagaaatgactttccttttgtatgttagccct

SEQ ID NO: 40521 - DNA, 201 bp, Homo sapiens
atggcatggcatgatcccactacttagggaggctaattatgtagtgtctacagagccagtggtttattttgcattgtttatgtcagcattaagcagtattsttacacagtttgtaagtcttaaaactcagtatctactctagtagttgctccaaatgtgatgtcctcataaatcaccgagggatcttgttaaatttggatt

SEQ ID NO: 40522 - DNA, 201 bp, Homo sapiens
tagaaaattataaaaatagaaaacagatggctgggcacggtggctcactcctgtaatcccagcactttgggaggccaaggcagatgggtcacctgaggtcyggagttccagaccagcctgaccaatatagtgaaaccccatctctactaaaaatacaaaaagttagccgggcgtggtagcacacacctgtaatcccagcaa

SEQ ID NO: 40523 - DNA, 201 bp, Homo sapiens
agaagttccagaattgcagatggccctttgctgcttagggaggggggagaagaagaaggagaaaaagaagaaaaagaaaaagagcaggtggaaacttaaaraaatgtttagctgcatgtagatggcttttattataactgctaggctgaaccagaagacttgagctatgtaaaaatgtcacttgctcttatcacggttcat

SEQ ID NO: 40524 - DNA, 201 bp, Homo sapiens
ttgttattgtaaaagcatcatgcaccaggtaaaatgtttaataacacagagaaatctaattgtcaagtatcttctcaacacacattaatcaacaattctcmtatcgaaggataacctcttgtatttacaaaaaaaagaagaaaaagtgctgtcatcagtaaattcattcatgtatgttatacacttacatacaaaatgtat

SEQ ID NO: 40525 - DNA, 201 bp, Homo sapiens
agcagaagagagaaacagggagagtggaggttgttctctagaacatagaagccgcttcttcatcccacacaatggaaaccagagcccagattatattaacragaagttccagaattgcagatggccctttgctgcttagggaggggggagaagaagaaggagaaaaagaagaaaaagaaaaagagcaggtggaaacttaaa

SEQ ID NO: 40526 - DNA, 201 bp, Homo sapiens
tctcattaatgtctgggcaaaactcaaagaggcaaacattttcattacatactgttatccatcctattgtgggaccaatttctccagaaaggtctctctcrgtgggaggattaataaacaccatcagaaatccaattaaacccaattgttaaaatccaacaaatacgttgcttgtggatacagttgtgtatagtaatgtgt

SEQ ID NO: 40527 - DNA, 201 bp, Homo sapiens
atgggcttttgcgaagaagttttttcttttttcagagtcagaggttggcagcaaaatatgagagatggaaggtcaagtgcagcagaagagagaaacagggrgagtggaggttgttctctagaacatagaagccgcttcttcatcccacacaatggaaaccagagcccagattatattaacgagaagttccagaattgcaga

SEQ ID NO: 40528 - DNA, 201 bp, Homo sapiens
cattgatacctgccttgcgttctgttacctggaagcacaggtcaaggtagtcttcttgttccactgatttgatgggggtcaggatgctttcagaaaggaartgagaagagtggcttagaacagggaaaatgtggccgggcgcagtggctcacgcctgtaatctcagcactttgggaggcctaggtgcgcagattacgaggt

SEQ ID NO: 40529 - DNA, 201 bp, Homo sapiens
aatatatgggcttgaatccagtgtatcttgctccgaaagccttgcttttgtcattatccaacattagctgtctttattatagtggccttcttaccacctasaaaacaagtgccagcattctagtaaaatttattcaccttccgagattatttactattttagtctgtagcttttatccctttaactacaccattcaaagcg

SEQ ID NO: 40530 - DNA, 201 bp, Homo sapiens
gtacaatcagagatcactgcagcctccaactcctaggctcaagcgatcctccagcctctgcctgccaagtatctgggactacaagcatgcactcctgtgcytggttaattttgactatttttttgtagagatggggcttgcttgcttttttctccagtctggtcttgaactcctggcttcaagcagtcctctcacctcatt

SEQ ID NO: 40531 - DNA, 201 bp, Homo sapiens
agtttcagaataataattctgcagaaaaaagtactgattgtccagcagttgtgtcaggtagaaaactgggatgcccgactgcattggtttagccagaactrtggccatgaaaccttgcctggcccccagggatggggtgaggggggatatcatatatgctttaggtggggcagaggggtggtctgcccctgtgcaggcagg

SEQ ID NO: 40532 - DNA, 201 bp, Homo sapiens
aagaaagggtcttgctcttttgcccaggctgcagtgcagtggtacaatcagagatcactgcagcctccaactcctaggctcaagcgatcctccagcctctrcctgccaagtatctgggactacaagcatgcactcctgtgcttggttaattttgactatttttttgtagagatggggcttgcttgcttttttctccagtct

SEQ ID NO: 40533 - DNA, 201 bp, Homo sapiens
cactcagattgcaataggacctgccctgatagcctcattttttacataatcacctctttataggccgtacctccaaatacagtcacattctgaggtagtasgggttaggtcttcagcatatgaattttggggaaacagaatccagctaacaacagttggggatgaggctataacgaataccactgcctaatgtttgcacgg

SEQ ID NO: 40534 - DNA, 201 bp, Homo sapiens
ctcagccttttctctcgatctttttttttttttttttcctttcttaagaaagggtcttgctcttttgcccaggctgcagtgcagtggtacaatcagagatsactgcagcctccaactcctaggctcaagcgatcctccagcctctgcctgccaagtatctgggactacaagcatgcactcctgtgcttggttaattttgac

SEQ ID NO: 40535 - DNA, 201 bp, Homo sapiens
tcctgtgttcagatgtcctcttctttgaaggacaccactcagattgcaataggacctgccctgatagcctcattttttacataatcacctctttataggcygtacctccaaatacagtcacattctgaggtagtaggggttaggtcttcagcatatgaattttggggaaacagaatccagctaacaacagttggggatgag

SEQ ID NO: 40536 - DNA, 201 bp, Homo sapiens
gctattggcagtggcatggagtgtgggaaaatgcgtccctctctccttcctggattagaaaagtcatcatcctgctagtgtgaatccatgtcctgtggtgkccctctcaggagggattgtgattaaagaatggacaacccaagggaatcatgtgtcatggtggagcatacaggccagcaggtgagttggggaggcgccttt

SEQ ID NO: 40537 - DNA, 201 bp, Homo sapiens
gccgccttcccaccgtgttctcacgtgacctagccgctgtgtgcatgcatccctggtttcttttcctgtgttcagatgtcctcttctttgaaggacaccastcagattgcaataggacctgccctgatagcctcattttttacataatcacctctttataggccgtacctccaaatacagtcacattctgaggtagtaggg

SEQ ID NO: 40538 - DNA, 201 bp, Homo sapiens
cagttgatgtcttctgaggtctccctcgtctgcttgcagacagccgccttcccaccgtgttctcacgtgacctagccgctgtgtgcatgcatccctggttwcttttcctgtgttcagatgtcctcttctttgaaggacaccactcagattgcaataggacctgccctgatagcctcattttttacataatcacctctttat

SEQ ID NO: 40539 - DNA, 201 bp, Homo sapiens
aggctggatgacttgaacaacaaaaatacattttctcatagttgtggagcctagaattccaaggtcaaggtgccggcacagttgatgtcttctgaggtctmcctcgtctgcttgcagacagccgccttcccaccgtgttctcacgtgacctagccgctgtgtgcatgcatccctggtttcttttcctgtgttcagatgtcc

SEQ ID NO: 40540 - DNA, 201 bp, Homo sapiens
aaaataccacaggctggatgacttgaacaacaaaaatacattttctcatagttgtggagcctagaattccaaggtcaaggtgccggcacagttgatgtctwctgaggtctccctcgtctgcttgcagacagccgccttcccaccgtgttctcacgtgacctagccgctgtgtgcatgcatccctggtttcttttcctgtgt

SEQ ID NO: 40541 - DNA, 201 bp, Homo sapiens
ctgctcaggctgccataacaaaataccacaggctggatgacttgaacaacaaaaatacattttctcatagttgtggagcctagaattccaaggtcaaggtkccggcacagttgatgtcttctgaggtctccctcgtctgcttgcagacagccgccttcccaccgtgttctcacgtgacctagccgctgtgtgcatgcatcc

SEQ ID NO: 40542 - DNA, 201 bp, Homo sapiens
atgaactcatgggaagcaaacacacaccctccctccgatccaccaggcactcgggtttcctgtgtgtctggtgatgtgctgggtgttgtggatctggactsaacggcagtctcaggtttatgtattaggaagcattcagcaggcaggagcagccgatctgagactggcatgggcagtggagacatcattcatctcctgaaa

SEQ ID NO: 40543 - DNA, 201 bp, Homo sapiens
cagaggggaaaagaggaagtctgaacgagggccacattgcagatagaggccggtgtactggtctgctcaggctgccataacaaaataccacaggctggatracttgaacaacaaaaatacattttctcatagttgtggagcctagaattccaaggtcaaggtgccggcacagttgatgtcttctgaggtctccctcgtctg

SEQ ID NO: 40544 - DNA, 201 bp, Homo sapiens
caaggacataaacatttactcctgtggtgttatgatatatatagggttcctggctcataactctcatagcccttgttgcagtctattgttacaatattgcstgtgttaggcatcaggaaacagaatctctttgtctcctgtccttctttcacctgccccaaggcaggactctaatctttcccacctttttgattgtgagtc

SEQ ID NO: 40545 - DNA, 201 bp, Homo sapiens
ttggcaaatacttccctaaagtggtcatcccattttacattcttgccaacagtgtttaaggatccacttcctctacatccttaataatacttgatattatyggtcttctaaattttctgtttgggtacatagtggtattttgttgtatatatttttttaattgtgaaatatgtgactatgatgagtaatgattttgaacat

SEQ ID NO: 40546 - DNA, 201 bp, Homo sapiens
aaatcctttgcaaacattttctctcaatctatgggtaggcttttttactctttttatagtgtcttttgatgaacaaagattttaaatcttgatgaagtccmctttatctattttggatgttgttgcttctgtttttggtgttgtatctaagaatccattgccaaatccaaggacataaacatttactcctgtggtgttatg

SEQ ID NO: 40547 - DNA, 201 bp, Homo sapiens
cagtcctcagtgtaccccaggaaagaggaaactgagtctccatgtggctttctgtctggcctttctcttttgcttgccttgtgctttgaatgcaggcctgmtgtttgcctgtggacctcaggatttgtaaggccatctccacccacctacagctaagtttcccaagagccgatctccagccgaagtccaaggttccttgat

SEQ ID NO: 40548 - DNA, 201 bp, Homo sapiens
aggtaagcggctagcacagtgctcagcatgcatgaaggactctttcattatcgttattaactgatgtttttaacttatacattgaaatgtggaaacaagcsttgcttctattgaatgacttcttgaaagtgccagtctgatccttgaccttcaggtgcatctctaaattctttcatgtcagggtctctgaaatctgaacac

SEQ ID NO: 40549 - DNA, 201 bp, Homo sapiens
acaagataatacaaatataatagtatgaataaatatgctaatttgatagaaaatattttaatatttactactagtgtagttggacgtgttaaatattgcartggttatttgtaatctacctttataaaatttctaatgtctgccactgtttctgttagactcttaagaagatacgtgtttgtctcatagatttgtaagaac

SEQ ID NO: 40550 - DNA, 201 bp, Homo sapiens
ggtatggggtatgaatcacacatattaattttaatttcctgctttttcaattaaattgagaaagtttgggaacctctggcttaatcattatttatccactyctctgttgttggatgttagattgcttctagttcatatgtaattttataattttagttgacatgtcattatggattcttgggcataaacgtttatatgaat

SEQ ID NO: 40551 - DNA, 201 bp, Homo sapiens
taaaataaattgcatccatttaaatatacaattcaatgagttttgacagatgcacatgcccatgaaaccaacacgaaaataaaaaaaatagaacatttacrtcacctcaaaaagatttcaaatgccacttctgtggtgtatgactctgagtccagacagcctcagctccaggaaaaccctggtctgttttctgtcactatt

SEQ ID NO: 40552 - DNA, 201 bp, Homo sapiens
acatgaagtcattgtcttaggttggtgatcctagcagctgagcctgggatggggattcttgttcctatgatcgattaggggactgttcccagaggagagcsgagagggaagcaggctttggtttctactggaaatctgtttccgcccgattccatggggagctctggagaaggaattgtatcaccgagttggtcctccttg

SEQ ID NO: 40553 - DNA, 201 bp, Homo sapiens
cggaggctgaggcagcagaatggcttgagcctgggagatcaaggctacagtgagctgcaattgtgccactgcactctaatttaggcagcagaatgagactrtgtctcaagaaaatgttcaagaagaaatacaaactattgaaaaaggaaggctgaatgctttatcagaaaactgtatttagaggggacctttctggggtct

SEQ ID NO: 40554 - DNA, 201 bp, Homo sapiens
  misc_feature (1)...(201): n = A,T,C or G, or insertion/deletion polymorphism (see Tables 1-2)
agttgaagactagccttggcaacatagcaagacctcatctctacttggaaaaaaaaaattagctgggcatggtggtgctcacctatagtaccaggtacttnggaggctgaggcagcagaatggcttgagcctgggagatcaaggctacagtgagctgcaattgtgccactgcactctaatttaggcagcagaatgagacta

SEQ ID NO: 40555 - DNA, 201 bp, Homo sapiens
tgatgctgagataagtctagatgggataggtgggcaacatgcaggagaaacctcctgggaaaggtgagcaagagcacacaggtgagacatagcatcgagtrtggaaacctccatgggtggcaggtcagtgttgctgagggatgtggacatgtctgaggccaaatagatgagtccctattgggttttgcctctccacaatct

SEQ ID NO: 40556 - DNA, 201 bp, Homo sapiens
tgttgaagacaaggcttagaacatcatcagacccagagcctttctcagaggacctgggagaactctccatatggattttcatttgggaagatagatgctcytattggaacagctggttttccctttaaaacagggagtccagcagcttctaggatgcttagaatcagaattgttgctcactttttaaggtatagagtagtt

SEQ ID NO: 40557 - DNA, 201 bp, Homo sapiens
gaacccagaagactgactctcagaacggaaaactcttggctagaggattccgaaagctagcgtgaagtggaggctattactcagtgggtgccgtaacatgkctgtgtcacctggcacctttttattctctaatctcaggagtgagtgcttcctcctgccgtgcctggccacttctcaccttcagagtctttggtatgcata

SEQ ID NO: 40558 - DNA, 201 bp, Homo sapiens
ttaactttcagaggagccaccaaattgttttccacggaggctgcaccattttatatttccacttgcagtatatgaaggttccaatttctccacatccttgmcaacactttattttctgttttctttgaaggtatgaaattgtatcgtggttttgatttgcatttccctcatgattaatgatgttgagtatttttatgtggt

SEQ ID NO: 40559 - DNA, 201 bp, Homo sapiens
ttagtcatattcttatcagtatctgaagaacccagaagactgactctcagaacggaaaactcttggctagaggattccgaaagctagcgtgaagtggaggstattactcagtgggtgccgtaacatgtctgtgtcacctggcacctttttattctctaatctcaggagtgagtgcttcctcctgccgtgcctggccacttc

SEQ ID NO: 40560 - DNA, 201 bp, Homo sapiens
agccttcatctgttttcctgcagatgcccggctcgtggttaacccaagcaagaggtagttaaacggccccgcagattgccagtgactccgggaatgcctargtttatgtatggattaacacagtgatagaccctgagtagcaaaagacgaagactaattacctgacagagctcccctccactcgcctgggtcattgaaatt

SEQ ID NO: 40561 - DNA, 201 bp, Homo sapiens
tattatggactgaataaatgtttattgaacaaatgccatttttttaactcttaaaatgttcagttcttccaccaaacatagatgacacaactgttggagayggagcaccggactgatgcagtgtagcattattttgtaatctacgaactgggagcctatggagacctatgcatggtggaatacaaaagtcatgacctgtct

SEQ ID NO: 40562 - DNA, 201 bp, Homo sapiens
acaccagactaatgcttctgacttttccatggtgccccagcagcaggctggagggaagggcgggggcggtcagaggagagatagagcacttcagattccamtcgaatacattagagcattagagcttttctcttcctcagggtgctctctctctctgggttgggaggagatgtggcatttctaggaattcacagtaaaatc

SEQ ID NO: 40563 - DNA, 201 bp, Homo sapiens
aaggcagactttagtctggtttataatgctttaatatttttttgaaggaagaaaaatgttcattacttaacgtaataattatttttaaaaagcagcctggsgggggggtattcatttttctgtggctgccataacaaagttcttcaaacttagtgtcttgagacaagacatttattttcttaaagttctggaggtcagagg

SEQ ID NO: 40564 - DNA, 201 bp, Homo sapiens
ctttgatgtgtgtaggtaagcggctagcacagtgctcagcatgcatgaaggactctttcattatcgttattaactgatgtttttaacttatacattgaaakgtggaaacaagccttgcttctattgaatgacttcttgaaagtgccagtctgatccttgaccttcaggtgcatctctaaattctttcatgtcagggtctct

SEQ ID NO: 40565 - DNA, 201 bp, Homo sapiens
gcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggag

SEQ ID NO: 40566 - DNA, 201 bp, Homo sapiens
tccactgtttatcctggtgaccttaggcaagtcatttaatttccttgagttttggtgtaagtattgatggagcagaccatcaataactgttcttatgtctrttattaccatgtgtctgtctacatgtttgtttgtaaattctctgtgggtaaaagttctcttttcatccccttgcctcagcacggagcccagagccagact

SEQ ID NO: 40567 - DNA, 201 bp, Homo sapiens
accttgtagcaagggggaaaaaaagagcttcttgacatctttttgaagaatggcgctctttaaaaaaacataagggaactttttttttcaaacactgtaaygagggtattcaagtctgcaggcaaaacagagctgtttgaaaagacattagcctcgaaaccgcactgtgccagaatagatacagctacgtcaaaatgccgc

SEQ ID NO: 40568 - DNA, 201 bp, Homo sapiens
gtctggatatgaattccaaagaccactggactttggaatattcgtaggtctctgaaaattcagacccacagaggccttaccccgctacagagaggccccargagagaggcctcacaccctctggctccactgaaattcacttcacgtttccaacttggattaaactggcacgacagttcagtcaaatgtcaagtccatttt

SEQ ID NO: 40569 - DNA, 201 bp, Homo sapiens
aaaaaaaaaatcgggaattagcgtgtagctattaggcgtagattcctgcctaaggtctggatatgaattccaaagaccactggactttggaatattcgtargtctctgaaaattcagacccacagaggccttaccccgctacagagaggccccaagagagaggcctcacaccctctggctccactgaaattcacttcacgt

SEQ ID NO: 40570 - DNA, 201 bp, Homo sapiens
tggaaaaaaaaaatcgggaattagcgtgtagctattaggcgtagattcctgcctaaggtctggatatgaattccaaagaccactggactttggaatattcrtaggtctctgaaaattcagacccacagaggccttaccccgctacagagaggccccaagagagaggcctcacaccctctggctccactgaaattcacttca

SEQ ID NO: 40571 - DNA, 201 bp, Homo sapiens
cagactcaacttacttctagtggtaatggctgtaggagagatggggagtaggagaagaaaagccaaaggcagactttagtctggtttataatgctttaatwtttttttgaaggaagaaaaatgttcattacttaacgtaataattatttttaaaaagcagcctggggggggggtattcatttttctgtggctgccataaca

SEQ ID NO: 40572 - DNA, 201 bp, Homo sapiens
ttttgagctacttccctcctggggagatgcgtgttaactgtttcatgactggcaatgccgtaacagtgagcaagcaatgtgaccttacaaatacatgtgcwgaaatgcagatgagtgggcctaaagaatccagactcaacttacttctagtggtaatggctgtaggagagatggggagtaggagaagaaaagccaaaggca

SEQ ID NO: 40573 - DNA, 201 bp, Homo sapiens
cttccttcacccccaggagcactgaagcagacactgattcctctgcagttgttgggcttttgagctacttccctcctggggagatgcgtgttaactgtttmatgactggcaatgccgtaacagtgagcaagcaatgtgaccttacaaatacatgtgcagaaatgcagatgagtgggcctaaagaatccagactcaacttac

SEQ ID NO: 40574 - DNA, 201 bp, Homo sapiens
taattaattagcaaaaacttatctttggaatgcttcaagaaacagttctatgttgttctcataacttaattttacacaactgtcttttgtttgtatcttamagaaaacaaaataccaccctccgccagaaaagtgcagaataaaaattttccactagcaaaagaaggaaaaaataaaagatcttgaatagtctcatcaatt

SEQ ID NO: 40575 - DNA, 201 bp, Homo sapiens
gaatttgttaattaattagcaaaaacttatctttggaatgcttcaagaaacagttctatgttgttctcataacttaattttacacaactgtcttttgtttktatcttacagaaaacaaaataccaccctccgccagaaaagtgcagaataaaaattttccactagcaaaagaaggaaaaaataaaagatcttgaatagtct

SEQ ID NO: 40576 - DNA, 201 bp, Homo sapiens
tttgaaatctggaaattttacataacaggcatcagatttgaagaatgtccaaaatattacgagtcatagcacaacctttgctaacaccatggaaatttttraacatggaatttgttaatgctgacttggcccaccatggggttaaaaaaagtgaatttctttttgataaccaaggtgatgatcttatgaagttgatgatgg

SEQ ID NO: 40577 - DNA, 201 bp, Homo sapiens
aaaaggatacattttgaaatctggaaattttacataacaggcatcagatttgaagaatgtccaaaatattacgagtcatagcacaacctttgctaacaccrtggaaatttttaaacatggaatttgttaatgctgacttggcccaccatggggttaaaaaaagtgaatttctttttgataaccaaggtgatgatcttatga

SEQ ID NO: 40578 - DNA, 201 bp, Homo sapiens
agcattcacacaggcactaagacggtgagtactcactacttagcgctgtcaacatcatctccgtccacatcaatgtcgtcatcgtccttatgaaaagccckgggcatcattttgcccttgagctggatgtccatgttggaaaaacagctagtggaaggcgtgcccaaatctcagaagttggcgtttccttgcagatatcat

SEQ ID NO: 40579 - DNA, 201 bp, Homo sapiens
tgaaggaaagcgagataaatgcaggaaaaaggatacattttgaaatctggaaattttacataacaggcatcagatttgaagaatgtccaaaatattacgartcatagcacaacctttgctaacaccatggaaatttttaaacatggaatttgttaatgctgacttggcccaccatggggttaaaaaaagtgaatttctttt

SEQ ID NO: 40580 - DNA, 201 bp, Homo sapiens
ttggttatttctttattcaagggttgttgagaggatgaagtgctaaaaatgcttgaccagcattcacacaggcactaagacggtgagtactcactacttakcgctgtcaacatcatctccgtccacatcaatgtcgtcatcgtccttatgaaaagccctgggcatcattttgcccttgagctggatgtccatgttggaaaa

SEQ ID NO: 40581 - DNA, 201 bp, Homo sapiens
cctcaaatccttctggaagtaggttggttatgaattatgaataattaaagaaataaactctggctctgcagctgaaattgggatcgcatggagaaaatagmaagtccagtgtttgtagctgtgatctctcagttgcttgcatgaattgtgctttaagactgtaaaattttagcccattaaaaataaaatctgttgctttcc

SEQ ID NO: 40582 - DNA, 201 bp, Homo sapiens
gtgagcatccagcaagtggttttgacaatgataataattataacccaagcgacacatacaatttaatcaggcactgtgtgtccacagcgatgtcaaggaamaatgcacaaagcagagtttttccagtctcctgatgtttgagccctgcgcgagccccactcttctcccttttctcataactgctgtgagcaacctcaaatc

SEQ ID NO: 40583 - DNA, 201 bp, Homo sapiens
tggctggaggtacccctcagctcctagaggcatcaacagttcctgaatatctgggcttttcccacaaagcagcttccttcatcaagccagcaacaagagtytctggggcaagttggtcaacaagatggtgtcttacatgcccaatgtaatcatggaagccatgtatacctcatcacatttgccagatttctgctgattaat

SEQ ID NO: 40584 - DNA, 201 bp, Homo sapiens
gttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcag

SEQ ID NO: 40585 - DNA, 201 bp, Homo sapiens
cctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagg

SEQ ID NO: 40586 - DNA, 201 bp, Homo sapiens
ttctcccttaatgcctcatgaatgcccaagcagcacttcatggaagtacactgagtctctactgcttgcagggattaaacataacattctcaacagtggtragagagcctttcccttctctttggctcgttttcagtttttattaatttcctgtgcttctggttcatgaatcccaagtcatgatgtgaatcagttcagttc

SEQ ID NO: 40587 - DNA, 201 bp, Homo sapiens
ttctccgcctgctgtgccttcctatagtgtagctccaattgccttcatccttagaagacctttaatgatatcctatgccaaacttcctagcctccacctgkaccctgaattggccctagcctagttttccaaactttatccccaggtggttgaactttctaagtttccccaagctgatcagtgttttggggtggtatggaa

SEQ ID NO: 40588 - DNA, 201 bp, Homo sapiens
tcttgcttccgtcacctcgtgctttgaaacataaccacaatgtgctgaggtttcacattgttacatcctacaagcgtgcttacctgcatcaccttgctggsctgtttcagcattggaatatcactgggaatctcaagttcccaggagccaaccacaagagcttcacagctcagaattttcaagatgtggatgtaggcaggg

SEQ ID NO: 40589 - DNA, 201 bp, Homo sapiens
ctgaaataagtggacacatactccaccatccccaggtagtgtacagtgtgtgccctttcaggctagtatgtacagctttaaatcattcctttacagagctrtgtaatattccacaacccagaggagcagcttgaagccagctaaagtatgtatatccaagtggaattaagagcttcatgcgtagtttcttgattttgatta

SEQ ID NO: 40590 - DNA, 201 bp, Homo sapiens
tcttggttttagatttttttaattataaaagaacattattatacattatttgaataattttttaaaattatagagctgtctaaaggaggcattaaaaaaascctttctattccttcatctaattctatccctctgaggcaaccatgattagtattttgtacttcttgtacatcctccttcatgttaatatagatgtacaca

SEQ ID NO: 40591 - DNA, 201 bp, Homo sapiens
gctcttatttttaagtcatccttatctctttcacttattccctcattcaggcaccaaaaatgctgtttgactgggagagcaagtggagctgttcaaagttstagggacagccgggcgcagtggctcatgcctgtaatcccagcactttgggagggcgaggcgggcagatcacaaggtcaggagttcgagaccagcctggcc

SEQ ID NO: 40592 - DNA, 201 bp, Homo sapiens
tggcacctttttagttttgataagagatatttaccatttattctctctgaggcctatttcctggaggcttcatctgcatcataagaaccttggtctttttrtggacttatcttaacccagatagtcctttctactgatgccaggtgtttagctaataacacttttaaccaattgccaatcagaagatccttgaatctacct

SEQ ID NO: 40593 - DNA, 201 bp, Homo sapiens
gccaaaatattcttttcaaagtgattagaagtaggagaagcttgctctctttttattggcacttctgtcttacatgcactttttgattgaaattattctgkcttctatgaaatgacagtgattggaggtggtttatttttttttaagtctgcttactcggaaaaataaaacaaagttgacaacctgatttcagacctccca

SEQ ID NO: 40594 - DNA, 201 bp, Homo sapiens
cactaggagtctggcacctttttagttttgataagagatatttaccatttattctctctgaggcctatttcctggaggcttcatctgcatcataagaaccktggtctttttgtggacttatcttaacccagatagtcctttctactgatgccaggtgtttagctaataacacttttaaccaattgccaatcagaagatcct

SEQ ID NO: 40595 - DNA, 201 bp, Homo sapiens
gtttcagtgcctgacacagttgtattcctaagacatagttgggaccagacctcaagaaaatagccaacaaatactggctgaatgaacgaaagaggccataygcagtcagcccccctctctctgggttctacatatgtagatttaactaatgacagattaaaagcattcgaacaaacggagggtggtatctgtactgaaaat

SEQ ID NO: 40596 - DNA, 201 bp, Homo sapiens
tatctgtttcataacccatttccaaccttctgggttttttccttcaacgtttcctgtgacagttctccattatatctttgttagataatagttagcaaccmattaataacttccaactttttgagcctctaccatatcttgttttcactgggatttctacaccgtggctactttgtgggacctgacttatcaagaacttaa

SEQ ID NO: 40597 - DNA, 201 bp, Homo sapiens
ttccatgggttgttatgtgttactggtcaggcgatcagggatttgctgaagattttctttcccatgtggcagtagatatttcagaaccctgcatcatggtrtccacagaagtccccagagttgtatgagagttcatctgggcacctttcccaaaggcaggccccctgtgcagcttcaactattcactctatttataatgtt

SEQ ID NO: 40598 - DNA, 201 bp, Homo sapiens
gtgtgtttccatgggttgttatgtgttactggtcaggcgatcagggatttgctgaagattttctttcccatgtggcagtagatatttcagaaccctgcatsatggtgtccacagaagtccccagagttgtatgagagttcatctgggcacctttcccaaaggcaggccccctgtgcagcttcaactattcactctatttat

SEQ ID NO: 40599 - DNA, 201 bp, Homo sapiens
ggaagctggatgatgggtatagggtgttctctgtaccagtttggccatgttttgtgaatctataattagtttcaaataaaagttaacaaccagaagatcaygagctaaaccaataaagtgaattatggtcagttgcagattcactgccagacctgggaggaaatctcaccttggcagatcgagtctcttgtcctcgcctaa

SEQ ID NO: 40600 - DNA, 201 bp, Homo sapiens
aagctatattgattttgtatttctgggctcagcttttgactcagtctcattccccagaaataatccctgttaacatttcggtttgtgttatggaagtgttytctcttctatgaattagctaatgcccataccatacatatgcctgcatttgtacactcttaagccaaataacatcgtactgtgtattattctctagtagcc

SEQ ID NO: 40601 - DNA, 201 bp, Homo sapiens
ctcctgagctcaagcgatcctactcactcggcctcccaaagtgctgggattacaggtgtgagccaccatgccaaagcctaagggaccttagaattttttcycctttcttttcacattttgttttgtgcttgcttatttattgaaatctggaccacaaataacttacatgtttgtcaaggccagatttcaggacctaaccaa

SEQ ID NO: 40602 - DNA, 201 bp, Homo sapiens
catccttaataatacttgatattatcggtcttctaaattttctgtttgggtacatagtggtattttgttgtatatatttttttaattgtgaaatatgtgastatgatgagtaatgattttgaacatgaaaactatgcttattgctcatatctatgttattttattatttactttttttgagatggagtctcgttctgttgc

SEQ ID NO: 40603 - DNA, 201 bp, Homo sapiens
acttaaaaaatttttctaagcaatgatgtcattgtattttacttataatcagaagtacatcagcccgtgaatttagttaaaggtttttaatgtcacttttrttacatttttactgtgcattcatgtgcacacacacacttttaagcatttttgatttatatatccctctgcatattttgtgccttgtgatgtgtttaacga

SEQ ID NO: 40604 - DNA, 201 bp, Homo sapiens
cccagcctgattcctgttttacatattaaaaatttcatctctccaatcttcgaagaatccgtagtccatttttaagtagctcttgtcttccaaaggtatgsgatgtgcctacctaatgctcttcctggatgggagaatattaccaaaaacgtttggtcgactaattttatgacagtttccaactacaatttttttcctctt

SEQ ID NO: 40605 - DNA, 201 bp, Homo sapiens
tattggccagtatattcaatgattcacttgcacctttaaccttgtgttgttctaatctttttttttttttttttttttttttttttttttttgagacagartcttgctctgttgtctaggctggagtgcagtggcaccatctcggctcaccacgagctctgcgtcgtgggttcatgccattctcctgcctcagcctccgga

SEQ ID NO: 40606 - DNA, 201 bp, Homo sapiens
tgacaaagatcatttgggagagattctttcaaaaatgcctactccctattcccatatcccagcctaagggaatgagtttaagtgggtctacagtgggtcckgggaatttgcttcttatctagcatccctggtgaatcttttcattcaagccaatgcaggaagtagtcctctgaaatacatgtccacagaacacgccgtgct

SEQ ID NO: 40607 - DNA, 201 bp, Homo sapiens
catttgcgtctcgctgcctgtcttccaaaggatttgccttctagtaattcatgtttttatagcttaactacatttatagtgaacgggtggcttcttcatcsaaagaaagaacaaatgacaaaaagaaaaattttgatgatttgggaaccgcatttatggaataataacattcatgatacctctggataatgacaataatta

SEQ ID NO: 40608 - DNA, 201 bp, Homo sapiens
tgaccaatttttgtaaatctcttctgttactgtttatatacccggccacttctgccaaaatatgctggccttttagtcttttggttttttctctcttttgktttgttggcttatgttcgctgcttgatctgactactggttttatttctaaggatttttttttaagttggcatctttttttctttgactttccttgtatgc

SEQ ID NO: 40609 - DNA, 201 bp, Homo sapiens
tgataactgtggtacagtgtccctaccctaagcaatattgttggtcctttaagaatggttcatctgcaacctaaggttacatgggtgtagttaggccccaycctaaatcacattaagagtctccagagtatgatcagaggtgcccaagcaaacaaagactctttttttcaggaatatattctgcatatatttcagtgattt

SEQ ID NO: 40610 - DNA, 201 bp, Homo sapiens
tatgtacatatatatgtatatatatatgtggttttttcaaaaaaattgtgggcacttagtaggtatatatatttgtggtctgtgtttcttataaattggtratcccccaggggatgcctgccttgttggtccaggtaacacacttggagtagcaaacatctagacgtagttctcaatagtaggactattgccagtggaggg

SEQ ID NO: 40611 - DNA, 201 bp, Homo sapiens
ggttggcgtttcagtgcctgacacagttgtattcctaagacatagttgggaccagacctcaagaaaatagccaacaaatactggctgaatgaacgaaagasgccatatgcagtcagcccccctctctctgggttctacatatgtagatttaactaatgacagattaaaagcattcgaacaaacggagggtggtatctgtac

SEQ ID NO: 40612 - DNA, 201 bp, Homo sapiens
aagaagccccactctccctctgccccacatctattgtgggctgggatacatgttgggcctctgcccagatcatgcttggagtggcaccagctgggtaggayatgtgaaatatttgctcagagagatccagaagtgttgatctgagtaggatcagctggtgctccaggataaaaatcgtgtcaccacttttgccgaaaagtc

SEQ ID NO: 40613 - DNA, 201 bp, Homo sapiens
acagggacaagaaataaataactttgatgcaaatcctgggaagactctggaacaacatggaggcacctatgttaactctatttcattttggaaaagttgastagacaaaaggtgcagagtagagtatgcagtgatttcagggtgttgggctctgacaagatgatgccgacttagacagtgttagtcaacatcaaatgtctg

SEQ ID NO: 40614 - DNA, 201 bp, Homo sapiens
cctaggaacagcctagaaggtgaatgatgcagcccagttgtttttattctgagtttggcaaaaatgatagagaagaaaatgtacttttatgtgttcgttcracagttaaagagtattccagattcctccctccaaaaaaaaaaaaaaaaaaaaaaaagggcatattccctagccaaggcccacatggcttttctttacttt

SEQ ID NO: 40615 - DNA, 201 bp, Homo sapiens
ccagaggtctgttttcatcacatcgtatcaagcattccaccttcatcatgactcttcactgttgatggtgactctgattcacctggtcaaggtagtgttcrttaggtttctccactgcacacttagtctttccctctactttccacactgctgcctttggaggagtgttgctgtgcccagctcacgcttgtggagtgggga

SEQ ID NO: 40616 - DNA, 201 bp, Homo sapiens
acaacaacgaaaaaactcccatgtattatctatggattgactgtaaaatatgagaagcaataaatatgttcatcactagggccatctagaaatttctaacycaagggtcaactaatctttccctgtgttgtatttcctgctctgcggatccggcatcatgacctttgtactacccaggaaagccagtgttctcatgggctc

SEQ ID NO: 40617 - DNA, 201 bp, Homo sapiens
gaactctggagacagaggttggcgtgagctgagatcgcaccactgcactccggcctgggtgacagagcaagactctgcctcaaaaaaaaaaaaaaaaaaaraaaaaaaaaagattgaacatgtggaatatgagacaaatgaaaaagattgaattccgttccaactgggcttttgaatttattttcgcacttcctatttttt

SEQ ID NO: 40618 - DNA, 201 bp, Homo sapiens
tattcctcgcctggcctcattgctcgcttcgtttcggaggaaattttccctgttaaagtactgtacttgtcatttatttcccttttttccactctccctcygtggctgggtttggatatgcatttatccaaaaggcaaggcttttacacacttccgctaacctcttatggtcaggctcataaaagcaacccaacaaagctt

SEQ ID NO: 40619 - DNA, 201 bp, Homo sapiens
gggaagtggaggttgcagtgagccgagatcttgccattgttctccagcctgggcgacaagagtgaaactccatctcaaaaaaaaaaaaaaaaaaaaaaaarattatgtcatttcgttgtcacagcgtcagcagaataaatcttagatcaagatgggattactgcgccactcccttcttcccagtctgtggtttagcacggg

SEQ ID NO: 40620 - DNA, 201 bp, Homo sapiens
gggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaaca

SEQ ID NO: 40621 - DNA, 201 bp, Homo sapiens
ctccaggctgtgtgacagagcaagaccccatctctaaataagtaaataaatgcctctgtgaatccatttcattgcattggaaagacctccaggattctctscagaagaatctttcccaacataaaatccattgttaatcacatttgacacacatgtgtgcccatgtctctgggcctgtgtccataggcatctacgtcactg

SEQ ID NO: 40622 - DNA, 201 bp, Homo sapiens
aaggctgcagtgaaccatgatggtgccactgcactccaggctgtgtgacagagcaagaccccatctctaaataagtaaataaatgcctctgtgaatccatytcattgcattggaaagacctccaggattctctgcagaagaatctttcccaacataaaatccattgttaatcacatttgacacacatgtgtgcccatgtct

SEQ ID NO: 40623 - DNA, 201 bp, Homo sapiens
agactcactagaagtttcagaaagatgcagactgctttaaaaaaaaaaaaaaagggcaaggggaggtgtgagaagaaagtataattctttttcttctaackggagatataaaaatcatataagcatgatttatgatttgattggaacattgtattttatggttgcagagcacacgtatcatcctatctgcttctgacaccc

SEQ ID NO: 40624 - DNA, 201 bp, Homo sapiens
gagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactg

SEQ ID NO: 40625 - DNA, 201 bp, Homo sapiens
actggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggt

SEQ ID NO: 40626 - DNA, 201 bp, Homo sapiens
ggaggcctcaggaaacttacagttatggcagaaggtgaaggggaagcaggtaatgtcttcacatggctggcactggaggaagagagaaagtagggaggtgstagatgcttttaaacaaacagatctcaggagaactctttcacaagacagcactagggggatggtgattagaaagcacctcatgatcccgtctacttcctg

SEQ ID NO: 40627 - DNA, 201 bp, Homo sapiens
ggtgatgtttgaacttaagaatcaaaaacagtgcaagcgctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgt

SEQ ID NO: 40628 - DNA, 201 bp, Homo sapiens
aaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaaggagctcagcctctttgttagctagaacaagaaagggg

SEQ ID NO: 40629 - DNA, 201 bp, Homo sapiens
aaggcctctgacttaacaggacttccgtgatgcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaa

SEQ ID NO: 40630 - DNA, 201 bp, Homo sapiens
tcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggagttaaagaaattaaactggtccttgtggaagc

SEQ ID NO: 40631 - DNA, 201 bp, Homo sapiens
ttctcttctccttccaagaaaaaacacccataccattcttaacatctctggaagctgggggtcaggagagggagatccataaagttcttgtcttccccgaytcaagaagcttaagggtacattcactcactcatgaattgactggtttattcattcactggttgattaattcattcattcactggttaattaattaattca

SEQ ID NO: 40632 - DNA, 201 bp, Homo sapiens
tcccctcctctccagccctcacctggttttctcttctccttccaagaaaaaacacccataccattcttaacatctctggaagctgggggtcaggagagggrgatccataaagttcttgtcttccccgactcaagaagcttaagggtacattcactcactcatgaattgactggtttattcattcactggttgattaattca

SEQ ID NO: 40633 - DNA, 201 bp, Homo sapiens
tggtgtggccatggttctcgtacttcaggtccctgtgagcccctggggtcctacacaacttggggtaatgctatggtcacctgcatcccctcctctccagycctcacctggttttctcttctccttccaagaaaaaacacccataccattcttaacatctctggaagctgggggtcaggagagggagatccataaagttct

SEQ ID NO: 40634 - DNA, 201 bp, Homo sapiens
gggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtag

SEQ ID NO: 40635 - DNA, 201 bp, Homo sapiens
ggcaggaagattgcttgagcctgggacgtcaaggctgcagtgaaccatgatggtgccactgcactccaggctgtgtgacagagcaagaccccatctctaartaagtaaataaatgcctctgtgaatccatttcattgcattggaaagacctccaggattctctgcagaagaatctttcccaacataaaatccattgttaat

SEQ ID NO: 40636 - DNA, 201 bp, Homo sapiens
actctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgc

SEQ ID NO: 40637 - DNA, 201 bp, Homo sapiens
attatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattca

SEQ ID NO: 40638 - DNA, 201 bp, Homo sapiens
atgaaagccagccgggcacagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatga

SEQ ID NO: 40639 - DNA, 201 bp, Homo sapiens
cctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaa

SEQ ID NO: 40640 - DNA, 201 bp, Homo sapiens
tcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcag

SEQ ID NO: 40641 - DNA, 201 bp, Homo sapiens
tcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgaactcttgagctcaaga

SEQ ID NO: 40642 - DNA, 201 bp, Homo sapiens
aataaaaccaatgagcttaatctacttgtggaatgttatagccggaagggattcatagagatcactctatcgcctaaaattctctcttctacatatctcastgttggaaaacataaatgtgactccaacttgtcttttttgttgtttgtttttgagacagggtctttgtttcccaggctggagtgcagtggcatgatcttg

SEQ ID NO: 40643 - DNA, 201 bp, Homo sapiens
tccatctatttcaggggatgaccagtctgaataaaaccaatgagcttaatctacttgtggaatgttatagccggaagggattcatagagatcactctatcrcctaaaattctctcttctacatatctcactgttggaaaacataaatgtgactccaacttgtcttttttgttgtttgtttttgagacagggtctttgtttc

SEQ ID NO: 40644 - DNA, 201 bp, Homo sapiens
tgtgaaatgggaacatgacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcc

SEQ ID NO: 40645 - DNA, 201 bp, Homo sapiens
agttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatgga

SEQ ID NO: 40646 - DNA, 201 bp, Homo sapiens
ccgcagctcctgtagtagttatggtcactgactccgggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaa

SEQ ID NO: 40647 - DNA, 201 bp, Homo sapiens
ccaaggaaatgaccagcacgtggctcactccctgtctgtccagtagaggacaccaaggcacgatgaccgcagctcctgtagtagttatggtcactgactcygggttcagacggacttggggttcagtcctagctctggcgcttaccagttttctcaagtgactttgagcatctttactcaaggctcttggtctcagttttc

SEQ ID NO: 40648 - DNA, 201 bp, Homo sapiens
ctaaattatgccagattaagaaaatgaaatctgactgtaaattacttctctaggagcaaatgattgcttgattctattgtagaaaataaaaattttttacytaaaccacacaaattaaaaaatggaactcactttcacagtcaagagttacttctatttttttttacagtaaatgcgctctttaagatgttgcaagctcaa

SEQ ID NO: 40649 - DNA, 201 bp, Homo sapiens
ttgaaattttttatactatgttctattgggaaccatttcagggttttgagatatagtatgatataataacagctatgctaaattctttgaagttattggtrgtggaatatcaatccagaatgaaaataaataattttggaaatgagcctgtcattgaaatatactttatttctcgttaaatgtcccagcaaaagtattttg

SEQ ID NO: 40650 - DNA, 201 bp, Homo sapiens
agcctcttgtcgaggagtgcactgggaggggaggctggacttctgggctctgctctgcctctaatctgctgcccagcatcagccttagcccagacccccaragttcctgggcttcattctgctttgcattcatctcaaagttaagccttctggctggcaggggtttctgagacagactgacagtattagcgtgctgcagtt

SEQ ID NO: 40651 - DNA, 201 bp, Homo sapiens
ccggagtttaatggatcaagtagcggtgataggttttatggctcttttttactttagggcatagggaagagagagccgggcaggttggttttaaattcaargatttatgttgttaatcctccgggctaattataatttatgggatcttggcaaattaatatgcagttgctattcaaaagtggagagcaatgtaaggcaggc

SEQ ID NO: 40652 - DNA, 201 bp, Homo sapiens
tgaactgaagtgctaatgtgaaatgttcatgatggtacccgagtacttgcggtggtacctagcgtgtgctttccaagtgctggcaaagaaaagaaaagaawtgcttggggctctgcctacctgtctaggctcctgtctggccattctctttcttgttccaaccatatcaaactcactgctgttgctaaaccttcctgtctc

SEQ ID NO: 40653 - DNA, 201 bp, Homo sapiens
ggaaaaggccagcagccacgttccttgttttgtgtaattggtctttagcctgatctgattcatctggcgaaacccctttttccagtaaaagtcgttggcgrggagtgaattgtgatggaaacagagacagatgtatgtacctttcatggacataatttccccaagactgaacacaaaaatgagggtttttggagatctctc

SEQ ID NO: 40654 - DNA, 201 bp, Homo sapiens
tgatccacctgcctcacctcccaaagtgctgggattacagtcgtgagccaccgtgccggccactttcatctttctgattaactgaaaagtatcaagcaatrcttacatgtaactgcactttctcatcaactgcaaccataatttagctatggatacaagagttgggcacaaatccatgaaagcattgagtgagaatcaatt

SEQ ID NO: 40655 - DNA, 201 bp, Homo sapiens
taacttgtctaagaatcctcatcttaaccctgtgctagaacaacaagcttggaaggagccagccaacaggagaaagccagagcaagactctgtgctggacmagaagtcctgagcactggggagttgacttcatattggaggcagagaagaattacctgccgatggctgttggcccatggcaacaccctagatcgttgcatt

SEQ ID NO: 40656 - DNA, 201 bp, Homo sapiens
tgactttaagccttaatgaaactaaggccggagcgggtggcacactccgtggctgggatccacagtgaaatctacgctgggagaggaggaatttagggtgrtaatttggttctttgctattgacgaaattttctaattgactggggttacttaataccagataatatttttttcttgctataaagagagtaaatttgtttt

SEQ ID NO: 40657 - DNA, 201 bp, Homo sapiens
ttatgattctgcaagcgtggtttacactataaatttccaccggtctctgcttgtctcttctagaatttagggttattctcaaactctattatacaagcagygcccaagtgccttcctccaaaagtacattagatactttcttggggagagaagaaattagacaggagctacaaagatggattaaaattaatttggtcctaa

SEQ ID NO: 40658 - DNA, 201 bp, Homo sapiens
tgtttgcctatgctataaggcatcagtggttaccaggcagtgttgcattttttccatcccatacctctgtgtgtgttccttatctgtttctaggatgtgcyctctgccccgtcacatcacactctgtgctgctctcagccaaagctcttcttaaatacactagccatcaaaaccatacaacttggctgggtgcggtggctc

SEQ ID NO: 40659 - DNA, 201 bp, Homo sapiens
ttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctc

SEQ ID NO: 40660 - DNA, 201 bp, Homo sapiens
tcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctggga

SEQ ID NO: 40661 - DNA, 201 bp, Homo sapiens
ctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccatctgaaaaaaaaaaaaaaaaaaagacatttacattt

SEQ ID NO: 40662 - DNA, 201 bp, Homo sapiens
ggtggctcacgcctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggagg

SEQ ID NO: 40663 - DNA, 201 bp, Homo sapiens
ctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgtctgtacaaaaa

SEQ ID NO: 40664 - DNA, 201 bp, Homo sapiens
cagttttcagaccaactccattgttactagatatcctgacactgaagaagctaaaaccaaacaacaatgacaacaacaaacccaagtctgccttatggcasattcttcacgtcgtaacaccttccttgggaccctatttctcagtatggacctgactctcccagggatcctagaatgcaagcatagtgattgcaaaccaga

SEQ ID NO: 40665 - DNA, 201 bp, Homo sapiens
ccaaaccataccactcatggcatctcgtttttacagagtatatgtgttttcagattttgcatgacattttaggataaatgtgatgaaaatgaggaaaattrggaatgaagtttaggtcagaaaagtttcagtgattattttttcagaatcattgtttcttggtttctagggtccaacatgccattgttcaatggctgtatt

SEQ ID NO: 40666 - DNA, 201 bp, Homo sapiens
ttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttc

SEQ ID NO: 40667 - DNA, 201 bp, Homo sapiens
agatccagtggagtgtggggtgctgagagaacaagtctatgttttcttgagacaaagtcttgatctgttgcccaggctcgagtgcagtggcagcatcttgrctcactgcaacttctgcctcccgtgttcaagtgattctcctgtctcagcctcctagggagctgggattacaggtgtgcaccactatgcccagctaatttt

SEQ ID NO: 40668 - DNA, 201 bp, Homo sapiens
agagggttgcctgggacaaaggcattataagcttattcatttaacttgagtacagggtttctcaagctttggcactgccaacatgtggggttggataattytttgttgggatctgccctgtgcattgtaggatgtttagcagcatccctggcctctacccactagatgccagtagcatcccttccccctcttgtcacaaac

SEQ ID NO: 40669 - DNA, 201 bp, Homo sapiens
gaagtatcacttatcctacgttccatgtaagatctctttcctagggtaaacttgatatggaaggtcttcacagattaaaacgaaggaaaaaaaaaaaaaaactagataaatctccctggacatgaacttttgtagaagtagttacaacgctagtgacctcatatactcatggtaacggcttccggcatccaatgaccttgc

SEQ ID NO: 40670 - DNA, 201 bp, Homo sapiens
gccctttattagtcactcatggtgtcacaagccctttacaaagcactttgcatgcaaatgattcctcataacaaccttgggaggtagttactttcattgtrttagctatctcttgctgtgtaagaaattaccacaaatttagtatatttgttatctcatagctccataggttaaaagtcctggttcaggctgggacttctg

SEQ ID NO: 40671 - DNA, 201 bp, Homo sapiens
ggactctggatagggtttggctggttgagtctcctcttgcagtggctgttgatggaggtcatttagtggaatccagttggcaggagagctggccttggagrgtctaggatggcttttgtcacatgtccagggctttgtcaggttagcagggcagggagggctcagctggtctcagctcgtggctgctccagcaccgtggtc

SEQ ID NO: 40672 - DNA, 201 bp, Homo sapiens
atgtctgatgaactcatctttgcttccttggatccccaagatagaatggccctaatgcagtcaaaccaccctgcagaatcttaacagcaccacaaatattrcatccaggcatcctgcccatgctggcttgcaggctggggatccctgtccatagcgcccatggctccaccaccagtcaaaggtagtggggccagcagtgga

SEQ ID NO: 40673 - DNA, 201 bp, Homo sapiens
agagtgaggataaataagaacaagaatgacaaaccgataggctacttgacatcattccttaattccaggtcactggcggacatcactcattcatcagtackctgtttttctcccaagaatggatctgactcttgaattctctttaatagagtgttctgggaggctgttaccaattgaccagggttgatgcacatgttgaaa

SEQ ID NO: 40674 - DNA, 201 bp, Homo sapiens
cacagtgcgtggtctgcatggcacagtgtgtggtctgtatggcacagtgcatggtccgcatggcacagcgcatggtccgcgtggcacagcgcgtggtccgygtggcacagcgcgtggtccgcgtggcacagcgcgtggtctgcgtggcacagtgcgtggtctgcatggcacagcacatggacatgattcatacatgcaagt

SEQ ID NO: 40675 - DNA, 201 bp, Homo sapiens
gctgtggcttcagagggtggaagccccaagccttggcagcctccatgtggtgttgagtgtgtgggggcacagaagtcaagaattggggtttgggaacctcygcctagttttcagaaaatatatggaaacacctggatgccccagcaaaagtttgctgcatgggtggagccctcatggagaacctctgctagggcagtgctg

SEQ ID NO: 40676 - DNA, 201 bp, Homo sapiens
ccaacctttttgctggctctctttcaaactgtactgctcactttgggctgtacgttagaaccacctgagaagttctttttctttcttttttttttttgagrtggagtcttcctctgtcacccaggctggagtgcagtggtgggatcttggctcactgcaacctctgtctcctggcttcatgccattctcctgcctcagcct

SEQ ID NO: 40677 - DNA, 201 bp, Homo sapiens
ggctgcagcagtgtctaggtatctgtgaatgtgtaagaaattgagacagcctgcaaaatagctcacccagcttttctttaaagttccaacctttttgctgsctctctttcaaactgtactgctcactttgggctgtacgttagaaccacctgagaagttctttttctttcttttttttttttgaggtggagtcttcctctg

SEQ ID NO: 40678 - DNA, 201 bp, Homo sapiens
tgtgggcccttctctttcctcgtgatgcacggtgatagtgcgtatctaacacttgaaggtgtccacgctggccctagctcagtgagatggctttgctttgsgggggtgagggggcggaggtggtggaaaggcagcaagctacgatgttcttatgtgtgtggccttgcttctggtggtggggtggcacacatgctctgtagt

SEQ ID NO: 40679 - DNA, 201 bp, Homo sapiens
cctttgtttttgttgtcatcgttttatgattaacttatatctggtcctttagacatttagattttttctgttttatctctctctctctatatgtatatctrtatatatatttatctatatctatatagagatatatatatatatatataataatgaatgaaatggactgtttgcaacctcagatgtatttctaggacttag

SEQ ID NO: 40680 - DNA, 201 bp, Homo sapiens
tcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttg

SEQ ID NO: 40681 - DNA, 201 bp, Homo sapiens
gttttaagccagagagagattgataagacatggaatgatatggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgg

SEQ ID NO: 40682 - DNA, 201 bp, Homo sapiens
attggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcaactcatacctactgttcgtcagttttctcatctgtaaaatggggattccagtggtt

SEQ ID NO: 40683 - DNA, 201 bp, Homo sapiens
ctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactga

SEQ ID NO: 40684 - DNA, 201 bp, Homo sapiens
gagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtt

SEQ ID NO: 40685 - DNA, 201 bp, Homo sapiens
agaccttgatatatgtacatatattgtatgatacatatccatgcatatacgtgggtgtacacacacaggtacacacaaatatatatgtgcctttggacaaraaaaaatccccaggacagtctcatttggcttttaaaatgctgcagttgaataggaccgtagaggtggcctaaggcagccttccattcagggcacgcagat

SEQ ID NO: 40686 - DNA, 201 bp, Homo sapiens
ccccccccagcttccccacctgtaaaatgatttgctcaaagtttgcaaagaatggaggcatattcaaagtgctcagcactgggccggacccatgggtatgmattcataatgatcagcttcattctctccctttccctctctctccacacctttccattcctcctaactaatgtgggagagaagagaaaattacagtgagag

SEQ ID NO: 40687 - DNA, 201 bp, Homo sapiens
aaaggatatgcgaagcacttttcatgcattatttaacctagctataatactcccatttgacagatgagaggactgaggcttgtagactttccaaggctgtkcagctctaggtctagtctgccatttgaatttgggcgatgataccagagaccaagttctcaactatgatatactgcacatgtttttgtttttgtattttgg

SEQ ID NO: 40688 - DNA, 201 bp, Homo sapiens
tgcctgccctctggttgaaacatcagtgttgaatcaatagaccacgtcctgtccataccttgggaattagactcacccagactctgagttaagagtttctrtgagacagagggctggactgggggagcaaggcttgcaaatcgaaagcatcagttgctacccctgagcaccatctcccataggagactctttgaacacttt

SEQ ID NO: 40689 - DNA, 201 bp, Homo sapiens
tttctttttaatgcagaagatttcttatgtgattaactgaatgggaattgatgctttgtggaatgaaatggattgagtacagagtgtgggatcaagaactwttaggcactgtgagtataagagggaaaccaggccgggagcagcggctcacacctgtaatcccagcactttgggaggcggaggcgggcagatcacgaggtc

SEQ ID NO: 40690 - DNA, 201 bp, Homo sapiens
agctgcaggatcacttgctttagatggaatcacccagcggatggcgtttaactctgctttaaaccccttcatggcttcccaccacacttacaaatacaachccttatcctgtcagcaggggcttgcttaatctgaccctttccacatatgctggatcacttcacgcctccctgttctttcaattccttgaacacaccaagt
